United States Patent 10,760,091 (GENES AND USES FOR PLANT ENHANCEMENT) - sequence listing, part 11

SEQ ID NO: 44378 - protein, 635 aa, Zea mays
  misc_feature (139)..(139): Xaa can be any naturally occurring amino acid
  misc_feature (165)..(165): Xaa can be any naturally occurring amino acid
MPTPTMVRPFPLFFFIVVVLLVRSPAGAAADGGGNATTDSCPLDLGYVRTFLWDPALRAGGAPNVTGLAPEAALPARHRPRLAPASHGFTDLISAAPASLSGSSLVAECFPDPSQFAITSSYCAGVSAATEFVAAAGNXRLRLPTPPAGPSSAAPAARALCYSAXGVADTPHLTSAAANDSKSGSCFYLTVLYAAGISTSAGPTYPPTAACALGLGLLSPAPTPSKSSHAAVYAATIPIAFVLLASLFGFFLWRKRTRANSKNKKNHKICEEGSGDRRSHPRPNTGSVFFDIADLAKATGGFAERNLVGRGGFGAVYRGVLADGSVVAVKKMLDPDMEGGDEEFANEVEIISHLRHRNLVPLRGCCITDEDVEEGKQRFLVYDFMPNGALEDFIFRDREAATKLPPLAWAQRRSIIMDAARGLEYLHYGVKPAIYHRDIKSTNILLDSEMRARVADFGLARRSREGQSHLTTRVAGTHGYLAPEYALYGQLTEKSDVYSFGVLLLEIMSGRRVLDMTAPAGPVLITDWAWTLVKAGQAREVLDEALSTAESPRSGVMERFVLVGILCAHVMVALRPTIGDAVRMLEGDMDVPELPDRPLPYGHNAMFSEAGSTFSISPAFSGPLAPFIDNGDMLR

SEQ ID NO: 44379 - protein, 969 aa, Magnetococcus sp. MC-1
MSVHSHDDVGHFDRKLAVSFGAVVLLVMLTVSAVSWYAFDAIMKDQEARLARIIGSVVGEAVGRVSFSGKHHTRLLVKDLIAKNPQFSHIGVINLEDQIIAHSNDQLNDRPMLWPQGMSLQKALTEPNQVYHFSLFGRPTVRELFLPYHSGFNNRLAGIIHIGIRQDATTRALKSGFLSLLSMIALLTMGAMILVHRLSKRYSRPVKRLANQMAALLEHAPMLIAIQKGQQQPHVTSRLWHQFYRTHPLPDQPPLHPLLPTKQEDLTKINSSAQELNVTLDGHEYHFLFTRFILSEELQEHAQPQICTIALDISDHKLVERQLSESENRFHSLVSNLPGAVYRCNLDSAWSMLFISDGIERISGYPKESFIHNLERSFASIIHKDDLIMVEQKVFEGVNLNRSYHMEYRIIHQDGATRWVYEEGRAHFGKHGQALWLDGVIFDITDRKQMEHTLHQNRTRLQAAVVASRAGTFYYTIENDQNSWDARMLEIYGLEASQFDNNYAAWVRCIHPEDQHSTEQAFFRALSASYHTQTYDIEHRIVRPDGSIHHLRTQAWIQRDSQGKAEQVSGLVFDITEQKEVETTLRLAREQAESANRAKSDFLAAMSHEIRTPMNAVIGMGEVLLETKLDQEQRHYIETLQHAGEALLDLINAILDLSKIESGRMELVEQDFDLHKMVVETCQLFQVQCRKQGIELNLNWEESNPTYIHGDQARIRQILFNLIGNAVKFTDEGSVTVEIRSIEQEKTLLFKITDSGIGIPADKQETIFQKFSQADSSLSRRHGGSGLGLTICRHLVEHMKGRIWVDSEEGQGSCFSFTLPCRPTAPKAEIISNPHDAQQKQSKKARILLVEDSKDNQILIRTYLKREPHSLVVAWDGEEALTRFNEDGPFDLIFMDMQMPIMDGYAATAHIRALEQARHLTATPIVALTAHALQGDEQRSLQAGCNAHLTKPIRKAHLLAAIRDHANPS

SEQ ID NO: 44380 - protein, 145 aa, Haemophilus somnus 2336
MERPMTLEQTLAIIKPDAVERNLIGNIISRLEDKGFQIIAMKMLHLNQEQAEGFYAEHRNKAFFTELVKYMTSAPIVVLVLQKENAVKDYRTFMGTTNPEIAENGTLRYEFAINQTQNSVHGSDSLENAQREIAYFFAEAEIYAR

SEQ ID NO: 44381 - protein, 499 aa, Triticum aestivum
  misc_feature (247)..(248): Xaa can be any naturally occurring amino acid
MAKSHETTSRKPPGLRLFKGAKALRNYQTLVLVLTFLAYTCFHMTRKITSIVKSELDPQTKVGSAWGRLHTRDSLNIGWSPFNTSDGSTLLGEIDVAFLAVYSLGMFFAGHLGDRMDLRIVLTIGMIGTAIFTALFGAGYWLNIHNFYYFLVFQMIAGLFHSSGWPSVVAVVGNWFGKSKRGLIMGIWNAHTSIGNISGSLLAASLLKFGWGWSFAIPSIIMALAGLVVFFFLPVSPDVMEIDIDDXXEVNSDKDTAKEPLLEPGQEVKHKAIGFLEAWRIPGVAPFALCLFFSKLVAYTFLYWLPFYISHTPIGNEYLSDAMAGSLSTVFDVGGVLGGVLAGHISDRLNARAITAASFMYCAIPALFLYRTYGSMSMMSNICLMFITGMFVNGPYALITTAVSADLGTHSSLNGNSRALATVTAIIDGTGSVGAAIGPLLTGYISTESWSAVFTMLMAAALLAGLLLTHLVCAELRGKLSSNVSKVVANAQTTCSDQV

SEQ ID NO: 44382 - protein, 321 aa, Auxenochlorella protothecoides
MWRSWLREAHQSFERLPYESKQDRVVEDISKAIMSIKEAIFGEDEQSSSKEHAQGIASEACRVGLVSDLVTYLTVLDFETRKDVVQIFCAIIRITLEDGGRPGRDYVLAHPDVLSTLFYGYEDPEIALNCGQMFRECIRHEDIAKFVLECNLFEELFEKLNVQSFEVASDAFATFKDLLTRHKQLVAAFLQENYEDFFSQLDKLLTSDNYVTRRQSLKLLGELLLDRVNVKIMMQYVSDVNNLILMMNLLKDSSRSIQFEAFHVFKVFVANPNKTKPVADILVNNKNKLLTYLEDFHNDRDDEQFKEEKAVIIKEISMMHA

SEQ ID NO: 44383 - protein, 321 aa, Polaromonas sp. JS666
MRLDADSFDNETYIARPITVEELSVNSSYLIRLQQRWAWPTVTLSFAGAGVAAWLAVTEGVSIAEIGILVAMYVLTYLGLTVGYHRCFAHRAFKANPLVRYVLAILGSMNVQGPIVFWVATHRRHHQFSDVPGDPHSPHLHGSGFRGSVEGFFHAHIGWLFAADMTNTALYARDLLRDSVMRRINRLYLVWVMLGLLIPTLAGALLLGGVGGALRGLLWGGLVRGFIAYHATWALNSLTHVVGKRDFNTQDHSHNIGWLAMLTLGEGWHNNHHAFPYSAVLGLKWWQLDVSAIVIRMLKALGLAWDVKVPLKKAREVMATA

SEQ ID NO: 44384 - protein, 172 aa, Pasteurella multocida subsp. multocida str. Pm70
MARVKGKGFILMGVSSTGKTSVGTVVAQRLGIKLIDGDDLHPRANIIKMGQGIPLNDEDRAPWLERIRDAAFSLEQKSEVGIIICSALKKQYRDLIRDGNDVKFIFLHGPFELVLERMKQRKGHYMKPEMLKSQFDTLEIPQADEPDVIHISIDGTFEQVVERCIKALKPLL

SEQ ID NO: 44385 - protein, 319 aa, Arabidopsis thaliana
MNSSSPISIDLIAEILSRVPSKSVARFRCVSKPWASMIRRPYFTELFLTRSSPKPCILFATVADGVWSFFSLPQYPYEKSSSASVAASAKFHVKFPPNNMRIGHNSDRRYFSYGYTSGLIYLYGDSSDDRSVICNPYTGEYAILPYLQRYRKTYSFLVFEPIEKQFKILFMAYLSGDRDHKILTVGTGNMKWRTIRCSLRYEIKYAYTWTDDIFFRRREVSVAPTTAAWGDIVFSMCEYTPGQPFYVFYFNPEKSTLQRVEIQGFGEGVCSVYTFVDDVEDLNVKDLKILKPSNAPFEKTEDSEYEEEYEEEDGDDGWS

SEQ ID NO: 44386 - protein, 432 aa, Thermus thermophilus HB27
MKPSVRTPLPGPKAWALLERGERVLSPSYVRPYPFVPARGQGAFLEDVDGNLFLDFMSGIAVNTTGYAHPKVVEAVRAQAERFAHVCFSDFTHEPTLSLAERLVGKLGGGYRVFFGNSGTEGVEAAIKLVRYHTRRPYLLAFTGAFHGRSLGALSLTASKSAYRQGFAPFLPGVVHLPFPNPFRPPLGARPEEAGDAVLDHLEHLFQTVLPPEEVAALFLEPIQGEGGYVVPPPGFIPRLKEVLDRFGILLVADEVQTGAGRTGRFFALEHEGVQADVYVLAKGLASGYPISAVLFREELGSWPPGAHGTTFGGQAVAAAAAHATLDLLEGGLQENAARLGEFLLAELRALKRRFPFLGDVRGRGLMIGLDFGDPDHPQPDLRDKAVRLAFEKGLLLLPAGPSALRIAPPLVLTQEEAALGLEILEEVFRAL

SEQ ID NO: 44387 - protein, 664 aa, Chlamydophila pneumoniae CWL029
MEKVSSYPSVPLPLGASKISPNRYRFALYASQATEVILALTDENSEVIEVPLYPDTHRTGAIWHIEIEGISDQSSYAFRVHGPKKHGMQYSFKEYLADPYAKNIHSPQSFGSRKKQGDYAFCYLKEEPFPWDGDQPLHLPKEEMIIYEMHVRSFTQSSSSRVHAPGTFLGIIEKIDHLHKLGINAVELLPIFEFDETAHPFRNSKFPYLCNYWGYAPLNFFSPCRRYAYASDPCAPSREFKTLVKTLHQEGIEVILDVVFNHTGLQGTTCSLPWIDTPSYYILDAQGHFTNYSGCGNTLNTNRAPTTQWILDILRYWVEEMHVDGFRFDLASVFSRGPSGSPLQFAPVLEAISFDPLLASTKIIAEPWDAGGLYQVGYFPTLSPRWSEWNGPYRDNVKAFLNGDQNLIGTFASRISGSQDIYPHGSPTNSINYVSCHDGFTLCDTVTYNHKHNEANGEDNRDGTDANYSYNFGTEGKTEDPGILEVRERQLRNFFLTLMVSQGIPMIQSGDEYAHTAEGNNNRWALDSNANYFLWDQLTAKPTLMHFLCDLIAFRKKYKTLFNRGFLSNKEISWVDAMGNPMTWRPGNFLAFKIKSPKAHVYVAFHVGAQDQLATLPKASSNFLPYQIVAESQQGFVPQNVATPTVSLQPHTTLIAISHAKEVT

SEQ ID NO: 44388 - protein, 457 aa, Prochlorococcus marinus str. AS9601
MDEKESFLKQKIDLESPNKNIVPITTSIGGDGKLSVGGCSIEELVKKYDSPLYILDETTLRMSCRAYKKALEKYYPGETLPIYASKANSSIFMSNLVSSEGLGLDAVSEGELLTALKGGVPNEKIVFHGNNKSDKEIDFAIKNNIKIIVDNDYDLKRLEEVSNSLNHDLEIMIRFTPGIECHTHEYIRTGSFDSKFGFGIEYLNNLFANISDTKHLKLRGIHAHIGSQIFELEPHKDLGEIMVKVILDAKKFGHNIKELNVGGGLGIKYTKNDDPPSIDEWVKTISTSVVEACKKHNLDLPKLMCEPGRSIVSTAGITIYKIGAFKEIPGIRTYLSVDGGMSDNPRPITYQSNYSACLVKNPLNINSKNKYTIAGKHCESGDVLLKEIELANCKTGDLICVFGTGAYNVSMSSNYNRIPRPAALLVCDGEAEIIQKRESPFDLLRYDVLPDRFIKQN

SEQ ID NO: 44389 - protein, 139 aa, Thermoanaerobacter tengcongensis MB4
MIFMEVTLAIVKPDGVKRGLIGEILKRYENKGLRLKAAKVVTPSIELLEKHYEEHKGKPFFKPLIEYMSSGPVFAMVLEGENAVKLVRMINGATKVEDALPGTIRGDFASSTTYNVVHGSDSVESAKREIALWFPELIL

SEQ ID NO: 44390 - protein, 234 aa, Medicago truncatula
MMHLKLTLDVTRKSYQAFSSSAIFIKREFASRSHTADPDIHSGQQKPGYTNYRNSPQGTSRGDSDTNTKFAETEKEEGIFESPKSPYQSSPKLRSTGVNERLDPNIQQKRKQGTKAALEDLSCAGLDGTPWPEEENDRTKDEQNEDNKEYYKHHKASPISEFEFADTRKPAERVMHGTVDAKQNGDVIGWLPEQLETAEETLLRAAEMWRQRAMRGDPDAPHSRVLRTLRGEDF

SEQ ID NO: 44391 - protein, 373 aa, Staphylococcus epidermidis RP62A
MAKRDYYEVLGVNKSASKDEIKKAYRKLSKKYHPDINKEEGADEKFKEISEAYEVLSDENKRVNYDQFGHDGPQGGFGSQGFGGSDFGGFEDIFSSFFGGGSRQRDPNAPRKGDDLQYTMTITFEEAVFGTKKEISIKKDVTCHTCNGDGAKPGTSKKTCSYCNGAGRVSVEQNTILGRVRTEQVCPKCEGSGQEFEEPCPTCKGKGTENKTVKLEVTVPEGVDNEQQVRLAGEGSPGVNGGPHGDLYVVFRVKPSNTFERDGDDIYYNLDISFSQAALGDEIKIPTLKSNVVLTIPAGTQTGKQFRLKDKGVKNVHGYGYGDLFVNIKVVTPTKLNDRQKELLKEFAEINGENINEQSSNFKDRAKRFFKGE

SEQ ID NO: 44392 - protein, 159 aa, Frankia sp. FE245
ITKEQYSRDPRNIAKKAEEYLRGTGIADTAYFGPEAEFYIFDDVRYDYSPSGSMHAVDSVEAAWNTARKEEGGNLGYKPRFKGGYFPVPPTDHFTDLRSEMTRVLFDVGITVEMQHHEVGTAGQAEIDIRYDTLLKTADNLMLYKYVIRNVARSRGKTV

SEQ ID NO: 44393 - protein, 669 aa, Saccharomyces cerevisiae
MNQQLAEMQQIRNTVYELELTHRKMKDAYEEEIKHLKLGLEQRDHQIASLTVQQQRQQQQQQQVQQHLQQQQQQLAAASASVPVAQQPPATTSATATPAANTTTGSPSAFPVQASRPNLVGSQLPTTTLPVVSSNAQQQLPQQQLQQQQLQQQQPPPQVSVAPLSNTAINGSPTSKETTTLPSVKAPESTLKETEPENNNTSKINDTGSATTATTTTATETEIKPKEEDATPASLHQDHYLVPYNQRANHSKPIPPFLLDLDSQSVPDALKKQTNDYYILYNPALPREIDVELHKSLDHTSVVCCVKFSNDGEYLATGCNKTTQVYRVSDGSLVARLSDDSAANNHRNSITENNTTTSTDNNTMTTTTTTTITTTAMTSAAELAKDVENLNTSSSPSSDLYIRSVCFSPDGKFLATGAEDRLIRIWDIENRKIVMILQGHEQDIYSLDYFPSGDKLVSGSGDRTVRIWDLRTGQCSLTLSIEDGVTTVAVSPGDGKYIAAGSLDRAVRVWDSETGFLVERLDSENESGTGHKDSVYSVVFTRDGQSVVSGSLDRSVKLWNLQNANNKSDSKTPNSGTCEVTYIGHKDFVLSVATTQNDEYILSGSKDRGVLFWDKKSGNPLLMLQGHRNSVISVAVANGSPLGPEYNVFATGSGDCKARIWKYKKIAPN

SEQ ID NO: 44394 - protein, 288 aa, Thermoanaerobacter tengcongensis MB4
MQAEILKAIQTISNPFLDYFFIILTMLGSSGFYFIFIPIFYWCIDKRLGLKLGLILIASIYINTVIKEVTKISRPIGYPGIRSIFTQSAGGYSFPSGHAQGSATFWGTLMVHYNKKWLWYLGSLVVILVSFSRMYLGVHWPIDIAGGILIAFLIVVLGELIYSILRENPLKFPLYLKILLSIVVPVIFVCIFPHKDIYEHMGLIAGVLTGYFVDKEKFDFTTHGTFSKQVTKFLIGVAVFFALKEGLKFIMPYENAFNFLRYSLCGVWLSLGAPYTFFLLKLNDKKIA

SEQ ID NO: 44395 - protein, 158 aa, Frankia sp. FE46
ITKEQYSRDPRNIAKKAEEYLRGTGIADTAYFGPEAEFYIFDDVRYDYNPYGSMHAVDSVEAAWNTARKEEGGNLGYKPRFKGGYFPVPPTDHFTDLRSEMTRVLFEVGITVEMQHHEVGTAGQAEIDIRYDTLLKTADNLMLYKYVIRNVARSRGKT

SEQ ID NO: 44396 - protein, 159 aa, Frankia sp. FE14
ITKEQYSRDPRNIAKKAETYLRGTGIADTAYFGPEAEFYIFDDVRYDYSPYGSMHQVDSVEAAWNTARKEEGGNLGYKPRFKGGYFPVPPTDHFTDLRSEMTRVLYETGITVEMQHHEVGTAGQAEIDIRYDTLLKTADNLMLYKYVIRNVARSRGKTV

SEQ ID NO: 44397 - protein, 159 aa, Frankia sp. FE34
ITKEQYSRDPRNIAKKAETYLRGTGIADTAYFGPEAEFYIFDDVRYDYNPYGSMHQVDSVEAAWNTARKEEGGNLGYKPRFKGGYFPVPPTDHFTDLRSEMTRVLYETGITVEMQHHEVGTAGQAEIDIRYDTLLKTADNLMLYKYVIRNVARSRGKTV

SEQ ID NO: 44398 - protein, 836 aa, Yarrowia lipolytica CLIB122
MSQYSRHAFDTDSDSDTELTPIYIDDRYSSMVSNDSRAGLLRRGGDLERDAESEKTREEKEEELRNHSFSKSRDKTRETVADATLESSSCVDSQYDTVETTSIFSVGRKKAINSPYPEVRAAVPATDDPLMPQNTPRMWVIGIFLVTICSGLNILFTLHWPAFVISSFFAAMVAWPLGRIWDQFVPNWRIPLTNIYLNNSPFNIKEHCLIIVMANVSYGTGVSYVPVIVLTMKHRYNNTYFGWGFSIVSSICVQCLGYGMAGICRRILVYPASLIWPSNLVTTTFLTNIHMNVNHTADGWKISRLRFFLIVFSAYFVWNWLPGYLAPFLSNFAFVTYAAPDNVIVNQIFGSSSGLGLIPINFDWNVIAGYIGSPLVPPFFSIGNVAAGVVVIFWIITPILHYSNAWYGRYLPMSDSNSYDRFQRTYDAERVLKPLVKGGKKKFELDVEKYKEYSPLYLSTTFALSYGVSFAAITSTVVHTILFHGKEIMYYWKHSRKEPEDVHMELMRKYPEVPEWWYALVLAICFALACVTVSVWETDLPIWALIIALLIAGGLLIPAGMIAALTNVTMGLNVLTEFVVGYILPGRPVGMMFFKTFGYISNAQALNFLVDLKLGHYLKLAPRVMFCAQILATTWGSICQLAVVEWAQMAIPDLCEESQKTNFSCPQVQVFYSASVIWGLVGPGRIFGEGQLYHGLLWMFLVGAALPFFSWLWLKRHPNSRLKFIHWPVFFNGPSQIPPATPYNYASWCVVGYIFNWLIKRRWFNWWAKYNYTLSAGLDVGMAVSAAVIFVSLQLPNINPPSWWGTNIFTPTMDIQGNAFQEVLKEGESFGMKTWK

SEQ ID NO: 44399 - protein, 163 aa, Zea mays subsp. parviglumis
EEGRIIEFAEKPKGEQLKAMMVDTTILGLDDVRAKEMPYIASMGIYVFSKDVMLQLLREQFPEANDFGSEVIPGATSIGKRVQAYLYDGYWEDIGTIAAFYNANLGITKKPIPDFSFYDRFAPIYTQPRHLPPSKVLDADVTDSVIGEGCVIKNCKINHSVVG

SEQ ID NO: 44400 - protein, 428 aa, Colwellia psychrerythraea 34H
MAESKATLSIDGKEIGEFPVLKGTAGTDVIDIRTLGSHGYFTYDPGFLATGSCESSITYIDGGKGVLQHRGYPIDSLAKQADYLEVCYILLNGDAPTQSEYEEFKSIITTHTMVHEKLVHFFHGFLPDAHPMAMLCGVVGAMSSFYHSDLDITDPAQRKRSAHRLIAKMPTIAAMAYKYSVGQPFVYPRNELSYAENFLHMMFSVPAEEYIVSPTVANAMDRIFTLHADHEQNASTSTVRLAGSSGANPYACIAAGVASLWGPAHGGANEACLTMLEQIGSLENVAEYVAKAKDKNDPFRLMGFGHRVYKNFDPRATVMRETCHEVLNELGISDPLLDVAMALEKVALEDPYFIEKKLYPNVDFYSGIILKAIGIPSSMFTVIFAMSRTVGWIAHWDEMLSQPGQKIGRPRQKYTGEINREFVPLNKR

SEQ ID NO: 44401 - protein, 163 aa, Zea mays subsp. parviglumis
EEGRIIEFAEKPKGEQLKAMMVDTTILGLDDVRAKEMPYIASMGIYVFSKDVMLQLLREQFPEANDFGSEVIPGATSIGKRVQAYLYDGYWEDIGTIAAFYNANLGITKKPIPDFSFYDRFAPIYTQPRHLPPSKVLDADVTDSVIGEGCVIKNCKIHHSVVG

SEQ ID NO: 44402 - protein, 633 aa, Magnetococcus sp. MC-1
MEVARLIEDLVFQCRERLGEEAAERVQRAADLAIYFHEGQFRKLDGSRYVLHCIQVATHCFSWGLVDAAGICAALLHDSIEDAPPEKQADQAIRALDPEVFSIVEALSKIRNLQTGGGDMPATYRRILLAASRDLRVLVIKSFDVLHNAETLEVHGPEKAKVKASLGLIYVGIARRLGMIVMADALIDRLLPHLMPVQYERARKNLRTLQNQCGESMDHMVKEVARINEDGLIRDVILEPRKVADYFLLAEKPGTGRLNRVGWPVYRLKLFVAKGSDAWQVLGRVHDHFEPLPRHIRDYMNAPRINGYQALTTRILWGGVPVNVLIVESGKDESNRYGILATWGEGSSPYTGRYMRLLSTLGDSDLRMSEVHAHVLPDLLDAYSPKGERYTFPAGSVVIDFAYAVHTEIGNRCAGAYVNGVKRAPDYPFKDGDVINVITAKSSCPLRGWLNVVKTARAKTVIKQALKNHEGGVHGVQHPQPGLFVLTALASSDIAWSNCCCPVPGDTVVGRSAADGRWIVHTSQCTKVHEGNDEVHWERGRWNLADACNQANINIILVVERSGGVLAEIYRLLEVSGVRIHHTEIKPRSPTRLLVMLQFGHEHINPLGVVLTQLRGLAGVVSLQEYSWSSRNN

SEQ ID NO: 44403 - protein, 162 aa, Zea mays subsp. parviglumis
RRRIIEFAEKPKGEQLKAMMVDTTILGLDDVRAKEMPYIASMGIYVFSKDVMLQLLREQFPEANDFGSEVIPGATSIGKRVQAYLYDGYWEDIGTIAAFYNANLGITKKPIPDFSFYDRFAPIYTQPRHLPPSKVLDADVTDSVIGEGCVIKNCKINHSVVG

SEQ ID NO: 44404 - protein, 589 aa, Oryza sativa (indica cultivar-group)
MAVAARVVEEEDPDVVEMMKRRDDEEEVVGEAWDYKGRGAIRGSTGGWRSAAMILCVELNERLTTLGVAVHLVTYLTGTMHLGSAASANAVTNFLGTSFMLCLLGGFLADTYLGRYLPIAIFTAVQAAGMAVLTISTAAPGLRPPPCSSGGSGCAAANGTQLGVLYLGLYMTALGTGGLKSSVSGFGSDQFDESDGGERGSMARFFSWFFFFISMGSLLAVTVLVYVQDKVGRRWGYGICVVAILTGLLFFLAGTTTYRFKKLLGSPLTQIAAVTAAAWTNRNLPLPSDPSMLNHDDSAHTTAKPNQKLPHSKQFRFLDHAAIVETTTAEAKKRKRWAACCTVTEVEEVKQLVRMLPTWATTILFWTVYAQMTTFSVSQAAVMDRRLSTSFVIPAGSLTVFFVAAILLTVPLYDRLLAPLVRRLTANPRYDLSPLHRIFVGLLLAALAMVAAALTERARRDAAVTLSVFYLLPQFLLVGAGEAFTYIGQLDFFLRECPKGMKTMSTGLFLSTLSLGFFFSTALVTVVHKVTAESRRPWLADNLDEGRLDNFYWLLGGISVVNLAVFVAAAARGYVYREKRLADAGIIHI

SEQ ID NO: 44405 - protein, 163 aa, Zea mays subsp. parviglumis
EEGRIIEFAEKPKGEQLKATMVDTTILGLDDVRAKEMPYIASMGIYVFSKDVMLQLLREQFPEANDFGSEVIPGATSIGKRVQAYLYDGYWEDIGTIAAFYNANLGITKKPIPDFSFYDRFAPIYTQPRHLPPSKVLDADVTDSVIGEGCVIKNCKIHHSVVG

SEQ ID NO: 44406 - protein, 357 aa, Aspergillus nidulans FGSC A4
MPGQIMRAVVFKGPYKVAVEERPIPKIQNPEDIIIKATYTALCGSDLHVYRGIEPAGTGFVMGHEVTGEVVEVGDAVKTVQRGDLVVSAFTTSWISGTCFYCEQGFSSRCDENTLLGCDDLDGAQAEYVRIPHADGTVVKAPSGVSPQYLVLMGDIFPTGYFAAQNAFKNATAAQIAEQTVVIIGCGPVGLCALINALEYKPKHLLAVDCVPSRLDLAKSLGAEPWDFKNDREALDRRVSELTNGRGADAVIEVVGMSPALRMGFELLRPWGVISSVGVHNGEIPWTGSEAYGKNVTVQMGRCPVRSVSDAALEVLKKNQHLLGFMTENIMPLSQAAEAYDLFNAMKVQKVIFEAGK

SEQ ID NO: 44407 - protein, 63 aa, Arabidopsis thaliana
  misc_feature (10)..(10): Xaa can be any naturally occurring amino acid
  misc_feature (16)..(16): Xaa can be any naturally occurring amino acid
  misc_feature (21)..(21): Xaa can be any naturally occurring amino acid
  misc_feature (37)..(38): Xaa can be any naturally occurring amino acid
  misc_feature (47)..(47): Xaa can be any naturally occurring amino acid
  misc_feature (50)..(50): Xaa can be any naturally occurring amino acid
  misc_feature (53)..(53): Xaa can be any naturally occurring amino acid
  misc_feature (59)..(62): Xaa can be any naturally occurring amino acid
MASSMLSSTXVVTSPXQATMXAPFTGLKSSASFPGTXXANNDITSFXSKXGRXSCMKVXXXXL

SEQ ID NO: 44408 - protein, 414 aa, Oryza sativa
MAAPSSLASSSHLSRRATAAASPSIPPPSPPPPPQRLRCGWVGRAAPPTRRAPGVCSVVSPSKPGVAAVDVPAATIPDAAATGVGVAERISVSSLLEVVADDLLKLNNNLKSLVGAENPVLVSAAEQIFGAGGKRLRPALVFLVSRATAELAGLLELTTEHQRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTRSAAIFSGVSTAICEQMYEYGRNLGLSFQVVDDILDFTQSAEQLGKPAGSDLAKGNLTAPVIFALQDEPQLREIIDSEFSETNSLATAIELVHRSGGIKRAHELAREKGEIAIQSLQCLPRSEFRSTLENMVKYNLERID

SEQ ID NO: 44409 - protein, 560 aa, Zea mays
  misc_feature (98)..(98): Xaa can be any naturally occurring amino acid
MGSSGFSWTLPDHPKLPKGKPVAVVVLDGWGEANPDQYNCIHVAQTPVMDSLKNGAPEKWRLVKAHGTAVGLPSDDDMGNSEVGHNALGAGRIFAQGXAKLVDQALASGKIYDGDGFNYIKESFESGTLHLIGLLSDGGVHSRLDQLQLLLKGVSERGAKKIRVHILTDGRDVLDGSSIGFVETLENDLLELRAKGVDAQIASGGGRMYVTMDRYENDWDVVKRGWDAQVLGEAPYKFKSALEAVKTLRAQPKANDQYLPPFVIVDDSGNAVGPVLDGDAVVTINFRADRMVMLAKALEYADFDNFDRVRVPKIRYAGMLQYDGELKLPSRYLVSPPEIDRTSGEYLVKNGIRTFACSETVKFGHVTFFWNGNRSGYFDATKEEYVEVPSDSGITFNVAPNMKALEIAEKARDALLSGKFDQVRVNLPNGDMVGHTGDIEATVVACKAADEAVKIILDAVEQVGGIYLVTADHGNAEDMVKRNKSGKPLLDKNDRIQILTSHTLQPVPVAIGGPGLHPGVKFRNDIQTPGLANVAATVMNLHGFEAPADYEQTLIEVADN

SEQ ID NO: 44410 - protein, 237 aa, Saururus chinensis
MGRGRVQLKRIENKINRQVTFSKRRTGLLKKAHEISVLCDAEVALIVFSTKGKLYDYSTNAGMARILERYERYCYAEREVAVTSPDSEGSWWLEYGKLKARIEAQQRIQRQLMGEDLDALTPKELQQLENQLESALKHVKSRKNQVIYDSMVELRRKEKLLRDENTMMEKKIQEKKKERVQQAQWEQQIQSQNSPSFLPTLNIGYHQGTATETGEKEEAHPGHNTVMLAWLLRSSNN

SEQ ID NO: 44411 - protein, 595 aa, Zea mays
MEDVAPGAEPWEGYVDWRNRPATRSRHGGMAAASFVLVVEVLENLAFLANASNLVTYLMGFMHYSPSQSATAVTNFMGTAFLLALLGGFLSDAFFTTYTIYIASAFIELMGLVILTVQARTQSLMPPQCAKPGAGGAACEPVSGAKKAMLFAGLYLTALGVGGIKGSLPSHGAEQFDEHAARGRKGRSTFFNYFVFCLSCGALVAVTFAVWVEDNKGWQWGFGISTIAILLSIPLFVAGSSRYRNKVPTGSPLTTIAKVLIAAALARRGCAPSSSNGAVIDRAPSPTGSTDMKEYCKPGDMEEITVSGAAIVASSPAEPSRELAFLNRAVQCQPPRHGRLACTVQEVEDVKIVLMVLPIFLSTIMLNCCLAQLSTFSVEQAATMDTRVGSLTVPPASLPVFPVTFIIILAPVYDHVIVPFARRVTGTEMGITHLQRIGTGLVLSIVAMAVAAVVEVKRKNVASHNGMLDSTKPLPITFFWIAFQYLFLGSADLFTLAGLLEFFFSEAPPRMRSLATSLSWASLALGYYLSSVLVSIVNSATGRGDHRPWLQGASLNHYHLERFYWVMCVLSTINYLFFLFLAVRYKYRNAGVIKG

SEQ ID NO: 44412 - protein, 297 aa, Nicotiana tabacum
  misc_feature (209)..(209): Xaa can be any naturally occurring amino acid
MWVRHFPVMGPRSASTVALNDKQHDKKVENGGAAASGGGDGGDEKSVVSYWGVPPSKVTKEDGTEWKWNCFRPWETYKADLSIDLTKHHAPTTFLDKFAYWTVKALRYPTDIFFQRRYGCRAMMLETVAAVPGMVGGMLLHCKSLRRFEQSGGWIKALLEEAENERMHLMTFMEVAKPNWYERALVFAVQGVFINAYFVTYLLSPKLAXRIVGYLEEEAIHSYTEFLKELDKGNIENVPAPAIAIDYWRLPKDSTLRDVVLVVRADEAHHRDVNHFAPDIHYQGQQLKDSPAPIGYH

SEQ ID NO: 44413 - protein, 283 aa, Gibberella zeae PH-1
MPSPRRVRLLILATIGTFIFILFYTSGFDGHHDAETSTGQEFIKKTQNAMSANEMPAPIVDFATGEKAGSAHSDKDGDGDIDEEDKKMAEEMQQRLKAAEAEAKGKANEKGGLRPDPPKKVVGVGSSAEGQNKDKIVKPAAGEKGAAAAPDAAAADKKPVTETRTKEELEARAELDSILKKSPVIIFSKTYCPHSKRAKAILIEKYAITPEPYIVELDVHPQGSALQDQLLETTGRRTVPNVMVNGVSLGGADDITEMDHAGNLVGKIVDLGNKRVEVTARTK

SEQ ID NO: 44414 - protein, 159 aa, Frankia sp. FE36
ITKEQYSRDPRNIAKKAETYLRGTGIADTAYFGPEAEFYIFDDVRYDYNPYGSMHQVDSVEAAWNTARKEEGGNLGYKPRFKGGYFPVPPTDHFTDLRSEMTRVLYETGITVEMQHHEVGTAGQAEIDIRYDTLLKTADNLMLYKYVIRNVARIRGKTV

SEQ ID NO: 44415 - protein, 163 aa, Zea mays subsp. parviglumis
EEGRIIEFAEKPKGEQLKAMMVDTTILGLDDVRAKEMPYIASMGIYVFSKDVMLQLLREQFPEANDFGSEVIPGATSIGKRVQAYLYDGYWEDIGTIAAFYNANLGITKKPIPDFSFYDRFAPIYTQPRHLPPSKVLDADVTDSVIGEGCVIENCKIHHAVVG

SEQ ID NO: 44416 - protein, 206 aa, Zea mays
MVERANRPSALNAPAATGPSPQVDIVGEAGSQKVVARLPSGESVEVLLYGATVTSWKSNGGQTENLWLSEAADLTGKKPVRGGIPVVFPVFGPPPKEGHPTSTLPQHGFARGSRWEFMGKSTAEDALDSNSVKLDFGLDRQALSEESRKAWPLDFGLVYSVTLSKDSLQAVLTVRNEGEESFEFQFLLHTYFKIQDISKGVITGLA

SEQ ID NO: 44417 - protein, 78 aa, Brassica napus
FSDEKNHPLLIHCNRGKHRTGCLVGCMRKLQKWCLTSIFDEYQRFAAAKARVSDQRFMELFDVSSFKQIPMSFSCSSS

SEQ ID NO: 44418 - protein, 178 aa, Oryza sativa (indica cultivar-group)
MATKAGVIATLLALNLLFFTFSDACGCQCGSCPSPGGGGGGGGGGRGGGGGSGGGGGGGGGSGGGGSGGGGSGGGGSGGGGGGGSGGGGGGGRCPIDTLKLGVCANVLNGLINVQLGTPPRQPCCSLIQGLADLEAAVCLCTALRANILGINLNLPINLSLLVNYCGRSVPSGFQCSN

SEQ ID NO: 44419 - protein, 143 aa, Glycine max
MPWVRLSESPRLDVAIDMGNPFLNLTVDGFLKIGAVAATRSAAEDTYHIIQKGNISSRDFEKTLKKMCKEGVYWGTIAGVYVGMEYGVERIRGTRDWKNAMIGGAVTGALVSAASNNKKDKIAIDAITGAAIATAAEFINYLT

SEQ ID NO: 44420 - protein, 815 aa, Wolinella succinogenes DSM 1740
MQYLTKIAKVIGNKKSEKDEDSEYPAQSGGFLLGQYQKMRMHQGDILKDSILAKYLSGEQPKSFDDPQEDEIIFPFGLNLSQEKALKRVFSHQVSIIEGPPGTGKTQTILNIVSNILLRGKTVAVVSNNNSAVDNIYEKFDALGLSFFMAKLGNQDNRKKFFDAQLKKYPSFDIKTDDQHGYESLKSKVSSLREILQVHNDLAQAIHSMEELRLERTYFANEVIKSLEIDHLRSLLDLSRYSVEEILSLLAEIEKIEADGVKNVTLFIKIKFFIKFRITSFSLYNYSLKQIAIFLKEQFYVIKTKELEEKISTLEKKLSGIDFENVLNEYKDISMEIFKSMLSQKYKSGEQRKEFDKDSFRCDDFMEEYPVLLSTTHSLRECKKDDYLFDYLIIDEASQVDLVAGGLALSCAKNAVIVGDLKQLPPVIEGQMVEKAKELLYFFSIEASYDYQKSLLESISRVFPHAPKTLLREHYRCHPKIIDFCNKKFYNGELIILTKNCEETSPIVLIEAQSDRKTESNKCNMHQICSISKHLSDADISDAACISPFKAHNQQSREVFKGDNIEIEVNTVHKYQGREKDTIILSTVVDQENSFVDDPRLLNVAISRAKKRLYVAVSDRGQNQNIKDLVEYIKYNHFEVIESKLHSIFDILFKSYCPHSNKHRISLLDKYKARWAQQAGRSKYSSENLMYDLIQETLSEQFSSLALDVSLNYPLRWLIKNKEILEEEELRFVNSFSHVDFLLYSKVSKRAALAIEVDGVSYHRNNPQQKKRDELKNRILEKYQIPLLRFCTNDFEEKEKLIKKLKEIKSQTDQR

SEQ ID NO: 44421 - protein, 171 aa, Prochlorococcus marinus str. AS9601
MKFLKLIPILFIFFGNIPYKNEVRAEIKNPKDFRVLSNESKKLSISNVRYFIKEGDKYIKNGDFEKAKDFYLDARKLAKQLASFYSDLNSSFKGIDARIPNEMQRKGKQTLQILAQSNERLASLYIKTEKPEVAVPLLVETIRIMSPTSPEGKEAYERLIQLGFVETNYKG

SEQ ID NO: 44422 - protein, 219 aa, Glycine tabacina
NGNNLPTKQAVVDLYKSNRIDKIRLYHPDEAILQALRGSNIEVILTVPNDQLQSLTNAGAANDWVNKYVKGYSQNVKFKYIAVGNEVHPGDAAAGSVLPALKNIQNAISSANLQGQIKVSTAIDTTLLGNSYPPKDGVFSNSASSYIGPIVSFLARNGAPLLANVYPYFAYVGNQQTIGLDYALFTKQGKNEVGYQNLFDALLDSLYAALEKVGAPNVK

SEQ ID NO: 44423 - protein, 449 aa, Nicotiana tabacum
MDNNSVGVPHNLPRGEMGGKQKNAQADGRNRRALGDIGNLVPAPAAEGKPKAAQISRPVTRSFCAQLLANAQEEKNKKPLAEVVNKDVPAKKKASDKEMKTVGGSPLSKRKAKKSGKTLTSTLTARSKAACGLSNRPKYEIEDIDVADADNHLAAVEYVEDIYNFYKLTEGESRVDDDYMNFQPDLNHKMRAILVDWLIEVHRKFELMPESLYLTITILDRFLSLKTVPRKELQLVGISSMLIACKYEEIWAPEVNDFIHISDNAYAREQILQMEKAILGKLEWYLTVPTPYVFLVRYIKAATPSDNQEMENMTFFFAELGLMNYKITISYRPSMLAASSVYAARSTLNKTPLWTQTLQHHTGYSEDQLMECAKILVSYHLDAAESKLKAIYRKFSSPDRGAVAFFPPARNLLPTTTTDAASLVLEEFYFLVWEAFLGSFYCCDLSSLD

SEQ ID NO: 44424 - protein, 219 aa, Glycine falcata
NGNNLPTKQAVVDLYKSNRIGKIRLYYPDEGVLQALRGSNIEVILGVPNDQLQSLTNTGAATNWVNKYVKTYSQNVKFKYIAVGNEIHPGDSLAGSVLPALENIQKAISAANLQGQIKVSTAIDTTLLGNSYPPKDGVFSSSASSYIRPIVNFLARNGAPLLANVYPYFAYANNQQSIGLDYALFTKQGNNEVGYQNLFDALLDSLYAALEKVGAPNVK

SEQ ID NO: 44425 - protein, 548 aa, Burkholderia sp. 383
MSTPSNVSPPIAVERSAVLDEAHLGDIRGALGTIAHHDTGSRGTWWARLRTLLAIIGPGLIVMVGDNDAGAFGTYTQAGQNYGTTLLWTLLLLVPVLYVNQEMVLRLGAVTGVGHARLIFERFGKFWGAFSVIDLFLLNALTIVTEFIGITFVLDFFGLPKVAGVCVAAALTMAAVSTGDFRRFERFAIGLCVLSLLLVPVLVSIHPPVAQMSRDFFVPNWPAHAKLSDVMLLVIGIVGTTVAPWQLFFQQSYVIDKRITPRFMKYEKADLWIGIVFVLIGAVAMIGFSAALFNGHPEAGNFTDAGGIIAGLEKYAGRTSATLFAVALLDACIIGAAAVSLSTAYAIGDVFKIRHSLHRGVSDAKGFYLVYFGIVAAAATLVLIPGSPLGLLTEAVQTLAGVLLPSATVFLLVLCNDRQVLGPWINSTKLNVFTGAVIWVLVLLSIILTASVMYPDISGEAIVDVLVGGTVLAIAGYIATVLIRRNKRVVEPAVDRSLRDTWRMPPLDTLEPQNMTVATRIWMAVLRGYLVIAVGLVIVKVVQMTLLK

SEQ ID NO: 44426 - protein, 219 aa, Glycine latrobeana
NGNNLPTKQAVVDLYKSNRIGKIRLYYPDEGVLQALRGSNIEVILGVPNDQLQSLTNAGAATNWVNKYVKAYSQNVKFKYIAVGNEIHPGDSLAGSVLPALENIQNAISAANLQGQIKVSTAIDTTLLGNSYPPKDGVFSNSASSYIGPIVSFLAGNGAPLLANVYPYFAYVGNQQNIGLDYALFTKQGKNEVGYQNLFDALLDSLYAALEKVGAPNVK

SEQ ID NO: 44427 - protein, 401 aa, Xylella fastidiosa Ann-1
MIPSVTTTTTSGEPIAGDVARKQNLLELDREGLERFFEDVLGEKRYRAHQVMKWIHHRYVADFEQMTDVGKALRTRLQACAEVRVPRVVFDKHSVDGTHKWLLAMGADRKNAIETVYIPDKGRGTLCVSSQIGCGLNCTFCSTATQGFNRNLTTAEIIGQVWVAARHLGNVPHQQRRLTNVVMMGMGEPLMNFDNVVRAMSVMRDDLGYGLSNKRVTLSTSGLVPMIDRLSTESDVSLAVSLHAPNDKLREQLVPLNKKYPIVELMASCERYLSVNPKRDSVTFEYTLMKGVNDKQEHAHELAKLMRQFDCAMQVKGAAKVNLIPFNPFPGTCYERSTEVDIRAFQKILLDAQILAMVRRTRGDDIDAACGQLKGQVVDRTRRQAEFRRTIEDRVGRDVAA

SEQ ID NO: 44428 - protein, 219 aa, Glycine latrobeana
NGNNLPTKQAVVDLYKSNRIGKIRLYYPDEGVLQALRGSNIEVILGVPNDQLQSLTNAGAATNWVNKYVKAYSQNVKFKYIAVGNEIHPGDSLAGSVLPALENIQNAISAANLQGQIKVSTAIDTTLLGNSYPPKNGVFSSGASSYIRPIVNFLARNGAPLLANVYPYFAYVNNQQSIGLDYALFTKQGNNEVGYQNLFDALLDSLYAALEKVGAPNVK

SEQ ID NO: 44429 - protein, 484 aa, Saccharomyces cerevisiae
MADKIERHTFKVFNQDFSVDKRFQLIKEIGHGAYGIVCSARFAEAAEDTTVAIKKLTNVFSKTLLCKRSLRELKLLRHFRGHKNITCLYDMDIVFYPDGSINGLYLYEELMECDMHQIIKSGQPLTDAHYQSFTYQILCGLKYIHSADVLHRDLKPGNLLVNADCQLKICDFGLARGYSENPVENSQFLTEYVATRWYRAPEIMLSYQGYTKAIDVWSAGCILAEFLGGKPIFKGKDYVNQLNQILQVLGTPPDETLRRIGSKNVQDYIHQLGFIPKVPFVNLYPNANSQALDLLEQMLAFDPQKRITVDEALEHPYLSIWHDPADEPVCSEKFEFSFESVNDMEDLKQMVIQEVQDFRLFVRQPLLEEQRQLQLQQQQQQQQQQQQQQQQPSDVDNGNAAASEENYPKQMATSNSVAPQQESFGIHSQNLPRHDADFPPRPQESMMEMRPATGNTADIPPQNDNGSLLDLEKELEFGLDRKYF

SEQ ID NO: 44430 - protein, 655 aa, Burkholderia sp. 383
MCGIDGFLNSVAFDEETARGTLARMTASLAHRGPDGQGIWVDPEAGIALGHRRLAIVDLSVHGRQPMASACGRYVMVFNGEIYNHRELRAELERAGRAPAWRGHSDSEVLIAAIVAWGVDATLRRATGMFSIALWNRESRVLTLARDRIGEKPLYYGRIGDALVFASELKALRGYPGFDGAIDRDALCLYLRQSSVPAPHTIYRGIHKLPPGTYIQFEHARDTPRLRAYWTLEQAIEDGRAQPFEGNADEAVSQLDAVLRQAVARQMEADVPLGAFLSGGVDSSTIVALMQAQSSTPVDTFTIGFHEAGYDEAGYAKAVARHLGTRHTELYVTADHALGVVPKLPSIYDEPFSDASQIPTFLVSEMTRRHVKVSLSGDGGDELFGGYTRYFLTPRLWRKLHRVPGAVRARIAAALHALRPDHADQLAAVAQGAWGGVEARESATRIGDRLHKLGHVMTAESRIGLYRLLMSSVHHPERLALSGQEPATPLDTVSAWPAHLSFAEQAMAIDTLTYLPTDILAKVDRAAMAVSLETRMPFLDHHVVEFAWRMPADLRLPEGQSKALLRRLLDRYVPSALIDRPKQGFCAPVDHWLRGSLRDWAEALLRPSRLREEGFFDAAAVERLWRQHVTGRMNWQHQLWTVLMFQAWLEAQRAT

SEQ ID NO: 44431 - protein, 152 aa, Solanum tuberosum
MSSFSEEQEALVVKSWGSMKKDAGEWGLKFFLKIFEIAPSAKKMFSFLKDSNVPLDQNPKLKVHAKSILVMTCEAAVQLRKAGKVVVRDSTLKKIGATHFKYGVADEHFEVTKYALLETIKEASPEMWSVEMKNAWGEAYDQLVSAIKTEMK

SEQ ID NO: 44432 - protein, 198 aa, Escherichia coli
MNMSASALVCLAPGSEETEAVTTIDLLVRGGIKVTTASVASDGNLAITCSRGVKLLADAPLVEVADGEYDVIVLPGGIKGAECFRDSTLLVETVKQFHRSGRIVAAICAAPATVLVPHDIFPIGNMTGFPTLKDKIPAEQWLDKRVVWDARVKLLTSQGPGTAIDFGLKIIDLLVGREKAHEVASQLVMAAGIYNYYE

SEQ ID NO: 44433 - protein, 334 aa, Xylella fastidiosa Ann-1
MAIKVGINGFGRIGRNILRSAVQNFGSNIDIVAINDLLEPDYLAYMLQYDSVHGRFKGEIAIEGTALILNGKKIRLTAERDPGNLQWADAGAEIVIESTGLFLTQESAGKHLAAGAKKVIISAPSKDETPMFVYGVNHNSYNGEPIVSNASCTTNCLAPLAKVINDKWGITRGLMTTVHAATATQKTVDGPSNKDWRGGRGILENIIPSSTGAAKAVGKVIPSLNGKLTGMSFRVPTSDVSVVDLTVQLNTPATYKEICTEVKQQSEGPLRGILGYTEDKVVATDFRGETCTCVFDADAGIALDPTFIKLIAWYDNEWGYSNKCLEIAKVIAAK

SEQ ID NO: 44434 - protein, 219 aa, Glycine latrobeana
NGNNLPTKQAVVDLYKSNRIDKIRLYYPDEGALQALRGSNIEVILTVPNDQLQSLTNAGAANDWVNKYVKGYSQNVKFKYIAVGNEVHPSDAAAGSVLPALKNIQNAISSANLQGQIKVSTAIDTTLLGNSYPPKDGVFSNSASSYIGPIVSFLAGNGAPLLANVYPYFAYVGNQQNIGLDYALFTKQGKNEVGYQNLFDALLDSLYAALEKVGAPNVK

SEQ ID NO: 44435 - protein, 162 aa, Triticum aestivum
MSAAERAVVFSEEKDALVLKSWAIMKKDSANLGLRFFLKIFEIAPSARQMFPFLRDSDVPLETNPKLKTHAVSVFVMTCEAAAQLRKAGKITVRETTLKRLGGTHLKYGVADGHFEVTRFALLETIKEALPADMWGPEMRNAWGEAYDQLVAAIKQEMKPSE

SEQ ID NO: 44436 - protein, 159 aa, Frankia sp. FE19
ITKEQYSRDPRNIAKKAETYLRGTGIADTAYFGPEAEFYIFDDVRYDYNPYGSMHQVDSVEAAWNTARKEEGGNLGYKPRFKGGYFPVPPTDHFTDLRSEMTRVLYETGITVEMQHHEVGTAGQAEIDIRFDTLLKTADNLMLYKYVIRNVARIRGKTV

SEQ ID NO: 44437 - protein, 159 aa, Frankia sp. CcI3
ITKEQYSRDPRNIAKKAEAYLRGTGVADTAYFGPEAEFYIFDDVRYDYNPYGSMHQVDSVEAAWNTARKEEGGNLGYKPRFKGGYFPVPPTDHFTDLRSEMTRVLYETGITVEMQHHEVGTAGQAEIDIRYDTLLKTADNLMLYKYVIRNVARGRGKTV

SEQ ID NO: 44438 - protein, 345 aa, Bradyrhizobium japonicum USDA 110
MTGQLRLDDHLQRYSETAPHALAVATAVDAIAAAAIEIADLIGAGDLADASGLTTGRNSDGDVQRDLDVQADAILRRCLGKLSIAALASEEMREPQIGDRAARICVAIDPLDGSSNIDINMTVGTIFSILPAPDDLALAFHQRGSAQFAAGFVTYGPQTSLVLTLGDGVDIFTLDRKAGCFRLARSAIQISEAGEEFAINASNRRHWDPPVRAFIDECLAGVEGPANHDFNMRWVGSLVAEAYRILTRGGVFLYPSDARPGYGDGRLRLTYEAHPMAYIIEQAGGSASTGRERILDLSAQSLHQRVPLIMGSSNEVRRVEELHCDPLLVASISAPLFARRGFFRL

SEQ ID NO: 44439 - protein, 159 aa, Frankia sp. FE131
ITKEQYSRDPRNIAKKAETYLRGTGIADTAFFGPEAEFYIFDDVRYDYNPYGSFHQVDSVEAAWNTARKEEGGNLGYKPRFKGGYFPVPPTDHFTDLRSEMTRVLYETGITVEMQHHEVGTAGQAEIDIRYDTLLKTADNLMLYKYVIRNVARSRGKTV

SEQ ID NO: 44440 - protein, 672 aa, Bradyrhizobium japonicum USDA 110
MNISVHAEADVTAVAHNDLANAVRFLAVDAIETSQSGHPGLPMGMADVATVLFSRFLKFDSAHPSWPDRDRFVLSAGHGSMLLYALLHLTGGAVSLDDIKAFRQWGSKTPGHPEYGHTPGVETTTGPLGQGIATAVGMALAERMANARYGDGLVDHFTYVIAGDGCLMEGISQEAISLAGHLRLGRLIVLFDDNGISIDGPTSLATSDDQLARFAASGWSVRRVDGHDPEAVAQAIAEERETAKPSLIACRTVIGYGAPDRQGTEKAHGAPLGTEQTAAARRTLGWDYQPFVVPIPILKAWRMIGQRGQVERLAWLDRYESATPEQRDLFVEGKVVALPAAYALAAAKLRERFASERPKLATRQASQQVLDGIAGTIPGLVGGSADLTHSNLTHAKPQTPVTRGAFAGDYIHYGIREHGMAAAMNGLALHGGFIPYGGTFLAFSDYSRPAIRLAALMRLRVIHVMTHDSIGLGEDGPTHQPVEHLAALRVIPNLLVFRPADAVETLEAWDCALAAEHRPSVLCLSRQALPTFRSDARGRNRVARGAYLVVSPDGGRDVTLMATGSEVSIALEAARLLATEHIRAAVVSAPCLALFEEQPEDYRATVLGTAPRVGIEAAVLGDWPRWIGADGEFVGMRGFGASAPAPVLYREFGITPQSIAEAARRAIARKSQ

SEQ ID NO: 44441 - protein, 159 aa, Frankia sp. FE140
ITREEYSRDPRNTAKKAESYLRGTGFADTAYFGPEAEFYIFDDVRYDYNPYGSLHAVDSIEAAWNTARKEEGGNLGYKPRFKGGYFPVPPTDHFTDLRSEMSRALIRAGITVEMQHHEVGTAGQAEIDIRYDTLLRTADNLMLYKYIIRNVALSRGKTV

SEQ ID NO: 44442 - protein, 456 aa, Pseudomonas syringae pv. phaseolicola 1448A
MCIIGSGPGGLCMARALKRQGLDYEQFERHGEVGGVWDINNPGTPMYQSAHFISSRDQSGFIDYPMPAHFPDYPSNRQIFEYVRSFAVAFDLYDRIRFNTAVKDVEKEQDGRWLVTLASGERRRYRAVVCATGCNWDPNMPEVKGQFEGTVRHSVTYKNPDEFKGKRVMVIGADNSGADIACDAAKHADKAFISMRRGYHLIPKHLFGMPVDEFGEKGPQLPMWLARPVFQTILRVINGDTRRFGLPRPDHKLFESHPLLNTQLLHYLQHGDIQVKPDVSHYEGQHVVFKDGTREPLDLVLYATGYKWSCPYAAKYFEWQGGRPRLYLSIFSREHHNLFGIGYVETNSSAYKLFDSEAHAVACYLRDQLHQKTQASHFDQLIATDDPDLSGGIKFVKSQRHEVYLEAHALKKYLRKLFHSQGWPAVEEGYYKSLRKGTGYIPAPLQQKVAIQETCL

SEQ ID NO: 44443 - protein, 171 aa, Pisum sativum
MDSRNVFLILGLLAMVLVISSEVSARELAETSTNAKEEVAEKSNEVNDAKYYGGGYGHGYGHGYGHGHGGYGHGGGGGYGHGGGGGYGHGGGGGYGHGGGGGYGHGGGGGYNGGGVSNNEVVEKSNEVNDAKYGGGHYGGGHYGGGHYGGGHYGHGGGHHGGHGGASDNGN

SEQ ID NO: 44444 - protein, 1058 aa, Lactobacillus plantarum
MPKRTDIHKIMVIGSGPIIIGQAAEFDYSGTQACLALKELDYEVVLVNSNPATIMTDKEIADQVYLEPITLEFVSQILRKEHPDAILPTLGGQQGLNMAMELSKSGILDELHIELLGTKLSAIDQAEDREQFKALMEELGEPVPASGIARTVDEALAFAEQAGYPVIVRPAFTMGGTGGGIAETPQQLHDITENGLALSPVTQVLIEQSIAGYKEIEFEVMRDAADNAMVVCNMENFDPVGIHTGDSIVYAPVQTLADREVQLLRDAALKIIRALKIEGGCNVQLALDPNSFNYYIIEVNPRVSRSSALASKATGYPIAKMAAKIAVGLHLDEIKNPVTGTTYAEFEPALDYVVCKIPRWPFDKFTHADRRLGTQMKATGEVMAIGRNIEEATLKAVRSLEIGVHHVEESTLRSVDDDVLSDKLIHAQDDRLFYLTEAIRRGYQIDELAELTKINVFFLDKLLHIIEIEQALRTHTDDIETLTVAKRNGFADQTVADYWHETIDQVRDFRLAHKLAPVYKMVDTCAGEFASETPYYYGTYEFENESIVTKRPSVLVLGSGPIRIGQGVEFDYATVHSVKAIQKAGYEAIIMNSNPETVSTDFSVSDKLYFEPLTIEDVLNVIELEKPVGVIVQFGGQTAINLAKPLADHGIKILGTSVADVNRAEDRDEFDKVIKALAIPQPAGDTASDEATALAIADKLGYPVLVRPSYVLGGRAMEIVKKRTDLDYYMHNAVKVSHDHPVLVDSYLVGKECEVDAICDGQTVLIPGIMEHIERAGVHSGDSMAVYPPQSLSAAVQAQIVDYTEKLAIALNCVGMMNIQFVIHDDQVYVIEVNPRASRTVPFLSKVTNIPMAQVATRAILGQSLAEQGYQTGLVTPGPLVHVKAPVFSFSKLNRVDSLLGPEMKSTGEVMGSDVTMAKALYKAFEAAKLHVPSHGNVLLTVRDEDKPETVALAKRFHALGYQLLATRGTATALTTHGLPVTTVDKIDSGEHDLLHRMEAGEVQVVINTVSDEEQAENDGTLIRNTSIMHGIPLFTALDTVAAILQVRESQSFVTQAL

SEQ ID NO: 44445 - protein, 549 aa, Candida glabrata CBS 138
MEEVAPEQVQEVQGNTEAHIDSTTASTAPTEALPSDKQSRKANEIDSMADGAPAEKKQKTDQRQIIREPKLDDNGNPIPREPRLPKRKVAVMIGYCGTGYHGMQYNPPNPTIEAALFKAFVDAGAISKANSNDLKKNNFMRAARTDKGVHAGGNLISLKMIIEDPEIMDKINANLPEGIRIWDIERVNKAFDCRKMCSSRWYEYLLPTYSLIGPKPGTILNNDIESSKTELPGVLDEDLESKEFWENFEAAAKKEFTPEEIAAIKDYSPPPREEFDDQEELYQKVKQWKLLENTHRRQYRISEMKLNKFRAAMNQYLGAHNFHNFTLGKEFKDPSAIRFMKEIKVSDPFVIGDAKAEWVSIKIHGQSFMLHQIRKMISMATLIARCGTPVERISQAFGPQKINIPKAPALGLLLEAPVFESYNKRLEKFGYKPIDFSKYQEKVDAFKMKHIYDKIYAEEVSDNVFNAFFSYIDSFNKVTGAQTEESAESNKPATKSIFEFLSAHGIPGIDYGKNEKEDSNKESSNDQVNKESAPATSKPAEAVEQTEKN

SEQ ID NO: 44446 - protein, 290 aa, Lactobacillus sakei subsp. sakei 23K
MADFKQLAARELPQFDAYLKRELAKIQEPTLQKSMTYSVMAGGKRLRPLLLFAVLESTGQSIDETAFRAAGALELIHSYSLIHDDLPAMDNDDLRRGQPTNHKVFGEAEAILAGDGLLTLAFEWLATLNVTAEQRIELVRLLAQAAGANGMVAGQIEDIEGEHKTLTLAQLQQVHHLKTGCLIEVAVAMGAVLAQLGEVETTALRGFAQQFGLAFQIQDDILDVTSTTAEMGKAVHKDAAEQKNTFPILLGMSGAQEALHTTCQQAQQQLAQVTTFDRTLLNSFLDYFNE

SEQ ID NO: 44447 - protein, 560 aa, Moorella thermoacetica ATCC 39073
MKKFAALFLAVVIAVTMLAAPAASSAAGTPQYDLGASAQPDHITLTWTQDPLTTQTITWRTNITIARGLVQYAKAADKASFPGKAATVEATVQKFTSDLGDMNIHTATLTGLEPGTEYIYRVGDGTNWSDIHTFTTEASNTHSFKFLIFGDSQSGDPLNPEYKPWHDTIQNAFKTNTDAKFFVNVGDLVEQGQNYVHWNKWFEAAKGVIDTIPAMATQGNHETYNPPDGHSTKPIFWTTQFKLPQNGPEGLKGQAYSFDYGNAHIVMLDSQEEEEKGVAGDILAAQKAWLEKDLQNTNKPWKLVFFHKTPYYNKATRTNEDIKAAFQPLFDKYHVDVVFNGHDHAVARTYPIAGDKFVSSPAKGTIYYLTGRSGNKYYPDLSAKVWDAFFYDPQDQPNYIVAELNGDKLTLRAMKQDGTPIDTYTIDKASGLDTPQTIVPPKYNSTRLVIFGNMLQQPLLPVTPKQVNGQWYIPVRAFMQFLGGNVAWYDDGSVTIVYGKDKVQMASKSARATINGQEVNLPGSSLMDKNTLFIPAADLEEFFGFSYKYDAATNMLMFTK

SEQ ID NO: 44448 - protein, 184 aa, Triticum aestivum
MAAQPAERSFDVIVVGAGIMGSCAAHAAASRGARVLLLEQFDLLHQRGSSHGESRTIRATYPQPHYPPMVRLSRRLWDDAQRDSGYAVLTPTPHLDLGPRDDPAFLASVANGGATVLAPAAADAPRPAWAEAFRVPDGWAAASSELGGVMKATKAVAMFQALAAKMGAVVRDRTEVVDVARKGV

SEQ ID NO: 44449 - protein, 219 aa, Glycine tabacina
NGNNLPTKQAVVDLYKSNRIDKIRLYYPDEGALQSLRGSNIEVILTVPNDQLQSLTNAGAANDWVNKYVKGYSQNVKFKYIAVGNEVHPGDAAAGSVLPALKNIQNAISSANLQGQIKVSTAIDTTLLGNSYPPKDGVFSNSASSYIGPIVSFLARNGAPLLANVYPYFAYVGNQQNIGLDYALFTKQGKNEVGYQNLFDALLDSLYAALEKVGAPNVK

SEQ ID NO: 44450 - protein, 427 aa, Mycobacterium smegmatis str. MC2 155
MPIIEQVGAREILDSRGNPTVEVEVALTDGTFARAAVPSGASTGEHEAVELRDGGSRYGGKGVEKAVEAVLDEIAPQVIGLSADDQRLVDQALLDLDGTPDKSRLGANAILGVSLAVSKAAAESAGLPLFRYIGGPNAHILPVPMMNILNGGAHADTGVDVQEFMVAPIGAPSFKEALRWGAEVYHSLKSVLKNQGLATGLGDEGGFAPDVAGTKAALDLISSAIEATGLKLGSDVALALDVAATEFYTEGSGYAFEKETRTAEQMAEFYAGLLDSYPLVSIEDPLSEDDWDGWVSLTAAIGDRIQLVGDDLFVTNPERLEDGIQRGAANALLVKVNQIGTLTETLDAVSLAHNSGYRTMMSHRSGETEDTTIADLAVAVGSGQIKTGAPARSERVAKYNQLLRIEETLGDAARYAGDLAFPRLEAK

SEQ ID NO: 44451 - protein, 219 aa, Glycine tabacina
NGNNLPTKQAVVDLYKSNRIDKIRLYYPDEGALQALRGSNIEVILTVPNDQLQSLTNAGAANDWVNKYVKGYSQNVKFKYIAVGNEVHPGDAAAGSVLPALKNIQNAISSANLQGQIKVSTAIDTTLLGNSYPPKDGVFSNSASSYIGPIVSFLARNGAPLLANVYPYFAYVGNQQTIGLDYALFTKQGKNEVGYQNLFDALLDSLYAALEKVGAPNVK

SEQ ID NO: 44452 - protein, 163 aa, Aspergillus nidulans FGSC A4
MLDPRPFHILSYGTLLGVQLYQSFVSGIIAFRALPRPQFSALQAKIFPTYFALQTALPVVVALTASRGGQPLGISGLLERENQFSVLLPLAAAFITGLVVRITDMLGEETRDGKKSYDPPPHSKEMIALNKKFGRLHGLSSLVNLVTLGATIFYGVVLSKKLE

SEQ ID NO: 44453 - protein, 118 aa, marine gamma proteobacterium HTCC2143
MSSNKIIAEIEAEQMTKEIPDFGPGDTVVVQVKVKEGTRERLQAFEGVVIGKRNRSLNSAFTVRKISHGIGVERTFQTYSPLVDSIEVKRRGDVRQAKLYYLRELSGRAARIKEKLSR

SEQ ID NO: 44454 - protein, 87 aa, Arabidopsis thaliana
  misc_feature (16)..(16): Xaa can be any naturally occurring amino acid
  misc_feature (55)..(55): Xaa can be any naturally occurring amino acid
MPISATMVGALLGLGXTRCTSNALRKLPYMRHPWEYVVGMGLGAVSANQTVKWRXKLKEHLDVMHAPGHSCSRPAAYSDHTTGLTTA

SEQ ID NO: 44455 - protein, 151 aa, Glycine max
RLRRRLPQIEARPKTLGKPPAPPRLAAAPDLAAVAVAVAVAMDMAAMNDPERLFFFDLACKTAKSTYDENPLDADNLTRWGGALLELSQMQNGPESLKCLEDAESKLDEALRIDPNKADALWCLGNALTSRGFFTSETVQANECFEKATGC

SEQ ID NO: 44456 - protein, 219 aa, Glycine tabacina
NGNNLPTKQAVVDLYKSNRIGKIRLYHPDEAILQALRGSNIEVILGVPNDQLQSLTNAGAATNWVNKYVKTYSQNVKFKYIAVGNEIHPGDSLAGSVLPALENIQNAISSANLQGQIKVSTAIDTTLLGNSYPPKDGVFSNSASSYIGPIVSFLARNGAPLLANVYPYFAYVGNQQTIGLDYALFTKQGKNEVGYQNLFDALLDSLYAALEKVGAPNVK

SEQ ID NO: 44457 - protein, 219 aa, Glycine canescens
NGNNLPTKQAVVDLYKSNRIDKIRLYYPDEGALQALRGSNIEVILTVPNDQLQSLTKAGAATNWVNKYVKAYSQNVKFKYIAVGNEIHPGDSLAGSVLPALENIQNAISAANLQGQIKVSTAIDTTLLGNSYPPKDGVFSGGASSYIRPIVNFLARNGAPLLANVYPYFAYVNNQQSIGLDYALFTKKGNNEVGYQNLFDALLDSLYAALEKVGAPNVK

SEQ ID NO: 44458 - protein, 269 aa, Staphylococcus epidermidis RP62A
MKFAVIGNPISHSLSPLMHHANFQSLNLENTYEAINVPVNQFQDIKKIISEKSIDGFNVTIPHKERIIPYLDDINEQAKSVGAVNTVLVKDGKWIGYNTDGIGYVNGLKQIYEGIEDAYILILGAGGASKGIANELYKIVRPTLTVANRTMSRFNNWSLNINKINLSHAESHLDEFDIIINTTPAGMNGNTDSVISLNRLASHTLVSDIVYNPYKTPILIEAEQRGNPIYNGLDMFVHQGAESFKIWTNLEPDIKAMKNIVIQKLKGEL

SEQ ID NO: 44459 - protein, 399 aa, Burkholderia pseudomallei K96243
MSSNRGVVYQGPGKVEVRKIDYPKMVDPSGRAIGHGVILKVVSTNICGSDQHMVRGRTTAPVGLVLGHEITGEVIEVGRDVETLKIGDLVSVPFNVACGRCAMCKEQHTGVCLNVNPARAGGAYGYVDMGGWIGGQAEYVLVPYADFNLLKFPDRDRAMAKIRDLTCLSDILPTGYHGAVTAGVKPGSTVYVAGAGPVGMAAAASARLLGAACTIVGDMNAERLAHAKAMGFEVVDLSKDATLGEQIEQILGKPEIDCAVDCVGFEAHGHGSSGHAQEAPATVLNSLMEITRPAGAIGIPGLYVTDDPGAVDVAAKHGSLSIRFGLGWAKSHSFHTGQTPVLKYSRNLMQAILFDRLPIAEIVNVAVISLDDAPEGYKKFDGGAPRKFVIDPHGMLKAA

SEQ ID NO: 44460 - protein, 153 aa, Frankia sp. FE141
ITREEYSRDPRNTAKKAESYLRGTGFADTAYFGPEAEFYIFDDVRYDYNPYGSLHAVDSIEAAWNTARKEEGGNLGYKPRFKGGYFPVPPTDHFTDLRSEMSRALIRAGITVEMQHHEVGTAGQAEIDIRYDTLLRTADNLMLYKYIIRNVAL

SEQ ID NO: 44461 - protein, 142 aa, Capsicum chinense
MASKKTTTLALFILVNLLFFSLVSACGTCPSPKPKPKPKPKPTPTPKPTPSPGSKGKCPIDALKLGICANVLGNLLGVVLGNPPKKPCCSLIQGLVDLEAALCLCTALKANILGINLNVPISLSLLLNVCGKKVPSGFQCPN

SEQ ID NO: 44462 - protein, 218 aa, Magnetococcus sp. MC-1
MCKTPISNFLTQLKQGHQQFLRDELPNHLALFQRLSAEGQNPRAAVVACSDSRIHPNMITQSSPGELFIIRNVANLVPPHDPDGGYHGTSAALEYAVRVLNVEAIIILGHSCCGGVRALSQDCCEKVGADGSDFIGKWMEIAWNDAHVQQLALTAAKTGQHRPLEERMVTLSIHNLRGFPFIHQRETAGTLELIGLYFNIAEGRLYRYEPSIDAFEPL

SEQ ID NO: 44463 - protein, 159 aa, Frankia sp. FE2
ITREEYSRDPRNTAKKAEAYLRGTGFADTAYFGPEAEFYIFDDVRYDYNPYGSLHAVDSIEAAWNTARKEEGGNLGYKPRFKGGYFPVPPTDHFTDLRSEMTRALIRAGITVEMQHHEVGTAGQAEIDIRYDTLLRTADNLMLYKYIIRNVALSRGKTV

SEQ ID NO: 44464 - protein, 159 aa, Frankia sp. FE138
ITREEYSRDPRNTARKAEAYLRGTGFADTAYFGPEAEFYIFDDVRYDYNPYGSLHAVDSVEAAWNTARKEEGGNLGYKPRFKGGYFPVPPTDHFTDLRSEMTRTLIRAGVTVEMQHHEVGTAGQAEIDIRYDTLLRTADNLMLYKYIIRNVAVARGKTV

SEQ ID NO: 44465 - protein, 205 aa, Zea mays
  misc_feature (107)..(107): Xaa can be any naturally occurring amino acid
  misc_feature (117)..(117): Xaa can be any naturally occurring amino acid
  misc_feature (189)..(189): Xaa can be any naturally occurring amino acid
DGRIPCPYDVRVRMKAVGICGSDVHYLREMRIAHFVVKEPMVIGHECAGVVEEVGAGVTHLSVGDRVALEPGVSCWRCRHCKGGRYNLCEDMKFFATPPVHGSLANXVVHPADLCFXLPDGVSLEEGAMCEPLSVGVHACRRAGVGPETGVLVVGAGPIGLVSLLAARAFRAPRVLVVDVDNPRLAVAXSGADAAVRVSPPRRPV

SEQ ID NO: 44466 - protein, 228 aa, Bordetella parapertussis 12822
MDIERVEQVRAVERLAHRRGLALMPRAGLAAADFVAARLPAGAQVLALAGPGNNGGDVLVAATLLQARGYRVAVVMPAGPARLPDDARRAWQDWCAAGGQASADLPAHAPALVIDGLFGIGLARPLGGAWQGLIDQVNAWRVPVLALDVPSGLSAASGQPLGDPPGRPVRATWTLSFIGVPAALRAPGAAAWCGEQYLSLLGLTPAFLAEAVGPCGQATATAARRSGP

SEQ ID NO: 44467 - protein, 159 aa, Frankia sp. FE37
ITKEEYSRDPRNTAKKAEAYLRGTGFADTAYFGPEAEFYIFDDVRYDYNPYGSMHAVDSVEAAWNTARKEEGGNLGYKPRFKGGYFPVPPTDHFTDLRSEMVRALFRAGITVEMQHHEVGTAGQAEIDIRYSTLLRTADNLMLYKYIIRNVALSRGKTV

SEQ ID NO: 44468 - protein, 202 aa, Ustilago maydis 521
MSHAQDPTIGDDELATTATAGYKVGEKKSLAEYSQLDAEDESLARWKASLGIGASTSAVDPNAPKLSLHSLSLVSPTAPGGSISINLQQPKEQLAQIKQNPLSVKEGVEYSVKIRFSVGSDILSGLKYVQVVKRAGIKVDKMEEMIGSYGPRPEPYEKTFASSEAPSGMMARGNYSVRSRVVDDDNHVFADWEWAFKIAKDW

SEQ ID NO: 44469 - protein, 387 aa, Pseudomonas sp. 'TAC II 18'
MTVLKMTDLDLQGKRVLIREDLNVPVKDGVVTSDARILASLPTIKLALEKGAAVMVCSHLGRPTEGEFSAENSLKPVADYLSKALGREVPLVSDYLNGVDVKAGDIVLFENVRFNKGEKKNADELAKQYAALCDVFVMDAFGTAHRAEGPTHGVAKFAKVAAAGPLLAAELDALGKALGAPAKPMAAIVAGSKVSTKLDVLNSLSQICDLLIVGGGIASTFLAAAGHPVGKSLYEPDLLDTARAIAAKVNVPLPTDVVVAKEFAESAEATVKLIADVAADDMILDIGPQTAEHFAQLLKTSKTILWNGPVGVFEFDQFGNGTKVLAKAIADSAAFSIAGGGDTLAAIDKYGVADQISYISTGGGAFLEFVEGKVLPAVEVLESRAKA

SEQ ID NO: 44470 - protein, 170 aa, Prochlorococcus marinus str. AS9601
MKKLEDLILTYKDFPKKGIEFKDVLEILQYPDIFQDIILKMSSNQFLKKAEAIISIDARGFIFGSAVALESSKPMIVARKPGKLPGQLLTREYDLEYGKNSLSIQVNALKKFNSFVIVDDLLATGGTVKSVSRLIRDQKKKILGLITVVELKSLKGKSKLDFPVHSIVTL

SEQ ID NO: 44471 - protein, 331 aa, Thermus thermophilus HB27
MKVGINGFGRIGRQVFRILHERGVEVALINDLTDNKTLAHLLKYDSTYGRFPGAVGYDEENLYVDGKAIRATAIKDPREIPWKQAGVGVVVESTGVFTDGEKARAHLEAGAKKVIITAPAKNEDITVVLGVNHEQYDPAKHHIISNASCTTNSLAPVMKVLEEAFGVEKALMTTVHSYTNDQRLLDLPHKDLRRARAAALNIIPTTTGAAKATALVLPSLKGRFDGMALRVPTPTGSISDITALLKREVTAEEVNAALKAAAEGPLKGILAYTEDEIVLRDIVMDPHSSIVDGKLTKAIGNLVKVFAWYDNEWGYANRVADLVELVLKKGV

SEQ ID NO: 44472 - protein, 390 aa, Thermus thermophilus HB27
MRTLLDLDPKGKRVLVRVDYNVPVQDGKVQDETRILESLPTLRHLLAGGASLVLLSHLGRPKGPDPRYSLAPVGEALRAHLPEARFAPFPPGSEEARREAEALRPGEVLLLENVRFEPGEEKNDPELSARYARLGEAFVLDAFGSAHRAHASVVGVARLLPAYAGFLMEKEVRALSRLLKDPERPYAVVLGGAKVSDKIGVIESLLPRIDRLLIGGAMAFTFLKALGGEVGKSLVEEDRLDLAKDLLGRAEALGVRVYLPEDVVAAERIEAGVETRVFPARAIPVPYMGLDIGPKTREAFARALEGARTVFWNGPMGVFEVPPFDEGTLAVGRAIAALEGAFTVVGGGDSVAAVNRLGLKDRFGHVSTGGGASLEFLEKGTLPGLEVLEG

SEQ ID NO: 44473 - protein, 154 aa, Glycine max
  misc_feature (93)..(93): Xaa can be any naturally occurring amino acid
  misc_feature (110)..(110): Xaa can be any naturally occurring amino acid
  misc_feature (120)..(120): Xaa can be any naturally occurring amino acid
  misc_feature (131)..(131): Xaa can be any naturally occurring amino acid
MASEQTFIMIKPDGVQRGLIGEVISRFEKKGFYLKGLKLQNVEKSFAEQHYADLSSKPFFAGLVEYIVSGPVVAMVWEGKSVVSTGRKIIGAXTTPLASEPGTIRGDFAXDIGRNVIHGXSDSVESARKEXSALWFPLEGHCKGEGAPSHTWIQ

SEQ ID NO: 44474 - protein, 286 aa, Zea mays
MAQGINFPDFIGAVGGHDGGVDFGGNFCDMAFYQKLGEGTNISVDSLNSMQTSMHGGSIAMSVDNNSSVGSNSDSRTGMLGHPGLKGPAIVGSYSVGHSIFRPGRVSHALSEDALAHALMDNKFPTETLKDYEEWTIDLGKLHLGMPFAQGAFGKLYRGTYNGMDVAIKLLERPEADPEKAQLLEQQFVQEVMMLATLRHHEYCQVHCKRQNRSVPLKLAVKQALDVARGMAYVHGLGFIHRDLKSDNLLISGDKSIKIADFGVARIEVKTEGMTPETGTYRWMAP

SEQ ID NO: 44475 - protein, 379 aa, Photobacterium profundum SS9
MSTTKPPLLWLNVFIFSFSLAVAAIGTPLYAYFIGFDWTQVAMLVVAFSYCGLSITAGYHRLWSHKTYEANAVMRFIFAIGGAFALQNSILHWSSDHRVHHRHVDNNDKDPYSAKMGFFYSHIGWMLREYQASRYTDYSNCRDLQKDKIVMWQDKYYGILAIVTNFGFPLIFGVVHGDIWGALLLVGVVRLVLSHHTTFFINSLAHVWGSQPYSDKNTARDNGILAYLTFGEGYHNYHHIFENDYRNGIRWWQFDPTKWLIKSCSYFGFTRKLRVSPEDRIEKARAKMQLVRLQAKLTATSNANNCDVQARIRLLEEEYELLMSKISDYYAAKKRMVELKKKHLTKHYENFEFMQQYNDMKLHLQEQRKSWKMLTAQYA

SEQ ID NO: 44476 - protein, 908 aa, Oryza sativa (japonica cultivar-group)
MGSSRFVLLLLLLLAVAACVARGQGGGNSSSAAAPAPAAGAGPFVPRDDILLDCGATGKGNDTDGRVWSGDAGSKYAPASLGSASAAGQDPSVPQVPYLTARVSAAPFTYSFPLGAGRKFLRLHFYPANYSSRDAADARFSVSVPAANVTLLSNFSAYQTATALNFAYIVREFSVNVTTPTMELTFTPEKGHPNAYAFVNGIEVVSSPDLFDISTPNLVTGDGNNQPFPIDAGTALQTMYRLNVGGQAISPSKDTGGYRSWDDDSPYVFGAAFGVSYPKDDNVTIAYPSNVPEYVAPVDVYATARSMGPDKNVNLAYNLTWIMQVDAGFTYLVRLHFCEIQYPITMINQRVFNIYINNQTAFQGADVIAWTNNNGIGSPVYQDFVVTTVGSGAMDLWVALYPDVQAKPQYYDAILNGLEVFKLPLSNGSLAGLNPVPTVEPSLDGGAVKKSSVGPIVGGVIGGLVVLALGYCCFMICKRRSRVGKDTGMSDGHSGWLPLSLYGNSHSSGSAKSHTTGSYASSLPSNLCRHFSFAEIKAATNNFDESLLLGVGGFGKVYRGEIDGGVTKVAIKRGNPLSEQGVHEFQTEIEMLSKLRHRHLVSLIGYCEEKNEMILVYDYMAHGTLREHLYKTKNAPLTWRQRLEICIGAARGLHYLHTGAKHTIIHRDVKTTNILLDEKWVAKVSDFGLSKTGPSMDHTHVSTVVKGSFGYLDPEYFRRQQLTEKSDVYSFGVVLFEVLCARPALNPTLAKEEVSLAEWALHCQKKGILDQIVDPHLKGKIAPQCFKKFAETAEKCVSDEGIDRPSMGDVLWNLEFALQMQESAEDSGSIGCGMSDEGTPLVMPGKKDPNDPSIESSTTTTTTTSISMGDQSVASIDSDGLTPSAVFSQIMNPKGRHIQLNIITIRNR

SEQ ID NO: 44477 - protein, 803 aa, Oryza sativa (japonica cultivar-group)
MAHAFAGGTSAICRCPHDPGRAALVSRPRHRLRVLASSLPTPAIEGQGVELSVTTRRGRVLPVLKDCSLRVPPGQLWMLLGPNGCGKSTLLKVVMPTVESDVAFGLGKLNLSLDERPIQTLSGGQKQRVAIAGALAEASKVLLLDELTTFLDEYDQMGVIKAVRKSVGAGGEVSALWVTHRLEELRYADGAIYMEDGQTIIQGRLTPKPPSITFTHDYTSRAPKSCLIRYPAAVFAVKSKNPSSHQSRRRKSKHLRMRCIRQIVFSQRERYIRPVGVEIRRLRGDLPTTPRPVRSPSLYQAAAAAEGGPPAARGRGALAHLARLVLGGIVRPIQALGQILSPAAATVSRRSAAPPAAPAPAAADVSHHSPSEVLRSFKELRRLHIELPTGELGIEDGVLLKWKADFGSTLGSCVILGASSVTSKPPPPPAAPPPTAADSSAASPDSSREPDELGNIPESLYTNGGLKLRVVWTISSLIAASARHYLLQPIIADHSTLESLDLTDADGQGVLTMDKRQLQELRVRPVSASGNSHRTLMPALSMRLWYAPHIELPGGQLLKGATLELRRLHIELPTGELGIEDGVLLKWKADFGSTLGSCVILGASSVTSKPPPPPAAPPPTAADSSAASPDSSREPDELGNIPESLYTNGGLKLRVVWTISSLIAASARHYLLQPIIADHSTLESLDLTDADGQGVLTMDKRQLQELRVRPVSASGNSHRTLMPALSMRLWYAPHIELPGGQLLKGATLVAIRPSEDVLREGGGIEVAGPTGASWILDAFEEPYRTAAQVLLKRRTYSLEMNSF

SEQ ID NO: 44478 - protein, 518 aa, Callistephus chinensis
MTILPFIFYTCITALVLYVLLNLLTRNPNRLPPGPTPWPIVGNLPHLGMIPHHSLAALAQKYGPLMHLRLGFVDVVVAASASVAAQFLKTHDANFASRPPNSGAKHIAYNYQDLVFAPYGPRWRMLRKICSVHLFSTKALDDFRHVREEEVAILTRVLVHAGESAVKLGQLLNVCTTNALARVMLGRRVFADGSEGRGVDPKADEFKDMVVELMELAGEFNIGDFIPPLDCLDLQGITKKMKKLHARFDKFLNIILDDHKIEKGAAGRRHSDLLTTLISLKDVDAADDDEEGKLSDIEIKALLLNLFAAGTDTSSSTVEWAVAELIRHPELLKQAREEMDIVVGRDRLVTELDLSRLTFLQAIVKETFRLHPSTPLSLPRMASESCEVDGYYIPKGSTLLVNVWAIARDPKMWTNPLEFRPSRFLPGGEKPDADIKGNDFEVIPFGAGRRICAGMSLGMRMVQLLIATLVQTFDWELANGLDPEKLNMEEAYGLTLQRAEPLMVHPRPRLSPHVYESR

SEQ ID NO: 44479 - protein, 429 aa, Mesorhizobium loti MAFF303099
MKDIMKNSAISERKNQSISRGVGMTTQIYADRAENSEIWDVEGRRYIDFSSGIAVVNTGHRHPRVIEAVKAQLDRFTHTCHQVVPYESYVRLAERLNAMLPGKFEKKTIFVTTGAEAVENAIKIARNATGRPAVIAFAGGFHGRTFMGMALTGKVVPYKVGFGAMPGDVYHAPFPVPLHGVSVADSLAALDRLFKADVDPARVAAIIVEPVQGEGGFYEAPREFLTALRKLCDQHGMLLIADEVQTGFARTGKMFAMDHHEVAADITTMAKSLAGGFPLSAVTGRAEIMDAPGPGGLGGTYGGSPIGVAAAHAVLDVIEDEKLCDRANTLGARLKQRLQSIRDDVPEIVDIRGLGFMNAVEFNDVKKGMPSAEIANAIRLKALDKGLILLTCGVYGNVIRFLAPITIQDEVMNEALDILESSIREVCAA

SEQ ID NO: 44480 - protein, 417 aa, Mesorhizobium loti MAFF303099
MKNGVVIVGAGHAGVQAAASLREDGYDGPVILIGDENELPYHKPPLSKTFIKDAEAKPQPLRGEAFYTGSVIDYRPGVRIERIDAGGHSLEISGGGVLAFDHLILATGSRPRLLPLPGSDLSGVLSLRSLADARLIRDLSARSEDVVILGGGFIGLEIAATLRAAGRTVTVVEAVDRLLGRAVAPVVASHVRQRLEATGVRILTGTSIARLEGENGHVVAAITSSGEKLPARMVIVGIGAVPNVELAQDAGLTIANGIRVDHQMRSSVQDILAIGDAASYRHWFTGGDVRLESVQNATDQARLAARTITGHADAYSAVPWFWSDIGDMKLQMVGLTAGGDSHVVLGDLPDNKFSIYHYAGDRLLGIESVNRPGDHMLGRKMLGAGFSPTPEMVAAGPDGLKAALAAFQQDEPARAAG

SEQ ID NO: 44481 - protein, 510 aa, Callistephus chinensis
MSILSLLVYFCISLLVIIALVNMFITRHTNRLPPGPAPWPVVGNLPHLGAIPHHTLAALATKYGPLVYLRLGFVHVVVASSPSVAAQFLKVHDLKFASRPPNSGAKHIAYNYQDMVFAPYGPQWTMFRKICKDHLFSSKALDDFRHVRQEEVAILARGLAGAGRSKVNLGQQLNMCTANTLARMMLDKRVFGNESGGDDPKANEFKEMATELMFLAGQFNIGDYIPVLDWLDLQGIVKKMKKLHTRFDKFLDVILDEHKVIASGHIDMLSTLISLKDDTSVDGRKPSDIEIKALLLELFVAGTDTSSNTVEWAIAELIRQPHLLKRAQEEMDSVVGQNRLVTEMDLSQLTFLQAIVKEAFRLHPSTPLSLPRIASESCEVDGYYIPKGSTLLVNIWAIGRHPEVWTDPLEFRPTRFLPGGEKPGIVVKVNDFEVLPFGAGRRICAGMSLALRTVQLLMGTLVQAFDWELANGIKPEKLNMDEAFGLSVQRAEPLVVHPRPRLPPHVYKSG

SEQ ID NO: 44482 - protein, 511 aa, Lycianthes rantonnei
MVLLLISELCASAIIFIIVHIIISKLIATGWGRRQRLPPGPMGWPVIGALPLLGTMPHVALAKMAKKYGPIMYLKVGTCGMVVASTPNAAKAFLKTLDINFSNRPPNAGATHLAYDAQDMVFAHYGPRWKLLRKLSNLHMLGGKALEDWANVRANELGHMLKSMFDASRVGGRVVVADMLTFAMANMIGQVILSKRVFVEKGAEVNKFKDMVVELMTVAGYFNIGDFIPQLAWMDLQGIEKGMKCLHKKFDDLLTKMFDEHKATTNERKGKPDFLDVVMANRDNSEGERLSTNNIKALLLNLFTAGTDTSSSAIEWALAEMMKNPQILKKVQQEMDQIIGKNRRLIESDIPNLPYLRAVCKETFRKHPSTPLNLPRISNEPCMVDGYYIPKNIRLSVNIWAIGRDPDVWENPLEFNPERFLSGKNVKIDPRGNDFELIPFGAGRRICAGTRMGIVMVEYILGTLVHSFDWKFSNDVKEINMEESFGLALQKAVPLEAMVTPRLPFDVYYTN

SEQ ID NO: 44483 - protein, 657 aa, Rhodobacter sphaeroides
MKDIGAAQETRMANAIRALAMDAVEKAKSGHPGMPMGMADVATVLFNRFLTVDPSAPKWPDRDRFVLSAGHGSMLLYAIHHLLGYADMDMDQIRSFRQLGARTAGHPEYGHAEGIEVTTGPLGQGIATAVGMALAERMKNARYGDDLVDHFTYVIAGDGCLMEGISHEAIDMGGHLGLGRLIVLWDDNRITIDGDSGISTSTDQKAPFAASGWHVLACDGHAPEEIAAAIEAARRDPRPSMIACRTVIGYGAPNKQGGHDVHGAPLGAAEIAAARERLGWDHPPFEIPADLYEAWGRIAARGADARAAWETRLQASPLRAAFETAEAADTSALPPAIAAYKARLSAEAPKVATRKASEMALGVVNEALPFAVGGSADLTGSNLTRSKGMVSVAPGAFAGSYIHYGIREHGMAAAMNGIALHGGLRPYGGTFMAFADYCRPSIRLSALMGVPVTYVMTHDSIGLGEDGPTHQPVEHLASLRAIPNLAVIRPADAVETAEAWEIAMTATSTPTLLVLSRQNLPTVRTEHRDENLTARGAYLLRDPGERQVTLIATGSELELALAAADLLAAEGIAAAVVSAPCFELFAAQPADYRATVLGRAPRVGCEAALRQGWDLFLGPQDGFVGMTGFGASAPAPALYQHFNITAEAIVKSAKERI

SEQ ID NO: 44484 - protein, 750 aa, Ustilago maydis 521
MPSLVSSPGTSTMQTDNVHEPSSAFATPPTQSTSSFASGSNTPSHQIRLNGQSSGIGESPAPHSSRPYHSSSHASQSNGAGTGKDKKWKQMFKFGSIGRKASGNASNDRSWHTDSAESSMHKNGDYFEHVQYTGSQPGSTSFQPISGSTVVNDPASFSNDSYSSEDRNASGSIGDAMTTSASSKLQPPADISDTDSSHPRFTSRLMRRVSSAPDTNKLFKNGQNATQKPNEAASSTKNGYLSPDGAGGQHAQFVSEGGAPFTPSKELANAAFFSNSPVRMDSNATSFSYKDFEKGRSVSAKGSSTPKSGRIVFPGTGRSKSSNGKDKKSQLPPPSSSANLAALAGTASVNRGPGSFRRTYSSNSIKVKEVEVGPNSFSKVKMLGKGDVGKVYLVREKKTDKLYAMKVLSKKEMIKRNKIKRVMAEQEILAASNHPFIVTLYHSFQSEDYLYLCMEYCMGGEFFRALQTRPGKCLPEEDAKFYAAEVIAALEYLHLMGFIYRDLKPENILLHQSGHVMLSDFDLSARATQRGGAPAMIRQATPNSAPLVDTRSCIADLRTNSFVGTEEYIAPEVIKGCGHTSAVDWWTLGILIYEMIFATTPFKGSTRNETFSNVLRNEVQFPDSIPISSFGKSLIRKLLIKDELKRMGSQSGASEVKQHKWFSNISWGLLRNSTPPIVPAYSNGVDAVNFRNVRESRSLNLDDQGNDTRAKPAVIKAVAGQKNVGDEEGDAVVSNPFSGFSSVTLKHDDY

SEQ ID NO: 44485 - protein, 414 aa, Thermus thermophilus HB27
MDLDAFTLFERHINPGLAGLLRFTGLDRVESHAEGPYVWDTQGKRYLDFLGLYGTLNLGHRHPKVVEAVKRQLDRMPMSVRVLVSEPTARLAAKLAEITPEGLEMVFFGNSGAEAVEAAIKLARAYTGKPGIVTTQGGFHGKTMGALSLTPKPEYQDPARPLLPGVKVVPYGDLKALEAAIDEDTAAVIVEPIQGEGGIRVPPEGYLRGVRELTREKGVLMIADEVQTGLGRTGRLFGVDWEGVAPDLMTLAKALGGGVMPIGACVGRREVFEVFKNNPLFHSSTFGGNPLAAAAALAAIEVTLEEDLPGRALELGRHLMEGLKALKEEHPHLIEDVRGRGLMVGVEFTDADIGALVVAEMAERGVLTAFGLNNPKVVRLEPPLIIGKEHVDEALAVFAEALKATEKALEGLLG

SEQ ID NO: 44486 - protein, 513 aa, Matthiola incana
MTTLILTILLATFLSLFIFFLLRRNRNRNHRLPPGPNPWPIVGNLPHMGPKPHQTLAAMVTTYGPILHLRLGFVNVVVAASKSVAEQFLKIHDANFASRPPNSGAKHIAYNYQDLVFAPYGQRWRMLRKISSVHLFSAKALEDFKHVRQEEIGRLTREVARADTKPVNLGQLVNMCVVNALGREMIGRRLFGDGADHKAEEFRSMVTEMMALAGVFNVGDFVPALDWLDLQGVAGKMKRLHKRFDAFLSSILKEHEINNGGDQKHTDMLTTLISLKGTDFDGDGASITDTEIKALLLNMFTAGTDTSASTVDWAIAELIRHPHIMKRTQEELDAVVGRNRPINESDLSRLPYLQAVIKENFRLHPPTPLSLPHIAAESCEINGYHIPKGSTLLTNIWAIARDPEQWSDPLAFRPERFLPGGEKFGVDVKGSDFELIPFGAGRRICAGLSLGLRTIQLLTATLVHGFEWELAGGVTPEKLNMEETYGITVQRAVPLIVHPKPRLALNVYGVGSG

SEQ ID NO: 44487 - protein, 300 aa, Oryza sativa (indica cultivar-group)
MLPYATAAEAEAAVGRGLTWAEAAWFRYSASIPDYCLYCHNVPILLLVYTLAPLPLALLELRRHLPLPHKLQPGVRHPPAAFLRCYAATARVLLLAVGPVQLASFPAVRAVGIRTGLPLPSAGETAAQVAVYLLVEDYLGYWIHRLLHTPWAYHHIHRVHHEFTAPMGYAAPYAHWAEILILGFPAFAGPAIVPCHMTTFWLWFVLRHLEAIHIHSGFKLPFDPTKYIPLYGGVEYHDYHHFVGGHSQSNFSSVFTFCDYIYGTDRGYRYHKASLSKLKEMAGNHVEKGDENGFGNGKQD

SEQ ID NO: 44488 - protein, 294 aa, Oryza sativa (indica cultivar-group)
MEQYEKEEKIGEGTYGVVYKARDKVTNETIALKKIRLEQEDEGVPSTAIREISLLKEMHHRNIVRLHDVIHSEKRIGLVFEYLDLDLKKFMDSCPEFAKNPTLIKSYLYQILRGVAYCHSHRVLHRDLKPQNLLIDRRTNTLKLADFGLARAFGIPVRTFTHEVVTLWYRAPEILLGSRQYSTPVDMWSVGCIFAEMVNQKPLFPGDSEIDELFKIFRVLGTPNEQSWPGVSSLPDYKSAFPKWQAQALATIVPTLDPAGLDLLSKMLRYEPNKRITARQALEHEYFKDLEMER

SEQ ID NO: 44489 - protein, 976 aa, Kluyveromyces lactis NRRL Y-1140
MDPFMVSCYMMTSQKRLVEPSMRLEFNDVDDEHQAIMPQSILRSLSLEDGSNSDMSSKSTAPSSGSEESFVYDHIYKGIKGFLSRRPSFNGHGNSNNNPNKNKTSQLGGPLTYALSSNLRLESTDSGFGSFSADPLDLPLLKVTRRKRVRYTFHIDQNTISWNNGKKLIYVDTIKDIRSGDMATNYMDMYNVPCPSRDLWCTIIYSVNKNRLKALHVIAEDAAVFKSFYETTVNLVNSRRKLMEDIAVPNNEQFANIHWQTSVSTKKEDQDKDTLSFADVKRLCNRYHIYCSDNYLYALFIKADTNNNSLLNFPEFQDFVKYLKARPEIEIIWNQMKNKDTKVVDFQSFYQFICDVQGEVISQTNAYKIFKKYCTADELLDVEGLLKFLTKQPFLQLFEEDYSRPLNEYFISSSHNTYLMGKQVVDEVSVEAYTRALQQGCRCIEIDIWQGDHGPVVCHGLFTQSIPLEDVVKTIRKYAFITSPYPLIVSLEIHCKKDYQLMITKIMKEILGDLIFVIPPNTSLLSPEQLKNRIILKSKKTHAVESEIISGSTSSYTSSSSHESLSETNDMRLIKKRGLQKSTTSSTSPNTTTVPVTTKRNNKSLLLSTKIMISDKVHEISGIHGVRFRNFSLPESKTTTHCFSLSEKKFINLDKDETQKLAINKHNRRHLMRIYPHMLRYKSSNFNPIRFWKEGVQMVATNWQTYDLGQQLNHAMFQVSLDRNSIWHSGYVLKPAHLRKEIHKMKDIPVIMERLKREKIHIHLDVISGQMLSLQNCKILAPFVEIELITDNTMESLHLTNCLQPMGYTSNNSTHATGITSMSNASNGTFANITSTSTKRVDSNGSSGKTEPLCESNGTTVISGLSAEDGILSTPSAPPAVSVPVLSSPQLFSTKCFRDNGFSPVWNASFECTLTNTTFNFVRFTVKNSTQTIATTCVRLNYLKQGYRHLPLYNIKGEKFIFSTLFIRYKEELLKW

SEQ ID NO: 44490 - protein, 348 aa, Ustilago maydis 521
MAEATPIPIISLHSDDAGAPLGARILDAVVKTGFFYLTHHGINQDEIDLLFSQSAEFFLNESEAERQSHQDRNNNTGYTSMMQERLDPKSKAEGDLKESFYLAGLSRAEGGSSTVEEQYRPPSQTLPPTLSQHREAIATFIEKCKGVCDTVLAGFAEAIDLPTRYFADSHHGQHDRLRLIHYPPTAVCDSSTDTSATTSIRAGSHSDYGSCTLLFQKDVGGLQVEMQPGQWVDIPPQKGCIVVNVGDAMEFWSAGMFRSTQHRVVLPRSESESGSRFSVAYFCQPDEDARLIPLEISENVRQRCQGNLMDRDEFQKRCVAKGVSNVAELTGGQHLRARLRASYRVARS

SEQ ID NO: 44491 - protein, 357 aa, delta proteobacterium MLMS-1
MKKIAVLPGDGIGPEVMREAIKVLEAAQRKFDFTLSYDYADVGGCAIDRHGRALPHATLELCRQSDAILFGSVGGPKWESLPPEQQPERAALLPLRKEFELFCNLRPARVFPSLAAASPLKPEIVGNGFDLLVVRELTGGIYFGQPKGREGSGPEEKAFDTMIYSRREIDRIARRAFEAARLRRGIVTSVDKANVLTTMVLWREVVKEVAADYPDVTLNHIYVDNAAMQLIRNPHQFDVLLCGNMFGDIISDECAMITGSMGLLASASLNESGFGLYEPAGGSAPDITGLGIANPIAQILSAAMMLRYSFQLGQAADTIERAVAKALATDILTPDIAADPSQAVSTEEMGTAIANGL

SEQ ID NO: 44492 - protein, 146 aa, Pisum sativum
MPRSSFSGSLSSPKLDVVIDMGNPFLNLTVDGFLKIGAVAATRSVAEDTFHIIRKGSISSNDFEKSLKKMCKEGAYWGAIAGVYVGMEYGVERIRGTRDWKNAMFGGAVTGALVSAASNNKKDKIAVDAITGAAIATAAEFINYLT

SEQ ID NO: 44493 - protein, 798 aa, Oryza sativa
MSYLLPHLHSGWAVDQAILAEEERLVIIRFGHDWDETCMQGMMDEVLAAVAETIKNFAVIYLVDITEVPDFNTMYELYDPSTVMFFFRNKHIMIDLGTGNNNKINWALKDKQEFIDIVETVYRGARKGRGLFLAYSVSGPHFLHLTLSSRALRRAPPLWMTTHQKDRGDVRGHGGSVAHGEDAVEVISAAPTGTQLPVSFGARAGEERHDSRWEWSGRFERAHERGHCHLRNPHYLAGARRAKVGRGVHLDERTGREGGGGGGDQGRRGGDDLTANFFADADVMQCRTSPRCPYLRQASPFSLLAPFHRLSGVTPGERRWEGDEGRWGERRKKTAREREEGTANAEESAPAAAANHGNSRLPRSSYVPPHLRGQAAPAAPAQAGALPSAAAAAQPSVGQPGVVGGPRWAGIVNGGGGGGGGSVGGSRQGFGAGGRGGGGGGGGGAWNSRPGGWDRRDREPDPFANSEAAEVDFEGENTGINFEAYEDIPVETSGHDVPPPANTFAEIDLGDALNENIRRCKYVKPTPVQRYAIPISIAGRDLMACAQTGSGKTAAFCFPIISGIMRSRPPPRSRGSRTAYPLALILSPTRELSVQIHEEARKFAYQTGVKVVVAYGGAPITQQLRELERGVEILVATPGRLMDLLERARVSLQMIKYLALDEADRMLDMGFEPQIRKIVEQMDMPPRGERQTMLFSATFPKEIQRMASDFLADYIFLAVGRVGSSTDLIVQRVEFVLDADKRSYLMDLLHAQRANGTHGKQALTLVFVETKRGADALENWLYNNGFPATSIHGDRTQQ

SEQ ID NO: 44494 - protein, 362 aa, Burkholderia sp. 383
MTTPEAPPRMTAVVCHGPEDYRVEQVAKPRPGANELVIRIAACGICASDCKCYTGAKMFWGGPSPWVKAPVIPGHEFFGYVEALGDGAAEHFGVAVGDRVIAEQIVPCGKCRYCKSGQYWMCEVHNIFGFQREVADGGMAEYMRIPPTAIVHRIPLGVSLEDAAIIEPLSCAIHTVNRGDVQLDDVVVIAGAGPLGLMMTQVAHLKTPKKLVVIDLIDERLELAREYGADVTINPKRDDAREIVRSLTDGYGCDVYIETTGAPVGVSQGLDLIRKLGRFVEFSVFGEDATVDWSIIGDRKELDVRGAHLGPYCYPIAIDLLARGLVTSKGIVTHDFALEDWDDAIRVAKSPESIKVLLKPAR

SEQ ID NO: 44495 - protein, 253 aa, Medicago sativa
MGANVNLVFRKELPLRGFDDEMRAVVARNLEGRGINLHPRTNLTQLIKTEDGIKVTTDHGEELIADVVLFATGRAPNSKRLNLEKAGVEVDKTGAIVVNEYSCTNIPSIWAVGDVTNRMNLTPVALMEASHFANTVFGGKTQKPDYRDIPYAVFSIPPLSVVGLSEEEAVEQTNGDLLVFTSTFNPMKNTISGRQEKTVMKIVVDAQTDKVLGASMCGPDAPEIVQGIAIALKCGATKAQFDSTVGIHPSAAE

SEQ ID NO: 44496 - protein, 555 aa, marine gamma proteobacterium HTCC2207
MSDIEIARSATSQPIAEIAAKLHIPDAALIPYGRTKAKICPDHIASLKDKPDGKLILVTAITPTPAGEGKTTTSVGLTDGLNRIGKNALVCLREPSLGPCFGMKGGAAGGGYAQVVPMEDINLHFTGDFHAIGAAHNLLSALIDNHIHWGNSLEIDARRIVWKRVADMNDRALRSINCGLGGPGNGFPREDGYDITVASEVMAIFCLATDLDDLKERLNKIVVAYTRDHRPIHASEILGTGAMSVLLKDALAPNLVQTLENNPAIIHGGPFANIAHGCNSVIATKAGLKMADYVVTEAGFGADLGAEKFFDIKCRAAGLHPDAAVIVATTRALKMHGGVSKDDLDKEDLSALEEGCCNLVRHIENVKAFGVPVVVGINRFTSDTDAEIALIKKIALANGVKAIDCTHWADGGAGTEELAEEVVALVDSGHANFAPLYPDDMPIWDKVKTVATRLYRADDIIADQKIRDQIQKLQDSGYGHFPVCIAKTQYSFSTDPTLKGAPSNHVVAIREVRLSAGAGFIVVVCGDIMTMPGLPRVPAANHIDINENGEVVGLF

SEQ ID NO: 44497 - protein, 88 aa, Vigna radiata
MSQELESVEIDSLARFAVEEHNKKQNALLEFGRVVSAQQQVVSGTLYTITLEAKDGGQKKVYEAKVWEKPWLNFKELQEFKLVGEAPA

SEQ ID NO: 44498 - protein, 268 aa, Oryza sativa
  misc_feature (104)..(104): Xaa can be any naturally occurring amino acid
QTRNAETYCDTDDKLITDPLCVSLSELSSSALSKLAPLEAILFDIDGTLCDSDPIHFCAFRELLQQVGFNNGVPISEEFYSANISGGHNDDLARALFPDLDHDXKAMKFMDDKEALYRRLAPEQLVAVEGLHDLCRWIKDHKLKRAAVTNAPRSNAELMLSLLGLTEFFPVLVIGSECDRAKPFPDPYLKALELIGASPDHTFIFEDSASGIRAGVAANVPVVGLTTRNPEKVLQDAGASLLIKDFQDPKLLSILEEIEPTVAAVEQV

SEQ ID NO: 44499 - protein, 253 aa, Mesorhizobium loti MAFF303099
MAQSRFKQRTVLITGAGTGMGRAAALRLAEEEAHLVLVGRRPEPLERLVSDIEAASGTAMAITCDISRGDAVAAAVEKTIARFGRLDALFANAGVLGEFKPLADTETDDFDGLIATNLRGTFLTIKHCLPFLEGGAVLINASWTASSVMPGAGAYASTKGALLAMMRTLAVEQGPRNIRVNAINPGIILTPMADDVLSPDLAARLAAHTALRRNGTPEDVAGTVAWLLSDDAAFVTGQEIMVDGGYTIGGLRL

SEQ ID NO: 44500 - protein, 427 aa, Thermus thermophilus HB27
MEGMERPISEAYFQEAKRHIPGGVSSPVRAFKAVGGTPPFLVRGEGAYVWDADGNRYLDYVMSWGPLILGHAHPKVLARVRETLERGLTFGAPSPLEVALAKKVKRAYPFVDLVRFVNSGTEATMSALRLARGYTNRPYIVKFRGNYHGHADGLLVEAGSGALTLGVPSSAGVPEEYAKLTLVLEYNDPEGLREVLRRRGEEIAAIIFEPVVGNAGVLVPTEDFLKALHEAREFGVLLIADEVMTGFRLAFGGATELLGLKPDLVTLGKVLGGGLPAAAYAGRREIMEKVAPLGPVYQAGTLSGNPLAMAAGLATLELLEENPGYYRYLEDLGARLERGLKEVLAQKGIPHAVNRVGSMVTVFFTEGPVVTFQDAKRTDTELFKRFFHGLLDRGIYWPPSNFEAAFLSVAHTEEDVEKTLEALGEAL

SEQ ID NO: 44501 - protein, 324 aa, Pseudomonas syringae pv. syringae B728a
MNQSSDLIQSAQRTIRLEIEAMQGLLERLDGDFVRACEMILASKGRVVVVGMGKSGHIGNKIAATLASTGTTSFFVHPAEASHGDMGMITRDDIILALSNSGSTNEIVTLLPLIKRLGIKMISLTGDPESILAKAADINLNAHVVHEACPLNLAPTSSTTAALVMGDALAVALLDARGFTAEDFAFSHPGGALGRRLLLKVENVMHSGESLPSVQRGTLLRDALLEMTRKGLGMTAIVEADGTLAGIFTDGDLRRTLDRPVDIRQTIIDEVMTLHGKTAHAEMLAAEALKIMEDNKISALVVVDQNDRPVGAFNLQDLLRAGVM

SEQ ID NO: 44502 - protein, 326 aa, Thermus thermophilus HB27
MRVLNLVQAINEALDLALSRDERVLVFGEDVGRLGGVFRVTEGLQAKYGEKRVFDTPLAESAILGMAIGLAMGGMRPVAEIQFAGFLYPALDQILSHLGRWRHRSRGRVGLPVVVRAPYGGGVHTPEQHADSPEALLCHTPGVKVVIPSSPERAKGLLLSAIEDEDPVFFLEAIKLYRGARAEVPEGYYTLPLGKARVLREGKAATLIGYGGMVEVMLEAAEVAQREGVEVTVVDLETLVPLDEETLLEAVRATGRAIVVYEAMRTGGFGAEIAARIAEGAIDHLQAPVLRVAGYDAPYPPFSAIEHLYRPNARRVLAALRKALTY

SEQ ID NO: 44503 - protein, 334 aa, delta proteobacterium MLMS-1
MGIKVAINGFGRIGRSIFRAIELDPTFKEIEIVAINDLTPPATLAHLLKYDSVMGIYPHEVKAGDGEIRVDDHPVRVYNQRDPKELPWGELGVEYVIEATGLFTDSDKAQAHLDAGAKKVVISAPAKGQVKTIVMGVNEEDYDPATDHIVSNASCTTNCLAPVAKVIVERFGIKSGLMTTVHAYTGDQRLLDFPHNDLRRARAAAMSMIPTKTGAAAAVALVLPELKGKFDGLAVRVPTPNVSLVDVVMELEQETTVTEVNEALKQATNRYLGYSEEPLVSIDYQGDPRSSVVDAISTKVLGSTVKILSWYDNEWGYSNRVLDLILHMEENRTL

SEQ ID NO: 44504 - protein, 400 aa, Arabidopsis thaliana
MNNLDEIKIESKTCLNDQEQEVKIDNMHMSDQDKNKIEIKNKSGLGEKWPEPIVRVQSLAESNLTSLPDRYIKPPSQRPQTTIIDHQPEVADINIPIIDLDSLFSGNEDDKKRISEACREWGFFQVINHGVKPELMDAARETWKSFFNLPVEAKEVYSNSPRTYEGYGSRLGVEKGAILDWNDYYYLHFLPLALKDFNKWPSLPSNIREMNDEYGKELVKLGGRLMTILSSNLGLRAEQLQEAFGGEDVGACLRVNYYPKCPQPELALGLSPHSDPGGMTILLPDDQVVGLQVRHGDTWITVNPLRHAFIVNIGDQIQILSNSKYKSVEHRVIVNSEKERVSLAFFYNPKSDIPIQPMQQLVTSTMPPLYPPMTFDQYRLFIRTQGPRGKSHVESHISPR

SEQ ID NO: 44505 - protein, 167 aa, Zea mays
  misc_feature (25)..(25): Xaa can be any naturally occurring amino acid
  misc_feature (27)..(27): Xaa can be any naturally occurring amino acid
  misc_feature (31)..(31): Xaa can be any naturally occurring amino acid
  misc_feature (39)..(40): Xaa can be any naturally occurring amino acid
  misc_feature (43)..(43): Xaa can be any naturally occurring amino acid
  misc_feature (76)..(76): Xaa can be any naturally occurring amino acid
  misc_feature (121)..(121): Xaa can be any naturally occurring amino acid
MALAEADDGAVVFGEEQEALFSLSXAXMKKXGGHFFFSXXLKXFEIAPGAKQTPPLLRDSERAAGEEPPKLKTHAXSVFVMTCEAAAQLRMAGKVPGWETPLQRLGAPPLRYGVADGHFEXVTGFALLETIKEALPADMWSLEMKKAWAEAYSQLVAAIKREMKPDA

SEQ ID NO: 44506 - protein, 430 aa, Xanthomonas campestris pv. vesicatoria str. 85-10
MTTIAKILAREILDSRGNPTLEAEVTLDDGSFGRAAVPSGASTGTKEAVELRDGDKTRYLGKGVRHAVDNVNGTIAETLKNFDAADQQGLDRRLIDLDGTENKGRLGANALLGVSLAAAHAVAASRKQPLWQYLSTITESDVALPVPMMNIINGGAHADNNVDFQEFMVLPVGCSSFSEALRAGTEIFHSLKSVLKGHGLSTAVGDEGGFAPDFRSNVEALDTILEAIGKAGYTAGEDILLGLDVASSEFYDNGKYNLVGENKRLTSEQFVDFLADWVAQYPIISIEDGLAEDDWAGWKLLTERVGKKVQLVGDDLFVTNPKIFKQGIDSGTANAILIKVNQIGTLTETLEAIAMAHAAHYASIVSHRSGETEDTTIADIAVATTATQIKTGSLCRSDRVAKYNQLLRIEQALGSGARYAGRDAFVSLKR

SEQ ID NO: 44507 - protein, 1394 aa, Photobacterium profundum SS9
MPRTIKRQSMINVTIDGQKFPVNAQQTLLEAAADCNIEIPSLCGLNKNGEKVPCELCVVDVAGQGIQRACEILPVENMIVTTVSEELSSLRQTALNRILSDHYADCEAPCQTACPAGVDIQSYLYHISQDDHVKAVEVIKRTLPMPLSIGRVCPAFCETECRRGLVDEPIAIRQLKRHAADIDLAAQENYVPPKKASKGMSIAVVGSGPGGLTCGYYLTNEGYDVTVFESMPEAGGWLRYGIPEYRLPKAILAKEIELMCRNGMQVLTSKKLGDDFTLTQLTEDYDAVCLAVGASQAVEMNYTGSDLNGCYLGVDYLKDYVTEGCYITGKKVAVIGGGNTAIDCARTAVRDGADTTLIYRRTRDEMPAEDYEIVEAEHEGVKFHFLTNPVENIADANGHVCEIKLEKMALGEADASGRRRPEPTGKYFTEAFDTVIAAVSQKPDLSFMDKEELDLPLTRWNTQDANPNTMHSGLGNVFSIGDFRRGPATAIEAVADGRIAAEAIDRFFDGDMENIPVKLFNSQKERKLKQVAPEQFVEIKKVMRSVMPELSTKERELSFSEVETGFNNDEAMREAARCLECGCQANTDCKLRDYATEYDVAETELTNESCQKFHVDDSSEFIVFDANRCISCGQCVEACNEKAVHGTLSFAKNADGSSASRPECRPGFDKGYSMGDSNCVQCGACVQVCPTGALVDKRDKSQGRIEMLKPVETICTYCGVGCKLTMYVDESLNQIRYVQGVKDSPVNQGMLCVKGRFGFDFVNSKERLTTPLIRKNGELQPASWEEAISLVADKFNAIKADRGGNALAGFSSAKTTNEDNFAFQKFIRRELETNNVDHCARLCHASTVTGLEASIGSGAMTNDIPSIKFSDVVFIIGSDTTAAHPIIASHIKQAIRTGKTRLIVADPKRIDIADHSDLYVAHRPGTDVMLMNGIMQQIIKNDWHDKTYINERTEGFEALKAEVMLDSYAPDKVELVTGVKAQDVIKIAQMIGTANRTAVYYSMGITQHTTGHDNVRSVANLQMLCGNIGIEGGGINPLRGQSNVQGACDMGALPNNFPGYQKVQVPEIHAKFAKAWNKPNLPKEDGLTLTEIIDAACHDQVKGLYVMGENPVLSDPNQAHVIEGLEKLDFLVVQDIFLTETAQYADVVLPSCSFAEKSGHFTNTERRVQRISPAVNPPGEAKEDWWIIQSIANAMGSDWAYQSVKDITEEITQLTPQYAGIHWDRVGRDGLQWPCNDNAPDGTRVMHTSQFTRGKGEMAAIPFRYAAELPDAEYPLILTTGRLLEQFHTGSMTRKTKGLDNLAGPRAMISVVDAERLGVRNGEMLKVSTRRGSIETPAFVTKRMQEGVVFVPFHFAEAPANRLTTTATDPHAKIPEFKVAAVKIEKVRVLVETC

SEQ ID NO: 44508 - protein, 1072 aa, Thermoanaerobacter tengcongensis MB4
MPKYKDISKVLVIGSGPIIIGQAAEFDYSGTQACKSLKEEGVQVVLVNNNPATIMTDTDIADIVYIENPTVEVVEKIIAKERPDGILATLGGQTGLNLAVKLKEAGILDKYNVKLLGTSVESIKTAEDRELFKRKMQEIGEPVAESVTVTNVEDALKFAKNYGYPLIIRPAYTLGGTGGGIAHNDEELISIVDLGLKKSMVGEVLVEKSLYGWKEIEFEVMRDAADNCITICSMENFDPVGVHTGDSIVVAPAQTLSDYEYQMLRSASIKIIRALKIEGGCNIQFALDPQSHKYYVIEVNPRVSRSSALASKATGYPIAKIAAKIAIGLRLDEIKNPVTGKTTAFFEPALDYVVTKIPRWPFDKFYTTDRRIGTQMKATGEVMAIERSFEASLLKAVRSLEIKAYGLRLDSVRGMGTKEILEDISVPNDMRLFYIAEALRRNIDIDYINDVTKIDKWFLNKLSNIVNMEKEIEENELSKEILKKAKRMGFSDREIATIKGIKEEDVRTLRKKYGIYPSYKMVDTCAAEFESITQYIYSTYCEEDEVETHDIPKVIVIGSGPIRIGQGIEFDYCSVKALWALKETGIKSIIINNNPETVSTDFDTGDRLYFEPITLEDVLNIYEKEKPLGVMVMFGGQTAINLTEELVKNEVKILGTSFKSIDISEDREKFSKLLKELNINQPKGGYALTVEDAKDIALKLGFPLLVRPSYVIGGQSMEKVNTLQELIDYVKHATEVSPGKPVLIDKYIDGREVEVDAVSDGECVLIPGIMEHIERTGVHSGDSFSIYPARNLTEREINTIIEYTEKISKALNVKGLINIQFAVKEGTVYVLEVNPRASRTVPIMSKATGVPMVKLAVEVALGKKLKELGYKGGLWPQTPYTVVKAPVFSMEKLTDVEVSLSPEMKSTGEIMGIDLSYEGALYKALEGAGLKIPKKGKILLSIAERDFQEAVSLVEKLQSLGYEIYATYRTGKYFSLMGIHANIMSLDHAIKLLKNGYFDAVVNTPTKGKKPDNAGFKLRRTAVEYRIPLFTSIDTIKAALNAVSKVNVNGLSVLSMNEYQEIQKDNVKNLVL

SEQ ID NO: 44509 - protein, 78 aa, Medicago sativa
SSLYRRTLPPPSIEFASPEGKKIFTEALQNGTMNGFFKLISYYQTQSDPAFCGLATLSVVLNALAIDPGRKWKGPWRW

SEQ ID NO: 44510 - protein, 613 aa, Thermoanaerobacter tengcongensis MB4
MCGIAGWVNFNMDLSLQNEVIEKMTDTLKKRGPDGSGVWLSKHCVLGHRRLIVIDPQGGIQPMIKKYGEKNFVIIHNGELYNMDELKNELISLGYTFNTRSDTEIILTSYIEWGPLCVKKFNGIFAFAIWDEVQNRLFIARDHLGIKPLFYTIKNGSLIFGSEIKAILAHPHVKPEIDSQGLAEIFVMGPSRTPGCGVFKDIKELKAGHYLIFTKNGVNISKYWSLQSLPHEDSLEKTAEKIRYLLKDSSVRQLVSDVPLCSLLSGGLDSTAVSFFANEELKQKGHKLITYSVDYVGNDKYFTPNEFQPNSDADWVKFVANKLDTDHNYVFIDNEELAHALKPALYARDLPGMADIDSSLYLFLKEVKKGATVALSGEGADEVFGGYPWFRNKESIRSHTFPWTRMVNERMKLLLPEVVNYIRPLEYLNDRYNEALNEVPKLNGEDPYNARMREMFYLNITRFMPMLLDRMDRMSMAVGLEARVPFLDYRLVEYVWNIPWEMKNLNNREKGILRYALKGYIPDEVIERKKSPYPKTHNPVFKNIVKKWLKQIINDSTSPLLQLVDKKAIAELIETDAKAYDPAWFSQLMGSPQLFAYLVQINMWLKDYKISIV

SEQ ID NO: 44511 - protein, 372 aa, Bacillus cereus ATCC 10987
MKAEEKFSPGLDGIVAAETKISFLDTVKGEIVIQGYDLIELSKTKEYLDIVHLLLEEHLPNEDEKAKLEKKLKEEYAVPEGVFNVLKALPKETHPMDGLRTGVSALAGYDNDIENRSLEVNKSRGYKLLSKVPNIVANSYHILNNEEPIEPLKELSYSANFFYMLTGKKPTELEEKIFDRSLVLYSEHEMPNSTFTARVIASTQSDLYGALTGAVASLKGSLHGGANEAVMYMLLEAGNVEKFEELLQKKLYNKEKIMGFGHRVYMKKMDPRALMMKEALKQLCDVKGDYTLYEMCEAGEKIMEKEKGIYPNLDYYAAPVYWMLGIPIQLYTPIFFSSRTVGLCAHVIEQHANNRLFRPRVNYIGERHVLSK

SEQ ID NO: 44512 - protein, 226 aa, Bordetella parapertussis 12822
MLTQQELKQQAADAALELVEQVAGPDVIIGVGTGSTADLFIDGLARFKGRLRGTVASSERSAARLAGHGLAVLDLNDVQSMPIYVDGADEIDPNLHMIKGGGGALTREKIVASVARRYICIADESKLVERLGRFPLPVEVIPMARNAVARGLSRLGGQPALREGFVTDNGNIILDVAGLSIADAPGLEKTINDIPGVVTCGLFALAGADVALLATQDGIRRLERRG

SEQ ID NO: 44513 - protein, 627 aa, Bordetella parapertussis 12822
MPAATDPDIAALVARAAAVAPERRSGTLRDLDHIVILMQENRGFDHYYGALPGARGRADPHRAPTPDGDVFVQAHAGQRLAPYPLAPALPPGQPLGHLTPHTWDDAQRAWNDGRMDQWLAAKGRLGMGYYRPEELPLQTALARAFTLCEAYHCSMHAGTNPNRLFLWTGTNDPHGQAGGPALVNTHDRPGPAHEGYAWTTYPERLQAAGVDWAIYQDMADNYHDNPLAGFRQYRAELAGGAARAPLRERALSTRTLAALAEDAANGRLPQVAWIIAPAADSEHPEVSSPAQGAAFSARVLDILTRDPALWRRCALLLTYDENDCFFDHMPPPAPPGAAGGGSTADTAGEYHQARGGPSAGTPDDPRALHGRAYGLGPRVPMLVVSPFSRGGWLDARVYDHTSVIRLLESRFGVAEPNISPWRRAVCGDLSHAFDFTGAQDQAGAPGPRSRPSPYACHVEAWAADGRQRVRMANPGHATLVLHVYDCLRLAQGPRRYTIEPGRQWEDSWPDAGADLACDLWILGPDGFHRHIRRHGAAAPLAAAWRDQPPALLLENRGAQALQARIESAYGEAPALLRLAPGEQAAWPYEPSASRGWYDLTASAAGQSLRLAGRTRAAGPGRPDPRLG

SEQ ID NO: 44514 - protein, 843 aa, Azoarcus sp. BH72
MKIVLVGHGMVGHKFLEELQQLQIPGAEVTVLCEEPRTAYDRVHLSEFFSGKTAEDLSLVAPGFFDDTGFALRLNSRAAAIDRRAKTVTTQDGVTLSYDKLVLATGSYPFVPPVKGNDREQCFVYRTIEDLEAMKAAGAISRKGVVVGGGLLGLECAKALRDLGLETHVVEFAPRLMAVQVDDDGGRILREKIEQLGVQVHTSRNTTEITDGMTARHRMVFADGSHLETDMIVFSAGIRPRDELARQNALAVGARGGIAVDDHCRTSDPDIYAIGECAAWRDQTFGLVAPGYDMARLVARHLAGETKAAFAGADMSTKLKLMGVDVASIGDAHGKTAGCRSFRYSDEVKQVYKKIVVSEDGKRLLGAVLVGNADEYGTLLQMALNGIAPPAEPEFLILPSSDGKAKPGLGPDALPDSAQICSCNNVSKGQICAAVGEGATSIGEIKSCTKAGATCGGCVPLVTQIMKAEMAKRGMAVNNHLCEHFPYSRQELFHLVRVGGIKSFEDLLARHGQGHGCDICKPTAASIFASCWNDFVLQGELASLQDSNDYFLGNIQKDGTYSVVPRMPGGEVTPDGLIAVGQVAKKYGLYTKVTGGQRVDLFGARVEQLPAIWEELIAAGFESGHAYGKALRTVKSCVGSTWCRYGVDDSVGLAVELENRYKGLRAPHKIKFGVSGCTRECAEAQGKDVGIIATERGWNLYVCGNGGMKPRHAELIASDLDRAALIRLIDRFLMFYVRTADRLQRTSTWRENLEGGLDYLKDVLIADSLGLAAELEAQMQHVVDTYQCEWKTAVTDPDVRKRFRTFVNDPQADKRIVFVKERGQIRPARAEERDAATADPLAV

SEQ ID NO: 44515 - protein, 465 aa, Bradyrhizobium sp. BTAi1
MSKTIDPVDEMLPVPKLLALGLQHVLVMYAGAVAVPLIIGRALKLPPEDVAFLISADLFACGLATLVQCIGFPGVGIRLPVMMGVTFASVGPMLSMAASPDIGLLGIYGSVIAAGLFGIIIAPFISRLLPLFPPVVTGTIILIIGVSLMRVGINWAGGGQPTIIKVVDGVRGNFPNPDYGQLQGLGIALFVLLVILGLIKWGTGFVANVSVLLGIVAGAMLASALGVMHFDKVAAAPWGALVVPFKFGVPQFKPVPIVTMCIVMVVVMIESLGMFLALGEMTGKKVDREALARGLRADGVGTLLGGLFNTFPYTSFSQNVGLVSVTGVRTRWVTVTGGVIMLLLGLLPKMAALVEAVPQVVLGGAGLVMFGMVAATGARILAAVDFKTNRFNLFIVAISVGFGLIPLAAPGFFHNLPKDLQPLLESGILLCALVAVLLNAFFNGLGSSKAAETDAAAAASSAQHV

SEQ ID NO: 44516 - protein, 325 aa, Glycine max
SARVGTVYKGVLPESGDIVAVKRCNHSGQGKNEFLSELSIIGSLRHRNLVHLQGWCHEKGEILLVYDLMPNGSLDKALYESRMALSWPHRLKILLGVSSVLAYLHHECENQVIHRDIKTSNIMLDEGFNARLGDFGLARQTEHDKSPDATVAAGTMGYLAPEYVLTGRATEKTDVFSYGAVVLEVASGRRPIEKDDDAAAGNGKVGISSNLVEWVWSLHQDGKLLTAADPRLEGEFEEGEMRKVLLIGLACSHPDSMARPTMRCVVQMLLGEAEVPIVPRAKPSTSYSTSQLLMNLQDSDTDCKNGMITISTSSSENSSNGKDIV

SEQ ID NO: 44517 - protein, 164 aa, Brassica napus
FQAPVLKKYPARLSVTSYTCFFGIIQFLIIAAFCERDSQAWVFHSGWELFTILYAGIVASGIAFAVQIWCIDRGGPVFVAVYQPVQTLVVAIMASIALGEEFYLGGIIGAVLIIAGLYFVLYGKSEERKFAALEKAEIQTIVEHGIERVPVSRGSIKSSITVPL

SEQ ID NO: 44518 - protein, 278 aa, Pseudomonas aeruginosa PAO1
MPRKVFSSQAYRHKVVLVSGGCSGIGRALALRFARAGARLAILDLDQAALDSLVQHLRDHLGGEALGLRCDVADADAVERAVALAVERFGGIDVLVNNAGITHRGTFAETGLGVFRKVMAVNFFGAVHCTRAALPSLLERRGQIVVLGSLTGFAPLLYRSAYNASKHALHGLFDTLRMELEGTGVSVTLACPGFTATDLRKNALVGDGSVTRQPVQVLGSQVASPVEVAEAIFQGAARRRRLLVLSNVNWRARLLARFFPRLFEKLLVPRLSGLKPQP

SEQ ID NO: 44519 - protein, 310 aa, Triticum aestivum
NKFVQKSRLVPVRNSRDIVDPRVRSELLTYHNGAVLQGAIPVSVLWYGRFTPAQKAVVSDFLLSLTTASPAPTPSVSQWWNTIHQLYLSKAKGANAKRATQVALAGQVSDERCSLGKSLALPQLAALAARAKPRKGGIALVLTAEDVAVEGFCRSRCGLHGSDAAARTAYVWVGNSASQCPGQCAWPFHKPAYGPQAPALVAPSGDVGMDGMVMNVASMVAGAVTNPFGDGFYQGPREAPLEAATACPGVYGSGASPGYAGNLAVDATTGASYNANGANGRKYLLPALFDPDTSTCCLNTIKLELEGGKE

SEQ ID NO: 44520 - protein, 284 aa, Brucella suis 1330
MARGRKAFVTGFPIKHSRSPLIHGFWLKELGIDGSYEAVEVKPEDFSSFAASLAANGFAGGNVTIPHKEAAYAAAESLDEAACAIGAVNTLWLENGRLCGGNTDAYGFAANLDASAPGWDKADRALVLGAGGASRAVVHALLSRGVCHVSVVNRTLSRAEELAAHFGARVYAHGWDEAQALVSNAGLIVNTTALGMSGHGEGQDFPIDLTCAPKEAVATNIVYVPLRTAFLNKAEKAGLKTVDGLGMLLHQAVPGFERWFGQRPQVTQALREHILADMAKAGAL

SEQ ID NO: 44521 - protein, 250 aa, Thermus thermophilus HB27
MRRVLVAGNWKMHKTPSEARVWFAELKRLLPPLQSEAAVLPAFPILPVAKEVLAETQVGYGAQDVSAHKEGAYTGEVSARMLSDLGCRYAIVGHSERRRYHGETDALVAEKAKRLLEEGITPILCVGEPLEVREKGEAVPYTLRQLRGSLEGVEPPGPEALVIAYEPVWAIGTGKNATPEDAEAMHQEIRKALSERYGEAFASRVRILYGGSVNPKNFADLLSMPNVDGGLVGGASLELESFLALLRIAG

SEQ ID NO: 44522 - protein, 363 aa, Arabidopsis thaliana
MLSDLPKDVAEEVLSKFPVTSLRRVRFTCKKLNTLSKDMSFTRKHIDKEEAKKKQSKEFHVVMMLDFRVSLFSLNLLNPNPIERLGQLVSLDGGAQVDISNIFHCEGFLLCTTKDISRVVVWNPCVGQTIWIKPRNSFNKWDRYALGYDVMKNHKVLRFVDDGEYGRRHLLCEFEIYSFESDSWEVLDVNPDWEIDFVHRGLSIDGNSYWFARDKVVPYGGQDPSYFLLCFDFTTERFRPPLPLPFQPYFGDTVALSSVGDNQIAVLCQRSSSPYTLKIWISSKVEPNAVSWNKLFLKVDMKPLTGNSFSYSGGSFFVDEEKKMAVVLDKNIGGGFDPTRNIAYIIGKEGYFKKVDLGESRHL

SEQ ID NO: 44523 - protein, 75 aa, Triticum aestivum
  misc_feature (9)..(9): Xaa can be any naturally occurring amino acid
PLAIIRNMXFGYDPSRYAGRDEDVSDMEADFATIEMEEKRSARIARQEDEEELRLIEEEERREQERKRRKMARGR

SEQ ID NO: 44524 - protein, 264 aa, Arabidopsis thaliana
MYQDSGLMLRYMQNCPPDIQQFEDLFKSYKLSDEMNNTFVESSNISEYDIGEESDLFRAPDPILEEPILTVDPLSAALTMISCGEDTSQGLCELPDLGSLQSGQQLLDKAFYECEQDLMMKSAMESPFSDVLDIKNISVVTTINENQDMQKSVSSGNLSSMDWSHAQQETVMIQNFPDFDFGYGMRRAFSEGDIQKLGAGLVQSPLDRIIVSCTSEDRREKLSRYKNKKSRRNFGRKIKYACRKALADSQPRVRGRFAKTEERK

SEQ ID NO: 44525 - protein, 356 aa, marine gamma proteobacterium HTCC2207
MSKVLVLPGDNIGPEIITEAVRVLETVNQKFGLGIELDYAHLGGAALDAVGEPCPQETLDKARASDAILLGAVGGPQWDDVERHLRPEKGLLTIRSELELFGNLRPAIMYPQLAHASSLKPEFVSGLDILIVRELVGGIYFGEPRGIRTLDNGEREGYNTYKYNESEIRRIGRMAFEAAMVRGKRLCSVDKSNVLEATILWREIITSMAADYPEVELSHMYVDNAAMQLVKEPKQFDVVVTGNMFGDILSDTAAMLTGSIGMLPSASLDKDGGGMYEPCHGSAPDIAGQGVANPLATILSVAMMLRYSLDAVAAADAIEKAVSDVLDQGLRTGDIYTDGMTRVGTVEMGDAVVAAL

SEQ ID NO: 44526 - protein, 266 aa, Coccidioides immitis RS
MTSSPVLSLFSLQGKTALVTGGTRGIGQAMAQALAEAGADIILVQRDESNTTTRDAIVQKTGRKVTIHVAELSDREAVAQVIPSIVKCGQHVDILLNCAGIQRRHPAEKFPDGDWDEVLQVNLTSVFTLCREFGAYLLSRDASTFQSDRRGAIINVASLLSFQGGITVTAYAASKGGVAQLTKALSNEWASRGISVNAIAPGYIDTEMNTALINDAARNDGIMARIPAGRWGKPEDFKGVVVFLASEASAYVSGEIICVDGGWMGR

SEQ ID NO: 44527 - protein, 482 aa, delta proteobacterium MLMS-1
MSQLSEIGGLDAATLQQKDRALLWHPFTQMHDYAQRDLLLIDRGRGVRLYDHHGREYFDTISSWWCIVHGHCHPLIQEYIGRQLKRLDQIQLAGTGHEPAILLAEKLVALTPPRLSKVFYSDNGSTACEVAVKISLQYWQQSGHPERRGLVALERGYHGDTIGTMSLGGVPEFHQAFGHLMFPSHRVPPPNCYRCPAGMPAPELMEGGLAVEAGPEMEKLRCDCQCLAPLEQLLAAQGEQLAAFILEPRIMAAGGMIVYPAQWLRRAAELTRRHGVHLILDEVASGFGRTGRMFALESAGVEPDFLCLSKGLTGGALPLAATLTSDEIYNAFYDDYAAGKTFFHGHTFSGNPLAAAAALGSLAVFAEEQTIAGLPAKVAHLRQAMQRFKDLPWVGDLRCLGMIAALELVQDKERKIPFGPDQRVGWPIYLAGLEEGLLLRPLGNIIYLWLPLSVTTAEIDEICQRMWRVLSNPVNIRGVGKE

SEQ ID NO: 44528 - protein, 440 aa, Sorghum bicolor
MSTTKVKRRVGKYELGRTIGEGTFAKVRFARDTVTGEAVAIKILDKDKVLKHKMVEQIKREISTMKLIKHPNVVRIYEVMGSKTKIYIVLEFATGGELFQRIVNHGRMREDEARRYFQQLINAVDYCHSRGVYHRDLKPENLLLDSYGNLKVSDFGLSALSQQMKDDGLLHTTCGTPNYVAPEVLEDQGYDGAMADLWSCGVILFVLLAGYLPFEDSNLMTLYKKISNAEFTFPPWTSFPAKRLLTRILDPNPMTRITIPEILEDEWFKKGYKRPEFDEKYDTTLDDVDAVFNDSEEHHVTEKKEEEPVALNAFELISMSAGLNLGNLFDSEQEFKRETRFTSKCPPKEIVRKIEEAAKPLGFDVQKKNYKLRLEKVKAGRKGNLNVATEILQVAPSLHMVEVRKAKGDTLEFHKFYKNLSKTLKDVVWKSDDTQMLHAA

SEQ ID NO: 44529 - protein, 239 aa, Blastopirellula marina DSM 3645
MNSTRAEGIALVEGIAKGLAADCSVEVAVCPPALYLDAIVAAAGDSPIGVGAQNIYFEASGAFTGEISAAMLKDIGCQYVILGHSERRHVFGESSSLINKKVHAALAAGLVPIVCVGELLEERETGKTADVVAEQFYGSLAGVSAEQMESIVLAYEPVWAIGTGKVATPEQAEAVHADLRKVIEARYNSAVAEKVRIQYGGSVKPDNAAELLSQPNIDGALVGGAALKADSFLGIIAGA

SEQ ID NO: 44530 - protein, 413 aa, Archaeoglobus fulgidus DSM 4304
MMNMEEYALDIPVEPPRELRSLFIPIPPEYVEDTYRSDDFLVLVGPQHPGSGHMRLIVRVRGDIIQEVIPDPGYVHRSMEKLAENRLYIQNIPLVERPAIMDAPNFNLGYVRAIEEALDIEVPERAKFLRTMLAELGRVGTHLYDAAILAVFLGHTTGFMYPFGLRELICEALVRLTGARFTSSFIIPGGVRRDADDATLKWIYDMTLAMERRLKSFERIFINNPTVIARLQDVGVLSKEEAIKYGVVGPFLRASGVEYDVRKVEPYEAYDDLTWEMPVSDAGDGYARFLVRVNEVGQSLSIIRQCIKEMPEGRVISEQVAENEKDIRGSFFDSLSNIVLPSGEYTTLTEGARGTIIYSIISDGESNVPYRLRIVSPGWLYLRGFMESMKGERLADLQAIYGSFGYFPPEADR

SEQ ID NO: 44531 - protein, 440 aa, Sorghum bicolor
MSATKVKRRVGKYELGRTIGEGTFAKVRFAKNTETGEPVAIKILDKEKVLRHKMVEQIKREISTMKLIKHPNVVRIYEVMGSKTKIYIVLEYVTGGELFDTIANHGRMREDEARRYFQQLINAVDYCHSRGVYHRDLKPENLLLDSYGNLKVSDFGLSALSQQIKDDGLLHTTCGTPNYVAPEVLEDQGYDGAMADLWSCGVILFVLLAGYLPFEDSNLMTLYKKISNAEYTFPPWTSFPAKRLLTRFLDPNPMTRITIPEILEDEWFKKGYKRPEFDEKYDTPLDDVDAVFNDSEEHHVTEKKEEEPVVLNAFELISRSAGLNLGNLFDSEQEFKRETRFTSKCPPKEIVRKIEEAAKPLGFGVQKKNYKLRLEKVKAGRKGNLNVATEILQVAPSLHMVEVRKAKGDTLEFQKFYKNLSKTLKDVVWKSEDLQMQPAS

SEQ ID NO: 44532 - protein, 299 aa, Thermus thermophilus HB27
MFRGSIPPLPTPFRRGRLDEEALRRLVERVVQGGSHGVSVGGTTGEPGTQTLEERKRAIEVVLDQVAGRVPVIPGTGALRLEETLELTRFAKEAGAQGAMVIVPYYVKPNQEGLYRYFAEVARAVPDFPLLIYNIPGRAGVEIAPKTVGRLRRDFPNIVGLKHSSKDLEYLSHLFLEAGRDFLVFCGLESLTLPMMSLGAVGTIAATANWLPKEVALLCEKALAGDYQGARELHFYLLEANEAIFWDTNPIPLKTVLSWMGLLEKEWRPPLGPTTPEVEERLRRMAERYGLLPKEKEAA

SEQ ID NO: 44533 - protein, 520 aa, Oryza sativa (japonica cultivar-group)
MEATSSSSSLLNGLNSGVVLSLIAVLWTVVWQNLQRLQLQTLVGRHMNRHARRLAALVDPYLSVTIHEYEGGRMKRSAAYEEVKAYLSASSARDVRHLRAEGAKDADKLVLSMVDGEEVSDVVAADDSTDVTVWWCAYSTPPPRTDGGGYYGWGGGGRAQENRRYYRLFFLDRHRELVINTYLPSIRRQGRAVMVQNRQRKLFTNISTHNWSDVDGLVRSAWSHVVFEHPKTFDTLAMDPAKKKEIMDDLDMFKNGKDYYARVGKAWKRGYLLHGPPGTGKSAMIAAMANYLDYDIYDIELTSVHSNTDLRKLFIETTSKSIIVIEDIDCSLDLTGARKKKKEAADDDDGGSKDGGAPPKPDMKKDASSKVTLSGLLNFIDGLWSACGGERLIVFTTNHVKKLDPALIRRGRMDKHIEMSYCCFEAFKFLAKTYLDVDSHRLFAAVDELLSEVDMTPADVAENLTPKSLDDNADTCLAALVKELEKAKENKSKGKNAHGEDKDEDEDEEDDDVEVVGKDK

SEQ ID NO: 44534 - protein, 395 aa, Coccidioides immitis RS
MTGSSRPSRALVLHGPEDLRLETRETPYPAAGEVQIAIRATGLCGSDLHYFYQGRNGDFVVRAPLCLGHESAGTVTALGADVTTLQAGDRVALEVGIPCRKCTLCLQDRYNLCSSMRFRSSAAVFPHLDGTLMDITNHPAMLCHKLPPTISDVQAALIEPLAVCIHAVNRSKLDISAIAQIPQRDVTALIFGAGAIGLLLACVLAASQPFTAIVVADINTKRLQIASTLPYTNITPHHLLAKQAPSSCTPEADDDYAKSIAAELAAKFTLPHGFTRVYDCTGSPSCIRAAIHASSPGGAVVLVGMGGPRLPTLPLSFAALREIDLIGVLRYDGRCYPEAVRLMASGKLDGVTERIVTHTVEFGNEGGQKAFRLAGNGVDDEGNTVVKVVVMGEKR

SEQ ID NO: 44535 - protein, 473 aa, Mycobacterium smegmatis str. MC2 155
MSTTPAKTKHREVARLDRVPLPAEAARIGATGWQITRTGARVAANIFGRGSLQQKIVKQVPKTFSDLGPTYVKFGQIIASSPGAFGEPLSREFRGLLDRVPPANPDEVQKLIREELGDDPHKLFKTFDDTPFASASIAQVHYATLHSGEEVVVKIQRPGIRRRVAADLQILKRGARLVEFAKLGQRLSAQDVVADFADNLAEELDFRLEAQSMDAWVAHMHASPLGANIRVPTVYWDLTSERVLTMERITGVRIDDVAAIRKKGFDGTELVKALLFSVFEGGLRHGLFHGDLHAGNLYVDDDGKIVFFDFGIMGRIDPRTRWLLRELVHALLVKKDHAAAGKIVVLMGAVGTVKPEGQAAKDLEAFATPLTMKSLGDMSYAEIGRQLSALADAYDVKLPRELVLIGKQFLYVERYMKLLAPKWQMMSDPQLTGYFANFMVEVSREHKEIDDVDEIPDIPETGTETQAPSGDKA

SEQ ID NO: 44536 - protein, 294 aa, Photobacterium profundum SS9
MTKINSVAVVGGTHGNEFSGIYLLRKWKNNLNLISRGSFSVQTVFANPKAHEENKRYVDSDLNRQFDIAELANLDLANYEQSRAKVINNQLGPKGDAKTDFIIDLHNTTSNMGPSLILLQSDEFNCKMGAYVKSRMPEAVVVFEDHASVEEHYFLSSITPQGVIVEIGPQPQSVIRQDVLDWMEDMTRHILDYVDLHNTNALPELPSSYEAFEYKETLKLPENENGERIGMVHKNVQDGDFKQLNSGDPIFTLFDGSEISWEGDYEAYPHFINEAAYYDNNLAMSLAKKRIVEV

SEQ ID NO: 44537 - protein, 825 aa, Debaryomyces hansenii CBS767
MTSIYTSDIKHHRKAPPPPSTSNTFRSNSSSSASSSSNDKQSIKLNINSNKRQSGWVHIKDDGIFTSFRWNKRFMIINDKTLNFYKNEPTNLHSFNVPDSNLVNSNSPDLSFPLNLISSINLKPNSGYTKASQTFEIVPKNSGKSMLISIKSNNDYLDWLDAFTTKCPLINIGNENSANSAIINGNTGVSNPINFTHKVHVGFDPASGNFTGLPDTWKNLLQHSKITNEDWKKNPVAVIEVLEFYSDINGGSPGLTPINLPSINNNSNKNDSSSSLQEWTKHPSKQLQSAQPQQPAQFKPSRAAPKPPVPYHLTQQKPQSNVSPLNNLLQNSEKADTKRDSQNDLIPIRRAPPPPTSNKLNLNPDKNNSAPNLPAGLGISGSSNSIPKQLPPYLPKQKDLKIQTPSTGLNKYPSPPSSAPAAGPSYIKPFGLTSKQSQYLQQQSQLSHQEQQSPKNAGPKDITSPQKPEETPIKPLQPRPQKPQQQPDQPQLQVKKVASPQMGQGKIKTAKQIKKEREKLNEMQIIAKLKSVVNNNDPTPLFKIIEKAGQGASGAVYLAETKSTGNKVAIKQMDMNVQPRKELIINEILVMKDSQHKNIVNFLDSYLRGSSDLWVIMEYMEGGSLTEIIENNEFKLSEKQIATICFETLKGLQHLHKKHIIHRDIKSDNVLLDAKGNVKITDFGFCAKLTDQRNKRATMVGTPYWMAPEVVKQKEYDAKVDVWSLGIMTIEMIEGEPPYLNEEPLKALYLIATNGTPKLKKPELLSNSIKKFLSICLCVDVRYRALTDELIEHSFIQHKSTDVEVLAPLLEWKKNPRPDYSDEED

SEQ ID NO: 44538 - protein, 434 aa, Fusobacterium nucleatum subsp. vincentii ATCC 49256
MVFKNSIDLYKKAVELVPGGVNSPVRAFKSVNREAPIFVKKGQGAKIWDEDNNEYIDYICSWGPLILGHNHPKVIEEVKKIIENGSSYGLPTKYEVDLAELIVEIVPSVEKVRLTTSGTEATMSAVRLARAYTQRNKILKFEGCYHGHSDALLVKSGSGLLTEGYQDSNGITDGVLKDTLTLPFGDIEKVKEVLKSKDVACVIVEPIPANMGVIETHKRFLQELRKITEETGTILIFDEVISGFRLALGGAQEFFGITPDLTTLGKIIGGGYPVGAFGGKKEIMDLVAPVGRVYHAGTLSGNPIASKAGFATISYLKKNPNIYKELEEKTNYLIDNIEILAKKYSINVCVNSMGSLFTIFFIDIDKVENLKDSLKSNTKNFSIYFNTMLENGIVVPPSQFEAHFLSMAHTKKELNRTLEVIEMAFKKIGEKSGK

SEQ ID NO: 44539 - protein, 135 aa, Zea mays
MRKHRIVSLVAALLVLLALAAVSSTRSAQKESVADNAGMLAGGIKDVPANENDLQLQELARFAVNEHNQKANALLGFEKLVKAKTQVVAGTMYYLTIEVKDGEVNKLYEAKVWEKPWENFKQLQEFKPVEEGASA

SEQ ID NO: 44540 - protein, 135 aa, Salmonella enterica subsp. enterica serovar Typhi
PEIGYTPGVETTTEPLGQGLANAVGLAIAERTLGAQFNRPDHEIVDHYTYVFMGDGCLMEGISHEVCSLAGTLGLGKLIGFYDHNGISIDGETEGWFTDDTAKRFEAYHWHVVHDIDGHAPEAVKKAILEAQSVK

SEQ ID NO: 44541 - protein, 496 aa, Brassica napus
GSTTLLLSLSSYQILEMASDGEGACMQCKKIPPTEESLTCRTCGTPWHVPCLSSPPDSLASTLQWECPDCSGDFDPVPQPGEGSDLVAAIRAIESDVTLTDEEKAKKRQQLLSGKAVVEDDDEEEEEKKKSSSMGLDADILAALGDNLKCPFCLQLLERPVTTPCGHNFCLKCFVKWTGQGKRECIKCRFVVPNDVAANPRINASLVSAIRLAKVSRTSAAAAAASTSNVYHYVSNENRPDQAFTTERAILSGIANAASGKIYVTVPGDHFGPIPAENDPVRNQGVLVGESWKNRLACKQWRAHIPHVAGIAGQSKHGAQSVALSGGYDDDEDHGEWFLYTGSGGRDLSGNKRTNRQQSFDQKFTNGNEALRLSCRMGYPVRVVRTYKEIIAAYAPEEGVRYDGVYRVEKCWRKVGVQGEFKVCRYLFVRCDNAPAPWTSDEHGDRPRPLPDVPELEEAIDLFERIETPSWDFDEAESCWKWMKPPPASNSLFMFW

SEQ ID NO: 44542 - protein, 226 aa, Zea mays
AAAAAHPPSAFLLLLVLLGCASLAIGGAAMAGHVLGGVKENPAAANSAESDGLGRFAVDEHNRRENALLEFVRVVEAKEQVVAGTLHHLTLEAVEAGRKKLYEAKVWVKPWLDFKELQEFSHKGDATAFTNADLGAKQGGHEPGWREVPVEDPVVKDAAHHAVKSIQERSNSLFPYELLEILRAHAQVVEDFAKFDILMKLKRGSKEEKIKAEVHKSLEGAFVLNQ

SEQ ID NO: 44543 - protein, 431 aa, Rhizobium etli
MNVLRKETSQPPASVSIIGAGGICDLIGNSVLDFHRIQRLPPYVFEQVNRLKASARAGGADIIDLGMGNPDLPTPQSIVDKLCEVVQDPRTHRYSSSKGIPGLRRAQAAYYARRFGVKLNPDTQVVATLGSKEGFANMAQAITAPGDVILCPNPTYPIHAFGFLMAGGVIRSMSVEPDESFFPPLERAVRHSIPKPLALILNYPSNPTALVATLDFYKDVVAFAKKHDIIVLSDLAYSEIYFDGAPPPSVLEVPGAMDVTVEFTSMSKTFSMPGWRMGFAVGNERLIAALTRVKSYLDYGAFTPIQVAATHALNGDGSDIAEVRNVYKRRRDVMVESFGKAGFDVPPPAATMFAWAKIPEKFRHLGSLEFSKLLVEKADVAVAPGIGFGEMGDDYVRLALVENEHRIRQAARNIKRWLSGDEKFEINVMNQ

SEQ ID NO: 44544 - protein, 573 aa, Candida albicans SC5314
MCGIFAAYRQPEVEDFKSKALQYSKLIRHRGPDWSGNVVQNSTILCHERLAIVGLDSGAQPIVSPDGNFTLAVNGEIYNHIQLREQFPDYKFKSLSDCEPIIPLFTKYDIDAPKHLDGMFAWVLYDKKNDRIVAARDPIGITTLYMGKSSKSPKTRYFASELKCLIEECDEIFAFPPGHVYDSNTDEITRYFKPSWWDASKVPEQHVDFKKVRETLELAVRKRLMAEVPYGVLLSGGLDSSLIASIASRETKKAAQASFNPEGIDANKELSGVDDKGSLHSTGVFNQLHSFAIGLPGAPDLLAAEKVAHFIGTIHHSHTFTLEEGLDALDDVIYHLETYDVTTIRASTPMYLLSRKIKAQGVKMVLSGEGSDEIFGGYLYFANAPSAKEFHEECVKRVKNLHYADCLRANKSTMAWGLEARVPFLDKQFLEVCMNINPEDKLIQPGKIEKYILRKAFDTSDEPDVKPYLPEEILWRQKEQFSDGVGYSWIDGLKDTAEKMVSDEEFAHPKPEWGDDIPTTKEAYWYRCKFDKMFNGSKAAASTVMRWIPKAEWGCHADPSGRYAATHDHKVAQ

SEQ ID NO: 44545 - protein, 265 aa, Paracoccidioides brasiliensis
MGYEDAVYLAKLAEQAERYEEMVENMKIVASADKELSVEERNLLSVAYKNVIGARRASWRIVTSIEQKEESKGNEAQVALIKEYRQNIETELAKICEDILDVLDKHLIASAETGESKVFYHKMKGDYHRYLAEFALGDKRKDSADKSLEAYKNATEVAQTDLAPTHPIRLGLALNFSVFYYEILNSPDQACHLAKQAFDDAIAELDTLSEESYKDSTLIMQLLRDNLTLWTSSEAEPAPEVAPAPSEQKDEAPAATSEDAPKAAE

SEQ ID NO: 44546 - protein, 470 aa, Oryza sativa (japonica cultivar-group)
MSRRTTTTTARWVPRQGQKGEPGGSGHAAAPVDRLSALPDTLLHHVMSFLKAWEVVRTCVLSRRWRDLWASAPCVDIRLRGSGRDGAPPEDFGRFVYRLLLAREVSAPVDTLRLRSSNGEEYAETYDNDDVNIWICSAIKRNVRVIHLNGHRKDELVLEHTAFVSHHLKILKLSHIKLDGKILKQLSSQCTSLEDLELNNCPVNGGEILSVSLKKLTMVKCSITMDLSICAPNLELLCCITPYYHVPLFENLSSLVAATIMLDDSFLRRDEFLYEVEEETSDDEDDNKTTSDHCDSKMDADSDAYDDDDNDDILYDEYLNSRHGNLVDDYNYGSDIDSDDDLHEYSQIAHECRGGRYGYCHDSKRRGSYYETCKLADSFSGKYLLRSLSSARSLELLAHSGEVFQNLFLLINLYLVLVFCICILILMINSKRRTILFFFLVLFLLSTQKVTLKITNNCVTAMLHPCLLSY

SEQ ID NO: 44547 - protein, 884 aa, Bradyrhizobium sp. BTAi1
MSDGMVEARASESAQGETQTVDVAVVGAGFAGLYLLYRLRKAGFSTVALDIATDVGGTWYWNRYPGARCDIQTVDYSYTFDPELETAWQWSEKYATQPEILRYLGFVADRYDLRRDIRFGTRVLGASWDESKERWLLTTDNGPAVSCRHYIMATGCLSQPKPPEFDGVHDFKGAIYFTSRWPHDGVDLKGKRVAVIGTGSSAIQSIPIIAEQAAQLTVFQRTPNFALPAHNGPLPADRAAQLTQDRNGLREQARWSLTGVPIPPATEFSWQMSESERRARFEKLWAAGDLVGMLTQLWADQGVDADGNALLADLIREKIREIVKDPETAEALTPHDHPFGAKRPCLDTNYYATFNRPNVTLVNLRKEPITSITANGIKTDKRSFDIDVIVFATGFDAMTGAIRAVHPIKGRGGQSLDETWANGPETYLGLTVAGFPNLFLITGPGSPSVLSNMAVSIEQHVDFVVDRLAEMREAGFTTIEPTDTAQAGWMRHMADCATVTLHRLANTWYTGANVPGKPQTLMPYTGGVGPYRGICNEIVKRGMLGFKLAGPNGAAQCNDGEIVQLQPDVRLVLNMLAEMNLPPIESMGAQGARDFITEFNKTRPPGRPVGEVKDGTLPGADGPLAYRLYRPATPGPHPIVVYFHGGGWVLGDEQSDDPFCRDMCRRSNMIFISVNYRHAPEHRFPAAAEDGYAATRWVAEHAAELGGREGPVLVAGWSAGGNIAAVTCQLARDRGGPVVGGQLLVCPVTDCSFDRPSYTENAAGYFLTRGLMFWFWDIYCSPADRTDPRVSPLRGQLKGLPPAYIVTCEFDPLRDEGVAYAEALAAAGVPVGQLKARGHFHSSFTMVDIVITGVGGRVQMAEALQAFTQPAEDSGSPEINAAAS

SEQ ID NO: 44548 - protein, 367 aa, Glycine max
MPHYTGRTKEEIAAIKVQTAFRGYMARRALRALRGLVRLKTLVQGQSVKRQAASTLRSMQTLARLQSQIRERRIRMSEENQALQRQLHQKHEKELEKLRAAVGEEWDDSSQSKEQIEAKLLHRQEAALRRERALAYSFSHQQTWKGSSKSLNPTFMDPNNPQWGWSWLERWMATRPWDGHSTVVDHNDHASVKSAASRAVSVGQITKLYSLQDKKPSPFGSKARRPAPQSSHSKAPSTNGKARPSSSTKGSSVWGGDEDSRSMFSVQSERYRRHSIAGSSVRDDDSRASTPAIPSYMAATSSAKARSKIIRHSPEKKGGGGSVSARKRLSFSPSSAANSRRHSDPPKVEMVYNKDAAAATVSNGRGR

SEQ ID NO: 44549 - protein, 427 aa, Pseudomonas aeruginosa PAO1
MSRSETLFNNAQKHIPGGVNSPVRAFKSVGGTPLFFKHAEGAYVLDEDDKRYVDYVGSWGPMILGHSHPDVLDAVRRQLDHGLSYGAPTALEVEMADLVCSMVPSMEMVRMVSSGTEATMSAIRLARGYTGRDSIIKFEGCYHGHSDSLLVKAGSGALTFGVPNSPGVPAAFAKHTLTLPFNDIEAVRKTLGEVGKEVACIIVEPVAGNMNCVPPAPGFLEGLREACDEHGVVLIFDEVMTGFRVALGGAQAYYGVTPDLSTFGKIIGGGMPVGAFGGKREIMQQISPLGPVYQAGTLSGNPLAMAAGLTTLRLISRPGFHDELTAYTTRMLDGLQQRADAAGIPFVTTQAGGMFGLYFSGADAIVTFEDVMASDVERFKRFFHLMLDGGVYLAPSAFEAGFTSIAHGDKELEITLNAAEKAFAALK

SEQ ID NO: 44550 - protein, 331 aa, Desulfitobacterium hafniense DCB-2
MASPDMASVTIKSANSAISFPELLVVEERLRESFLRAGDTIKDSCLLLLDSGGKRLRPLLTLQSAQCFGPLNSAALDAAVAAELIHMASLIHDDVIDHSDRRRGIPTINSQRGNQVAVLAGDYVFAEAFRILANKHLLTSMSYLVDAIQSMCDGEVQQAEQRCDLAVEPSQYFQRIAQKTGILLASCCCSGAASAGANQKAVEALGQYGMNLGYAYQIIDDILDFTGNPQVTGKPAAADLVNGYITLPVIYLLDKPLYGPWARDMLQARDLSPANVQRIIQALISSGALNEAFNTALHCAETAVQALSSLPPSPSKTFLSELTQTILYRQA

SEQ ID NO: 44551 - protein, 183 aa, Brassica napus
MPIDKIFKDDASEEKGERARMASFIGAMAVADLVKSTLGPKGMDKILQSTGRGHSVTVTNDGATILKSLHIDNPAAKVLVDISKVQDDEVGDGTTSVVVLAGELLREAEKLVTSKIHPMTIIAGYRMAAECARDALLKRVMDNKENAEKFRSDLMKIAMTTLCSKILSQDKEHFAEMAVDAIF

SEQ ID NO: 44552 - protein, 279 aa, Pseudomonas aeruginosa PAO1
MSEDRSSNGHKSWLDKITQAFAHEPRNRQELLELLRDAHDNKLLDSEALSIVEGAIQVADLQVRDIMVPRSQMMSIRSTQTPKEFLPAIIEAAHSRYPVVGESLDDVMGVLLAKDLLPLILHNDERPFDIKELLRPATFVPESKRLNVLLREFRANRNHMAIVIDEYGGVAGLVTIEDVLEQIVGDIEDEHDVEEDSYIKPLPSGDFIVKALTPVDAFNDFFGSEFSDEEFDTVGGLVMSAFGHLPKRNEVVELGEFRFRVLNADSRRVHLLRLSPLQN

SEQ ID NO: 44553 - protein, 116 aa, Pseudomonas putida KT2440
MTNKIIQQLEAEQMSKEIPTFAPGDTVVVQVKVKEGERSRLQAFEGVVIAKRNRGLNSAFTVRKISSGVGVERTFQTYSPQIDSLAVKRRGDVRKAKLYYLRDLSGKAARIKEKLS

SEQ ID NO: 44554 - protein, 110 aa, Chlamydophila pneumoniae CWL029
MTVFKQIIDGLIDCEKVFENENFIAIKDRFPQAPVHLLIIPKKPIPRFQDIPGDEMILMAEAGKIVQELAAEFGIADGYRVVINNGAEGGQAVFHLHIHLLGGRPLGAIA

SEQ ID NO: 44555 - protein, 332 aa, Coxiella burnetii RSA 493
MKATDKQATFEIESLRQPVQNDIEAVDALIVKELSSHVPLIETITHHIIQSGGKRLRPLVVLLTARACGYEQDVEHQELATVIEFIHTATLLHDDVVDKSTQRRGQKTANALWGNSASVLVGDFLYSRAFQILARRSNVPIMKILATTTNQISEGEVWQLMNQNDPDIDEVTYYEVIRRKTAQLFSAAAEIGAIVATKNETWQKSMAAFGFHLGMAYQIIDDLLDYSKDASALDKNVGDDLAEGKATLPLIYAKQQAQPAQAEHIREAIKNGDLDDLQSIMKLMDETRAREYTQQCALKQAEKAHTYLQQLPPSPYRDALNALTQFVVSRHY

SEQ ID NO: 44556 - protein, 279 aa, Photobacterium profundum SS9
MKLEAVDYTADNAEELFVESLRNTGFGVLKNHPIQQKLVSAIYENWYNFFASENKDDFRFNVETQDGFFPSEISETAKGHTQKDIKEYFHYYPWGQCPEALKEELQNYYDEANKLAGELLSWVEKHSPEDVAKKYSQPLSSMVEDSSQTLLRVLHYPPLKGDEELGAIRAGAHEDINLLTILPAANEPGLQVKSKEGDWLDVPCDFGNLIINIGDMLQEASGGYFPSTTHRVVNPDGADKTKSRISLPLFLHPKPEVILSERYTANEYLMERLRELGVI

SEQ ID NO: 44557 - protein, 356 aa, Triticum aestivum
MHPKARIHADPAAPEPDRIDGLPDSLVLLILNKLEDVHSLGRCAAVSRRFNDLVPLVHDVYVKIDRVVAVDGDPDDALNLSSPKPRHIFSHLFKLMLFTIAKPFQGMRGPGGAGGRPLFPRLAQHSPVQVLRGFSHVRNLRVELPSGDVGTEEGVLLKWRARYGSTLQSCVILGGTLVDRKPAGGHEPSAAEDGGSMPESFYTNGGLKLRVVWTISSLIAASTRHYLLRSIIKEHPTLRSLVLADADGQGTLCMGAEQLAEFRESRLSASACSNRTQVPACSMKLKYAPYLELPGGLGLQGATLVVIKPSGDGAGGCHVGRKETEAFVSGAFDGPFRFAAKALMKRRTYLLEMNGF

SEQ ID NO: 44558 - protein, 855 aa, Rhizobium leguminosarum bv. viciae 3841
MSGTHEPVDLTNCDREPIHQLGSVQPFGFLLAVSSDWIVMRASANLAEFLEVTEANAIGRPVLSLITPEALHTIRNKLTTLRGSDVVERIFGIALMPDQNRFDLAVHLNGGQVIIEGERCQEDRHDAASLSMRSMMSRLDHTETLEAFFREGARQARALTGFDRVMVYRFDESGSGEVVAEAARAGIGSFLGLHYPASDIPVQARALYLRNLFRIIADVDAVPVPILPQLDEHGRPLDLSMSILRSVSPIHIEYLKNMGVGASLSISIVVDGRLWGLFACHHYGPRLPSAQSRSTAELFGQMFASRLESRERRLALDYETKARRIADRLLTSVADNASLLDDPAWLIEALADAIPADGIGVWINGRLALAGIGPNERGFAALVRHLNRNAAGRIYAVDRLAEAYPDLEVDDAVAGMLAIPISRSPRDYVVLFRQELVRTVRWGGDPHKPVEYGPNGPRLTPRKSFEAWSELVRGRSLPFTEAEHRVAETIRVTLIEVVLRLTDEVSMARQSANERQELLIAELNHRVRNILSLITGVIRQSQATSVSLGDYIRQLEGRIQSLARAHDQITRDHWAPASLRQLLLAETAAYFGKNAQRIQMGGEDVLLEPDAFSTAALVFHELMTNSAKYGSLSSTGSGTVQLGWHRDDQGNLRIGWREKDGPPVVEPKRHGFGSTIIRRSIPYDLGGKAEVRYVKDGLEADFCIPARHVVGPTSERSNPAPVGTTEPKTNPDDQPLSGLNVLLVENNLIIAMDGEDILRRLGADVATAPSVTEAMEILAGQSFDLALLDVNLGDETSFGIADRLAADGVPFVFATGYGEGIAQANSHSDAPVLQKPYTMEGVTDILARVPLRRSG

SEQ ID NO: 44559 - protein, 406 aa, Pseudomonas syringae pv. phaseolicola 1448A
MAIEIKAPSFPESVADGTISKWYKKEGDAVKRDEMLVDIETDKVVLEVLAEADGVMGSITKEEGAIVLSNEVLGTLNDGATASAATAPAAAPASAPAAAPAAAGEEDPIAAPAARQLAEENGINLASVKGTGKDGRITKEDVVAAVEAKKSAPAAAPAAKPAAAAAPVVAAGDRTEKRVPMTRVRATVAKRLVEAQSNMAMLTTFNEVDMTEVMALRSKYKDLFEKSHNGVRLGFMSFFVKAATEALKRFPAVNASIDGSDIVYHGYADVGVAVSSDRGLVVPVLRNAEHMSLAEIEGGIATFGKKARDGKLSIDEMTGGTFTITNGGTFGSMMSTPIVNPPQAAILGMHNILQRPMAVNGQVVIRPMMYLALSYDHRLIDGKEAVTFLVTIKNLLEDPARLLLDI

SEQ ID NO: 44560 - protein, 333 aa, Pseudomonas syringae pv. phaseolicola 1448A
MTLRIAINGFGRIGRNVLRALYTQGYRQDLQVVAINDLGDSEMNAHLLRFDTVHGPFSGTVECDKDSLTVNGDRISVSAIRNPAELPWKAQDIDVVFECTGLFTSRDKAAAHLTAGARKVIISAPASGADATIVYGVNHDTLRQSHQIISSASCTTNCLAPVAQVLHRELGIENGLMTTIHAYTNDQNLIDVYHTDPYRARSATQSMIPSKTGAAEAVGLVLPELAGKLTGMAVRVPVINVSLVDLTVTLKRETTVDEVNALLKEASQHSKVLGYNALPLVSHDFNHNPLSSIFDANHTKVSGKLLKVLSWYDNEWAFSNRMLDNCLALHNAE

SEQ ID NO: 44561 - protein, 218 aa, Vibrio vulnificus YJ016
MTQDEMKKAAGWAALKYVEKGSIVGVGTGSTVNHFIDALGTMSEEIKGAVSSSVASTEKLEALGIKIFDCNEVASLDIYVDGADEINADREMIKGGGAALTREKIVAAIADKFICIVDGTKAVDVLGTFPLPVEVIPMARSYVARQLVKLGGDPCYREGVITDNGNVILDVYGMKITNPKQLEDQINAIPGVVTVGLFAHRGADVVITGTPEGAKIEE

SEQ ID NO: 44562 - protein, 375 aa, Rhizobium etli
MQMRSVILRESGLPKPYSNSKPLKIELVELTPPGPMEVLVKIKAAGVCHSDLSAINGDRPRPLPVALGHEASGVVAAIGPSVEKVEVGDHVVMSFLPVCGHCSYCAEGRASLCEPGYQANAAGTLLSGGKHIRLRGYEINHHSGVSAFSEYAVVSASSVVKVTKDIDLATAALFGCAVMTGVGAVMNTCGVRPGRSVAVIGLGGVGLSAILGAVASGASDIVAIDLIQAKLDLAKELGATKTFLATSPNIVAQVKGATSGGVDYAIEMAGSKKAFELAYEITRRGGMTATAGLASANSRFEVSPLPLVGEERTIKGSYMGSCVPSRDIPRYIDLYLKGKLPVDKLLSSTGPLDEINEVFDRLDRAEINRHLVLMD

SEQ ID NO: 44563 - protein, 430 aa, Desulfitobacterium hafniense DCB-2
MGFQDQRSKEAFARANGVLPGGVNSPVRAFKSVGREPIFIAKGQGARLWDIDGNSYLDYVLSWGPLILGHAHPVVVGAIKAAAERGTSYGAPTEIETECAEEVIKAFPSMEMVRMVSSGTEATMSALRLARGVTGRNKIIKFEGCYHGHGDSLLIKAGSGALTFGVPTSPGVPSSVASQTIVAQYNDLEGLKEIFKECGEDIAAVILEPVTGNMGVVLPQPGFLAGLRTLTQDYGSLLIFDEVMTGFRVSYGGAQGRYQIDPDLTCLGKVIGGGLPVAAYGGKRKYMEQVAPSGPIYQAGTLSGNPLAMAAGLATLKLLQQEGVYEGLEKKTARLAEGLQSIAQELGFPIWVNSVGAMFSAFFTDQPVIDFKSACSSDVERFGSFFRGMLERGIYLAPSQYEAVFLSAAHTDADIDYTLEQARDVLKSLG

SEQ ID NO: 44564 - protein, 479 aa, marine gamma proteobacterium HTCC2207
MSEKYDVIVIGSGPAGYVSAIRAAQLGLKTACIEKWKDADGKGVNGGTCLNVGCIPSKTLLDSSFKYHEAKEDLGIHGISTAGVKIDIAAMLQRKDKIIKQFTGGIVGLFKANGVTGLYGTGKLLSGKKVELTDNDGTVSVLEANNVILASGSLPIAIPVAPVDGDLIVDSTGALEIGEVPKRLGVIGAGVIGLELGSVWNRLGSDVVLLEAMEDFLAIMDKGIAKESKKIFKKQGLDIRLGARVTGTEIKGREVHVTYVMADGSEKSEIFDKLIVCVGRRPFTEGLLAAESGVQLDERGSIFVNEQCATNVPGVYAIGDLVRGPMLAHKGSEEGVMVAEVIAGHKAQMNYDIVPNVIYTHPEVASVGQTEEQVKAAGEPYNVGSFPFAAVGRAVAANDSDGMVKIIAHADTDRILGCHIVGPSAADLVQQVAIAMEFGSSAEDLGMTVFSHPTLSEAVHEAALAVNGAAIHMPNRKRR

SEQ ID NO: 44565 - protein, 399 aa, marine gamma proteobacterium HTCC2207
MATEIKAPTFPESVQEGSLATWHKQVGETVKRDELLVDIETDKVVLEVVAPAAGVLAEIFKAEGDIVLSNEVIARIEEGAEASAPTAAAAAEAVAEAPEATASGGLINPAARKLAEERNIDVAQIVGTGKGGRITKEDVVNYKAPAAAQAVAAPAAVAEEVLETGDRVERRVPMTRMRSRIAERLLEVTQTTASLTTFNEVDMTALMDLRKQYKEEFTKIHNGTRLGFMGFFVKAAVEALKRFPSVNASIDGSDIVYHGYQDVGVAVSTDRGLVVPVLRNAENMSIANIENGIYDYAMKARDGKLTIDEMTGGTFTITNGGVYGSLISTPIINPPQSAILGMHKIQERPVAVNGQVVIRPMMYLAMSYDHRLIDGKGAVQFLVTMKELLEDPAKILLEI

SEQ ID NO: 44566 - protein, 293 aa, Populus tremula x Populus alba
MDPDSRDPPIEYREGYALSGKIMLSAILILFFVIIVMVLLHLYARWYLTRARQRQVRRVRNRRTHLVFYVDSPQNPNNVTSHVTRGLEETVKNSLPVFVYPRKTHQDSIECAVCLSEFEENERGRVLPKCNHSFHTECIDMWFHSHSTCPLCRSPVEPVAENPVPEGSNFGISEAGSGLCTSCQHEEDHLGSASTSSFNGGRKPVGLIGVTIDVPRRNGNFEDESNTESPSASHSFRSPMSRMLSFKRMLSRERRGTVSPTVANSVSCGGGSGTTEFDIEQGRDESMPQQTRC

SEQ ID NO: 44567 - protein, 683 aa, Lactobacillus plantarum WCFS1
MAETKPTYYITTPIYYPSGKLHIGNSYTTIACDTLARYKRAMGYDVYFLTGTDEHGLKIEEKAEKLNTDPKSYVDGMAKQIKDLWQLLEISNDKFIRTTDDYHERAVQEIFDRLLKNGDIYLGEYEGWYSVDDEEYFTETQLAEVFRDDNGKVIGGKAPSGHEVELVKEQSYFFKMSKYADWLLDYYQSHPDFIEPANRMTEMINNFIKPGLEDLAVSRTSFTWGVPVKSDPKHVVYVWIDALTNYITALGYATGDSEDLFNKFWPADVQMVGKEIVRFHTIYWPIILHALGLPLPKKVFGHGWLLMKDGKMSKSKGNVIYPETLVERYGLDALRYYLVKAMPYGNDGLFTPEDFVARVNYDLANDLGNLLNRTIAMINKYEDGQLPAFKAGVTEFDADLEATAATTIKNFNACMDSLHLSDALAEVWKLVSRTNKYIDETAPWQLAKSDDANDADKLASVMAHLAASLRVIASLISPVMTHAPKEIFTQLGLDPATLAIADLQLADLPAGAQVVAKGTPIFPRVDMDAEVEFLKGKMTKSDKQKGRKAMENAKHEAEVEQGWNPAETNLNLTKPAITIDDFDKVELKVAEVITVQKLKGADKLLQFRLDAGDADHRQILSGIAKWYPEPEELIGKKVIIVGNLKPRKLRGEMSQGMLLSAEHDGQVQLITVPDNMVNGSLIS

SEQ ID NO: 44568 - protein, 380 aa, Populus tremula x Populus alba
MCGGAIISGFIAPTTTARSSRRLTSGFEWLEPKKPFNNKHLKPVVADPEDDFEADLQEFKDESDVDEDYDVFADAKPFAFSASASEPAKKRGLPRGSTAVKSAGFSGLAKNSAKRKRKNQFRGIRQRPWGKWAAEIRDPRKGVRVWLGTFNTAEEAARAYDSEARRIRGKKAKVNFPDEAPCASARHPIKENSQKRLTKANLSQDFSYLSNPETDYNNMGFVEEKPQVSQFGIMNSIPVNGDSGVTPLTPSDNASMYFNSDKGSNSFDCDFGWGEQGAEILSVLAATPEVDESVFVEANPKKLKSYTEYAVPVEERNGKSLSEELLAFDNQLMNLQMPDLVGNWEASLDSFLNGDTTQDGTNAVDLWSFEDFPSMVGGVY

SEQ ID NO: 44569 - protein, 342 aa, Streptococcus pyogenes MGAS10394
MIALDGTPNKGKLGANAILGVSIAVARAAADYLEVPLYTYLGGFNTKVLPTPMMNIINGGSHSDAPIAFQEFMIMPVGAPTFKEGLRWGAEVFHALKKILKERGLVTAVGDEGGFAPKFEGTEDGVETILKAIEAAGYEAGENGIMIGFDCASSEFYDKERKVYDYTKFEGEGAAVRTSAEQVDYLEELVNKYPIITIEDGMDENDWDGWKVLTERLGKRVQLVGDDFFVTNTEYLARGIKENAANSILIKVNQIGTLTETFEAIEMAKEAGYTAVVSHRSGETEDSTIADIAVATNAGQIKTGSLSRTDRIAKYNQLLRIEDQLGEVAQYKGIKSFYNLKK

SEQ ID NO: 44570 - protein, 424 aa, Methanothermobacter thermautotrophicus str. Delta H
MKPNLRRELGLFDAVNLVVGTIVGADIYIVAAYGAGSLGPASILAWLLAGLMALIIALVFSEASAMLPRTGGPYVYAGEALGRFTGFITGWSLWVSSWVAIAVFPLAFIYYLEYFIPLDPPAEAVIKVLFILSLTIINIAGVGRAGKVNDILTILKVAPVLLFAVLGAIHLALNPGLLVSNYTPAAPMGLGALGTVTVLVFWAYVGFELVTVPADEVRDPERTIPLSITLGMIFVTLFYILTNAVILGLVPWRVLASSTAPLTVAGYSLMGGIGALILTAGAVFSIAGSEEAGMLTTARLLFAMSEDGFLPGFLSRVHRRFGTPHMSILVQNLTALLAALTGTVSGLIELSVVTLLLPYAVTCISLAILRRRDGSGIPLKSVLGVLVCIYLLMNTTPSTTAWGLLLILSGAPLYLIFGFKRLRR

SEQ ID NO: 44571 - protein, 595 aa, Arabidopsis thaliana
MAFWLSLIFFCFCTFASSTPPDDPVKCESGNNMCTVTNSYGAFPDRSICEAAKVEYPKTEAELVSIVAAATRAGQKVRVVTRYVHSIPKLVCTDGKDGVLISTKFLNNVVGTNPEAKTLTVESGVTLRQLIGEAAELELALPHAPYWWGLTVGGLMGTGAHGSSLWGKGSAVHDYVSEIRMVSPGLASDGYVKVRVLSETIDPDEFRAAKVSLGVLGVISQVTFQLQPMFKRSLTFVMQNDSDFGDQAVTFGEKHEFADFLWLPSQGKVVYRMDDRVPVNTSGNGLFDFFPFRPQLSVALAIIRSLEESEESSGDANDKCARAEQITSFLFSISYGVTNNGMEFTGYPVIGKQNHMMSSGTCLDSHQDGLITSCPWDPRIKGQFFHQTAFSIPLTRVKGFINDIKALVKIEPKSLCALERSNGILIRYVTSSPAFLGKEEKALDFDLTYYRSKDDPLAPRLYEDFIEEIEQMAIFKYNALPHWGKNRNLAFDGVIRKYKNANTFLKVKERFDPLGLFSTEWTNQILGLKGNVTIVKEGCALEGLCVCSDDAHCAPKKGYLCRPGKVYTKARVCTHVKSVNGYDDHTKFNLMFNRI

SEQ ID NO: 44572 - protein, 294 aa, Erwinia carotovora subsp. atroseptica SCRI1043
MNTFSGVFPYLVSPVRPDGQVDKPVLAQLTEHLIQCGVHGVVPLGSTGEFAYLSATQRLDVVKTVIETTAGRVPVIAGVASTTIQDAVEQTKRYVELGADGILAVLEAYFPLKDEGVEQYFRAIAEAAQGKPVVLYTNPQFQRSDLSLPVIERLSHVSNIRYIKDASTNTGRLLSIIERTRGRMEVFSASAHIPACVMLIGGVGWMAGPACIVPKQSIALYEAARAGDWNRAMELQRPLWRINEIFARYSIAGCIKAALQLQGFAVGDPLPPQQPLDEKARKEIADVLASVDSL

SEQ ID NO: 44573 - protein, 302 aa, Xanthomonas campestris pv. vesicatoria str. 85-10
MSLSGIITALATPFGPDGALDLDAWRRLLEQQLHGGVQGIVVAGSTGEAAALSDDEYDTLLRAAVAQVAGRVPVLAGTGLSGTAKTIAQTRRAAALGAQYALVVTPPYVRPTQAGLKAHFLAVANEGGLPVVLYNVPGRTGCDLLPETVAELVGHPNIVGIKEARSEPERIAALVALRSDSFVVLSGDDGSAAHAMLSGAAGLISVASNALPAAYRRLCDLARDGQRDAATAWDARLSEYHSFCGIESNPIPVKALLQRAGIGHGLRLPLLPLSAAHQPAADRLAADAIALEALSSREMLAA

SEQ ID NO: 44574 - protein, 500 aa, Burkholderia sp. 383
MSTTNFVAVSDTVRTFVARDFGLFIDGEMQPAHAAARLDVYDPATGERLATVADADERDVDRAVASAKHAFDTRVWSGLRPADRERILLKLADLIERDAETLAQLETLNQGKSIHVSRAIEVGASVEYVRYMAGWATKITGQTLDVSIPFPPGARYTAYTRKEPVGVVAAIVPWNFPLMIAVWKLIPALAAGCTIVLKPSPETPLTALRLAELALEAGVPPGVFNVVTGGRVCGAALASHPSIAKISFTGSTATGKLVGAAAVQNMTRFSLELGGKNPIVMLDDIDVAQALDGVAAGAFFNQGQVCAAASRIYVHRSKFAQLADGLAGVAQSMKLGAGLDTTAQINPLVSAHHRDKVVQHIEGARRAGLTFLAGGTPADDLPGYYVKPAVIADPHPDSAIVRDEVFGPVIVVVPFDDAADAVRLANASPYGLAASIWSNDLKRVMNLVPQIEAGTVWVNCHIPLDPSMPFGGYKQSGIGREFGQYAIEGFTETKSVCIAH

SEQ ID NO: 44575 - protein, 446 aa, Burkholderia sp. 383
MSYNEAKFWHPMVHPNEMKQRKPIRIVRGDGCYVFDEEGRKLVDGVAGLWNVNVGHNRQEVKDAIVRQLDELEYFQLFDGISHPRAEELSKKVIDMLEPEGMRRVLYSSGGSDSIETALKIARQYWKVRGQADRTKFISLKQGYHGTHFGGASVNGNTVFRRNYEPNLPGCFHVETPWLYRNPFTQDPEELGRICAEMLEREIQFQSPDTVAAFIAEPIQGAGGVIVPPANYWPLVREVCDRYGVLLIADEVVTGFGRSGSMFGSRGWGVRPDIMCLAKGISSGYVPLGATVVNARIEDAFAANADFGGAIMHGYTYAGHPVACAAAIASLDIVVKEDLPANAAKQGAYLLEALKPFAERFAAVGEVRGKGLMLALDLVANKDTREPIDPLSGYANAVAEVARENGVLVRPVGTKIILSPPLVIQREQLDRIVDALAAGFEAVPFA

SEQ ID NO: 44576 - protein, 287 aa, Alteromonadales bacterium TW-7
MANLDQSKWFTEISDRDGSAFSLRINKKLDEKQSPFQKVEMFETTDFGNLMIIDGCTMVSTRENFFYHEMISHPALLAHPNPKNVVIIGGGDCGTLREVLKHPGVESVTQIDIDEVVTQMSLKYFPELCESNNDARATVMFDDGIKYMREAAGESIDVVIVDGTDPVGPGEGLFNHAFYTSCLNALRPGGILVQQSESPLMHMPLLVEMREAMLSVGFNDLQTLPFPQPIYPSGLWSVTLARKSETFNGFREDGAAQIAEQSEYYNSGIHHGALATPNFMKRAFDKK

SEQ ID NO: 44577 - protein, 480 aa, Solanum tuberosum
MIPIMSSAPLSTPAPVTLPVRTIPGSYGLPLLGPIADRLDYFWFQKPENFFTKRMEKHKSTVFRTNVPPCFPFVGSVNPNVVAVLDVKSFSHLFDMEIVEKANVLVGDFMPSEVYTGDMRVCAYLDTSEPKHAQIKNFSLDILKRSSKTWVPTLLKELDTMFTTFEADLSKSKEASLLPALQKFLFNFFSLTLLGADPSVSPEIANSGYIFLDSWLAIQLAPTVSIGVLQPLEEILVHSFAYPFFLVKGNYEKLVQFVKNEAKEVLNRAQTEFQLTEQEAIHNLLFILGFNAFGGFTIFLPTLLGNLGDEKNAEMQEKLRKEVRDKVGVNPENLSFESVKEMELVQSFVYETLRLTPPVPSQYARARKDFKLSSHDSVYEIKKGELLCGYRPLVMKDPKVLDEPEKFVLERFTKEKGKELLNYLFWSNGPQTGRPTESNKQCSAKEIVTLTASLIVAYIFQKYDSVSFSSGSLTSVKKAS

SEQ ID NO: 44578 - protein, 183 aa, Zea mays
  misc_feature (151)..(151): Xaa can be any naturally occurring amino acid
MEGSSVVAVYGNGAITEAKKSPFSVKVGLAQMLRGGVIMDVVNAEQARIAEEAGACAVMALERVPADIRAQGGVARMSDPQMIKDIKQAVTIPVMAKTRIGHFVEAQILEAIGIDYIDESEVLTLADEDNHINKHNFRIPFVCGCRNLGEXLRRIREGAAMIRTKGEAGLGHRGSVRTGSLVG

SEQ ID NO: 44579 - protein, 131 aa, Triticum aestivum
MSYYDRRGESSVLEAFTLSPLPYPVILILMMVTLLLGASWFFSYEEFMEEASEQFSWFLLGVPIALVLLIRWISSVDTFEGYFGFYPTESRWRGYPAAPSEGSSPWGVAMVVLLLLVLASFHSTFQEMWKA

SEQ ID NO: 44580 - protein, 585 aa, Cryptococcus neoformans var. neoformans JEC21
MFLSRLAARQTRVQSYLPRQIAYRSFSSTIAIGMSMNDDILTKAVLPDNELKNGEKKAVDFGEGKVLLSKINGRVYATSAFCTHYGAPLEKGVLSHDGRLVCPWHGACFNVCSGDVEDAPGLDSLWSFSANVKNGQIEVTASKKEVTSKVGRIVARKRTKDQMQNQGQVSEETVVIVGGGSGGIHTLESLRMNGFGGKIVLISAENYAPIDRTKMSKSLLDDVEKLQWRTPDELRDSFGVDFHPGTTVTKVDFEAQTVTDSSGVLYKYNHLVLSPGGRPKKIPIPGADLKGVVTLRHVEDTKTITSSITKDSDVVLIGTSFISMEASVAVLKKGPKSVTLVGMDDVPFQGLLGKEFGSALMESMKEQGIKFRMSAQIEKITASDSNPDHAGMLHVKGSDPIPANLIIMGTGVSPATSFLEGSVKLEEDGGVLVDEYLHLKGYKNVYAIGDIAHYIQYPDKFPRRVEHWNVASNHGREVGHNITHPDNPVIYTKVPIFWSSIGKGLRYLGTGAGYDDMYVDGNFKELKFAAYQAKGGKVTAVATMQRDPIVSKASELMRLDLMPPLEEIKKGKDILQIELINKGQK

SEQ ID NO: 44581 - protein, 748 aa, Helicobacter hepaticus ATCC 51449
MANTFGYGGMTNHLGDMMFSKYILVIGANPAVNHPVSMVHILRAKEQGAKLVCIDPRFTKTAAKCDEFHRIRSGTDIAFAYGLLNHIIAKKLYDEQYLKERVYGYEDIIKEAQKFSPEVAADICGIPADEIRHIAEEMAAAKPASLIWNQGLTQHTIGTSNTRIMPILQMFLGNIGKNGGGVNILRGHDNVQGASDMNNLADSLPGYYGLGEPAWRHFCKHWGVEYEWMLGRFKDAEMMGKTGFAHSTWKFGVLDEENAANNGGTKLRALVVIGSGMTTVSLLDLQKKAMDMLDLVVFVDPYVNDLAIYSDRSDNLFMLPAASQMETSGSVAATNRSYQWRSKVMEPLFECRPDEEFLFGLAERLGFLKELQWRLYDIAKSKGREQFVWPEDATTELTQSIRSIGLQGMSPERLKAHQENWHLFDKVTLEGTGEFKGDYYGLPWPCWSDKHPGTPVMYNDTIPVMRGGMGFRVNWGVTSPDGQSMLTNRSLPNAKHIGGYAPVTAENAESLGISLSSEEKNAIEGSTFALGIGNNILVEKALEAGLCPYGNGKARANVWNWYDKIPLHREPLHSVRGDLVDKYPSFPDKPNLFRANVKYISRQKEKDWVKEFPINMLSGRLVAHMGTGAETRSAKYLAEVEGEMFVEIHPNKAAELKVKNGDLVWIYGTNGCKILVPAKLSVRVDENSIWLPQNFSGMDQGESRLDKYPEGTKPYAIGESANMISSYGYDYNSACPETKCGLCRIEKA

SEQ ID NO: 44582 - protein, 296 aa, Moorella thermoacetica ATCC 39073
MAAAEVGTWTVKKGLAEMLKGGVIMDVTTPEQAKIAEEAGACAVMALERVPADIRAAGGVARMADPTVILRIMDAVTIPVMAKARIGHFVEAQILEALGVDYIDESEVLTPADEDFHINKHEFKVPFVCGARNLGEALRRIGEGAAMIRTKGEPGTGNVVEAVRHMRRVMSEIRRLQNLPDEELMTFAKEIQAPYELVKQVKELGRLPVVNFAAGGIATPADAALMMQLGADGIFVGSGIFKSSDPRKRARAIVAATTHFREPEVLAEVSRDLGEAMPGIEIATIKPEERMQERGW

SEQ ID NO: 44583 - protein, 203 aa, Rhizobium leguminosarum bv. viciae 3841
MKSRNGPLRVGIGGPVGSGKTALTEKLCKAMRDDYSVAVVTNDIYTTEDAEALVRMQALTSDRIVGVETGGCPHTAIREDATINLQAIAGLNRRIPDLDVVFIESGGDNLAATFSPDLADITIYVISVCQGEEIPRKGGPGITRSDLLVINKKDLAPYVGADLEVMDRDATRMRASRPFVFSDMKRGDGVSSIVSFLREQGGL

SEQ ID NO: 44584 - protein, 428 aa, marine gamma proteobacterium HTCC2207
MSNRKATLTIEGQAPIELPILKGTLGQDVIDIGTLGSHNVFTYDPGFSATAACQSDITYIDGNKGILLHRGYPIEQLAEKSDYLETCYLLLEGALPNAEEKAEFVNTIKYHTMVNRSVEHFISGFRYDAHPMAMLVGVVGAMSSFYHDSLDINNEEHRKISAHRLIAKIPTIAAMCHKHFTGQPFIYPDNSLSYSENFLHMMFGTPCEPYVVQPAIAKAMDRIFLLHADHEQNASTSTVRLAGSTGANPFSCIAAGIAALWGPAHGGANEAVLDMLEEIGHEDNIEAYVAKAKDKSDPFRLMGFGHRVYKNHDPRATVMRESCDEVLAVLGLENDPLFRLAKKLEKIALEDEYFISKKLYPNVDFYSGIILKALGIPVEMFTVIFATGRTVGWISHWNEMITHPYRIGRPRQLYTGADVRDYPAMDDR

SEQ ID NO: 44585 - protein, 414 aa, Glycine max
  misc_feature (202)..(202): Xaa can be any naturally occurring amino acid
MEGSKENCVPRIPLIPSSNLQGPRMKPLLHHHHRLPLGNISQNVNMPHSQVNKLDLSRKCTAHTIQHHFPQPHPQPQENKKQNLLAPTPSYQLDCDIVDIDDDDGDGSDDAVPVFVKHTEAMLDEIDKIEEVEMEDVEEEPVLDIDACDRKDTLAVVEYIDDIYSFYKDIENSSRVSPNYMNSQFDINERMRAILIDWLVEXVHYKFELLEETLFLTVNLIDRFLERQAVIRNKLQLVGVTAMLIACKYEEVTVPTVEDFILITDKAYTRNEVLDMEKLMMNILQFKLSMPTPYMFMRRFLKAAHSDKKLELLSFFLVELCLVECKMLKFSPSLLAAAAIYTAQCSLYQFKQWTKTTEWYTDYSEEKLLECSRLMVTFHQKAGSGKLTGVYRKYNTWKYGCAAKIEPALFLLDN

SEQ ID NO: 44586 - protein, 338 aa, Glycine max
MGKVKIGINGFGRIGRLVARVALQRDDVELVAVNDPFITTDYMTYMFKYDSVHGHWKHHDVTVKDEKTLLFGDKPVTVFGHRNPEEIPWGSTGADIIVESTGVFTDKDKAAAHLKGGAKKVIISAPSKDAPMFVVGVNEHEYKPELDIISNASCTTNCLAPLAKVINDRFGIVEGLMTTVHSITATQKTVDGPSAKDWRGGKTASFNIIPSSTGAAKAVGKVLPALNGKLTGMAFRVPTVDVSVVDLTVRLEKEASYDEIKNAIREESEGKLKGILGYTEDDVVSTDFVGDSRSSIFDAKAGIALNKNFVKLVSWYDNEWGYSSRVIDLLVFVAKKSF

SEQ ID NO: 44587 - protein, 332 aa, Heterocapsa triquetra
MARAATRALVGAALFGCSFAFVQNSAVHPTAPSLRSTGASLRLNALPLEDVTPAVEQTEGRSWVAPVLGLSAMLGLVFGVLAPQPAKAITAEQFSQLTYAQVRGSGLANRCPTVESQGTEVPVTSSSRMQNFCLEPKSFAIEFETEPGKKEFVTTKLTTRQTYTLAFIEGALKPNPITFTEQDGMDFAAATVKMPDGEYVPFLFSCKQLIAKGDSSSFKPGFTWGGEFNVPSYRTGGFLDPKGRGMYTGYDQAVALPALQADGKGGQEELFKETNKVFDIGKGAIEMEVNKVNQELGEIGGVFVSKQPSDTDMGAKAPKTVLLKGIFYGKIV

SEQ ID NO: 44588 - protein, 448 aa, Archaeoglobus fulgidus DSM 4304
MCIMKYDVLIIGGGPAGIVTATTAKKFYPAKSVAIIKKEETSLVPCGIPYIFKTLGSVEADVMPTKPAENLGIEFIIDEVEDVDVKAKVVRTKGGKSISYEKLVFATGSTPVMPRIEGVEKKGVFTVSKNIEELRKLHEAVKKAEKVVIVGGGFIGVEVGEQIAKAGKKFTMVEMMDQLLPAAFDKEFARIAEEELKKLGVEVYLNSTVKRITGNSSVEAVELADGRKIEADVVIMSVGYRPNIELAKKAGLRISIGNRIWTDEYGRTSEKDVFAVGDCSEEKDFFTRETSRVMLASTATFEARIVGANLYSLKVVRVNKGTVGVFSTFVGDVALGAAGLTEEMAKKEGFEVVAGYGESLNRHLASIPGAAKTKVKLIFAKESGVILGGQVTGRYEVGEMVNQIAMAIQNNLTASEIDTLQIGTHPLLTSAPTTPPVILAAEDALRKM

SEQ ID NO: 44589 - protein, 332 aa, Porphyra yezoensis
MAPFLGFATAAAAGTCLFTPSARPGAAATCRSPAALPVAPPRMTSAGAPDAAARVAAVAAAAVFAASSLVGPPPPAAALTSADIRSLTYEQVKGTGLANRCPEVDVSKGSIPLSPNKSYKLVDLCLEPKSFQVEEEIGKKGESRKAFVDTKLMTRATYTLSGIEGILRSEGDTLVFEEKEGIDYAATTVQLPGGERLPFLFTIKQLVAKAAGGGSISTATEFGGTYRVPSYRTGGFLDPKGRGMVTGYDMAVGLPAMEADGREGQTKLFKETNKVFEVTDGEIEMAVNKLDAASGELGGVFVAEQLSDTDMGAKAPKNVLVKGVFYGRVAEH

SEQ ID NO: 44590 - protein, 409 aa, Moorella thermoacetica ATCC 39073
MLTGNCVVAQSGGPTAVINNSLGGVIEAALGSEAIKEVYGARHGVLGILREDFCDLRREDPASIQGLRYTPGAALGSCRYQLKNQEDYDRLLDIFRRYNIRYFFYIGGNDSMDTAAKVNRLALEEGYDLRVIGIPKTIDNDLPQTDHCPGYGSAAKYLATSVLEMGLDLKCIVTSTKVAIVETMGRNTGWLAAATALARRRPGDAPHYIYLPEVAFDMAAFLADVERAYRQYGTALVVVSEGLVDKNGNYVFNDAATVDVFGHQRLGGLGQFLLNKIERELNLKGRVILPATSQRSAMHLASRTDAEEAWAVGRVAVEAAVKGASGQMVAIRRLEGDTYQVTYELVDLDQVANKEKKLPRAWINEQGNDVTDHFINYVRPLIQGEVSIPFPNGLPAYVNLACHPVKDPD

SEQ ID NO: 44591 - protein, 212 aa, Glycine max
MNIFTKKPTAKEALRESKREMTNASRGIEKEIGALQSEEKKLVAEIKRTAKTGNEAATKILARQLIRLRQQIANLQGSRAQMRGIATHTQAMHAHSSVAVGLKGATKAMAAMNKKMEPAKQAKIIQDFQKQSAQMDMTTEMMSDAIDDALDNDEAEEETEELTNQVLDEIGVDVASQLSAAPKGRVATKNAENDSSSGIEELEKRLAALRNP

SEQ ID NO: 44592 - protein, 1572 aa, Ustilago maydis 521
MSSPPQKANRRAPQASAPPTLSHTPTSSATAAASATASATPMQATPSSLRSPTVSQPFIYPMRSAVSIKPLKNDLSTSHPPDAPISAAKSASRPASAEGPKSSPTKFPTFKPPPSAPHASHQAHHPEEVHNVTDPATADITVPVNKDESLCDHPEHLTTTRFEHVKTDEGHMILTGRGGKLARCEDEPIHIPGAVQSFGCMIVVRISPDGEMLVRQASENSAAILGMSPSYLFSLPTFLDLFDDDQADLLWDNIDTLDQSSQDLAESGPTVFQLRGYDMASYDERVSRGVQRNRWNTWCGAHIPDRRNDGQAELTVVLEFELVDDLTNPISTSSPPATPLDDRESHSGNGPGLGLAAGWIRPDQPTSSRQDSSPVTIGTVLSSSNASSVGPRAGLEGLAYTPSPNELHESTHAIHKPLKALSRMRRNAEIKSQTRSRRPAVLPNAGGADGTGGILDLFGILSQVNDQLAAQADLNEFLKVLVGIIRDITLFSRVMIYQFDEAWNGQVVCELVDWNDSHDLYRGLHFPATDIPAQARALYKINKVRLLYDRDQPTARMICRDQADLDFPVDMTHAFIRAMSPIHIKYLTNMGVRSSMSVSITAFGELWGLISLHNYGAHGKRVSFPIRQLLRLIGESVSSNIERLSYTRRLSARKLINTLPTDQNPSGYIISNAEDLLTLFDADYGVIAVGNEAKILGPLNASQEVLAVTEFLRLKKFEHLVTSQDVHRDFPDMVLSTGLHVIAGLLVVPLSGSGVDFIAFLRKAQLRHVNWAGKPFKEGKEGEAILEPRKSFKVWSETVEGTCRAWKDEELETASVLCLVYGKFISVWRQREQALHYNQLNRLLLSNASHEVRTPLNHIINYLELALDSKLDEDTRENLSKSHLASKSLLFVINDLLDLTKQEIGNELFLQEPFDLAATVREAVEMHEWEAKRRKIDFSVTTNPDVCLVLGDKNRVRQVITNTVTNSVKYTRAGQIIVSMRKRNEDEREADLPDGCDMEVELVVSDTGEGIPQEKLEVIFREFEQVESVIAQPGRQDLSEPEGSEASLLRTEPSDSGLGLGLAIVARVVKNLGGQLRVDSQVGEGTSFTYYIPFCSAETTTPTEMPPIGSSGGSGTKRSSDTISMRRSTSMGSGSASSAGRSEIDSLVEAIQQPVLRDQATSEDVVARRRTAEGVSPGLIHGSKIVSAGSIHRPEYAAQRTRSFDSGSHPVEGSGIPVRSVKINPQALDANDRADRRPASSSAFLLSATTHARPVKPSHTSAAESFKAEVEQRFRDKVPQLAQATLPVDASKLRSCQMADKEATVSPTTRAKSGVEAPQNEAVSPDCGDVHMAKRSSDERRSSSSSSVAKRRLAVMRGLHKAPGGRGEKIAPLRVLVVEDDPINRMILKKRLGLDGHTTLLAVNGEEGVRQFEQDAKEIDVILMDLQMPICNGQEACIRIRDLEHKWAERGEQADRPASQILNGRVPILAVSATLVPQMRQEMVDIGMDGWLLKPIDFARLGALLKGLLHPEDRVANHWRSGYVWEKGGWLSEPAQRSVLVAPSAVSEMIGHSSSNASNANPLSPPLSSPSA

SEQ ID NO: 44593 - protein, 122 aa, Arthrospira platensis
HDRNKGFWWSHMGWMLREIPADADVPRFTKDINEDPVYLFLQNYFIPIQVALGVVLYLLGGWPLVVWGIFFRIVVVFHCTWFVNSATHKFGYRTYQSNDNSKNCWWVALVTYGEGWHNNHHA

SEQ ID NO: 44594 - protein, 153 aa, Brassica napus
MFTCIACTKADGGEELGARGGTTPNTKESVKSLTTQIKDMAMKFSGAYKQCKPCTGSPRSPMKKGHRPFSDFDNASEGVPYPYMGGSAGSTPAWDFINSSHHPAGAKFTSIYGNDRESISAQSCDVVLDDEGPKEWMAQVEPGVHITFASLPS

SEQ ID NO: 44595 - protein, 235 aa, Triticum aestivum
AYSGDIIDQVCTKKQAGTGPEFPGYFAIPFLPPTSSTDAARDRGEGESSSEQIDRVGLPAMGNASSMLTQYDIEEVQEHCSYLFSQQEIVSLYERFCQLDRSAKGFVAEDEFLSIPEYSTNPLSQRLLRMVDGLNFKEFVSFLSTFSARASLQQKIEFIFKVYDIDGKGKVSFKDLVEVLRDLTGSSMSEKQREQVLTKVLEEAGYTRDSTLSLEDFVTIIGHTGLKMEVEVPID

SEQ ID NO: 44596 - protein, 481 aa, Arabidopsis thaliana
MAGGAFVSEGGGGGRSYEGGVTAFVIMTCIVAAMGGLLFGYDLGISGGVTSMEEFLTKFFPQVESQMKKAKHDTAYCKFDNQMLQLFTSSLYLAALVASFMASVITRKHGRKVSMFIGGLAFLIGALFNAFAVNVSMLIIGRLLLGVGVGFANQSTPVYLSEMAPAKIRGALNIGFQMAITIGILVANLINYGTSKMAQHGWRVSLGLAAVPAVVMVIGSFILPDTPNSMLERGKNEEAKQMLKKIRGADNVDHEFQDLIDAVEAAKKVENPWKNIMESKYRPALIFCSAIPFFQQITGINVIMFYAPVLFKTLGFGDDAALMSAVITGVVNMLSTFVSIYAVDRYGRRLLFLEGGIQMFICQLLVGFAWSWGPLGWLVPSEICPLEIRPAGQAINVSVNMFFTFLIGQFFLTMLCHMKFGLFYFFASMVAIMTVFIYFLLPETKGVPIEEMGRVWKQHWFWKKYIPEDAIIGGHDDNNTN

SEQ ID NO: 44597 - protein, 411 aa, Nostoc punctiforme PCC 73102
MPGGVSSPVRAFKSVGGQPIVFDRVKGAYIWDVDGNQYIDYVGTWGPAICGHAHPEVIAALHEALEKGTSFGAPSTLENVLAEMVIDAVPSIEMVRFVNSGTEACMGVLRLMRAFTNRDKIIKFEGCYHGHADTFLVKAGSGVATLGLPDSPGVPKAATSTTLTAPYNDLESVKALFEENRDEIAGVILEPVVGNAGFIAPDAGFLEGLRELTHEYGALLVFDEVMTGFRIAYGGAQEKFGVTPDLTTLGKVIGGGLPVGAYGGRRDIMSMVAPAGPVYQAGTLSGNPLAMTAGIKTLELLQKPGTYDYLERITKKLADGLLQIAKETGHTACGGQISAMFGLFFTSGPVHNYEDAKKSDTAKFGRFHRGMLERGVYLAPSQFEAGFTSFAHTEEDIDQTLAIARDVMSSL

SEQ ID NO: 44598 - protein, 569 aa, Moorella thermoacetica ATCC 39073
MLLKGIAISPGKVIGRAHRLIEHANNYSRSFLTSEVEKEKELARLAQAFNQAKEQLASLIDKTKREIGLQEAKIFEAHLLLLSDPLLGEKIRTKIQVEGKDAVWAVSEATEEIAQEFASLEDEYFRERAVDIRDIGRRLIACLGNGLEEVSDEATNTIIVAEELTPSQTASFSRRTVAGIITEKGGPTSHTAVVARSLGIPAVSGVTNLLDLVKDGDFVFIDGNNGVIHLNPDVEEIKNLPTNGQNNWREKRCIRNALAKAITRDGHEIEVATNLRNFEEAELALAYGAEGVGLFRTEFLYMNRQEPPGEEEQFLIYRDVLLALKDKPVIVRTLDIGGDKHLPYLEQDKEDNPFLGLRGIRLCLKHKDLFKTQLKALLRASSYGNLKLMFPMVTTLEEIRQAKTLLEEAREELQVAGIETSINIPIGIMIEVPAAALMADILASEVDFFSIGTNDLTQYTLAVDRDNEKVAVLYDAYHPAVLKFIYQVVDAAHRKGKWVGLCGELGGDSLAAPLLVGLGLDEISMSPVFIPAMKERIRALSYEEGRELVRRLLELPGAKEVREVLVKTS

SEQ ID NO: 44599 - protein, 410 aa, Oryza sativa (indica cultivar-group)
MSTPGAAWSRNGSRTLDAAATAPGRTLGVGAAAAAPSFGRGSFGHAVGVPPPPRSRGRGRGSVAAATTVPAFSIDGSVGGDFTSSIGPHASSQPWFDAAGGDPSSPGSWDQDVRPPGGFMSYFGNEAQNSHLVGAVIHMSPLNQAHNGSSPPEVEILHGNDSVRTEKRIMWTPDEDVRVMSAWLEHSTDSTCGADKGGVQYWGEVVETYNKTTPPLRRRNAKQCKDRWHKINKWTDLFECAYAKARRVFTSGYSAEMWLDAAHKFYVDDNKECKDVVGPYMLTEVWKICRDVPKWKTYNENLKNARKRKAFHLEGEYEENEDTCDEMPQRPIGRKAAKKEALAAKNGKLKGSSSSDDGHSKDSPIELDKFDRYSKFQEANNEKRMKLLDRQEKIASEKLEATKIAHLTAQ

SEQ ID NO: 44600 - protein, 232 aa, Triticum aestivum
  misc_feature (145)..(145): Xaa can be any naturally occurring amino acid
  misc_feature (155)..(155): Xaa can be any naturally occurring amino acid
  misc_feature (174)..(174): Xaa can be any naturally occurring amino acid
  misc_feature (213)..(213): Xaa can be any naturally occurring amino acid
MASDGVVALYGNNKAVVEPSAKPAAATFSVKVGLAQMLRGGVIMDVVTAEQARLAEEAGACAVMALERVPADIRAQGGVARMSDPALIRDIKRAVTIPVMAKARIGHFVEAQILEAIGVDYVDESEVLTLADDAHHINKHNFRVXPFVCGCRDLXEALRRIREGAAMIRTKGEXAGTGNVVEAVRHVRSVMGALRALPNMDEDKAFRYAKQIXAPPYNLLMQTSSLGRLRPC

SEQ ID NO: 44601 - protein, 495 aa, Rhizobium etli
MAISSTLLGRLKDQTLVREQMLVGGKWSSEGVNGTRINVLNPSTMDVLASLPSAGLAEVRASIDAAKAAQKKWAKVSAKERSLIMRKFYEEVVANAEDLAVILTSEMGKPLAEARGEIAYGASYIEWFGEEAKRVYGDTIPGHQADKRLLVIKQPVGVVAAIAPWNFPSAMVCRKIAPALASGCAIVFKPAAETPLSALALAILAERAGIPDGLFSVLPTDNARMFGEEVCSNPVVKKLTFTGSTEVGRILMAQGAQKIMKLSLELGGNAPFIVFDDADLDQAVEGAMLSKFRNAGQTCVCANRIYVQSGIHDRFVEKLAMRVSALQVLDGFESGATIGPLINDEAVAKLYGHIDDAVTKGATVVVGGDRDARGGTFVQPTLLSGATKDMKVAREETFAPLAPVFKFDTVEEVIELANDTEFGLAAYFFANDLRNVWKVTEALEYGMVGVNTGLISTELAPFGGVKQSGFGREGSKYGMDDFLSMKYVCMGGIGA

SEQ ID NO: 44602 - protein, 115 aa, Arabidopsis thaliana
WASSTTPPGVVIPFRRKLVGEEFKGRARDPERKESVRPNFRPKGPPVQRAPLRLKDFLVTLDSRLARTQVVPPVAPLSQQAGFFCRVGDGVVKDPATSWVHLIGKNLQRALGLSL

SEQ ID NO: 44603 - protein, 397 aa, Methanothermobacter thermautotrophicus str. Delta H
MSIMDDLMEGRIKLYEIERHVPVDEAVRIRREFIERTCGVKLEHVSNYSIDMERASRRNIENPIGVVQIPLGVAGPLRVRGEHADGEYYVPLATSEGALVASVNRGCSVITRAGGATVRVTGDSMTRAPVIRTGSVVEALQLREWIYENMDALREEAESTTRHGKLVKIDPIIVAGSYVYPRFVYTTGDSMGMNMVTIATERALELLTRETGAHVIALSGNLCTDKKPAAVNLIEGRGKSITAEITVPGEMVESVLKTTPEAVVEVNTAKNLIGSAAAGSMGFNAHYANIIGAIFLATGQDEAHIVEGSLGVTIAEERKGDLYFAVNLPDVPLATVGGGTGLETASECLDIMGVRGGGRVHAFAEIVGGAVLAGELSLMGALAAGHLARAHSELGRG

SEQ ID NO: 44604 - protein, 437 aa, Moorella thermoacetica ATCC 39073
MTDSEAWPRSAAAFAEAVKLMPGGVNSPVRAFKSVGLTPPFIQRGEGAYLYDIDGHKYIDYVSSWGPLILGHRHPEVVDALEKTLREMGTSFGAPTELENELAREITTAMPAVEMVRLVNSGTEATMSALRLARGYTGREKVVKFAGCYHGHADYFLIQAGSGALTFGIPNSPGVPATVAANTIVAPYNDLAAVEDIFQKAGEEIAAVIVEPVAGNMGCVPPLTGFLAGLRTITKEYGSLLIFDEVMTGFRVAFGGAQALYGIRPDLTCLGKIIGGGLPVGAYGGRREIMERVAPSGPIYQAGTLSGNPLAVSAGLATLKVLKKPGTYERLESLSARLEKGLKEAAAEAGVPVTFNRVGAMFTTFFNPGPVTDYATATASDTRAFAAFFRAMLRQGIYLAPSQFEAAFMSLAHREDDIDCTIAAAREAFKGIAIGDS

SEQ ID NO: 44605 - protein, 544 aa, Staphylococcus aureus subsp. aureus MRSA252
MKGIELLNNPFLNKGTAFTNEERKQLGLEGLLPANVRTLEQQAEQCYEQFKAKQTDFEKRLFLMAIFNRNRTLFYKLTSEHLVEFMPIIYDPVIAQSIEQYNENFSRPQDAVFLSVDRQDQIEQELRNVANGRDIRLIVVTDAEGILGIGDWGVDGVDIAIGKLIVYTAAAGINPAQVLPVSLDVGTNNEQLLNDELYLGNRHKRVDDETYYTFVDKFVSAVRKEYPNALLHWEDFGRGHAKNILDKYEDTLPTFNDDIQGTGIVTLAGVLGALNISKVDYTNQTFLVYGGGTAGMGITNILKDELIKQDVSEDKANQHFYIMDKQGLLFDDMDDLTEAQQVFAKNRNEFSNTVNWKNLKEVIENIKPTVLIGTSTQTGAFTEDAVKEMLKHTERPMIFPLSNPTKLAEATAQDLLKWTNGKALIGTGIPYNDIEYNGVNYSIGQANNALMYPGLGLGLIASKAKKVNQQILSAASHALGGMVNPDEPGAAVLPPVEKIHQCSRAIAKAVAQSVIDQGLNAETIDDIDEAIEAEIWYPEYKSYI

SEQ ID NO: 44606 - protein, 139 aa, Glycine max
  misc_feature (40)..(40): Xaa can be any naturally occurring amino acid
  misc_feature (91)..(91): Xaa can be any naturally occurring amino acid
  misc_feature (109)..(109): Xaa can be any naturally occurring amino acid
LDRRDYDFVGEKKDEENKPHPQAEAIATEFHTVTVSDHGXNQRRLLDKLYRSDSRSSSSCEEEGEDGGKREKKKKEKKGLKERIEEKIEGXHHDDQDEDTGDPAEKADXLMKHAHAAEQTGVLDEITEKLPGHKPTDEA

SEQ ID NO: 44607 - protein, 507 aa, Dechloromonas aromatica RCB
MSEINTLAGENAIIIAADAVPEITFADLGLAPELLRAVLDEGYTKPTPIQAQAIPLVISGKDIMGGAQTGTGKTAAFTLPILQRILPFASSSPSPAKHPVRALILAPTRELAMQVFESVKTYSKHTPIRAMCAYGGVDIRPQIAELKKGVEILVATPGRLLDHVENKSVSFNSVQALVLDEADRMLDMGFVPDVTRILNMLPAQRQSLLFSATFSEEIKKLADTMLKSPILIEVARRNQVSDTITHRVHPVSEYGKRGLLTKLLKSGEIRQCIVFCRTKQGCSRLTRELQRAGIKADAIHGDKSQLERIKALEAFKGGETDALIATDVAARGLDVDDLPYVINYELPHTPEDYVHRIGRTGRAGKKGNAISLVSAHEVCYLVDIEKLIKRPIEQVEVAGFEPEPEYEYPPGNKRKRSAAPPAKAPVAHRPERPERSERSERPDRGDRDRRPPRRNPMIAADGFDFSKPYEDNSPRGEVPDSPQAPSKVDPHKPKRVVAALLGGLGRK

SEQ ID NO: 44608 - protein, 221 aa, Methanothermobacter thermautotrophicus str. Delta H
MNTKICVPVFEKTAPEVTESAGRAIDAGADILEIRIDGLQNPGEVNIRELIEDIGFPVIATNRSPVEGGHFSGSEDERIKLLMAAAEVADFVDIELSSAREDIERVTGSARRSIVSYHNFRETPSLEALLRIVRMAKEMGDIAKVAVMPENLADTLVVLQLLTFEEDTVAISMGELGKYTRVAAALFGSPITFASMGRGTAPGQMDVDVTRKMIGELMPED

SEQ ID NO: 44609 - protein, 891 aa, Oryza sativa
MPPRKDPNGGAFPSEPAPPQPAKAKGKKKDENKDDDLSEEDQALKEQLELYVVRAQDPDPGVQKLALESMRQEIRSATSSMTSVPKPLKFLRPHYGILKAYFETMPESELKKYMADILSVLALTMSAEGERESLKYRMIGSEGDIGSWGHEYVRNLAGEIAQEFQKRQDDGMTTDSLKELVEQIVSFHMKHNAEPEAVDLLMEVEKLDLLVKHVDSTNYKRTCLYLTSSSKYLPAPDDMSALKIAFEIYMKFGDFANALRIALLLYDKSLELKPIFTATDDFQLKKQFAFIIARHGLSTDIDDDIAADENEKEALQDIISNIKLSEGYLTLARDIEVMEPKSPEDIYKVHLIDGRGATSSSLDSARQNLAATFVNAFVNAGFGQDKLMTAPSDSSGSGSSGNWLFKNKEHGKASAAASLGMILLWDSDSGLAQLDKYLHSNDIHVVAGALLGIGIVSCGVKSDCDPAFALISEYFSRDESIIRIGAILGLGIAYAGSQKEEVRENLTAFLSDSQVPLEVLVFAAISLGLVFVGSCNEEIAQTIICVLMEHSEPELAEPIIRLLPVALGLLYLGKQESVEATAEVSKTFDEKIRNYCDVTLMSLAYAGTGNVLKVQKLLGICSEHLEKGETHQGPAVLGISLISMAEELGAEMAVRSLERLLQYGEQNIRRAVPLALGLLCISNPKVNVMDTMSRLSHDADAEVSMAAIISLGLIGAGTNNARIAGMLRNLSSYYYKEAGHLFCVRIAQGLVHLGKGLLTLSPYHSDRFLLSPIALAGLVTVLHACLDMKSIILGKYHYMLYILALAMQPRMLLTVDEDLKPLSVPVCVGQAVDVVGQAGRPKTITGFQTHSTPVLLAAGERAELATEKYLPLTPVLEGFVILRNNPEYHED

SEQ ID NO: 44610 - protein, 475 aa, Xanthomonas campestris pv. vesicatoria str. 85-10
MSSVSIDGAPDAGENTRFIILISCVATIGGFLFGFDSGVINGTVDGLKQTFQSTAAETGFEVASMLLGCAIGAFFAGRLADRWGRRAVLIISAALFLLSAIGAGASHSSGFFIFARVMGGFAVGAASVISPAYIAEVASARYRGRLATMQQIAIISGLFCAFLSNYLLANAAGASTEPLWAGQAAWRWMFWMQAVPSILFLLLLLVIPESPRYLVVKGRREQALVVLKRLYGNAAAQTKLGEISASMAADQHKPKFSDLINKATGKIRPIVWIGIGLAVFQQLVGINVVFYYGAVLWQAVGFSEQDALLINVLSGGLSIGACLVTVMLVDKIGRKPLLWIGSAGMAVSLALVTYAFATASLDPNGKLAMSDAMGMLALVAANVYVVFFNASWGPVMWVMLGEMFPNQIRGSGLAIAGAAQWTSNFAITVSFPILLGSIGLAGAYGIYTVAAFISVFFVLKYVYETKGKELEQMEG

SEQ ID NO: 44611 - protein, 550 aa, Chromobacterium violaceum ATCC 12472
MSEHDTPETVPETAPQDPSRRRLFEGLAAIGAATVLPAVASEAADAAPAARGSLDDKLRHHVKNVVVIYLENRSFNNLYGNFPGVRYPLSKAPAEACIQLDRDGARLKSLPKIWGGMVQRGQTVGGKYYLIEEDKIQNLPNGPFPLKDTDGEPLPEGVITRDLWHLFYQNQMQINGGRNDQFVAWADSGALVMGYYNETAKNLNQWKIAQQYTLCDNFFMAAFGGSYLNHQFLISARTPEYFNAKDTAAAKKIAVLEDGPKGYRLKVKTPTSAMDGPPQFVNNGAITPDGYAVNTMAPPFQPSYVKPAEGGDKRYADPADANTLPPQTYDTIGDLLSRKGVSWAWYGGSWQAALDGKGGPDTPNFQYHHQPFNYFKNFAPGTQARAEHLRDGGLGDSPISNRFIADAVAGKLPAVSFYKPQGNLNMHAGYSDVESGDRHVANVLQHLMSGPQWKNMVVVITHDENGGWWDHVAPPKGDRWGPGSRIPAIVVSPFAKKGHVDHTFYDTTSIIRFISRLHGLPELEGVKVRNKAFRERGAQPPGDLTGALQF

SEQ ID NO: 44612 - protein, 216 aa, Nostoc punctiforme PCC 73102
MSSNDLRSLHYAIPVEKIRYDERGLVPAIVQDYLDGTVLMMAWMNQESLQKTLETEETWFWSRSRQELWHKGATSGHIQKVQSIRYDCDSDALLIGVEQLGDIACHTGERSCFHQIEGNIVSPPGDALSQLFQIICDRRDNPTESSYTCKLFAGGDNKILKKIGEETAEVVMAFKDDEADAIAGEVADLLYHTLVALAHHQVDLKSVYRKLQERRQ

SEQ ID NO: 44613 - protein, 161 aa, Brassica napus
MGSSCEIVDLSTSARRITGDNRISLKFYFRIADNILKQANIFRAEKNVIDLYVMLLRFSSLALETIPSHRDYRTSLKSNKEYLRMRLLDVLTELEKLKPVVQQRIDDLNPKPLPRYSVQAHPANGTPRWSSAVKPSLTGYDHAKVLNPSGHNFGYMGSRVS

SEQ ID NO: 44614 - protein, 517 aa, Oryza sativa (japonica cultivar-group)
MVAASGAGRPEYPGGLTMFVSMACLVAATGGLIFGYDIGVSGGVTSMDPFLSRFFPSVYRAQSAAAAAAGGNQYCRFDSQLLTMFTSSLYLAALASSLGAATVTRVAGRKWSMFAGGLVFLAGCALNGAAANVAMLIVGRVLLGVGIGFANQSVPVYLSEMAPARMRGMLNNGFQMMITTGVLAANLINYGTARIAGGWGWRLSLALAAVPAAVMTAGALFLPETPNSLLERGRRGEARRMLQRVRGEGVDMEDEYNDLVAAGEASHAVASPWRDILRRRNRPPLVMAVAIPLFQQLTGINVIMFYAPVLFRTLGFGGGASLMSAVITGGVNMAATLVSVLAVDRVGRRALFLEGGAQMVASQAAVGALIGARLGWSGTAAIPAGYAAAVVAAMCVYVAAFAWSWGPLAWLVPSEVMPLEVRPAGQSITVAVNMAMTFAVAQAFLPLLCRLRFVLFFFFAGWVAAMTAFVALFVPETKGVPIEDMAAVWSDHWYWKRFVDGDGDGARRRGDIEMGHK

SEQ ID NO: 44615 - protein, 521 aa, Glycine max
MSVRDHTQKIDLVETMKELWAQMGSLMATIVFMYTIFERFFPPHLREKLQAYTQKLTNHFNPYIQISFPEFSGERLKKSEAYTAIQTYLSANSSQRAKRLKAEVVNDSQTPLVLSMDDNEEITDEFHGIKLWWSANKVSNNPQRYNPFSYYGSSDEKRFYKLTFHKRHRDIVTMSYIKHVLDEGKDIEMRNRQLKLYTNNPSSGWYGYKQSKWSHIVFEHPATFETLAMDRRKKEDILKDLVKFKKGKDYYAKIGKAWKRGYLLYGPPGTGKSTMIAAIANFMNYDVYDLELTAVKDNTELRKLLIETPSKSITVIEDIDCSLDLTGQRKKKKEENEDEEQKDPMRRNEEESSKSSKVTLSGLLNFIDGIWSACGGERIIVFTTNYVEKLDPALIRRGRMDKHIEMSYCCYDAFKVLAKNYLDVESHHLFGAIGGLLEETDMSPADVAENLMPKSVDEDVEICLHKLIKALEEAKEEKARKKAEEEEEARLKEEKVKEESTQMEEKHKGKTGEDVKENGFH

SEQ ID NO: 44616 - protein, 87 aa, Zea mays
  misc_feature (19)..(19): Xaa can be any naturally occurring amino acid
MRAPAGAQKRCVFRGNIPXDATEEHFVQICKEVGPAESLEMGVDKEPGNPKRFGLWEAKGEEKCFKAPPKPLGIKKIGGPPYTVFFS

SEQ ID NO: 44617 - protein, 104 aa, Cryptococcus neoformans var. neoformans JEC21
MVKAIESYDEWKTLTSGSDVVVVDYWATWCGPCKMISPHFAKLEGKFPNVKFAKVDVEEQEDIAKEAQIKAMPTFVAYKDGKVIETVTGAVPAKINALLDKVAA

SEQ ID NO: 44618 - protein, 143 aa, Salmonella enterica subsp. enterica serovar Typhi
EFWDWVGGRYSLWSAIGLSIILSVGFDNFVELLSGAHAMDKHFSTTPAEKNLPILLALIGIWYNNFFGAETEAILPYDQYMHRFAAYFQQGNMESNGKYVDRNGNAVDYQTGPIIWGEPGTNGQHAFYQLIHQGTKMVPCDFI

SEQ ID NO: 44619 - protein, 118 aa, Brassica napus
MATTMKGLLKGLRYITQIFDEEKEEEMQIGFPTDVKHVAHIGNDGPATNAPSWMNDFKPQEHENGQVVSRGNSNKYNPQEMNQSSAGLKELLPPNTNEKQKQKTRRKPGSAASPNHNG

SEQ ID NO: 44620 - protein, 318 aa, Xanthomonas axonopodis pv. citri str. 306
MTADIRMSARIPTLDITRFDTDREAFVAELGAAYRQWGFAGIRNHGIAQADIDAAYEVFKAFFALPEATKRRYHVEGSGGARGYTAFGVETAKDSKHFDLKEFWHIGREIPDDSPYRAVMPPNLWPSEVAGFRERGHQLYQQLDQLGSRVLSALALHIGLPQDYFVDKTNNGNSILRPIHYPPITSDDIPNVRAGAHGDINFITLLVGASAAGLEVRSHEGEWVPFTADADTIVVNIGDMLQRLTNHVYPSTIHRVVNPPGEQARQPRYSVPFFLHPNPDFLIDVLPSCISADNPSRYPEPITAHGFLEERLREIKLK

SEQ ID NO: 44621 - protein, 473 aa, marine gamma proteobacterium HTCC2207
MNSDQPSTQAAEIISSDREHIWHHLTPHNAFKNSDPLIIKSGVGMRVTDIKGTEYLDATSGGVWSVNVGYGRESIANAVRDQILEMCYFANSAGSIPGAQFAQRLLQKMPEMQDADVNSKNHGKGKVYYSNSGSEANEKVYKMVRQLAHINGDGRRHKIIFRDRDYHGSTIGALSSTGHQQRKEQYGPFAPGFSEFAHCCCYRCPFGKTYGSCDIECAKDLEAAILREGPDQVGAVVLEPITAGGGIIPPVPEYFPIIQAICKKYSVLLHIDEVVCGLGRTGKWFGYQHYDVKPDLVTMAKGLASGYAAISCTVATDKVFNQFAAEDAGTLDYFRDISTFGGCTAGPAAGLANMAIIEEENLLDNVMQMGAHLKDRLFDLQEKYPVIGDVRGKGFFAGVELVSDRSTKQPVHESYAMKIVAHCMAQGVLIGRTNRSFTEFNNNLCLSPALIASRRDIDDIVDAIDLALTDNPL

SEQ ID NO: 44622 - protein, 505 aa, Staphylococcus aureus subsp. aureus MRSA252
MAKKPTALIILDGFANRESEHGNAVKLANKPNFDRYYNKYPTTQIEASGLDVGLPEGQMGNSEVGHMNIGAGRIVYQSLTRINKSIEDGDFFENDVLNNAIAHVNSHDSALHIFGLLSDGGVHSHYKHLFALLELAKKQGVEKVYVHAFLDGRDVDQKSALKYIEETEAKFNELGIGQFASVSGRYYAMDRDKRWEREEKAYNAIRNFDAPTYATAKEGVEASYNEGLTDEFVVPFIVEDQNDGVNDGDAVIFYNFRPDRAAQLSEIFANRAFEGFKVEQVKDLFYATFTKYNDNIDAAIVFEKVDLNNTIGEIAQNNNLTQLRIAETEKYPHVTYFMSGGRNEEFKGERRRLIDSPKVATYDLKPEMSAYEVKDALLEELNKGDLDLIILNFANPDMVGHSGMLEPTIKAIEAVDECLGEVVDKILDMDGYAIITADHGNSDQVLTDDDQPMTTHTTNPVPVIVTKEGVTLRETGRLGDLAPTLLDLLNVEQPEDMTGESLIKH

SEQ ID NO: 44623 - protein, 695 aa, Blastopirellula marina DSM 3645
MLMVYPHPELQFTHILPYGAVLHERGVQFVVFSRNATAMRLLMYKSVDDTEPSEIIDFDRDTDRWGDIWSIFVPGVSAGQLYHFQAEGPYDPSRGMLFDGRARLIDPYAKALAGTFQPAFDGIVRPPKCVVVDDQFNWEGDRHLRRDLSESIIYEMHVKGFTASETSGVKNPGTYAGVVEKIPYLKSLGVTAVELMPVHEFPIMDMMTGEKPTRNNYWGYDSMAFFAPHRGYAASKEPGGQVREFKEMVKALHQAGIEVILDVVYNHTCEGNEMGPILGFKGLENQVYYMMANGGSHYKNYSGCGNTVNGNHPIVREMIFHSLRHWVHNYHIDGFRFDLASILSRDRNGNLVPNPPLVEAIAEDPLLADTKIIAEAWDAAGAYQVGSFANMRWAEWNGRYRDDLRSFWRGDPGKLGALATRLAGSSDLYQPGGRQPYHSINFITSHDGFPMNDMVSYNDKHNDANGENNRDGDNHNISYNYGVEGPTRRRSIEKTRQRQIKNMMTTLLLSQGVPMILMGDECRRTQGGNNNAYCQDNEISYMNWKLVEKNADLRRFVKALVAFRRDQPTVRQKHFLSGKPTGRRGLFDVNWYSALGTAVTWDAAEGTLTCVLAAPEPFNDPHGVGRDVLLIMNSSAAPAQFILPPVAKATSWRMFVDTAAEPPADVYPDLNGPRPPASGKFVMPERSMRVYVAAR

SEQ ID NO: 44624 - protein, 1192 aa, Solanum lycopersicum
MSHKRCHEYFSLNGVLKNVVFMIILLSSSFLVVVSNARKLAENDQVGRLLAFKKSSVESDPNGFLNEWTLSSSSPCTWNGISCSNGQVVELNLSSVGLSGLLHLTDLMALPTLLRVNFSGNHFYGNLSSIASSCSFEFLDLSANNFSEVLVLEPLLKSCDNIKYLNVSGNSIKGVVLKFGPSLLQLDLSSNTISDFGILSYALSNCQNLNLLNFSSNKIAGKLKSSISSCKSLSVLDLSRNNLTGELNDLDLGTCQNLTVLNLSFNNLTSVEFPPSLANCQSLNTLNIAHNSIRMEIPVELLVKLKSLKRLVLAHNQFFDKIPSELGQSCSTLEELDLSGNRLTGELPSTFKLCSSLFSLNLGNNELSGDFLNTVISSLTNLRYLYLPFNNITGYVPKSLVNCTKLQVLDLSSNAFIGNVPSEFCFAASGFPLETMLLASNYLTGTVPKQLGHCRNLRKIDLSFNNLVGSIPLEIWNLPNLSELVMWANNLTGEIPEGICINGGNLQTLILNNNFISGTLPQSISKCTNLVWVSLSSNRLSGEIPQGIGNLANLAILQLGNNSLTGPIPRGLGSCRNLIWLDLNSNALTGSIPLELADQAGHVNPGMASGKQFAFVRNEGGTECRGAGGLVEFEGIREERLAILPMVHFCPSTRIYSGRTMYTFTSNGSMIYLDLSYNSLSGTIPDNLGSLSFLQVLNLGHNNFTGTIPFNFGGLKIVGVLDLSHNSLQGFIPPSLGGLSFLSDLDVSNNNLSGTIPSGGQLTTFPASRYENNSGLCGVPLPPCGSGNGHHSSSIYHHGNKKPTTIGMVVGIMVSFICIILLVIALYKIKKTQNEEEKRDKYIDSLPTSGSSSWKLSTVPEPLSINVATFEKPLRKLTFGHLLEATNGFSSESMIGSGGFGEVYKAQLRDGSTVAIKKLVHVTGQGDREFMAEMETIGKIKHRNLVPLLGYCKIGEERLLVYEYMKWGSLESVLHDGGKGGMFLDWPARKKIAIGSARGLAFLHHSCIPHIIHRDMKSSNVLLDENFEARVSDFGMARLVNALDTHLSVSTLAGTPGYVPPEYYQSFRCTAKGDVYSYGVILLELLSGKRPIDPRVFGDDNNLVGWAKQLHNDKQSHEILDPELITNLSGDAELYHYLKVAFECLDEKSYKRPTMIQVMTKFKEVQTDSESDILDGISVKGSILEESQEREP

SEQ ID NO: 44625 - protein, 175 aa, Triticum aestivum
MAPTVMASSATSVAPFQGLKSTAGLPVSRRSSSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 44626 - protein, 504 aa, Xanthomonas campestris pv. vesicatoria str. 85-10
MTQTNGFDALHAHAQRLRGAAIPALLAAEPQRPTQYARQVGPLYFNFARQKYDRAALDALFAIARERDLAGAFQRLFRGEQVNVTEQRAALHTALRGDLTDAPVASEAYATAAEVRQRMGALIQQLEATEVTDIVSVGIGGSDLGPRLVADALRPVSGARFRVHFVSNVDGAAMQRTLATLDPARTAGILISKTFGTQETLLNGSILHAWLGGSERLYAVSANPERAAKAFDIAPGRVLPMWDWVGGRYSLWSAVGFPIALAIGFERFEQLLEGAAQFDAHVLNTPLEENVAVLHGLTAVWNRNLLGSATHAVMTYDQRLALLPSYLQQLVMESLGKRVKLDGSAVDSDTVSVWWGGAGTDVQHSFFQALHQGTSVVPADFIGTVHNDDPYAENHVALMANVLAQTEALANGQDSSDPHRSYPGGRPSTVILLDALTPQALGGLISMYEHSVYVQSVMWGINAFDQFGVELGKQLASQLLPALKGEAADVADPVTRELLSKLRG

SEQ ID NO: 44627 - protein, 239 aa, Cryptococcus neoformans var. neoformans JEC21
MSHSSLDYPEMKELFNRNLKWSENVWARDPSFFPHHFPGQRPEILWIGCSDARVPETTILGCQPGDIFVHRNIANLYSPQDDSLNAVLMIALFNFNVKHIVVTGHTNCVGCLTALNVSRLPATPPTTPLQRYVKPLATLARTLYTPDGPPTLDLLVEENVVQQVKNLVESDIIKGVSGVYIQLKRKNADISLQNWKKRGADGVVIHGWVYHLEDGTIRDLNVSVGPSGHIPGKKVKSLF

SEQ ID NO: 44628 - protein, 446 aa, Thermotoga maritima
MNVKKFPEGFLWGVATASYQIEGSPLADGAGMSIWHTFSHTPGNVKNGDTGDVACDHYNRWKEDIEIIEKLGVKAYRFSISWPRILPEGTGRVNQKGLDFYNRIIDTLLEKGITPFVTIYHWDLPFALQLKGGWANREIADWFAEYSRVLFENFGDRVKNWITLNEPWVVAIVGHLYGVHAPGMRDIYVAFRAVHNLLRAHARAVKVFRETVKDGKIGIVFNNGYFEPASEKEEDIRAVRFMHQFNNYPLFLNPIYRGDYPELVLEFAREYLPENYKDDMSEIQEKIDFVGLNYYSGHLVKFDPDAPAKVSFVERDLPKTAMGWEIVPEGIYWILKKVKEEYNPPEVYITENGAAFDDVVSEDGRVHDQNRIDYLKAHIGQAWKAIQEGVPLKGYFVWSLLDNFEWAEGYSKRFGIVYVDYSTQKRIVKDSGYWYSNVVKNNGLED

SEQ ID NO: 44629 - protein, 795 aa, Candida albicans SC5314
MVQLALFTNNNHNNNSNSNTPNTLNDDTQYDSTTMNTEDTPIIPDKTDKLNGSDSRSSSRNRTRSISFTRFLFNSNNNNNNNKDHTEQSRCPSNETSDNSVGSPEQQNSGFNKLKKMFKTNSSLTQEDGKNSGRTRSASTPLTPPKVKKETSVPVITTTKAPNKEETTTTKIHSPPESPVVQSNPYFQYQGVPAHTNTSQNPQIETAPGRSDMSVALRHNDSVFSLNENGVLEPPEIHYSELSSSSEDNSDPSSPALPKTPMRDLVEKDELHLKPIEDERDLAIPASPFQRALRRVASAPLVHRLLNEKSPEDANNNNNNNNTGNNLGGPFSTSTQTSPKKDEPFDINKHIGEVKITGRPRTYTQDRTYSNAATRIVDVQVGPNSFEKVRLLGKGDVGKVFLVREKSSNKLYAMKILNKKEMIERNKIKRALAEQEILATSNHPFIVTLYHSFQSKDHLYLCMEYCMGGEFFRALQTRDTKTICEADAKFYAAEVTAALEYLHLMGFIYRDLKPENILLHQSGHIMLSDFDLSKQSERAKNPEISFHKSGMHLSSAGSSNHHNGPAIDTKACIDGFRTNSFVGTEEYIAPEVIRGKGHTSAVDWWTLGIFLYEMLFGTTPFKGQDRKKTFANVLKKDVKFSDTQQSISSNCRNLIKKLLIKDEEKRLGSKTGASEIKNHAFFKDTQWALLRHQKPPMIPVLTKSTSTSNSNKKYEKPMEDTEEIDDVTSISKSINEQIDDPFSQFNSVTLRYGGEFEDLNQSPMYNPDSSAYTSVAYTMTSNNENSFRQKSFLKR

SEQ ID NO: 44630 - protein, 396 aa, Ralstonia eutropha JMP134
MFDTILDWAANGLANWSWWEIVIYTLVVTHITIAGVTIFLHRCMAHRSLDLHPIAQHFFRFWLWLTTGMVTREWTAIHRKHHAKCETEDDPHSPQTRGIRKVLLEGAELYRAEAKNKETIAKFGHGCPNDWVERNVYSRFGWQGVGLMLIIDLALFGVIGMTVWAVQMLWIPINAAGVINGLGHWWGYRNYDCEDASTNVSPWGLVIGGEELHNNHHTYPTSAKFSIKWYEFDVGWGYIRAMQAVGLAKVKKTPPKARLVEARPVDENTLEAIIANRYDVMARYAKAVKSAFRQELEQLKEGRVAEYRTFKPASKWFHREEAKLAAPQRQQLASIVEQSKSLHTFVEMRRELAAIWGRSNLTREQLLQQLQAWCHRAEASGIQALHDFSLRLRRYA

SEQ ID NO: 44631 - protein, 535 aa, Oryza sativa (indica cultivar-group)
MDIAFKAAQTLLLPATLVAFNQVPMSIWFQFHPSGTCPSPAGDLAALPRRLLGRRLRGNRWVERHLPRLRLQRWIGRSSCERSGFSSALLHQVDRGMGMRGCWFWSSVWGFGGSLCQFATSMAVDQLFLLVGPHMTFSGMDIALKASTHSSTSQQHWLHSTRTDGGSLSADKWNGYVNKDDRALLKASAPGLNDVIRQIVFTLEIYGVKNIVGIQFGYRGFFEKGLKEMPLSRKVVENINLSGGSFLGVSRGGAKTSEIVDSIQARRIDMLFVIGGNGSHAGANAIHEECRKRKLKVSVVAVPKTIDNDILFMDKTFGFDTAVEEAQRAINSAYIEARSAYHGIGLVKLMGRSSGFIAMQASLSSGQIDVCLIPEVSFTLDGEHGVMRHLEHLLEKKGFCVVCVAEGAGQDLLQKSNATDASGNVILSDFGVHMQQKIKSHFKDIGVPADVKYIDPTYMVRACRANASDAILCTVLGQNAVHGAFAGFSGITSGICNTHYAFLPITEVITKPKRVNPNSRMWHRCLTSTGQPDFH

SEQ ID NO: 44632 - protein, 456 aa, Cenarchaeum symbiosum
MRRHTCLCRHSILEPVPRSLGAETRDYNAGSKCSCMGSRGLFERARKVIPSGVNSPVRYYAPYPFFAASASGGSIRDADGRKYTDLCNGYGALLLGHGRGEVVRAVSAQLRRGTLFCVPTEQEVELARLISGNYPSMESTRLVNTGGEATMTAIRLARGFTKRDRIIKFDGCYHGAHGSVLVKAGSGSAHLGISTSEGVPRGLARQTTVIPYNDEAAFEGAAADDVAAVIVEPVMGNMGVIPPKKGFLRLLRKLSSRLGMQLIFDETITGFRLSAGGAQEAFGVRPDITTLAKALGGGLPIAAVGGKKNIMERLAPGGSVYEASTFAGNPVSVSAALASIRTINRIKGRLYPRLERAAAALASSIADDAADLGLDRQINRVASIFQVFFTAEPVTDAASAKRADAARFDKMFRALLKNGVFVAPSQFEMASLSAAHTVEDLRNVSAAYRTALGAAR

SEQ ID NO: 44633 - protein, 458 aa, Oryza sativa (indica cultivar-group)
MDPFLKKFFPVVFRKKNDDGQNNYCKYDNQGLSAFTSSLYLAGLVSSLAASPVTRNYGRRASIVCGGLSFLAGATLNAAAVNLVMLILGRILLGVGIGFGNQAVPLYLSEMAPAHLRGALNMMFQLATTLGIFTANMINYGTQHIRPWGWRLSLGLAAAPALLMTVGGLLLPETPNSLIERGRVEEGRRVLERIRGTADVDAEFTDMAEASELANSIEHPFRNILELRNRPQLVMAVCMPAFQILTGINSILFYAPVLFQSMGFGGSASLYSSVLTGAVLFSSTIISISTVDRLGRRKLLISGGIQMIICQVIVAVILGVKFGTDKELTRSYSIAVVVVICLFVLAFGWSWGPLGWTVPSEIFPLETRSAGQSITVAVNLFFTFVIAQAFLSLLCALKFGIFLFFAGWITVMTVFVHVFLPETKGVPIEEMVLLWRKHWFWKKVMPDLPLEDGDSHHK

SEQ ID NO: 44634 - protein, 425 aa, Ralstonia eutropha JMP134
MHGGLHASHIQHIDRLLGKVMLFARPADAVVSYYFRENSKLGHRERGIIAEAVYAVLRRRVEFGQFAESGTGSASRRLALLGLAATLGRDTLTPFLYPDEAEWLDRLTTIERSSLSPRVRANLPEWLFDNLVARHGEAFTSALGDAWLRPAPLDLRVNLIKTTREAALAELEAAGLRAEPTPMAPAGIRMQGKPALNQLPMFVNGLVEVQDEGSQLLCSLVGPKRGEMVVDFCAGAGGKTLALGVAMRSTGRLYAFDVSEKRLANLKPRLARSGLSNVHPVLIDSERDAKVKRLAGKIDRVLVDAPCSGLGTLRRNPDLKWRQNPESVLELTAKQSAILEAAARLVKGGGRVVYATCSVLEAENEAIVRDFLAKHPTFRLVPATEVLAEQKIEVPALQTEGDMFALYPHLHQTDGFFAAVLERTQ

SEQ ID NO: 44635 - protein, 212 aa, Oryza sativa (japonica cultivar-group)
MNPFAKKPTPREAIRSSKRELTNATRGIERDIGTLQLEEKRLVAEIKRTAKTGNEAATRILARQLIRLRQQISNLQGSRAQIRGIATHTQAMHANTSVAAGMQSASKAMGALNKQMDPAKQMKVMQEFQKQSAQMDMTNEMMSDSIDNILDDDQAEEETEDLANQVLDEIGVDIASQLSSAPKGRITGKKVQADESSELDELEKRLAALKNP

SEQ ID NO: 44636 - protein, 385 aa, Dechloromonas aromatica RCB
MDTPIRIDSRFPNMGTTIFTVMSRLAAECGAVNLSQGFPDFQAEPALFDAMHRHMLAGRNQYAPMAGLPELRQAIADKVAALYGTRFDVESEVTVTAGATQAIFTAIAAFVRPGDEVLVFEPVYDSYVPAIETVGGTAVYAQLKFPDYTPDWAQVAGLISPKTRMIIVNSPHNPTGSLLTAADLDKLAELVRGTDIVILSDEVYEHILFDGEQHASLCGHPELAVRTIVVSSFGKTYHITGWKIGYVVGPAALMAEFRKVHQFNVFTVHAPSQLAIAEYMQDASRHLGLAAFYQEKRDFFRQLMAATPFELLPCRGTYFQLARYDRISDLPDRAFAEWMAREVGVAVIPVSVFNADGRDDKVVRFCFAKREETLRAAAERLCKAL

SEQ ID NO: 44637 - protein, 133 aa, Oryza sativa
CQFVCIFAKSDDMDPYVILTCRTQEQKSSVAKGAGSEPEWNETFVFTVSDDVPQLNVKIMDSDAFSADDFVGEANIPLEPVFLEGSLPPAVHRVVKEEKYCGEIKVALTFTPAAETRHHHNHENEGEGYSSWN

SEQ ID NO: 44638 - protein, 391 aa, Streptococcus criceti
MKFETSHLLKKLPKQFFADLVTKVNAKIAQGADVINLGQGNPDRPTYDFIVKALQDSAAKPASHKYSLFRGNPPFKEAAADFYKANYQVDLDSQTEICVLGGSKIGLVELPWALMNPGELLLLPDPGYPDYLSAVALGQVDCETYPLLAENDFLPDLTAIPEESARRAKFIYINYPNNPTGAVATPAFYESLVDWAKKYEVGVVSDFAYGALGYQGYKNPSFLSTPGAKDVGIELYTFSKTFNMAGWRLAFAAGNADMIEALNLIQDHLFVSIFPAIQDAGVAALSDPRAKEAIAALNQRYDQRREAFVQAAAQIGWQAFPSKGSFYAWMPVPEGFNSQNFADLLLEEAHVAVAPGIGFGQEGDSYVRIGLLVEPDHLAQAVERIGQLDLF

SEQ ID NO: 44639 - protein, 391 aa, Actinobacillus pleuropneumoniae serovar 1 str. 4074
MSVIKMADLDLAGKRLFIRADLNVPVKDGKVTSDARIRATIPTLKLALQKGAKVMVTSHLGRPTEGVFEEANSLQPVVDYLNASDLGVPVRLVRDYLDGVEVAENEIVVLENVRINKGEKKNDPELAKKYAALCDVFVMDAFGTAHRAEGSTYGVAEYAPVACAGPLLAAELDALGKALKEPQRPMLAIVGGSKVSTKLTVLDSLSKIADQLIVGGGIANTFIAAEGHPVGKSLYEADLIPEAKRLAAATNIPVPVDVRVGTEFSEIAPATEKAVSEVQADESIFDIGDKSAEELANIIKSAKTILWNGPVGVFEFPNFRKGTEVISNAIAEATANGAFSIAGGGDTLAAIDLFGIADKISYISTGGGAFLEFVEGKVLPAVEILEKRANG

SEQ ID NO: 44640 - protein, 119 aa, Brassica napus
MVSRQEGTLFSRKRDFTTYGEEFHNSFKKIKQDDQSLGKLQSTMFSERSNSESMRSVTFDFELQLHTPLTTKTKGYSKTSVDQRTYPKDSLLVERPKMSLDLELNLSPSYSPTNTTKKI

SEQ ID NO: 44641 - protein, 141 aa, Glycine max
  misc_feature (13)..(13): Xaa can be any naturally occurring amino acid
VACNLTCKCFFEXPALLPVFSEYSIDVVESNGEMLVVLLSEFLEIAPLRVWKYDEASRGWPQIAPMPAANFHEWYGKKPDINCVGAGNQIFICLNSPELCPYVVCDLEPTKWVEFPKCCINGEVIAFMSALSFEPRIEASV

SEQ ID NO: 44642 - protein, 276 aa, Acidobacteria bacterium Ellin345
MKTKVDSKRFGPWALITGASSGIGREFARQVAASGINVVLVARREPLLQEAGAEFSKTYGVEHRIVLADLSEEGFMDRLIPATDDLDIGLVISNAGTASPGEFLKRDRVSMLEIIRLNALSHLEIAHHFGERLARRGRGGLLMSGAMGAMVGLPFMAAESPSKAFIQTLGQALHVEFAPLGVNVTVLVIAPTETAVIAKIGFDHHNMPTEQMRMKRMPVEQCVREGLLALQRNRATHLPGRTNRIANALMPPSIARRIMGKMLGRAVAARSRTAST

SEQ ID NO: 44643 - protein, 556 aa, Candida albicans SC5314
MNYTRVNSSEELEVYEEVGRGGFGVVYRGIIKSTNQEVAIKQIDLEKDSTDLIEINKEIQIISECHCQQITSYMGSFVKNYKLWVIMEFIDGGSIFELLKPGPIDDEKIVSFILYEILLALNYLHNQGKIHRDLKSQNILISKTGDIKLTDFGVSTQLSSNFSKRNTTVGTPYWMAPEVIVNNNGGHSYKADIWSLGCCCYEMFTGKPPLQSKYPPMRALRLISKCQKNQDFIKLIELNELDISWEFKDFLHQCFIEDPKLRASASKLLKHKFITKHIHDKDKIKLLKKLITKKQLWNQQNHIVKTQNYYVPTEIYNNQLKWNMDDQNGNENQQTELTKESGDQHTGNTIKFDISSLMLNNDLEDDIEEDVEDDAHEERKSSPSSEPNDDIIGFFKNDFNNILTKIFNKIDNRNQLSRLQYDQLVEMNNLMGQLITNDNGGTNNNRKILLFQYLKYLIKELLKEKNSHINRLILPSSILRNTGTNGITTNISGNTLVNNNNHVTNMTNFTTNGILSSTTSTTTVNHNRTTSHTWTKFDEIESSLLESWINRMEQDN

SEQ ID NO: 44644 - protein, 133 aa, Brassica napus
  misc_feature (106)..(106): Xaa can be any naturally occurring amino acid
  misc_feature (132)..(132): Xaa can be any naturally occurring amino acid
MREQGVTENRLQLLKGVTGAFRPGVLTALMGVSGAGKTTLMDVLAGRKTGGYIEGDVRISGFPKVQETFARISGYCEQTDIHSPQVTVRESLIFSAFLRLPKEVGXEEKMMFVDQVMELVEAGTVLKDSSWXL

SEQ ID NO: 44645 - protein, 196 aa, Triticum aestivum
GIRKNPGCPLPSQLYTYIVQPLPPPLMALSATSFAPFQGFKFTAGLPVSHRSNGGSLGGVSNGGRIRCMQVWPTEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 44646 - protein, 510 aa, Xanthomonas campestris pv. vesicatoria str. 85-10
MSADLLKALDLAASNSGTYLGEATWSQAAGAGLLQPLNPTTNAVIAEVQATTPEDYELIVQRAQAAFKVWRTTPAPRRGEAVRLCGEALRAHKDALGSLVALEMGKSKPEGDGEVQEMIDIADFAVGQSRMLYGYTMHSERPGHRMYEQYQPLGLVGIISAFNFPVAVWAWNAFLAAICGDICIWKPSNKTPLTAIATMKICNAALKDAGFPDIFFLINDAGTALSEKLVEDTRVPLISFTGSTQIGRVVAKKVARRLGRCLLELGGNNAIILDETADLKLAIPGIVFGAVGTAGQRCTTTRRLIVHASIYDTVLATLVKAYKQLDSKIGDPTDPANLMGPLNSQGAVAQFLDSIAKAKAAGGTVEVGGTAIDRPGNFVLPAIVTGLQNSDAVVQHETFAPILYVMKYSTLDEAIELQNGVPQGLSSSIFTQNLKAAEKFLSAAGSDCGIANVNIGTSGAEIGGAFGGEKETGGGRESGSDAWKVYMRRQTNTINYSDSLPLAQGIKFDL

SEQ ID NO: 44647 - protein, 424 aa, Pseudomonas putida GB-1
MQDGFNDPLWRQVVSGAQMLFVAFGALVLMPLITGLDPNVALFTAGIGTLLFQLVTGRQVPVFLASSFAFITPIILAKGQFGLAETMGGVMAAGFVYTFMGLMVKIKGTGFIDRMLPPVVIGPVIISIGLAMAPIAANMAMGKGGDGAALMPYKTAMLISMPALLTTLVVAVFGKGIFRLVPIISGVLVGFALSFAFGVVDTAKIAAAPWLEIPNFTAPAFNWQAILFIVPVALAPAIEHIGGVIAVGSVTGRDYLKKPGLHRTLLGDGLATTAAGLFGGPPNTTYAEVTGAVMLTKNYNPKIMTWAAIFAITLAFIGKFGALLQSIPVPVMGGILCLLFGSIAAVGMNTMIRHKIDLAEARNLVIVSVTLVFGIGGVLIGSGDGPDDWGLKGIALCAIVAIALNLILPGNDGWKHKKLDDQLP

SEQ ID NO: 44648 - protein, 154 aa, Medicago truncatula
MTNILLRTASRGGSLRATLIRRFSTDALVESKPGEIGLVSGIPQEHLRRRVLIYSPARTAGQQGSGNVGRWRINFLSTQKWENPLMGWTSTGDPYSHVGDSALDFDTEEAAKEFAERHGWEYVVKKHHTPLLKVKLYADNFKWKGPPKAAEAEQ

SEQ ID NO: 44649 - protein, 216 aa, Brassica napus
  misc_feature (79)..(79): Xaa can be any naturally occurring amino acid
  misc_feature (135)..(135): Xaa can be any naturally occurring amino acid
  misc_feature (169)..(169): Xaa can be any naturally occurring amino acid
  misc_feature (183)..(183): Xaa can be any naturally occurring amino acid
  misc_feature (187)..(187): Xaa can be any naturally occurring amino acid
  misc_feature (208)..(208): Xaa can be any naturally occurring amino acid
IINCIILAIGNCGGPLMTRLYFRNGGKRIWFSSFLQTSGCPIILLPLLFSFLTRHRQQQEQEEPKTTLFLIKPPLFLAXLVVVGLLIGFDNYLYAYGLAYLPVSTSSLIISSQLAFTAFFAFFMVKQRFTPFTIXTAVVLLTLGAGSLALHADGDKLPKETRKEYNKVXGSVMTVGCSCSPNXVWGXRLVELAYKKASQRISYTLVLXKWLFRHLG

SEQ ID NO: 44650 - protein, 115 aa, Coxiella burnetii RSA 493
MNNIIQLLETEQTQGKEIPDFRAGDTVTVQVKVKEGNRERLQAFEGVVIARRHRGLNSSFTVRKVSHGEGVERVFQLYSPLIASIKVNRRGDVRRAKLYYLRNLRGRKAKIKEKI

SEQ ID NO: 44651 - protein, 417 aa, Oryza sativa
HYRRSSAPAFQVPTPPPHPLPPLHSSRIPMASSSSSSSSSPPPPPPRRSVFDAAYIRAEFAAAGISPHFIPLIWKYVLQNPRCGDLDAVPSLPAAAYALLRQKFQPTTSTLTTAAESKDRTTTKLLIRLKNGESVEAVIMRYDTRLGKYDGKPRPGGVRSTLCVSSQVGCKMGCRFCATGTMGFKSNLSSGEIVEQLVHASRYSQIRNVVFMGMGEPLNNYTALVEAIQVLIGSPFQLSPKRITVSTVGIIHSINKFNNDLPNINLAVSLHAPDQDIRCHIMPAARAFPLVKLMNALQSYQNESKQTIFIEYIMLDGVNDQEQHAHQLGKLLEMFKAVVNLIPFNPIGSSNNFKTSSEHNVKKFQKILRGIYNIRTTIRQQMGQDIAGACGQLVVSLPDERSAGGATLLSDIEDIRI

SEQ ID NO: 44652 - protein, 272 aa, Aspergillus oryzae
MSFRGGGRGGFATGANRGGSFGGRGEMGSFMHACEGEMVCESINPKIPYFNAPIYLENKTPIGKVDEVLGPINQVYFTIKPQEGIVATSFKPGDKVYIGGDKLLPLEKYGSLLYVYFANSIDPMIIGSFLSLSRHRVLLSPREPEALPGVVLAVAEEALVVEQEVDAADLALLEEEAASVVELEEAVEASVVEAVASPGEAAEEDLVEVSDVRQSPSCLALSYYGVMGKRELLQELFVLIFLCILGGLRIRKGCRLIQPLNECYYTNEVPAK

SEQ ID NO: 44653 - protein, 281 aa, Glycine max
MPLILAKSDSIQIREVWNDNLEEEFALIREIVDNYPYIAMDTEFPGIVLRPVGNFKNSYDYHYQTLKDNVDMLKLIQLGLTFSDEHGNLPMCGGDDEESDTCCCIWQFNFREFNVNEDVFANDSIELLRQSGIDFKRNNENGIDAHRFGELLMSSGIVLNDNIHWVTFHSGYDFGYLLKLLTCQDLPDTQVGFFNLINMYFPTVYDIKHLMKFCNSLHGGLNKLAELLEVERVGISHQAGSDSLLTSCTFRKLKDNFFSGSLEKYAGVLYGLGVENGQGSH

SEQ ID NO: 44654 - protein, 588 aa, Vibrio cholerae O1 biovar eltor str. N16961
MSIYNPTSKSVSFSRFTSTLPINRPNMNNDKRPLYISYAGPALLSTPLLNKGSAFSAEERASFNLEGLLPEATETIQEQVVRAYQQYRGFESDMDKHIYLRNIQDTNETLFYRLVQNHISEMMPIIYTPTVGAACENFSNIYRRGRGLFISYANRDRIDDLLNNAANHNVKVIVVTDGERILGLGDQGIGGMGIPIGKLSLYTACGGISPAYTLPVVLDVGTNNPQRLADPMYMGWRHPRITGPDYDNFVEEFMQAVQRRWPDALIQFEDFAQKNAMPLLERYKNRVCCFNDDIQGTAAVTVGSLLAACKAAGSQLSQQRITFLGAGSAGCGIAEAIIAQMVSEGISDEQARSQVYMVDRWGLLEEGMPNLLDFQQRLVQKKANTQHWTTENNGYSLHDVIRNAKPTVLVGVSGAPGLFSEEIIKEMHQHCPRPIVFPLSNPTSRVEALPSDIIRWTNGEALVATGSPFDPVLHEGKTYPIVQCNNSYIFPGIGLGVLAANARRVTDEMLMESSRALASCSPLAINGHGPLLPPLESIHSVSKKIAFAVAKKAIEQGVAPEVTDEALEASIEQHFWQPVYRRYKRTAF

SEQ ID NO: 44655 - protein, 416 aa, Listeria monocytogenes str. 4b F2365
MAVEKITMPKLGESVTEGTISSWLVKPGDTVEKYDAIAEVLTDKVTAEIPSSFSGTIKEILAEEDETLEVGEVICTIETADAGSSEPVAEVEETETKAPEKQETKQVKLADAPASGRFSPAVLRIAGENNIDLSTVEGTGKGGRITRKDLLQVIENGPVAKREEMKSAPQEKAAMPTPPVRSAAGDKEIPINGVRKAIAKHMSVSKQEIPHAWMMVEVDATGLVRYRNAVKDSFKKEEGYSLTYFAFFIKAVAQALKEFPQLNSTWAGDKIIEHANINISIAIAAGDLLYVPVIKNADEKSIKGIAREISELAGKARNGKLSQADMEGGTFTVNSTGSFGSVQSMGIINHPQAAILQVESIVKRPVIIDDMIAVRDMVNLCLSIDHRILDGLLAGKFLQAIKANVEKISKENTALY

SEQ ID NO: 44656 - protein, 406 aa, Candida albicans SC5314
MPQSSSTFINEYTLPDVVENSSSRASKMTIKEYKRIGEGAFGTVVEAMLKYETNSSKGNDGTGSHLLGHFRHHSHSDKDNNNTTNNNNNNNKDGEWLGPFAIKRVPAQTEYKSRELEILRFVSHPNIVSLRFFFDKKSSSDNKVYQNLVMECLPSNLQSEIKYYRQSKYTIPYPHMKAYTFQLARAMLYLHGYGISHRDIKPSNILVDPNTVRLKICDFGSAKKLEPNQPSVSYICSRYYRAPELIVGCSLYTTKIDIWGLGCVIAEMFLGKPIFQGQSPESQLKEIAKLLGPPPNTFFFKSNPQYRGNMYTTRLFNCSIEERFKQIFSNSPSDAIDLLMKILVYDPDVRASPRRVLIHPFFDELKSSQFKVYPRGSSTPIELHLFNFSEYELELLGSLKNEFVKS

SEQ ID NO: 44657 - protein, 419 aa, Glycine max
  misc_feature (165)..(165): Xaa can be any naturally occurring amino acid
RAELERSRQLRRPPPRCVLKLFAVTNGSVFSLHLNSRRRFHRRFNAKIKMSSSDAALPSLPDNRTVVGFGMTAVDFLATVDGFPKPDDKVRSASLKVEGGGNAGNALTCAARLGLKPKLISKVADDSHGFAILKELEADGVDTSFIVVSKGGSSTFSYVLVDNQXRKTRTSIYTPGDPPMMPDDLSQSTLLSAFDGARLVYFDGMFPETALFVAQEAARNNIPILVEAESLREGLDELLKLADFVTCSAKFPQAWTQAPSIPSALVSMLLRLPNINFVVVTLGEGGCLMLEGSANEDSDIEERDVESFLEFLYKGKDDSLAIPTCIPSAVTKFRANGIGTICGRFYIGTAEKIPDSELIDTTGAGDAFIGAIMYAICANMVPEKMLPLAAQVAAAKCRALGARTGLPRRTDPHVVSFLH

SEQ ID NO: 44658 - protein, 131 aa, Archaeoglobus fulgidus DSM 4304
MVMSVDTLSNAMIAIKNAEMVGEKKCEIKPASKLIGNVLKVMKDYGYIKGFEYVENHRGGKFIVELSGNINDCGAIRPRFSSSVTEYEMYEKRYLPARDFGILIVSTTKGVMSQKDARKQRLGGVLLAYVY

SEQ ID NO: 44659 - protein, 320 aa, Gibberella zeae PH-1
MSASYWQSTQCRFWTFTKEQLATMRQKLEEDNAELVRMFPLPQQRHLNIYFNQRLIRLAKRLTIRQQSMATAQVYMKRFYSKVEIRRTNPYLVIATAIYLACKIEESPQHIRLIVTEARQMWGDLVAIDTSKLGECEFFMISEMRSQLIVYQPYRTVVALRSELGLQEDEVQLARSVINDHFMTDLPLLYPPHVIAMVAMLLALVLRPNNSGPGQNPSGAAAAAGLAAAQQALMRAQGQQTSGGGATDAATAEPKERQQQARVSRVQKFAKWLVDSNVEIASMVDATQEIISFYECYEHYNDKLTREQINRFVKARGLDK

SEQ ID NO: 44660 - protein, 137 aa, Campylobacter upsaliensis RM3195
MEKTLSIIKPDAVKKGVIGKILDRFESNGLRIAAMKKLQLSKEQAEGFYAVHKERPFFKDLVEFMISGPVVVSVLEGENAVLKNRELMGATNPKEAKAGTIRADFAENIDANAVHGSDSLENAKIEIDFFFKPNEIC

SEQ ID NO: 44661 - protein, 469 aa, Brassica napus
MNVMRRLKSIASGRTSISSDPGVDSSLKRPKLDQDNDNLSSRGDDPMQVDQSTDMVVVSQDTVAGTSNVPPPPDQLPEVMNDMRLREDEPHANRRGEEDKDMEPPIVNGCGTETGQVITTTVGGRDGKPKQTISYMAQRVVGTGSFGVVFQAKCLETGEQVAIKKVLQDKRYKNRELQIMRLQDHPNVVRLRHSFFSTTDKDELYLNLVLEFVPETVYRALKHYTKMNQHMPIILVQLYTYQICRALNYLHRVVGVCHRDIKPQNLLVNTHTHQLKICDFGSAKMLVPGEPNISYICSRYYRAPELIFGATEYTNAIDMWSGGCVMAELLLGQPLFPGESGIDQLVEIIKILGTPTREEIRCMNPNYTEFKFPQIKAHPWHKIFHKRMPPEAVDLVSRLLQYSPNLRCTALEACAHPFFDDLRAPNVSLPNGRALPPLFNFTAQELAGASTELRQRLIPAHCQGTGNSS

SEQ ID NO: 44662 - protein, 417 aa, Coxiella burnetii RSA 493
MTVDVEYLGILLVLLIFLSAFFSGSETGMMALNRYRLRHLARKGHVKAQRVVTLLKRPDRLLGVILIGNTFANILASAVATVIAVHYLGDLGVIISTVILTFLILVFAETTPKTLAALYPQRVAFPASLPLQILLRVFYPLVWLVNTIANAFLRIFGVKVSVQGTEVVSAEELRSIVREVIGKGLSGYQQMLLRVLNLGQMTVEDVMVPRNRIHGIDIRDDWHKIVEVLLTSEHDYLPIYRENIDRVIGLLNLRRVMQLLSQQQLTKEKLVKVAEEVYFIPEVTLLNQQLLNFRERNKTVGLVVDEYGDIEGLVTLRDILEEVVGEFATGIDGATSLVQFQKEGSYLIDARISVRDLNRIMQWDLPIKGPKTLSGLIIEDLESIPIVGICIRLSGYPMEIVKVSRNAVRLVKVWSKF

SEQ ID NO: 44663 - protein, 254 aa, Chromobacterium violaceum ATCC 12472
MCIIAFAYKTPGMGQLVLLANRDEYYARPAEPLDWWPEFPNTLGGRDQQSGGSWLMVDGRNRIAAVTNFRDGFPPKAERSRGELVRRFVTGDDDPFAFADWLREECHRYAPFNLLFGTTSDLFFFHSPGRQIARVTPGIHTLSNATLDTPWFKSQRLAEYLGEFGRPPTEEQAYAALSDPTPAGPGHLPNTRIGLALEKTLSPIFIQGRDYGTRASMLLTVSSRGDIGFSELSWGLAGRETGRRHYNLRAGQAR

SEQ ID NO: 44664 - protein, 1469 aa, Magnaporthe grisea 70-15
MHGPVVVQTPQGARARHERASLETGEESDKTVYEGNPEEQVQDLALRITREASAAEYPSLFDLPPGSDLDPKSQNFNAERWTRAFYQTSVEALDGTEPNTAGLSFQNLNVHGHSALSNYQTTIGNSFHAGMDLVAGLVGRKQAQRVDVLRDLEGVMLSGEMLCVLGPPGSGCSTFLKTLACETYGFTVDKESRLNYQGLAAKDIQTRYQGEAIYVSEVDHHFPRLTAGETLYFAARARCPRKLKSRKHEYAEQIRDVVMAMLGISHTKNTRVGNDFIRGVSGGERKRVSIAEAVLSYSPWQFWDNSTRGLDSANAVEFCRTLRTQAKVFGNTACVAIYQAPQEAYDLFDKVILLYEGRQIFFGKTAEAKAYFEGLGFLCPEQQTTPDFLTSMTSASERTIRPGWQGKPPPRSPDEFAKAWKESSHRQRLCMDIASFQEEFPLGGAVSEKFEVARAGQKSTFQRPGSPYTLSIGGQLALNLWRAWRLLLSDPGMTITMLVTNFFESIIISSIFYNLSPGSSSMDKRNLLIFFAIAMNALGSLLEVLTLYEKRKIVEKHRRYALYHPSVEAVSSMIMDLPYKFVNSILVNVTLYFMTNLRREPGPFFVFFLFTTLAIIVMSSMFRLLASVTKTLSQALAPSAIILLAVLVYSGFTVPQNYLHDWIGWLRWINPIFYIQESLSLNEFVGRHFPCDGFIPNGPTYDDQGSLSTSRVCSVKGAAPGESFIEGAEHLRVVYGFIDGHLWRNLGIVLGLTLFYTICHLLATELIMSEQSKGEILIFPRNTLKKMKGARPAADEETTHEAPVSHVINGESPRREKVGGIAKQQSTFHWKNICYELNIKGERRTILDHVDGWVKPGTLTALMGVSGAGKTTLLDALACRITMGVVTGDAFVDGKPRTADFQRKTGYATQQDLHLGTATVREALEFSALLRQPDKYSKQEKLDYVNEVIELVDLQDCANAVIGVLGEGLNVEQRKRLTIGIELAARPELLLFLDEPTSGLDSQTSWAICNLMEKLTNNGQAILCTIHQPSASLFQRFDRLLLLARGGRTVYFGEVGRNSATLIDYLQRNGAPPFKDGLNPAEYMLDVIGATARSRSKDVDWPTIWRNSPEYQEVQAELARGIGASVVGTDQERAAVEKTPEFAAGLSTQFFLVTKRVLQQYWRTPEYIMSKTVMTAGCALFIGLAQVNAEMTERGLYNQMLFVYFLLVIFGQIIEQTTPMFMTQRTLYEARERHAKTYSWVAFLCGTMTAEIMWNSLMAVFSFLLFYFPLGLYRNAEHTGAVHSRGIAMFLNIWAFFVFSTTFGFLISAGIDTAEVSGGIVNLFFIMMFAFAGVLAGPDELPRFWIFMYRVNPFTYIVEALVATSLADAPVSCIDSELLTFEAPSGQSCDAYLGPYMRQNGGYLAGESSGSCSYCPTVQSNSFLTAHGLYFDNRWRDFGLVWAYCLFNILGAIGMYWLLRVPKGKKVRA

SEQ ID NO: 44665 - protein, 276 aa, Oryza sativa
MESQVLVALALSLVGGLSTSIGALFVILNPTPNLKMLGLLQGFAAGLMLSISFLDLAHNALNSIGFLKGNLWFFAGVLFFGLVVKFIPEPTVVPTADAGKKQTDDDGSGKDMMKKHRRQVLFSGIITAVGISLHNFPEGMEVFLGSMKGLRVGLNLAIAIALHNIPEGVAVALPLYFATNSKWQAFKVATLSGFAEPLGMIIVAYLFPSSLNPEVLEGLLGSVGGVMAFLTLHEMLPLAFDYAGQKQAVKAVFVGMAFMSASLYFLEISLPKEVSL

SEQ ID NO: 44666 - protein, 505 aa, Solanum melongena
MDVPCPWYSLLIPLFVFIFLLIHHCFFTTSKKQNMLLLPSPRKLPIIGNLHQLGSLPHRSLHKLSQKYGPVMLLHFGSKPVIVASSVDAARDIMKTHDVVWASRPKSSIVDRLSYGSKDVGFSPFGEYWRRAKSITVLHLLSNTRVQSYRNVRAEETANMIGKIRQGCDSSVINLGEHLCSLTNNIISRVALGRTYDEKESGIEHIIEQFVELLGIFNVGDYIPRLEWVNKFTGLDAKVKKVAKELDMFLEIVIEEHIIRKKKEEYTSTGEAKDFVDVLLEIQNGNETDFPLQRDSLKAILLDSFAAGTDTTFATLDWTMAELLRQPRALKTLQDEVRGLAQGKSEITEDDLKNMQYLRAVIKESLRLHPTQESLLVPRESMEDVNLLGYYHIPARTQAIINAWAIGRDPLSWENPEEYQPERFLNSDADVKGLNFKLLPFGAGRRGCPGSSFAIAVIELALARLVHKFDFALPEGIKPEDLDMTETIGITTRRKLPLLVVATPC

SEQ ID NO: 44667 - protein, 211 aa, Cryptococcus neoformans var. neoformans JEC21
MSGPAGQHYDFLIKLLLIGDSGVGKSCLLLRFCEDSWTPSFITTIGIDFKIRTIELDGKRIKLQIWDTAGQERFRTITTAYYRGAMGILLVYDVTDEKSFNNIRTWLSNIEQHASPGVNKILIGNKCDWEEKRSVTIEQGRALADEFGLRFLETSAKANEGVEEAFFTLARDIKTRLIDSQPQEAAPVQLGADRNGVNVNKQSDSSSGGCC

SEQ ID NO: 44668 - protein, 365 aa, Solanum melongena
LVPLFVFILFLHKCFFTTSNNNKKLPPSPRKLPIIGNLHQLGLHPHRSLHKLSKKYGPVMLLHLGSKPVIVASSVEAVRDIMKTNDLVWSNRPKSKMADRLIYGSKDVSFSPHGEYWRQIRSITVLHLLSNKRVQSYRAAREEETSNMIEKLKQMSNSSSSATDLRDLFCWLAYNIINRVALGKKYNDEIDAKATLDKFVELLGTFNVGDYIPCLEWVNKITGFDSKVDKVAKDLDTFLEFVIEAHMIRNEKEENRAGESKDLVDVLLEIQNGKETGFPIQRDSLKALLLDPFSAGTDTIYTVLEWTMTELLRHPRAMEKLQNEVQGLAQEKAEITEDDLPNMHYLKAVIKETLRLHPPIPLLLP

SEQ ID NO: 44669 - protein, 507 aa, Solanum melongena
MDVPCLWYSLLILLLLFIFLLIHHCFTTSKTQNMFLPPSPRKLPIIGNLHQLGSHPHRSLRKLSQKYGPVMLLHLGSKPVIVASSVDAARDILKTHDHVWATRPKYSIADSLLYGSKDVGFSPFGEYWWQVRSIVVLHLLSNKRVQSYRDVREEETANMIEKIRQGCDASVINLGEHLCFLTNNITSRVALGRTYDERESGIDAKDILEQFLQLLDTFNVGDYIPWLKWVNKITGLDTKVEKIAKKLDTFLDSVIEEHIIRNKKEEYAITDEAKDFVDVLLEIQNGKETDFPLQRDSLKAILLDAFAAGTDTIYTNLDWTMADVLRQPRAMKTLQNEVRGLAQGKSEITEDDLKNMQYLRAVIKESLRLHPPNSLLVPRESMEDVKLLGYYHIPARTQALINVWAIGRDPLSWENPEEFCPERFLNNDIDMKGLKFELLPFGSGRRGCPGSSFAIAVIELALARLVHKFNFALPKGTKPEDLDMTECTGIATRRKSPLPVVATPFSG

SEQ ID NO: 44670 - protein, 499 aa, Solanum melongena
IFTAFSLLFSLFIFLLTRKPKSKTPNLPPGPPGWPIVGNLFQVAGSGKQFFEYIRDLKPKYGSIFTLKMGSRTMIIVASAELAHEALIQKGQIFASRPRENPTRTIFSCNKFSVNAAVYGPVWRSLRRNMVQNMLSPSRLKEFREFREIAMDKLIERIRVDAKENNDVVWALKNARFAVFYILVAMCFGVEMDNEEMIERVDQMMKDVLIVLDPRIDDFLPILRLFVGYKQRKRVNEVRKRQIETLVPLIEKRRSVVQNPGSDKTAASFSYLDTLFDVKVEGRKSGPTNAELVTLCSEFLNGGTDTTATALEWGIGRLMENPTIQNQLYQEIKTIVGDKKVDENDIEKMPYLNAVVKELLRKHPPTYFTLTHSVTEPVKLAGYDIPMDTNVEFFVHGISHDPNVWSDPEKFDPDRFLSGREDADITGVKEVKMMPFGVGRRICPGLGMATVHVNLMLARMVQEFEWFAYPGNNKVDFSEKLEFTVVMKNPLRAKVKLRI

SEQ ID NO: 44671 - protein, 511 aa, Solanum melongena
MDFFSTSSLSSYYHLIFTILAFVISSIIYFLSKKAESKKLKLPPGPPGWPVVGNLLQVARSGKPFFQIMRELRQKYGPIFTLRMGTRTMIILSNADLVHEALILKGQVFATRPRENPTRTVFSCDKFTVNAAVYGPVWRSLRKNMVQNGLSSIRLKEFRAVRKSAMDKMIEKIRAEADANEGVVWVLKNARFAVFCILLAMCFGVEMDEKTIEKIDQMMKSVLIALDPRLDDYLPILSPFFSKQRKHAMDVRKQQIKTIVPFIEQRKKILESPEIDKTAASFSYLDTLFDLKIEGRNSTPTYPELVTLCSEFLNGGTDTTATAIEWAIGRLIENPNIQSQLYEEIKKTVGENKIDEKDIEKMPYLNAVVKELLRKHPPTYMSLTHAVTEPAKLGGYDIPTGVNVEIFLPGISDDPNLWSEPEKFDPDRFYLGKEDADITGVSGVKMIPFGMGRRICPGLNMATVHVSLMLARLVQEFEWADPENTRVDFTEKLEFTVVMKNTLRAKIKPRM

SEQ ID NO: 44672 - protein, 667 aa, Saccharophagus degradans 2-40
MSSRRELANAIRALSMDAVQKANSGHPGAPMGMADIAEVLWNDFLKHNPSNPNWADRDRFVLSNGHGSMLIYSLLHLSGYDLPMSELAQFRQLHSKTPGHPELGYTPGVETTTGPLGQGISNAVGMALAEKMLAAQFNRDGHDIVDHYTYCFLGDGCLMEGVSHETCSLAGTLGLGKLIAFWDDNGISIDGHVEGWFTDNTPARFEAYGWHVIPAVDGHDPEAIKAAVEAAQAETGKPTLICTKTTIGFGSPNKSGSHDCHGAPLGDAEIAAAREFLGWPHAPFEIPDNVYAGWDAKEKGAAAQSAWEAKFEAYKAAQPALAAEFERRVLNGDLPADFEAKADAFIKAVNEKGESIATRKASQNTIAEFGAALPELLGGSADLAGSNLTMWSGSKPVTREDASGNYIYYGVREFGMSAIMNGIAAHGGFINYGATFLMFMEYARNAVRMSALMKLPNIFVYTHDSIGQGEDGPTHQPIEQLAALRLTPNLNTWRPADAVESAVAWKSAVMRKDGPSALVFTRQGVKAQSHDDEQIANMARGAYVLVDCDGEPEVMLIATGSEVGITVDAAAQLAGEGVKVRVVSMPCTNVFDQQDAAYKESVLPIAVTHRVAVETSHVDYWAKYVGIDGRVVGMTTFGESAPGGALLEYFGFTVENVVNTVKELLED

SEQ ID NO: 44673 - protein, 391 aa, Saccharophagus degradans 2-40
MAVIQMKDLDLKGKRVLIRQDLNVPLQDGEITSDVRIQASLPTIKAAVDAGAKVMLMSHLGRPTEGEYADEFSLKPVAARLTKLLGKEVGLVKNWQEGVAVAEGEVVLLENVRFNVGEKKDDETLAKAYAALCDVFVMDAFGTAHRAQASTHGVAKFAPVACAGPLLSGELSALEKALANPARPMVAVVGGSKVSTKLTVLDALSKIVDVMVVGGGISNTFVAAAGNEVGNSLYEKDLIPEAQRLCAETEVIYAHDVRVTKEGFSDWNHNSVTEVKVPADIQADEEIIDYGPETAQKVAAILKDAKTIIWNGPCGVFEFDAFAKGTEVVARAIAESEGFSIAGGGDTLAAIDKFGLADGVSYISTGGGAFLEYVEGKPLPAVVMLEERAKG

SEQ ID NO: 44674 - protein, 175 aa, Brassica napus
MSVNNRDPLVVGGVIGDVLERFTRSIDLRVTYGQREVTNGLDIRPSQILNKPRVEIGGEDLRNFYTLVMVDPDVPSPSNPHLREYLHWLVTDIPATTGTNFGNEIVSYENPRPTSGIHRIVLVLFRQLGRQTVYEPGWRPQFNTREFAALYNLGLPAAAVYFNCQRDNGCGGRRC

SEQ ID NO: 44675 - protein, 453 aa, Streptococcus pyogenes MGAS10394
MIKMVIPYDYIVIGGGSAGIASANRAAMHGAKVLLAEGKEIGGTCVNLGCVPKKVMWYGAQVADILGTYAKDYGFDFKEKAFDFKQLKANRQAYIDRIHASYERGFEQNGVDRIYDYAVFKDAHTVEIAGQLYTAPHILIATGGHPVFPDIEGAQYGISSDGFFALDEVPKRTAVVGAGYIAVELAGVLHALGSKTDLFIRHDRPLRSFDKTIVDVLVDEMAVNGPRLHTHAEVAKVVKNTDESLTLYLKDGQEVEVDQLIWAIGRKPNLEVFSLDKTGVTLNDKGYIETDAYENTSVKGIYAVGDVNGKLALTPVAVAAGRRLSERLFNSKTDEKLDYQNVATVIFSHPVIGSVGLSEEAAVKQYGQEAVKTYQSRFTSMFTAITNHRQPCLMKLVTVGDTEKIVGLHGIGYGVDEMIQGFVVAIKMGATKADFDNTVAIHPTGSEEFVTMR

SEQ ID NO: 44676 - protein, 156 aa, Triticum aestivum
MACSPSPSPSPRLLHRASASASPLLSVGHVRSAPSSTFGCTIHCKQSGHILYGRSHVTSFLALASADMNQAPQGKGSSGQKVIMVDPQEAKRLAVKQMQEIRARDKLKKRRQAEAINGALAVIGLTAALVLEGRTGKGILGQLAGYLAALSSLFGQ

SEQ ID NO: 44677 - protein, 574 aa, Desulfovibrio vulgaris subsp. vulgaris str. Hildenborough
MFTPLPTPEEMSAWDAATIRLGLPAMVLMENAAREALDVLRTSCGPLRHRRVILFMGGGNNGGDAAAVARGLHDLGACTLLVHTRPLRAYRGETAAHLRLALRCGVPAIDASSWLKLAVRANAPFAPWHNAMAAARKQKAQTAHDGAQGNPPARLYGTVQDDTAPAPPRRRDATIDYTQAPLPPVIVDGLLGTGLRGPVRERERALIRAINALRDEGAHVFSLDIPSGVDGLTGRPAPEAVHAHVTVTFEAPKTGIVLPEARCHVGALHVRPIGIPRTVRSTPTRFRLMTDDCTKVMPVPRDDMHKGTAGHVLIIGGSPGLTGAPHLAARAALRGGAGFATIATPGSLATEAKCASPDVMTLPLGVAATWPDTPDEALMSLIRRCSVLVVGPGMGRTPQAAAFASRLLAVRHRPPAIVDADALHALATGGIALDLIAETDIVTPHPGEAALLLGWETADIQRDRPAALAALMSRLHCTVILKGACTLTGSPGLPVTVSPRMASTLAVAGSGDVLAGLAGALVAQGATSPIAACLSVNIHGKAGEMLLEGHPQRGCLASDIADALPRARKELCHA

SEQ ID NO: 44678 - protein, 199 aa, Helicobacter pylori J99
MVKIGVCGPVGSGKTALIEALTRHMSKDYDMAVITNDIYTKEDAEFMCKNSVMPRDRIIGVETGGCPHTAIREDASMNLEAVEEMHGRFPNLELLLIESGGDNLSATFNPELADFTIFVIDVAEGDKIPRKGGPGITRSDLLVINKIDLAPYVGADLKVMERDSKKMRGEKPFIFTNIRAKEGLDDVIAWIKRNALLED

SEQ ID NO: 44679 - protein, 294 aa, Geobacillus kaustophilus HTA426
MALTGTDRVKRGMAEMQKGGVIMDVVNAEQAKIAEAAGAVAVMALERVPADIRAAGGVARMADPTVIEEVMNAVSIPVMAKVRIGHYVEARVLEALGVDYIDESEVLTPADEEFHIDKRQFTVPFVCGCRDLGEAARRIAEGASMLRTKGEPGTGNIVEAVRHMRKVNAQIRKVVNMSEDELVAEAKQLGAPVEVLREIKRLGRLPVVNFAAGGVATPADAALMMHLGADGVFVGSGIFKSENPEKYARAIVEATTHYEDYELIAHLSKGLGGAMRGIDIATLLPEHRMQERGW

SEQ ID NO: 44680 - protein, 294 aa, Chenopodium rubrum
MDQYEKVEKIGEGTYGVVYKARDKVTNETIALKKIRLEQEDEGVPSTAIREISLLKEMQHGNIVRLQDVVHSEKRLYLVFEYLDLDLKKHMDSCPDFAKDPRMIKRFLYQILRGIAYCHSHRVLHRDLKPQNLLIDRQTNALKLADFGLARAFGIPVRTFTHEVVTLWYRAPEILLGSRHYSTPVDVWSVGCIFAEMVNQKPLFPGDSEIDELFKIFRTLGTPNEETWPGVTSLPDFKSSFPKWISKDLSAVVPNLDPAGIDLLNKMLCLDPSKRITARNALEHEYFKDIGFVP

SEQ ID NO: 44681 - protein, 294 aa, Vigna aconitifolia
MEQYEKVEKIGEGTYGVVYKARDRVTNETIALKKIRLEQEDEGVPSTAIREISLLKEMQHRNIVRLQDVVHSEKRLYLVFEYLDLDLKKHMDSSPEFVKDPRQVKMFLYQILCGIAYCHSHRVLHRDLKPQNLLIDRRTNSLKLADFGLARAFGIPVRTFTHEVVTLWYRAPEILLGSRHYSTPVDVWSVGCIFAEMVNRRPLFPGDSEIDELFKIFRILGTPNEETWPGVTALPDFKSTFPKWPPKDLATVVPNLDAAGLNLLSSMLCLDPSKRITARIAVEHEYFKDIKFVP

SEQ ID NO: 44682 - protein, 648 aa, Cryptococcus neoformans var. neoformans JEC21
MAPIAIQNPLEDAQVAPPPPLKSSKASMGSIKKELPKHPDAVPHDYMYKFKYNHELPLHGKEGIEIPQNVNPKDVADEIASLLSQATSKGDPKAFSELFLEHGVWRDRVALTWDYRTFNWRSAILKAATDLLPENPISKVTVIDPPPTVERPYEDLSFVQAHIGFQTNKVGATALCNIVLTKDGYKIWTFNSAIESLHGFREVPERDGHMTGPHSWTQQREIDISMEDSEPEVLIVGGGQNGLMLGARLKALGVNALIVERNKRIGDNWRGRYEALSLHLPHWADHFAYMPYPEQHWPTFCPAAKLGDWFEWYASAMELNTWTDSSVTGAKQDPDGKWTVEVNRGGQGKRVFHPKQLVMATSLIGIPHVPKVPGDDIFKGTIRHSSQHDSSREWVGKKVLVVGTSSSGFDTAYDFARRGVDVTLLQRSPTYIMSLTHCIPRLLGVYKPDDNGKRPDIDIADRIAHGMPVGPGEELGRRLGQELTELDHDLLQALEDKGFKTWRGQRNTSTQTLGYTKAGGFYFDAGACTQIIEGKIKVEQGYIDHFTEDKVVLNGDREKTYDLVVLATGFSNTIDSVRRTLGDDVADRCKPVWGMDEEGELNSAWRDTGVPNLWVMVGTLQAARYHSKKVALNIKARLEGICKEPYLE

SEQ ID NO: 44683 - protein, 586 aa, Hevea brasiliensis
MDEVRRRPPKHIVRKDHDGEVLNSFSHGHHLPPLKPSDYSLPLSLYLANALVFSLFFSVAYFLLHRWREKIRKSTPLHIVTFPEIAALICLVASVIYLLGFFGIGFVHSFSRASTDSWDVEEYDDDNIIIKEDTRPTGACAAPSLDCSLSLPTKIHAPIVSTTTTSTLSDDDEQIIKSVVSGSIPSYSLESKLGNCKRAALIRRETLQRMSGRSLEGLPLDGFDYESILGQCCEMAIGYVQIPVGIAGPLLLDGKEYTVPMATTEGCLVASANRGCKAIYASGGATSVLLRDGMTRAPVVRFPTAKRAADLKFFMEDPDNFDTIAVVFNKSSRFARLQSVQCAIAGKNLYMRFSCSTGDAMGMNMVSKAVQNVIDYLQNDFPDMDVIGLTGNFCADKKAAAVNWIEGRGKSVVCEAIIKEEVVKKVLKTNVAALVELNMIKNLTGSAVAGSLGGFNAHASNMVTAVYIATGQDPAQNVESSHCITMMEAVNDGKDLHISVSMPSIELGTVGGGTQLASQSACLNLLGVKGASKDSPGSNSRLLATIVAGSVLAGELSLMSAIAAGQLVNSHMKYNRSAKDVSKITF

SEQ ID NO: 44684 - protein, 400 aa, Caulobacter crescentus CB15
MKTARPPLPVVATRGARLILEDGRELVDGLASWWTACHGYNHPHIAGALRKQIETMPHVMFGGLAHEPAYRLAKRLARLLPGDLDHVFFAESGSVAVEIAMKMALQYQINRGVGGRTRFLAFRGGYHGDTLATMTVCDPEEGMHSLFAGVMPAQVIADLPRDPASEAALDALLAARGHEIAAMLVEPLIQGAGGMLPHPPEVLRTLRRLADKHGVLLIFDEIFTGFGRTGSLFAMQAAGVEPDIVTLSKALTGGTLPLSAAVARRHVFEAFWSDDPAAALMHGPTYMANPLACAAANASLDLFEDGAWARDVARVSAALAEGLEPCRAGEGVVDVRTLGAIGVVEFEAPVPVSDLCARFAALGVWIRPMGKVVYLTPAFTTPDEDLSRLTSAVRQVVGVD

SEQ ID NO: 44685 - protein, 315 aa, Hordeum vulgare subsp. spontaneum
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGARMAGASRIIGVDLNPAKYEQAKKFGCTDFVNPKDHTKPVQEVLVEMTNGGVDRAVECTGHIDAMIAAFECVHDGWGVAVLVGVPHKEAVFKTHPMNFLNEK

SEQ ID NO: 44686 - protein, 182 aa, Acidobacteria bacterium Ellin345
MSESTTGPCHDSLKAYVREIPDYPKPGILFYDITTLIKEPVGLARTIDGITEHFLNKNIDLVVGMEARGFIFGPAVAYRLNAGFIPIRKPRKLPGETVKHTYKLEYGEDTLEIHKDAIQKAQRVLVVDDLLATGGTAVAATELVKQLGGEICGIAFVIELDFLNGRERLKDYDVYSLLHYDK

SEQ ID NO: 44687 - protein, 315 aa, Hordeum vulgare subsp. spontaneum
MATAGKVIKCKAAVAWEAGKPLSIEEVEVAPPQAMEVGVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGARMAGASRIIGVDLNPAKYEQAKKFGCTDFVNPKDHTKPVQEVLVEMTNGGVDRAVECTGHIDAMIAAFECVHDGWGVAVLVGVPHKEAVFKTHPMNFLNEK

SEQ ID NO: 44688 - protein, 150 aa, Desulfovibrio vulgaris subsp. vulgaris str. Hildenborough
MLKARDIMTASPVTVAPDTEIAKAARILVERKFNGLPVVDDSGRLVGVICQSDLITQHKKLNIPSFFTVLDGFIPLTSMSELDEQMRRISATIVKHAMTADPVTVTPETAIDEIASLMVDSKLHTLPVVENGKLVGVIGKEDLLRTLAGA

SEQ ID NO: 44689 - protein, 315 aa, Hordeum vulgare subsp. spontaneum
MATAGKVIKCKAAVAWEAGKPLSVEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGARMAGASRIIGVDLNPAKYEQAKKFGCTDFVNPKDHTKPVQEVLVEMTNGGVDRAVECTGHIDAMIAAFECVHDGWGVAVLVGVPHKEAVFKTHPMNFLNEK

SEQ ID NO: 44690 - protein, 833 aa, Oryza sativa (indica cultivar-group)
MPPWWGKSFSKDAKKTTKENLIDTFHRLISPNDQKGSTKSKRSCRRGNDSSVEKSCRSTTVSRPTSPSKEVSRCQSFSADRPHAHPLPIPGVRPPVTRTVSDITESKPILEKRGKPPLLLPLPKPNRPPRRHGNSEVVSEIVVASPSSNCSDSDDHGDSQLQSPVGNDAENATLVTLKNKSSNARKECPGPITAKNMKEIHRPANQVHGSHILSTSPRGVAADSYQSNLQNPRPLVLDSAPNSLMSSPSRSPRRICPDHIPTSAFWAVKPHTDVTFVGSGQCSSPGSGQTSGHNSVGGDMLAQLFWQPSRSSPECSPIPSPRMTSPGPSSRVHSGSVSPLHPRSGGMAPESPTNRHDDGKKKQTHKLPLPPLSISHSSFYPNNSTPTSPISVPRSPGRTENPPSPGSRWKKGKLIGRGTFGHVYVGFNSDSGEMCAMKEVTLFLDDPKSKESAKQLGQEISLLSRLQHPNIVQYYGSETVDDKLYIYLEYVSGGSIHKLLQEYGQLGEQAIRSYTQQILSGLAYLHAKNTVHRDIKGANILVDPSGRVKLADFGMAKHINGQQCPFSFKGSPYWMAPEVIKNSNGCNLAVDIWSLGCTVLEMATSKPPWSQYEGIAAMFKIGNSKELPPIPDHLSEPGKDFIRKCLQRDPSQRPTAMELLQHPFVQKAVSLEKSVLSEPLEHLAVISCRPSAKFSDGCAYKKYFLIGIGGSDNLPEKRCKIFFKTQQSTYSNEGFAIPSRSPDDLFASRPTDPDLGQFIRVHQISQGLQERVVSEADILSPQFGKRLGNVFDLRDKLSPSERFTHHAFVDHVKLNPSLDLTSGSPHLGLKHGN

SEQ ID NO: 44691 - protein, 268 aa, Gloeobacter violaceus PCC 7421
MIKSPDCAGGCGMSIKLFDLSQKVAAITGSGRGIGRAIARGMAAAGAKVVIADIDAASARVSAAEIEQAGAEALAVEVDTVSPEQCTRMVDSTVERFGRIDVMVCNAAVDVIKPAVELAEAEWDWIVDVDLKGYFNAAQAAARRMLAQGGGSIVMTSSLASVIGIHGLVAYAAAKGGVNQLVRSMAVEWATSNVRVNAIAPGYCENIMVGAESTHADPVKEQQIRTFTPMGRRCKPEELVGPVIFLASEAASYVTGAILHVDGGYTAM

SEQ ID NO: 44692 - protein, 197 aa, Saccharophagus degradans 2-40
MADRKAQVSRDTLETQISVELNLDGTGTGKFNTGVPFLEHMMDQIARHGFIDLDVTCKGDTYIDDHHSVEDIGITIGQAMAKAVGDKRGIRRYGHAYVPLDEALSRVVIDFSGRPGLIMNIPFTQKRIGKFDTELFWEFFQGFVNHAGVTLHVDCLRGENAHHQIETVFKAFGRSLRMALERDERLGDAMPSTKGTL

SEQ ID NO: 44693 - protein, 297 aa, Medicago truncatula
MATIINLSSTQLLSYHHFPSFSPQNTPTLSLNFHPNSSTNLRPISLKPYHPRKPQSWLVAMAVKNLADTSPVTVSPENDGLTGEELPSGAGVYAVYDKNGELQFIGLSRNIAATVLAHRKSVPELCGSFKVGVVDEPDRESLTQAWKSWMEEHIKITGKVPPGNESGNATWVRPQPKKKADLRLTPGRHVQLTVPLEELVDKLVKENKVVAFIKGSRSAPLCGFSQKVIGILEKEGVDYESVDVLDEDYNYGLRETLKKYSNWPTFPQIFLNGELVGGCDILTSMNEKGEVAGLFKK

SEQ ID NO: 44694 - protein, 170 aa, Thermobifida fusca YX
MHYVFMGVSGSGKTTVARGVAQELGLPFADADDFHPEANIAKMARGIPLTDEDRLPWLQALAAWISEREREGTSSVVTCSALRRSYRDLLRRSAPGVFFLHLHGSAELIGKRIRERRGHFMPPQLLDSQFATLEPLAPDEAGAVLDVSASPEDLIAEAVRIVTGLRNAQA

SEQ ID NO: 44695 - protein, 81 aa, Glycine max
MPATPTIIGALLGLGTQMYSNALRKLPYMRHPWEHVLGMGLGVVFVNQLVKFDEKVKVDLDKMLERAKHANEQRYFDEDDD

SEQ ID NO: 44696 - protein, 116 aa, Dechloromonas aromatica RCB
MSDCIFCKIVEGKIPAGKVYEDEDILAFNDINPARPVHVLVIPKKHITSLATVVAADTPVLGKILAKANEIAVAQGSPDGFRVIINTGRVGQQEVPHLHAHIVGGPEPVGPMLKRI

SEQ ID NO: 44697 - protein, 108 aa, Dechloromonas aromatica RCB
MSTHDILHRLSETLASRRHADPEKSYTAKLFSEGPDSILKKIGEECAELIMAAKDGKRLNIVWESTDVIYHVLVLLAFYGLSIEDVSQEMRRREGISGIDEKASRGTK

SEQ ID NO: 44698 - protein, 528 aa, Alteromonadales bacterium TW-7
MYYITKTLLSYGLDELVPKSKTPWFAKIARGCLFWLRNQHKEKPAGLRLRLALQELGPVWIKFGQMLSTRRDLLPHDIAQELAFLQDQVQPFEGELAQKIIENALEINDISELFSEFSQTPLASASIAQVHTATLVDNDNIEQDVVIKVIRPNIHEQINADLALMEKLAQVLANVHNESKRLRPVEVVKEYKKTLLDELDLMREGANGIQLKRNFDDSDALYIPTVYSDYSRSNVLVMERIYGIPVSDTESLIAQNTNMKLLAERGVEVFFTQVFRDSFFHADMHPGNIFVSREHPENPKYIGIDCGIVGTLSKEDKRYLAENFIAFFNRDYRQVAQLHVDSGWVPEDTSIEEFEFAIRTVCEPIFNKPLAEISFGHVLVNLFNTARRFNMQVQPQLVLLQKTLLYVEGLGRQLYPQLDLWKTAKPFLEQWVKEQVGPLSVLKQMYANLPFWAEKMPELPDLIYQNLKRPVRTHAPVKPASHKALVLSLLGSATLVVSALCYLQHDLIAAGITATCSAACFIAAWRHT

SEQ ID NO: 44699 - protein, 347 aa, Prochlorococcus marinus str. MIT 9301
MKNLLGSTIKDLENVALDYGQAGFRGRQIYNWIYNYRNKKKNIDQIEVLPLDFRKRLKDDGFKVSDLSIHERNLANDGTLKLLLSTEDNESIECVGIPTEKRLTACLSSQVGCPMDCKFCATGKEGLKRSLKVSEILDQILFIENEMNRKVTNIVFMGMGEPLLNIDDLLLSIRSINEDLKISQRKITVSTVAVPKMINKLSAKSFKILGNCQFTLAVSLHAPNQKIRETIIPSAKNYEIENIIEDCKQYVRDTGRRVSFEYLMLRGVNDKIEHANELSHLLKGFQCHVNLIQYNQIDEVEFQRACLKDLQSFQSRLSHNGIAVSLRKSRGLDKNAACGQLRQNARN

SEQ ID NO: 44700 - protein, 286 aa, Sinorhizobium meliloti 1021
MHDSRETFVNHAFVTGYPVKHSRSPLIHGHWLKQFGIRGSYRAHEVTPEAFPDFMRQIKEGRTDFCGGNVTIPHKEAAFRLADRPDELSAELGAANTLWLENGKIRATNTDGRGFVANLDERAKGWDRISAAVILGAGGASRAVIQAIRDRGVKTIHVVNRTPERARELADRFGTAVHAHSMAALPEVVSGAGLFVNTTSLGMDGEPAPAIDFSGLAPDAVVTDIVYVPLKTPLLRQAEEQGFRIVDGLGMLLHQAVPGFEKWFGLRPVVDETLRQIIISDMDRHA

SEQ ID NO: 44701 - protein, 469 aa, Fragaria x ananassa
MAFFRTVTKLRSRLGQPPSLRDSVRCLQTQASSDLDLHSQLKELIPEQQERLKKLKKEHGKVQLGTITVDMVIGGMRGMTGLLWETSLLDPDEGIRFRGLSIPECQKVLPGATPGGEPLPEGLLWLLLTGKVPSRSKNMHYPVNNGVVPKFQIMCSRPLMLCLLEHIPMTQFTTGVMALQVQSEFQKAYDKGIPKSRYWEPTYEDSLSLIAQLPVVASYVYRRIYKGGRMIPVDDSLDYGGNFSHLLGFDDHKMQELMRLYVTIHSDHEGGNVSAHTGHLVASALSDPFLSFAAALNGLAGPLHGLANQEVLLWIKSVVDECGENITKDQLKDYVWKTLNSGKVVPGFGHGVLRKTDPRYTCQREFALKHLPDDPLFRLVSKLYDVVPPILTELGKVKNPWPNVDAHSGVLLNHFGLTEARYFTVLFGVSRSIGIGSQLIWDRALGLPLERPKSVTMESLESFCKKAAS

SEQ ID NO: 44702 - protein, 403 aa, Oryza sativa
MSISHCEDNDSDRISNLPDKLLHHVMSYLTAQEAVRTCVLSRRWQNVWSSMMFLHANAAKSSSITSFKKFLDNVLLYRNPVPLKGLWVSAACDNSDDSLDYSDIHRWVHHVLRSNAREVGIFVRCGSKLLSIDGYPFAFNSVHLSKLVLFKFTVNDCFAKKFSSGCPVLKDLVLISCGIDVTMFSSTTLKSFVIHNAEDIEHLPKQIEYLVIEMPNLVTLHIEEIPRRNIHLVDLSSVKEATIYFFEHSFRNSAVDCNILSALSNATSLKLICDSVYDEVSKLGAEDFPRCKTFSNLKYLKLGEWFLRDGCYPLLFLLRRSPNIEKLHLQLNKYGSDDYEDYPDAAAAIDPTCREIEEMFNCVKLRKITIFYPQGDERVHIIVRILIANISPLPAIKIKPTPV

SEQ ID NO: 44703 - protein, 344 aa, Arabidopsis thaliana
MKGLFKSKPRTPADLVRQTRDLLLFSDRSTSLPDLRDSKRDEKMAELSRNIRDMKSILYGNSEAEPVAEACAQLTQEFFKEDTLRLLITCLPKLNLETRKDATQVVANLQRQQVNSRLIASDYLEANIDLMDVLIEGDFENTDMALHYGAMFRECIRHQIVAKYVLESDHVKKFFDYIQLPNFDIAADAAATFKELLTRHKSTVAEFLTKNEDWFFADYNSKLLESSNYITRRQAIKLLGDILLDRSNSAVMTKYVSSRDNLRILMNLLRESSKSIQIEAFHVFKLFAANQNKPADIVNILVANRSKLLRLLADLKPDKEDERFEADKSQVLREIAALEPRDLA

SEQ ID NO: 44704 - protein, 82 aa, Cryptococcus neoformans var. neoformans JEC21
MTASTTASQTEMEAARVPLGWRDQCSALLIPLNVCRHKELYMPWKCEDERHGYEKCQYDDYIRRMKQLTRQKKEAAEAASEE

SEQ ID NO: 44705 - protein, 428 aa, Arabidopsis thaliana
  misc_feature (186)..(186): Xaa can be any naturally occurring amino acid
LGFALVLFCLNRILKGLCRDCRLQLFYIYREAEEICNHRQRKNKNKMYNLPRDLPEEVLCRIPLTSLRPVRSTCKKWSTLSKCGSFAKKHLAQAKVLADAKEFMVVLMMNFRVYLMRVNLQNNVVESSSSSSSSSSSCIKREAKLISLGDEEADISQVFHCDGLLLCISITESKTRLVVWNPYWGXTRLFEPTHQFNKFDSYSYALGYDKSRKSHKILRGITCLDPFKIYDFNSDLWRDLDVTPEWHLWQMLHGVSLKGNAYWFARENYTETMDTDHFFLLCFDFTSETFGPPLPLPFEFAVSEDTMSVSSVREEQLVVLYQPWDYLQLDIWVTSKIEPNAVSWNSKVFLSVSLKQLVSPQFQLTFGSFFIDEEKKVAVVFDKDYDNKRNIAYIFGVDGSFKAVDLGDSDRKCFPLVCSYVPSLVQLN

SEQ ID NO: 44706 - protein, 795 aa, Vibrio cholerae O1 biovar eltor str. N16961
MKFSESWLREWVNPAITTDELTHQITMAGLEVDDVLAVAGVFDGVKVGHVVECAQHPDADKLRVTKVDVGEEELLDIVCGAANCRQGLKVAVATVGATLPGDFKIKKAKLRGQPSHGMLCSFSELGIDVESNGIMELAENAPIGMDFRDFLSLNDVTIDVDLTSNRADCFSIRGLAREVGVLNRADVTAPAVNAIVATINDTISIDVKAPAACPRYLGRIVKNVNVQAQTPLWMQEKLRRCGIRSIDPVVDITNFVMLEQGQPMHAFDLAKIEGGIVVRLAEQDEKLTLLDGSEAKLNADTLVIADQQKALAIAGVFGGEHSGVSTDTKDVLLECAFFAPDHIRGRARSYGLHTDSSMRFERGVDYALQHAAMERATQLLVEICGGDVAPVVAAESAADLPKPNQVALRRSKLDKLLGHAIPDADVVEILERLGMQVETTAEGWQATAPTWRFDIAIEQDLVEEVGRIYGYNNIPNQAPVAALNMNLHNEAKLPLKRVRDLLVDRGYQEAITYSFVEPEQQKLVVPGVDALILPNPISAEMSAMRLSLIQGLLNTVVHNQKRQQPRVRLFEYGLRFIPDAAAENGMRQEPMLAGVISGARGEEHWNMETATVDFFDMKGDLEAVLELTAKGKAYSFAATKHPALHPGQAAAIMVDGKAIGVIGTVHPELERKFGLNGRTIVFEIEWNAINTRVIPEAAAISKFPANRRDIALVVDGNIASGDIVEACRVAGGELLKDAKLFDVYVGKGVEEGKKSLAIALTLQSVERTLEEADIAAAVEAIVQAVSAQFGAALRD

SEQ ID NO: 44707 - protein, 509 aa, Listeria monocytogenes
MAKELKGIAASDGIAIAKAYLLVEPDLSYEKTEVTDVESEVKRFESALEVSRTELSMIREKAAKDLGEDKAQIFDAHLLVLNDPELTGPIEESIKNSKTNAETALQETTDMFIGMFESMDNEYMRERAADIKDVRKRVLSHLLGVTIPNPALIDEEVVVVAADLTPSDTAQLNRNFVKGFVTDIGGRTSHSAIMARSLEIPAVVGTKEVTASVAKNDIVIIDGLEGNVIIHPTEEQIAHYEKIKSDFALQQAEWDKLKNEKTVSKDGVHVELAANIGTPNDLEGVISNGGEAVGLYRTEFLYMGRDNFPTEEEQFEAYKAVVSGMDGKSVVVRTLDIGGDKTLPYLELPEEMNPFLGFRAIRLCFANEELFRTQLRALLRASVYGNLKIMFPMIATVNEFRQARDILLDEKAKLKAAGTEVSDSIELGIMIEIPAAAVLADQFAKEVDFFSIGTNDLIQYTMAADRMNERVSYLYQPYNPSILRLVKMVIDASHKEGKWTGMCGEMAGD

SEQ ID NO: 44708 - protein, 231 aa, Prochlorococcus marinus str. MIT 9301
MKQVVADAAIREVKSDMILGLGSGSTAALMIKSLADEMRSGKLQNIKGVATSFQSEVLALELNIPLIDLASVSQIDLAIDGADEVDPGFQLIKGGGACHVREKLVASKADQLLIVVDETKLVQNLNLSFPLPVEVLPNAWKQVQEVISEMKGSSTLRMATKKAGPVVTDQGNLILDVLFDDGINNPKDIEMKINNIPGVLENGLFVDLTDKVLVGKIENNTPVVYSPSRAS

SEQ ID NO: 44709 - protein, 315 aa, Hordeum vulgare subsp. spontaneum
MATAGKVIKCKAAVAWEAGKPLSIEEVQVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGARMAGASRIIGVDLNPAKYEQAKKFGCTDFVNPKDHTKPVQEVLVEMTNGGVDRAVECTGHIDAMIAAFECVHDGWGVAVLVGVPHKEAVFKTHPMNFLNEK

SEQ ID NO: 44710 - protein, 1184 aa, Gloeobacter violaceus PCC 7421
MSDTPKARRRRGYRLTSQGWQRLHEARCRTEERENAGERLTLEDLSERTGFDPNTVAKVLKAEEGVDKQTLLRFFIAFGLELESDDYARPEAGAASSQPPREVRRDWGEAVDVSLFHGRGGELAILENWLVEERCRLVAVLGMGGIGKTALAVKLARQSEAHFERLIWRSLRNAPPLADLLAELIVFAGDEQAPALPTGIEGRILRLLECLRRNRCLLVLDNAESLLRGGEQAGTYREGCEGYGELLRRVGEVPHASCLVLTSREKPAEVAALEGSSLPVRSLRLGGLQESEGEVILQAKGLRGGADERRKLVECYRGNPLALMIISTSIRELFDGQIREFLAQDTAVFNGIANLLQQQFDRLTEAEKQLMYWLAIHREPVVATQLRENVVPAVSAPKILEALESLLRRSLIERGTTGYSQQPVVMEYTTEHFVERICDEVHKGTIGLFRSHALLLAQAKDYIRAAQSRLILKPVIDELLVRLGSQAHLEQRLAAVLAQQRDEAPLQPGYVGGNTLNMLATLQTELRHWDFSHLAVWQAYLQEVNLYGVNFSHTDLARCVFAQNFGGVFSVAFSPDGEQIAVGDDNSEIRLWRAADGQQQLSCQGHTDWVCAVAFAPNGQTFASASQDGTVKLWDARIGQCLATLRGHIGWVRSAAFAPDGSLLASAGQDSTVKLWDAATGRCLATLQGHTGVVHSVAFAPDGSLLASAGQDSTVKLWDAATGRCLATLQGHTEPIRSVVFSPDGHRLASASHDRTVKLWNPATGRCLATLAGHGDWVSAVAFAPDGRSLATGSLDRTVRLWETITGQCLKTLQEHTDQVFSIAFHPQGHTLASGSPTQTVKLWDTESGQCLRTLQGKTVTVLAVAFSPHGQTLVSGSDDRLVRLWDVRTGECTRVLRGHLRGVTTVAVAPDGRTLASAGADLSVKIWDALSGQCLRTLREHTGSIRSVAFAPDGRLLASGSQDGTAKLWDPGTGRCVATLRGHTSWIRSVAFAPDGGLLASGSQDGTARIWDTRTGECLQILAGHTYLICSVAFSLDGQLLASGSQDQTIRLWEVQTGACLRTLTEKTGMVFSLAFSPDGQILASGSNDMTVKLWQVGTGRCVKTLGPHTSLVVSIAYAPDGSTLASASLDETIRLFDPATGACLRRFTVERTYEGTDLTGATGLSDAQKAVLIALGAVERIL

SEQ ID NO: 44711 - protein, 260 aa, Campylobacter upsaliensis RM3195
MKFFCVIGDPISHSKSPRIHNNAIKLLGLNGIYTRFHLKDKEKLKESLFKLELNGANITLPFKEEALKIADFKDYLAEQIGSANTLILKENQIYAYNTDAPGFLKAIEEFKDVKKALILGAGGTAKAIAYALKQKNITSLIANRSEKNFAHFKDFNCVLYEDLKDFNFDLIINSTSAGLSDACLPCDVNLLKKIQTKYAFEVIYGKKTPFIKFYEEKHIKHKDGLDMLLWQGVFAFELFFDLKNRQKQIQKAMLEALNLS

SEQ ID NO: 44712 - protein, 517 aa, Gibberella zeae PH-1
MDSSQAPLIAGHSDEEEELEYASEGSRSPEEAGKTGSGMPSAFVLALTFAADDTGVVSATLVSIGTSLSNRELTSMDKSIITSSTSLFALIISPFSSVLADRLGRKHVILYADILFVTGALLQAWSSTVPIMVAGRCIIGAGVGAASFVVPLYIAEVAPAAHRGRLVTLNIMFITLGQVIAYIVGWAFSTYSSPATGWRWMVGLGALPAVLQGGMIAFMPETPRWLVKAGRSNAAKEVIRRANGDTLQHNADAVIREIELEVREEHEAERLRDHQVSDRWTWLGKWGPLVSEGRNRRALAIACLLQGLQQLCGFNSLMYFSATIFTVIGFQSPTLTSMVVAVTNFLGTVAALGLVDRIGRRRVLLYSIPFMIVGLLLSAYGFSFLSLATGINTTASEPPATAGHEMAALTILVSIMVYVAAYALGLGNVPWMQSELFPLAVRSLGSGVATATSWAANFVVGLTFLPLMDLLSPSWTFVLYAIICGGGYFLVWRIYPETAGLSLEEATALLDNGWGVR

SEQ ID NO: 44713 - protein, 516 aa, Saccharophagus degradans 2-40
MSEVKKPLALIILDGFGYSESDKYNAINAAKAPTWRKIWAENPKTTIATSGMAVGLPEGQMGNSEVGHMTLGAGRVVYQNFTRINKAIADGDFYTNPVYTKAVDDAQSQGKAVHVIGLLSDGGVHSHEDHMIAMMELAVKRGAEKVYMHAFLDGRDTPPRSAKAPLQKTEEKLKALGGGKIASIIGRFFALDRDNRWDRVQQAFDLMVDGKAAFTAQSATAGLEAAYERDENDEFVKATAIVDADGKPVTIEDGDAVIFMNFRPDRARQLTNAFVDKNFDGFARARVPALSDFVMTTEYSADIDTSCAYPPEDLVNSFGEVMAKNGKKQLRIAETEKYAHVTFFFSGGQESLYEGEDRILVPSPQVETYDEQPEMSAPEVTAKLVDAIENGGYDAIICNYANCDQVGHTGDFDASVKAVEAVDAALAEVFAALERVGGEALITADHGNVELMYDDEAQQLHTQHTTLPVPLVYVGKRDISLEQGGSLADIAPTMLALLDVPQPTEMNGRNLVKFSK

SEQ ID NO: 44714 - protein, 132 aa, Dechloromonas aromatica RCB
MADLDNSQDWLEALKWDADGMIPAIAQDENGRVVMFAYMNRDSLQETVLCGNAVYWSRSRKRLWRKGEESGHFQKVNSIRTDCDGDVLLLSIEQVGGIACHTGRESCFFNELNGDRWIPADPVLKDPKEIYK

SEQ ID NO: 44715 - protein, 368 aa, Oryza sativa (indica cultivar-group)
MTKQEILLEKKRVITVQGRDKAGRPIVRIVGKNFPARELGGGGHAEAALKGYVRRRVTPAIGDAEFVVVYMHSGVDRRENFPGVGAVRTAYESMPAAVRERLHAVYFLHPGLQSRLFFSTLGRFLFSSGLYGKLRYVSRLEYLWAHVRKGELDVPEAVRRHDDELEQRPLMDYGIEASERTSKNGPKPHCTPPSPPKHRRHLNHMNMARSNLLCCLGTRREENARQRQTRPTPRPRLRRLMSGMKRVFGRSPPCGQTAVAPDSGIVVVEPRRQTAARRVGKGARDGGVNNREEISREEAAAATIQAGFRGHLARRAFRALRSLVKLQALARGSYVRKQAGVAIRFMKVLVRLQVRVRARQLLHRSKDQ

SEQ ID NO: 44716 - protein, 195 aa, Dechloromonas aromatica RCB
MRQAEITRNTLETQITVRLNLDGTGQGKYATGVPFLDHMLDQIARHGLIDLDIEAKGDLHIDAHHTVEDIGITFGQALAKAWGDKKGLTRYGHSYVPLDEALSRVVIDLSGRPGLELHVEFTRAVIGTFDVDLVGEFFHGLVNHAGMTLHIDNLRGKNAHHQAETIFKAFGRALRMAVTPDPRMAGTMPSTKGSL

SEQ ID NO: 44717 - protein, 380 aa, Alteromonadales bacterium TW-7
MFNSKLPDVGVSIFSQMSELANQFSAINLSQGFPEFDTPNFLKSQITHYVQHGVNQYSPSSGVPKLQQQIASLIQKKYATELNAAKQITITSGATEALFVAIQTIVRPNDEVIVFDPAYDAYKPAIELAGGRSVHIALKAPDYTINWRTVEQKITKHTRAIVINSPHNPTAKVITQQDITELKRLVGTYKLYIVSDEVYEHIAFDGQPHLSVLRDKELLAQSFVVSSFGKTFHCTGWKMGYCIAPEHLASEFRKIHQYVTFSSFTPAQHALADMLEQQSEHVDSLSDFYQQKRDLLIRHLLGSRFTVLPSQGTYFLLLDYSDVSDLNDVEFCHWLVEQAGVAAIPLSVFYQTSPGDKVIRLCFAKNDETLKEAAHILCQL

SEQ ID NO: 44718 - protein, 457 aa, Shigella flexneri 2a str. 2457T
MESKNKLKRGLSTRHIRFMALGSAIGTGLFYGSADAIKMAGPSVLLAYIIGGIAAYIIMRALGEMSVHNPAASSFSRYAQENLGPLAGYITGWTYCFEILIVAIADVTAFGIYMGVLFPTVPHWIWVLSVVLIICAVNLMSVKVFGELEFWFSFFKVATIIIMIVAGFGIIIWGIGNGGQPTGIHNLWSNGGFFSNGWLGMVMSLQMVMFAYGGIEIIGITAGEAKDPEKSIPRAINSVPMRILVFYVGTLFVIMSIYPWNQVGTAGSPFVLTFQHMGITFAASILNFVVLTASLSAINSDVFGVGRMLHGMAEQGSAPKIFSKTSRRGIPWVTVLVMTTALLFAVYLNYIMPENVFLVIASLATFATVWVWIMILLSQIAFRRRLPPEEVKALKFKVPGGVATTIGGLIFLLFIIGLIGYHPDTRISLYVGFAWIVVLLIGWMFKRRHDRQLAENQ

SEQ ID NO: 44719 - protein, 123 aa, Alteromonadales bacterium TW-7
MSQETIFTKIINREIPANIIYEDENTLAFEDINPQAPFHVLIIPKIAIPTINHINDDNAHLVGNLYVVAAKLAKEHNFSDDGYRVVMNCNDHGGQTVYHIHLHMLAGKQMGWPPYQDNKKEIA

SEQ ID NO: 44720 - protein, 650 aa, Geobacillus kaustophilus HTA426
MEKKTFYLTTPIYYPSDRLHIGHAYTTVAGDAMARYKRMRGYDVMYLTGTDEHGQKIQRKAEEKGVTPQQYVDEIVAGIQELWKKLDISYDDFIRTTQERHKKVVEQIFTRLVEQGDIYLGEYEGWYCTPCESFYTERQLVDGNCPDCGRPVEKVKEESYFFRMSKYVDRLLQYYEENPDFIQPESRKNEMINNFIKPGLEDLAVSRTTFDWGIKVPGNPKHVIYVWIDALANYITALGYGTDNDEKFRKYWPADVHLVGKEIVRFHTIYWPIILMALGLPLPKKVFGHGWLLMKDGKMSKSKGNVVDPVTLIDRYGLDALRYYLLREVPFGADGVFTPEGFIERINYDLANDLGNLLHRTVAMIEKYFDGVIPPYRGPKTPFDQELVQTAREVVRQYEEAMEGMEFSVALAAVWQLISRTNKYIDETQPWVLAKDEQKRDELAAVMTHLAESLRHTAVLLQPFLTRTPERMFAQLGITDHSLKEWDSLYDFGLIPEGTKVQKGEPLFPRLDIEAEVEYIKAHMQGGKPAAEPVKEEKKAAEAAEISIDEFAKVDLRVAEVIHAERIKNADKLLKLQLDLGGEKRQVISGIAEFYKPEELVGKKVICVANLKPAKLRGEWSEGMILAGGSGGEFSLATVDQHVPNGTKIK

SEQ ID NO: 44721 - protein, 392 aa, Corynebacterium melassecola
MTIDLQRSTQNLTHEEIFEAHEGGKLSISSTRPLRDMRDLSLAYTPGVAQVCEAIKEDPEVARTHTGIGNTVAVISDGTAVLGLGDIGPQASLPVMEGKAQLFSSFAGLKAIPIVLDVHDVDALVETIAAIAPSFGAINLEDISAPRCFEVERRLIERLDIPVMHDDQHGTAVVILAALRNSLKLLDRKIEDLKIVISGAGAAGVAAVDMLTNAGATDIVVLDSRGIIHDSREDLSPVKDALAEKTNPRGISGGINEAFTGADLFIGVSGGNIGEDALKLMAPQPILFTLANPTPEIDPELSQKYGAIVATGRSDLPNQINNVLAFPGIFAGALAAKAKKITPEMKLAAAEAIADIAAEDLEVGRIVPTALDPRVAPAVKAAVQAVAEAQNA

SEQ ID NO: 44722 - protein, 183 aa, Arabidopsis thaliana
MASSSEEIVSAGESSEIEEAVASLTMSSNKILLTSSDGESFEIDEAVARKFLIIVHMMEDNCAGEAIPLENVTGDILSKIIEYAKMHVNEPSEEDEDEEAKKNLDSWDAKFMEKLDLETIFKIILAANYLNFEGLLGFASQTVADYIKDKTPEEVREIFNIENDFTPEEEEEIRKENAWTFNE

SEQ ID NO: 44723 - protein, 172 aa, Trichodesmium erythraeum IMS101
MILNKKISQSLVLKGLFLILPLSIFNSITYPTFAQINPNQPPRNQNSSGRSLTVRSDIQEADARTGVVTARGNVQINYPARKIQATAAQAQYFSRERRIVLSGDVFILQDGNTIRGETVTYLIDEGRFIALPQSQGQVESVYVVPTGQGADIEGAVSAPFNPKPAFKTPISP

SEQ ID NO: 44724 - protein, 484 aa, Sinorhizobium meliloti 1021
MNLKDPSLFRQAALVGETWIEADPKNAIEVNNPATGEIIGRVPKLGAADTRTAIEAAARVQKEWAARTAKERSAVLRRWFELMIENKDDLGRILTMEQGKPLAEATGEIVYGASFIEWFAEEARRVYGDLVPGHQKDKRILVMKQPIGVVAAITPWNFPNAMITRKAGPALAAGCAMVLKPAAQTPFSAIAIAVLAERAGMPKGLFSVITGSAREIGAEMTSNPTVRKLTFTGSTEVGAELYRQSAATIKKLGLELGGNAPFIVFDDADLDAAVEGALIAKFRNNGQTCVCANRIYVQDGVYEAFSDKLAQAVAKLKTGNGMEDGVILGPLIDQPALKKVEEHVADALAKGARVVQGGRRHSLGGTFYEATVLADVTQAMAVAREETFGPVAPLFRFKDESDVIAQANDTEFGLASYFYAKDLARVFRVAEALEYGMVGVNTGLISTAEAPFGGVKLSGLGREGSKYGIEEFMEIKYVCLGGIA

SEQ ID NO: 44725 - protein, 177 aa, Zea mays
  misc_feature (8)..(8): Xaa can be any naturally occurring amino acid
  misc_feature (12)..(12): Xaa can be any naturally occurring amino acid
  misc_feature (19)..(19): Xaa can be any naturally occurring amino acid
  misc_feature (21)..(21): Xaa can be any naturally occurring amino acid
  misc_feature (23)..(23): Xaa can be any naturally occurring amino acid
  misc_feature (28)..(28): Xaa can be any naturally occurring amino acid
  misc_feature (30)..(30): Xaa can be any naturally occurring amino acid
  misc_feature (39)..(39): Xaa can be any naturally occurring amino acid
  misc_feature (46)..(46): Xaa can be any naturally occurring amino acid
  misc_feature (49)..(49): Xaa can be any naturally occurring amino acid
  misc_feature (55)..(56): Xaa can be any naturally occurring amino acid
  misc_feature (60)..(60): Xaa can be any naturally occurring amino acid
  misc_feature (63)..(64): Xaa can be any naturally occurring amino acid
  misc_feature (67)..(67): Xaa can be any naturally occurring amino acid
  misc_feature (94)..(95): Xaa can be any naturally occurring amino acid
  misc_feature (109)..(109): Xaa can be any naturally occurring amino acid
  misc_feature (111)..(112): Xaa can be any naturally occurring amino acid
  misc_feature (114)..(114): Xaa can be any naturally occurring amino acid
  misc_feature (118)..(119): Xaa can be any naturally occurring amino acid
  misc_feature (131)..(131): Xaa can be any naturally occurring amino acid
  misc_feature (133)..(133): Xaa can be any naturally occurring amino acid
  misc_feature (138)..(139): Xaa can be any naturally occurring amino acid
  misc_feature (142)..(143): Xaa can be any naturally occurring amino acid
  misc_feature (145)..(145): Xaa can be any naturally occurring amino acid
  misc_feature (148)..(148): Xaa can be any naturally occurring amino acid
  misc_feature (150)..(150): Xaa can be any naturally occurring amino acid
  misc_feature (164)..(168): Xaa can be any naturally occurring amino acid
  misc_feature (171)..(171): Xaa can be any naturally occurring amino acid
LTSPPPPXPPAXERSPFYXYXKXQILRXFXAYRDALQGXRSIVGYXVKXNNNLPXXRVLXELXXGAXLVSGNELRLALQGGFDPARCIFNGNGXXLEDLKLAAESGVFXNXXSXFDLXXIVRAARATGKEXAXFNLKXXPDXXSXVHXLXGHGEIKTFPNFRGXXXXXNLXIGFFEN

SEQ ID NO: 44726 - protein, 358 aa, Oryza sativa (japonica cultivar-group)
MSAYCGKYKDELIKNAAYIGTPGKGILAADESTGTIGKRFASINVENVEENRRSLRELLFCTPGALQYLSGVILFEETLYQKTKDGKPFVDVLKEGGVLPGIKVDKGTIEVAGTEKETTTQGHDDLGKRCAKYYEAGARFAKWRAVLKIGPNEPSQLAIHLNAQGLARYAIICQENGLVPIVEPEILVDGPHDIDPCAYVSEVVLAACYKALNEHHVLLEGTLLKPNMVTPGSDAKKVSPEVIAEYTVRTLQRTVPAAVPAIVFLSGGQSKEEATRNLNAMNKLSTKKPWSLSFSFGRALQQSTLKAWSGKAANIEKARAAFLTRCKANSEATLGTYKGDAVLGEGASESLHVKDYKY

SEQ ID NO: 44727 - protein, 509 aa, Myxococcus xanthus DK 1622
MRAPAPTPKRTVYTEAMEIFHRAADLIALDKRVRLELEEPDYEHIFYVTAKLKDRLVPLSEEKARTFSNLPETQVRNKEGLELLANGNIILNGRALLGSDVDIRQGHLRLPDGKVYQLVPGESQRFKAYRVQHNQARGPYKGGLRYHREVSLDLFKALAAEMTWKTAIAEVPFGGGKGGIQIDPREYGREEIEAITLRFMYRLKSMIGPDIDIPAPDVGTNPGIMALLYRQYSDGERERHNLRGIVTGKDVRIGGSEGRHKATGQGVAFCIEDYYADRGESVKGKTFIIQGFGNVGSHAANILSQMGARLLAVNDADGTIFNGDGIDVTALSAYVQDPKNLKRSVLGFPGAQRIEKKDLWDVQADILVPAALGGEITADVAERLRVKLVAEGANGPTTPEADRILEKRGIELIPDIIANAGGVTVSYYEWIQNKRMERWSEAEVDQRLERAMKRNYRIIRDISRNQPRKTEMHDSRQYCIGETVDTRCAAMILALKRIEAHYLLEGFSQ

SEQ ID NO: 44728 - protein, 122 aa, Medicago sativa
RETWSHTPQYKIGYCQQCPDKVQWPSNFGPKPPLYFNAGMFVFQPNVATYHDLLEKVQITKPTPFAEQDFLNMYFKDKYKPIPNVYNLVLAMMWRHPENVELEKVQVVHYCAAGSKPWRYTG

SEQ ID NO: 44729 - protein, 475 aa, Coccidioides immitis RS
MSATKAQSQKIFEKLKTRPANKICFDCGSKNPTWSSVPFGIYLCLDCSSNHRNLGVHISFVRSTNLDQWQWDQLRVMKVGGNESATKYFQSHGGTAALASKDPKVKYTSNAAVKYKEELKRRAALDAQEYPDEVVITDVVATGTPDGSSTPAGEPDDDFFSSWDKPAIKRPSNPPSRTTTPAGTRTASPFLNPGANGNGANRPKSPLSASDKSGAPPPLVAVRTGSAVRKGASAGAKKGSVLGAKKGPKLGAKKVTGTESIDFEEAERKAKEEAERIEKLGYDPEAEQEEAKTKIVSPTPVSPSRSSFNASRGHERSPSEIERLGMGVSRLGFGQVGKPKAPAPKKLGFGAVGHAKPTVDDEELEQTRAKFGSQKGISSDEFFGRNQFDPAAQAEAKARLAGFEGATAISSNAYFGRPEDENTDDYGNYGDLESAAKDFVRRFGITAGDDLENLTNVLGEGASRLQDAVRNYLNR

SEQ ID NO: 44730 - protein, 468 aa, Saccharophagus degradans 2-40
MSEKTLNLIKESEATWLDLRFTDTKGKEQHVTIPASYVDEEFFENGQMFDGSSIAGWKGINESDMILMPDDSTAMLDPFTDEATVILRCDIVEPSTGQGYERDPRSVAKRAEEFLKSTGLGDTAFFGPEPEFFVFDDVKWGADMSGSFVKINSEEAAWSSGSKFTDGNLGHRPRVKGGYFPVPPVDSLHDIRASMCNAMMQMGLDVEVHHHEVATAGQCEIGVKFNTLVKKADEVQILKYCVHNVAHAYGKTATFMPKPIVGDNGSGMHVHQSYWKDGVNQFAGDGYAGLSETALYYIGGIIKHAKAINAFSNPGTNSYKRLIPGFEAPVMLAYSARNRSASIRIPYVPSPKGKRIEARFADPIANPYLCFAAMLMAGIDGVKNKIHPGDAADKDLYDLPKEEADKIPQVCGSLREALDNLDKDREFLTQGGVFTDDMIDAYIELKMEDVFKIEHTTHPLEFDLYYSV

SEQ ID NO: 44731 - protein, 559 aa, Oryza sativa (japonica cultivar-group)
MASSGFSWTLPDHPKLPKGKTVALVVLDGWGEANADKYNCIHVAQTPVMDSLKNGAPERWRLVKAHGTAVGLPSEDDMGNSEVGHNALGAGRIFAQGAKLVDLALASGKIYDGEGFNYIKECFDKGTLHLIGLLSDGGVHSRLDQVQLLLKGASERGAKRIRVHILTDGRDVLDGSSVGFVETLESDLSQLRDKGIDARIASGGGRMYVTMDRYENDWDVVKRGWDAQVLGEAPYKFQNAVEAVKTLRAETKASDQYLPPFVIVDESGKSVGPVVDGDAVVTFNFRADRMVMLAKALEYADFDKFDRVRVPKIRYAGMLQYDGELKLPSHYLVSPPEIERTSGEYLVKNGVRTFACSETVKFGHVTFFWNGNRSGYFDETKEEYVEIPSDIGITFNVKPNMKALEIAEKARDAILSGKFDQVRVNLPNGDMVGHTGDIEATVVACKAADEAVKIILDAIEQVGGIYLVTADHGNAEDMVKRNKSGQPLLDKNGGIQILTSHTLQPVPVAIGGPGLHPGVKFRSDIQTPGLANVAATVMNFHGFEAPADYEPTLIEVVDN

SEQ ID NO: 44732 - protein, 375 aa, Shigella flexneri 2a str. 301
MLNTGHLHPKVVAAVEAQLKKLSHTCFQVLAYEPYLELCEIMNQKVPGDFAKKTLLVTTGSEAVENAVKIARAATKRSGTIAFSGEYHGRTHYTLALTGKVNPYSAGMGLMPGHVYRALYPCPLHGISEDDAIASIHRIFKNDAAPEDIAAIMIEPVQGEGGFYAASPAFMQRLRALCDEHGIMLIADEVQSGAGRTGTLFAMEQMGVAPDLTTFAKSIAGGFPLAGVTGRAEVMDAVAPGGLGGTYAGNPIACVAALEVLKVFEQENLLQKANDLGQKLKDGLLAIAEKHPEIGDVRGLGSMIAIELFEDGDHSKPDAKLTAEIVARARDKGLILLSCGPYYNVLRILVPLTIEDAQIRQGLEIIGQCFDEAKQ

SEQ ID NO: 44733 - protein, 524 aa, Solanum lycopersicum
MDTCCAAMKSTVHLGRVSTGGFNNGEKEIFGEKIRGSLNNNLRINQLSKSLKLEKKIKPGVAYSVITTENDTETVFVDMPRLERRRANPKDVAAVILGGGEGTKLFPLTSRTATPAVPVGGCYRLIDIPMSNCINSAINKIFVLTQYNSAALNRHIARTYFGNGVSFGDGFVEVLAATQTPGEAGKKWFQGTADAVRKFIWVFEDAKNKNIENILVLSGDHLYRMDYMELVQNHIDRNADITLSCAPAEDSRASDFGLVKIDSRGRVVQFAEKPKGFELKAMQVDTTLVGLSPQDAKKSPYIASMGVYVFKTDVLLKLLKWSYPTSNDFGSEIIPAAIDDYNVQAYIFKDYWEDIGTIKSFYNASLALTQEFPEFQFYDPKTPFYTSPRFLPPTKIDNCKIKDAIISHGCFLRDCTVEHSIVGERSRLDCGVELKDTFMMGADYYQTESEIASLLAEGKVPIGIGENTKIRKCIIDKNAKIGKNVSIINKDGVQEADRPEEGFYIRSGIIIISEKATIRDGTVI

SEQ ID NO: 44734 - protein, 443 aa, Rhizobium sp. NGR234
MYRTNTPNLENYWMPFTANRQFKAAPRLLASAEGVYYRDIDGNQVLDGTAGLWCVNAGHARKEISQAVERQLNTLDFAPSFQMGHPIAFQFAEKLAEIAPGEPGKKLDRIFYTGSGSESVDTALKIAIAYQRAIGQGTRTRLIGRERGYHGVGFGGISVGGLVNNRRVFPQVPGADHLRHTHDLARNPFTKGGLPEHGAELADDLERLVALHGAETIAAVIVEPVAGSTGVLLPPKGYLERLRATADKHGILLIFDEVISGFGRLGAPFAVDYFGVTPDIITTAKGLTNGVVPMGAVFTSSKVHDALMHGPEAQIELFHGYTYSGHPVACAAGLAAMEIYEKEALLTRASELATYWEDAVHGLRSRKNVIDIRTIGLVAGIELASRSEAAGARAYDVFVDCFKRGLLIRVTGDIIALSPPLTIEREQVDELMSILADALDRAD

SEQ ID NO: 44735 - protein, 91 aa, Cladophora glomerata
VDAELLADGKKVFAGNCAACHLGGNNSVLADKTLKKDAIEKYLEGGLTLEAIKYQVNNGKGAMPAWADRLDEDDIEAVSNYVYDQAVNSKW

SEQ ID NO: 44736 - protein, 124 aa, Geobacillus kaustophilus HTA426
MRKVETTKAPQAIGPYSQGIIVNNMFYSSGQIPLTPEGELVKGDIQAQTHQVFQNLKAVLEAAGASLDTVVKTTVFLKNMDDFAAMNEVYSQYFPNHKPARSCVEVARLPKDVLVEIEVVALVP

SEQ ID NO: 44737 - protein, 788 aa, Azoarcus sp. EbN1
MTRYVIPFTELRMSDVEQVGGKNASLGEMISQLPASVRVPGGFATTADAFREFLAHQGLAGRISAALETLDVDDVNTLAKTGAQIRQWIVDTPFPANLEEEIRTAYNALTAEGEGSFAVRSSATAEDLPDASFAGQQETFLNIHGYEHILHAMKEVFASLYNDRAISYRVHKGFTHAEVALSAGVQRMVRSDTGASGVMFTIDTESGFNDVVFITASYGLGETVVQGAVNPDEFYVHKSTLALGKPAVIRRNLGSKLIKMVFADKKEAGKSVRTVDVAEADRVKFSLTNEDVLELARYAVIIEKHYGRPMDIEWGKDGGDGKLYILQARPETVKSQSSGHVMEKYRLKQYGKSLTHGRAIGQKIGVGTVRIVADASEMSRVQAGDILVTDMTDPNWEPVMKRASAIVTNRGGRTCHAAIIARELGIPAIVGCGNATEVLDEGDSVTVSCAEGDTGYVYRGRLDFEVVTTDMGNLPEIPVKIMMNVGNPELAFEFAQIPNGGVGLARLEFVINNMIGIHPKAILELGQVPASLRDEILRRSRGYATPKQFFIEKLVEGVATIAAAFYPKPVIVRMSDFKSNEYRKLLGGEIYEPEEENPMLGFRGASRYIAHSFRDCFELECTAMKKVRNELGLTNVQIMIPFVRNVEEAAGVVELLAEHGLKRGVNDLKLIMMCEIPSNALLADAFLEHFDGFSIGSNDLTQLTLGLDRDSGLVAHAFDERDPAVKQLLSMAIQSANRLGKYVGICGQGPSDHADFAEWLMDEGIQTISLNPDTVIDTWLKLAAHVKN

SEQ ID NO: 44738 - protein, 527 aa, Solanum habrochaites
MDTCCAAMKSTVHLGRVSTGSFNNGEKEIFGEKMRGSLNNNLRINQLSKSLKLEKKEKKIKPGVAYAVITTENDTETVFVDMPRLERRRANPKDVAAVILGGGEGTKLFPLTSRTATPAVPVGGCYRLIDIPMSNCINSAINKIFVLTQYNSAALNRHIARTYFGNGVSFGDGFVEVLAATQTPGEAGKKWFQGTADAVRKFIWVFEDAKNKNIENILVLSGDHLYRMDYMELVQNHIDRNADITLSCAPAEDSRASDFGLVKIDNRGRVVQFAEKPKGFELKAMQVDTTLVGLSPQDAKKSPYIASMGVYVFKTDVLLKLLKWSYPTSNDFGSEIIPAAIDDYNVQAYIFKDYWEDIGTIKSFYNASLALTQEFPEFQFYDPKTPFYTSPRFLPPTKIDNCKIKDAIISHGCFLRDCSVEHSIVGERSRLDCGVELKDTFMMGADYYQTESEIASLLAEGKVPIGIGENTKIRKCIIDKNAKIGKNVSIINKDGVQEADRPEEGFYIRSGITIISEKATIRDGTVI

SEQ ID NO: 44739 - protein, 365 aa, Pleurochrysis carterae
DNGSGMCKAGFAGDDAPRAVFPSIIGRPRQPGVMVGMGQKDSYVGDEAQSKRGILTLKYPIEHGIVTNWDDMEKIWHHTFYNELRVAPEEHPVLLTEAPLNPKANREKMTQIMFETFNVPAMYVAIQAVLSLYASGRTTGIVMDSGDGVSHTVPIYEGYALPHAILRLDLAGRDLTDWMVKLLTERGYSFTTTAEREIVRDIKEKLAYVALDFDAEMASCAQSSAVEKSYELPDGQVITLGNERFRCPEALFQPSFLGMETAGVHETTYNSIMKCDVDIRKDLYANIVLSGGTTMYAGIADRMSKEITALAPASMKVKIIAPPERKYSVWIGGSILSSLSTFQQMWISKKEYDESGPSIVHRKCF

SEQ ID NO: 44740 - protein, 370 aa, Rhizobium sp. NGR234
MKSRAAVAWAANKPLSIETIEIGGPKTGEALIEIMATGVCHTDAYTLSGLDSEGKFPAILGHEGAGIVREVGPGVTSLRPGDHVIPLYTPECRECKTCLSQRSNLCTSIRATQGQGLMPDRTTRFSCDAGEIFHYMGCSTFSNFTVLPEIAIAKVREDAPFDKICYIGCGVTTGIGAVIHTAKVWPGANVAVFGLGGIGLNVIQGARMVGADRIIGVDLNPAKAEMARRFGMTDFVNPNEVGTGKVVEAIQDLTGGGVDFSFDATGNTNVMRQALECCHRGWGESIIIGVAEAGKEISTRPFQLVTGRVWKGTAFGGARGRTDVPQIVDWYMEGKINIDDLITHTMPLDEINTAFDLMHEGKSIRSVVLF

SEQ ID NO: 44741 - protein, 284 aa, Brassica napus
  misc_feature (90)..(90): Xaa can be any naturally occurring amino acid
MAGGLDMSLDDLIKSNRKPTGSRGRGNGGSSRFGGGSGPSRRFSNRVGNRTAPYSRPLQQQQAQDPMWQNDVFATDASVAAAFGHQFWRXGSVVGGSSIETGTKLYISNLDYGVSNEDIKELFSEVGDLKRYGIHYDKSGRSKGTAEVVFSRRGDALAAVKRYNNVQLDGKLMKIEIVGTNLSAPTPTTPLAPVQFPFPSNGILGNFNENYNGGFNGNFRGRGGFMGRPRGGFGGGNFRGGRGGRGGRGGGGGRGSGRGRDEKVSAEDLDAELDKYHKAAMETS

SEQ ID NO: 44742 - protein, 468 aa, Nostoc sp. PCC 7120
MKTPPINQKSLRETESWKLLESSIIYYEGNPIGTVAAQDPELAALNYDQCFLRDFVPSAFVFLMDGQTDIVRNFLIETLTLQSHEKEMDCFQPGAGLMPASFKVESDGSKEYLVADFGEKAIARVPPVDSCMWWILLLRAYEKATGDLTLAREPKFQAGIKLILDLCLAHRFSMYPTMLVPDGAFMIDRRMGVYEHPLEIQVLFYAALRAARELLLPDGDGEQYLNKVHGRLGALQYHIRNYYWVDLKRLREIYRYKGNEFGKEIANKFNIFSQSIPDWVIEWLPEKGGYLAGNLGPGRMDFRFFALGNLMAILAGLASEEESQRIMNLFAHRWEDLIGYMPVKICYPALQGLEWQIVTGCDPKNIPWSYHNGGNWPVLLWLFTAAALKTGKVELAHEAIAIAEGRLSNDKFPEYYDGNNGRLIGKEARIYQTWSIAGLLVAKQFLANPDHVEFISFPDTFIGPGCSL

SEQ ID NO: 44743 - protein, 365 aa, Pleurochrysis carterae
DNGSGMCKAGFAGDDAPRAVFPSIIGRPRQPGVMVGMGQKDSYVGDEAQSKRGILTLKYPIEHGIVTNWDDMEKIWHHTFYNELRVAPEEHPVLLTEAPLNPKANREKMTQIMFETFNVPAMYVAIQAVLSLYASGRTTGIVMDSGDGVSHTVPIYEGYALPHAILRLDLAGRDLTDWMVKLLTERGYSFTTTAEREIVRDIKEKLAYVALDFDAEMASCVQSSAVEKSYELPDGQVITLGNERFRCHEALFQPAFLGMENAGVHETTYNSIMKCDVDIRKDLYANIVLSGGTTMYAGIADRMSKEITALAPASMKVKIIAPPERKYSVWIGGSILSSLSTFQQMWISKKEYDESGPSIVHRKCF

SEQ ID NO: 44744 - protein, 201 aa, Actinobacillus pleuropneumoniae serovar 1 str. 4074
MLVSTEILDQYQALIFDMDGTIIDTMPSHAKAWEITGEHFGYQVDSSVMYELGGATTYTIGREIMQRANMPMELLEEVVQMKRKIAMDLTYEHSSLLPAFEIIQHYSGKKPLAVGTGAHRIQAYKLLDKFNLRPYFNTIVDADDVKEHKPSPETFLLCAERLGVEPKHCLVFEDADLGIQAALAGGMDVFDVRTNQITKAR

SEQ ID NO: 44745 - protein, 165 aa, Brassica napus
AYMIYIKFEEYPNALQIALFLDNMQYVKQVFTSCTDLPHKKQDAWVISRHGITVELDSEMVADKDDRDMLQDIVNNTKLSEGYLTLARDIEVMEAKTPEDIYKAHLLDGRASSSPSVDSARQNLAATFVNAFVNAGFGQDKLMTVPSDAASGTAGNWLFKNKEHG

SEQ ID NO: 44746 - protein, 302 aa, Prochlorococcus marinus
MSPVPEISSAPFGRLLTAMVTPFDTAGAVDFALAARLARYLVDQGSDGLIVCGTTGESPTLSWEEQYQLLETVRNAVNGSAKVLPGTGSNSTSEAIHATAKAAEAGADGALVVVPYYNKPPQAGLESHFRAVAQAAPDLPLMLYNIPGRTGCSISPITVQRLMNCSNIVSFKAASGTTNEVTDLRIRCGSRLAIYSGDDGLPLPMLSVGAVGVVSVASHIVGMRLKAMIEAYFAGENSLALSHHEQLQPLFKALFATTNPIPVKAALELIGWPVGAPRSPLLPLENQMKNELMKTISALLQT

SEQ ID NO: 44747 - protein, 345 aa, Pleurochrysis carterae
DNGSGMCKAGFAGDDAPRAVFPSIIGRPRQPGVMVGMGQKDSYVGDEAQSKRGILTLKYPIEHGIVTNWDDMEKIWHHTFYNELRVAPEEHPVLLTEAPLNPKANREKMTQIMFETFNVPAMYVAIQAVLSLYASGRTTGIVMDSGDGVSHTVPIYEGYALPHAILRLDLAGRDLTDWMVKLLTERGYSFTTTAEREIVRDIKEKLAYVALDFDAEMASCAQSSAVEKSYELPDGQVITLGNERFRCPEALFQPSFLDIRKDLYANIVLSGGTTMYAGIADRMSKEITALAPASMKVKIIAPPERKYSVWIGGSILSSLSTFQQMWISKKEYDESGPSIVHRKCF

SEQ ID NO: 44748 - protein, 315 aa, Hordeum vulgare subsp. spontaneum
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGARMAGASRIIGVDLNPAKYEQVKKFGCTDFVNPKDHTKPVQEVLVEMINGGVDRAVECTGHIDAMIAAFECVHDGWGVAVLVGVPHKEAVFKTHPMNFLNEK

SEQ ID NO: 44749 - protein, 413 aa, Oryza sativa (indica cultivar-group)
MDRASENRRLAAVGKPVPGIGEMGNRRPLRDINNLVGAPPHPSAIAKKPMLEKSGKEEQKPALVVSHRPMTRNFAASLTRKEQLDHQVSVADAAVVCTDPQKNPIPDGTVDDDVESCESNDYIAVDECNDTDEDESMMDIDSADSGNPLAATEYVEELYKFYRENEEMSCVQPDYMSSQGDINEKMRAILIDWLIEVHHKFELMDETLFLTVNIVDRFLEKQVVPRKKLQLVGVTAMLLACKYEEVAVPVVEDLVLISDRAYTKGQILEMEKLILNTLQFNMSVPTPYVFMRRFLKAAQSDKQLSLVEYQMLKYRPSLLAAAAVYTAQCALTRCQQWTKTCELHSRYTGEQLLECSRMMVDFHQKAGAGKLTGVHRKYSTFKFGCAAKTEPALFLLESGAGGYNLQKHLQQAC

SEQ ID NO: 44750 - protein, 319 aa, Saccharophagus degradans 2-40
MNLHIFKRSILTIHLVILAGLISGCYGISNTKADTSQSMPNHKNATQQTASGDAAPFDNGRMCIDHLVNAKLNHFNDDWSLPENMVDLRSEEGQTRLLECSYCEDYPTLATAYLTQATQTFCGLASTTMVLNADAESRKWRPVTQPYQPFNFYTQCNLLNDEVREHIDVAKVLNEGMELNEIFFVVKNQPSVVEAYCQHATSAQNKGELPASDAPHNCGVDQDYNTFMKTITNALNTPRHYVIANFAGAPSPERGGHFSPIAAYHKASDSFLIMDVARYKYPPFWISSKELWQAMQKIDSGSGKARGYIIAQTKSGSAN

SEQ ID NO: 44751 - protein, 410 aa, Gossypium hirsutum
MAGDSEMNPEQVEEEFSVWKKNTPFLYDLVISHPLEWPSLTVHWVPSSPTPYGPDPTFNVHKLVLGTHTSGGAPDFLMIADAVLPTLASESNIAAKNDDPVIPKVEITQKMRVDGEVNRARCMPQNPVIIGAKTSGSDVFVFDYAKQAAAKEQEGDCVADLRLRGHEKEGYGLSWSPFKEGYLLSGSQDHKICLWDLSSWPQDKVLDATHVYEAHESVVEDVSWHLKNENIFGSSGDDCMLMIWDLRTNQTEHRVKAHDREINYLSFNPYNEWVLATASSDSTVGLFDVRKLTVPLHVLSSHSGEVFQVEWDPNHETVLASSGDDRRLMIWDLNRIGEEQLEIELDADDGPPELLFSHGGHKAKISDFSWNKNEPWVISSVAEDNTLQVWQLAESIYRDEDDTQTAEDHP

SEQ ID NO: 44752 - protein, 240 aa, Thermobifida fusca YX
MSRSSEPIRQAVILAGGQATRLRPYTDTRPKAMVEVAGRPIIDYQLEWLARHGVEHVVVSCGYKAEVLREHLSGRTDPEVSILVEDEPLGRGGALRFASSGLRDTESPYFALNGDILTWFPLDEFTAYHREKGGLITLALAQYRTSWGIVDVTDSGLIEGFTQSPLLPFWINAGVYIFEPEATELLPVKGDHESSTFPELAKQGRLYGYRIDGFWRGVDTVKDVKEASEQIPRLFGGAAQ

SEQ ID NO: 44753 - protein, 314 aa, Oryza sativa (indica cultivar-group)
MCIAAWAWQSQPAHRLLLLFNRDEYHSRCAPCSVPSIPTPYNSHLLTRARRDFLSRPTQPAGWWAAGKAEVKLILGGRDELGGGTWLGCTRDGKLAFLTNVREPGTLVGAKSRGELPVRFLQGNQCPLEYAEEIAKEADQYNGFNLVLADVQSGNMAYISNRPEGDPVVQKVLPGFHVLSNAAIDCPWPKMLRLGQSFNRFLATQDGAEVSLQQMVEELMMDPVKADKSAVPDTGVDPDWEYQLSSIFIDTEKGQARYGTRSMTALAVKFNGEVTFYERYLESNLWKENLMQFELEMSQWEDLRGTSNISPKSC

SEQ ID NO: 44754 - protein, 504 aa, Bixa orellana
MESTGRAPLGNGRIGNPGGLVVPEIKFTKLFINGRFVDNVSGQTFDTRDPRTGDVLATIAEADKDDLDLAVKNAREAFDHGPWPRMSGYERARIMTKFADLVEAFIEELAALDTADAGKTLSMGKAVDIPAAVQIMRYYAGAADKLHGQPLKMNQDTQGYTLKDPIGVVGHIIPWNYPTMMFFLKNAPALAAGCTMVVKPAEQTPLSALFYAHLARMAGVPDGVVNVVPGFGPTAGAAVSSHMDVDSVSFTGSQEVGRAIMRAAAQSNLKNVSLELGGKSPVIIFDDADVDMAVSLSQLACFTNKGEICVATSRVYVQEGIYDALVKKIVEAAREWRFDTKANMGPQVDKKQFERVLKYIDLGKREGATLLTGGKTNGDKGYYIQPTIFLDVREDMNIAQDELFGPVMALMKFKTVDEAIQKANCTKYGLAAGIVTKELNLANTVSRSIRAGAVWVNCYFGFDPDAPFGGYKMSGFGKDRGVLAIDQYLKAKTVNTAIPNSPWY

SEQ ID NO: 44755 - protein, 314 aa, Oryza sativa (indica cultivar-group)
MGLPGFMDPMRSSAYYDFLKDPDLAHPFGEAATQGDFSQPSEDFPYAHGQFPLFSTQPPTTVAVNGGRTAATRSRVRQRVQANPAGQDDGRGRMYYTRDEDLRLVSAWLENSTDVIEGNSRKGDTYWKQVAATYNSTTEEERKRDPKHLKGHWHKNTKKVSAFNGVYVQLRDNYQSGRSEEMLIEQALTMYESRVGQPFALMYWWKAVCDSPKWNAHVTLLGHGTTKIRAEFDVNAPPVEEQPAQVRPMSIKRAKMGKQTDYSEEVKELIKSLCKSHAKQEDETAEMKEFQQKLLKKDLMEHIWTYHRGSTSGS

SEQ ID NO: 44756 - protein, 417 aa, Oryza sativa (japonica cultivar-group)
MAGRKENPVLTACQAPSGRITRAQAAANRGRFGFAPSVSLPARTERKQTAKGKTKRGALDEITSASTATSAPQPKRRTVLKDVTNIGCANSSKNAPPRASCSDKVIPLFQQKSKPTQRVKQIPSKKQCAKKVPKLPPPAVAGTSFVIDSKSSEETQKVELLAKAEEPTNLFENEGLLSLQNIERNRDSNCHEAFFEARNAMDKHELADSKPGDSSGLGFIDIDNDNGNPQMCASYASEIYTNLMASEVSEEYKLVPDTLYLTINLIDRFLSQHYIERQKLQLLGITSMLIASKYEEICAPRVEEFCFITDNTYTKAEVLKMEGLVLNDMGFHLSVPTTKTFLRRFLRAAQASRNNHTLEHYTSYKSSDIQICVCALRELQHNTSNCPLNAIREKYRQQKFECVANLTSPELGQSLFS

SEQ ID NO: 44757 - protein, 414 aa, Rhizobium sp. NGR234
MQFTLPEEGAMHYDCLIVGSGHGGAQAATSLRQNGFQGSIGILSEDRDPPYERPPLSKDYLLGGKTFDRILIRPAEFWTSRSIDLLLGHEVVKVHAKEKQVLCADGATYSYGYLIWSAGGRPRRMSCPGHDLQGIHAVRTRSDVDRLVKDLASAEGVVVVGGGYIGLEAAAALTKLGKTVTVVEAMNRVLARVAAEPLSRFYEREHRDHGVEIRLETGVDKFVGSEGRLTGVLLKDGVTLPADIAIVGIGIVPCVEPLIEAGASGENGLDVDEHCRTSLPDVFAVGDCARVKSAHGLRIESVQNAHDQATAVAKTLCGELTPYSATPWFWSNQYDLRLQTVGLSAGFDRTVVRGDPNTRSFSIVYLREGAVIALDCINSVRDYVEGRMLVERRARVSPDVLANNSIRLKSLALA

SEQ ID NO: 44758 - protein, 604 aa, Triticum aestivum
  misc_feature (307)..(307): Xaa can be any naturally occurring amino acid
  misc_feature (486)..(486): Xaa can be any naturally occurring amino acid
MGGFEDDEPPSKRARASSVESANLPESFCYSKSINPLGGTMARPLASQGKEVMVGSKGVIKRDEFVRIITKALYTLGYEKSGAVLEEESGITLHSPSVNLFRKQVLDGNWDNAVATLNKLGLLDENIVKSAAFLLLEQKFFDLLRNDNLMGAIKTLQNEISPLGVNRKRVHEMSSCIISSPQNFLLAFPKLGTEASDSRLKLLEELQKVLPPAVMVPERRLENIVEQALTVQREACYLHNSIDGLSLYVDHHCGRDQIPSRTLQVLCAHGDEVWFLQFSNNGKYLASSSNDKSAIIWKVDPPGCPRXEDGELLLKHRLTGHEKPVMMVAWSPDDSQLLTCGMEEAIRRWNIESGECIHVYEKPGLGLTSCGWFPDGKQILCGLSDQSLCLWDLDGKEADCWKGQRSSKTSDFAVTKDGKFIIIMNRDSTILLFNRDTKQERLIEEDNTITSFSLSDDGDFLLVNLISEKIHLWNIRNDPSRVKQYXGHKRSRFVIRSCFGGSDQAFIASGSEDAKVYIWHRATEDVIETLSGHSGAVNCVSWNPTNPHMLASASDDHTIRIWGLKKATVKRRDAGSSSGSNGIHMNGSANGNGFVHQCNGSRSK

SEQ ID NO: 44759 - protein, 293 aa, Listeria monocytogenes str. 4b F2365
MDLGKVITAMVTPIHPEKDKVCKKRIHHLVNHLIKNGSDGLVIAGTTGESPTLSHDEKIKLFRQVIETNDGRAKLIAGTGSNNTAETIAFTKEVAELGGIDAVLIVAPYYNKPNQDGLYAHFAAVSEASDLPVVIYNIPGRSVVNIEPETIIRLAKLPNIVGVKESSGNLDNISKIIAETSDDFQVYSGDDSLTLPILAVGGNGVISVASHVVGNEMQEMIQAFERGEVQKAAQIHRELLPLMNGLFSVPNPAPTKYLLNQQGISVGPVRLPLVDLNAEQGTKLQAILEGLSK

SEQ ID NO: 44760 - protein, 533 aa, Oryza sativa (japonica cultivar-group)
MERMSRVAVAVLLLLCLQLQLGISGGGGGGHGARRDDQLVQECSGFCLADLCVRPAARLIHAKKSSSSSQQQQQQQRSRQAGSKAGWPSTSSTPSNPFGLPMLLPPPPPLKDWPPWLDMPPVQGPSSSPSPSPSPAPSPASSAAVAEHAAPPRRGEEHARPRSIALPPASSSGDAGETSRPEVTDGSATRRGGGGGKTNYVLVAAAGASVLLAASAAAFAACYRSEQGRAFVTGVPALRRAELEAACEDFSNVIGSLPEYTMYKGTLSSGVEIAVVSTTKTSPKDWSKKCEAHFRKKITSLSRVNHKNFVNLLGYCEEEQPFTRMMVFEYAPNGTLFEHLHARDEGHLDWPTRLRVAVGVAYCLEHMHQLAPPEIVRTLDASTVYLTDDFAAKISDVGFCEEEMAAAAAAPAMADRESVVHGYGMLLLEMMAGRLAASEGGLVQGWAAALLRGERRLRDVMDPALRGAFHAETVDRLDAVVRSCADRDPRRRPSMADVAARLREITAMPPDAATPKVSPLWWAELEIISTEAA

SEQ ID NO: 44761 - protein, 315 aa, Hordeum vulgare subsp. spontaneum
MATAGKVIKCKAAVAWEAGKPLSVEEVEVAPPQAMEVRVKILYTALCHTDVYFWEAKGQTPVFPRILGHEAGGIVESVGEGVTELVPGDHVLPVFTGECKDCAHCKSKESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGARMAGASRIIGVDLNPAKYEQAKKFGCTDFVNPKDHTKPVQEVLVEMTNGGVDRAVECTGHIDAMIAAFECVHDGWGVAVLVGVPHKEAVFKTHPMNFLNEK

SEQ ID NO: 44762 - protein, 612 aa, Gibberella zeae PH-1
MPSQKNSNGTGQVSHRLRNFFRMNTGGSTGSASSDKEKDKDKEKNSASTTPDPSKPRHTKFFSNTVGRLRAHTVASEGNQLEEAMSPTAHANPYFAHQGQPGLRHHNSDSVPPSPPDTPSLKVHGPDGTPATDQTTSETKEELARRLRRVASAPNAQGLFSKNDPNNERPATAELGKDPLLTSSGALGLIEPAKTPQNEEMPTHANPEDILAALPAPNMSMAFRRTYSSNSIKVRNVEVSPSSFDKIKLIGKGDVGKVYLVREKKSSRLYAMKILSKKEMIKRNKIKRALAEQEILATSNHPFIVTLYHSFQSEDYLYLCMEYCSGGEFFRALQTRPGKCIPEEDARFYAAEVTAALEYLHLMGFIYRDLKPENILLHQSGHIMLSDFDLSKQSDPGGKPTMIVGKNGARTDALPTIDTRSCIANFRTNSFVGTEEYIAPEVIKGSGHTSAVDWWTLGILIYEMLYGTTPFKGKNRNATFANILREDIPFPDHAGAPQISKKLLIKDENRRLGARAGASDIKAHPFFRTTQWALIRHMKPPIVPHAGRGVDTVNFRNVKESESVDLSGSRAMNLKGVPLDSGLATPGGEIADPFLEFNSVTLHHDGDDDHHR

SEQ ID NO: 44763 - protein, 520 aa, Caulobacter crescentus CB15
MTQKTDHQRVLIVDFGSQVTQLIARRVREAGVYCEIHPFDKAEAIVDEYAPSAIILSGGPASVLEADSPRIGRKLFDLGLPLLAICYGQQLLCDVLSGKVEGGHAGEFGRAELTIGKDSPMFQGLAGVGGVETVWMSHGDRVTAIPEGFEVIGTSTGAPFAAIANDAKKIYALQFHPEVYHTVNGPAMYRNFLFNIAGLKGDWTMAAFRQEMVQKIRDQVGDGKVICGLSGGVDSSVAAVLIHEAIGDQLTCVFVDTGLLRKNEADQVVTLFRDHYNIPLVHVDAGDLFLGELAGVSDPETKRKTIGRLFIDVFDKEAAKIEGATFLAQGTLYPDVVESVSARGGPSAVIKSHHNVGGLPDYMKLKLVEPLRELFKDEVRALGVELGLAPAFVGRHPFPGPGLAIRIPGEITPEKVKVLQDADAIYLEEIRNAGLYDQIWQAFAVLLPVKTVGVMGDARTYENVLALRAVTSTDGMTADFFEFPWPVLGKTATRIINEVRGVNRVVYDVTSKPPGTIEWE

SEQ ID NO: 44764 - protein, 266 aa, Escherichia coli
MTEPLTETPELSAKYAWFFDLDGTLAEIKPHPDQVVVPDNILQGLQLLATASDGALALISGRSMVELDALAKPYRFPLAGVHGAERRDINGKTHIVHLPDAIARDISVQLHTVIAQYPGAELEAKGMAFALHYRRAPQHEDALMTLAQRITQIWPQMALQQGKCVVEIKPRGTSKGEAIAAFMQEAPFIGRTPVFLGDDLTDESGFAVVNRLGGMSVKIGTGATQASWRLAGVPDVWSWLEMITTALQQKRENNRSDDYESFSRSI

SEQ ID NO: 44765 - protein, 315 aa, Hordeum vulgare subsp. spontaneum
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGARMAGASRIIGVDLNPAKYEQAKKFGCTDFVNPKDHTKPVQEMLVDMTNGGVDRAVECTGHIDAMIAAFECVHDGWGVAVLVGVPHKEAVFKTHPMNFLNEK

SEQ ID NO: 44766 - protein, 590 aa, Debaryomyces hansenii CBS767
MPTIPVDKQDLFDLLGRSYTTEEFDELCFEFGIELDEDTTEECKGDERPQFKIEVPANRYDMLCIEGIAQALNEFLGKKLSPGFKYNPSKPEISLTIHKSTEQVRPYAASAILRNVQLDERRYDSFLALQDKLHTNLCRNRTLVAIGTHDLDTLTPPFTYEALPPSEINFIPLNQEKEMDGNQLMEFYEKDKHLGKYLHIIKDSPVYPVILDANRTVCSLPPIINSNHSKISAQTRNIFIDVTGTDRTKTEIVINQLVAMFAGYCKVPFEIEPIEIKSEHNKQDRITPDISARPFEAEIPYINSCLGLDLTGQEISDLLKRMSLHAKPSSKKDLIDIGIPITRPDILHQCDIMEDAAIAYGYNNLTKTKAKGDSLVAAPLPVNKIGDILRIASAQAGYLEVLPLTLCSHDENFKFLRTKDDNTTAVKLENPKTIEYQVVRTTLVPGLLKTIKENRKHSLPIKVFEAGDIVLKNPELERGAFNQRNWSAIYAGKTSGFEFVQGLLGKIMQTMRTSWLENPKESTERGYWIEQDDENPTFFPGRGAKVFFRAGDGSKEQHIGAIGVLHPEVMANFEIPYAASSVEINAEVFL

SEQ ID NO: 44767 - protein, 315 aa, Hordeum vulgare subsp. spontaneum
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEASLDKVCVLSCGISTGLGATLNVAKPKKGSTVAIFGLGAVGLAAMEGARMAGASRIIGVDLNPAKYEQAKKFGCTDFVNPKDHTKPVQEVLVEMTNGGVDRAVECTGHIDAMIAAFECVHDGWGVAVLVGVPHKEAVFKTHPMNFLNEK

SEQ ID NO: 44768 - protein, 354 aa, Debaryomyces hansenii CBS767
MNQLTKILEPIAKAIQAGDKKVTFFEGAGISTAAGIPDFRSPDTGLYSNLAKLDLPYAEAVFDIDYFKENPKAFYTLAHELYPGKFMPTKFHYLLRLFQDKKLLKRVYTQNIDTLERVAGIEDEYIVEAHGSFARNHCIECSLEMSTEELKKQMSDKLVNDGIPICQECGGYVKPDIVFFGEALPVKFFDTWDEDADEVEIAIVAGTSLTVYPFASLPSETTKKSLRLLINNEVVGDFKHGKRKTDILAISDCDEAAVTLAELLGWSEELDELINKNKTLFESTYSIGEKTNDEEVSKKSLSKASERLAEEIRDVEAEKGTQKPEKTDKQTESKEEKSKNDTDDLEKDISNLKI

SEQ ID NO: 44769 - protein, 322 aa, Pseudomonas putida GB-1
MQPQTFYRAVADDFSAVDEIIKKQLTSRVPLVSKIGDYITSAGGKRLRPLLVLLCGKALGREGDDLRLLAATIEFLHTATLLHDDVVDMSGMRRGRSTANALWGNAPSVLVGDFLYSRSFEMMVELGSMPVMQILSKATRVIAEGEVLQLSRVRDASTTEEVYMEVIRGKTAMLFEASTHSAAALAEATDEQREALRTFGDHLGVAFQLVDDLLDYKGDSQTLGKNVGDDLAEGKPTLPLIYTMREGTAEQAALVRQAIQKGGLEDLEQIRVAVEESGALKYTAELARDYVKRAIACLEVLPASEYRDALVELSEFAVARTH

SEQ ID NO: 44770 - protein, 149 aa, Geobacter metallireducens GS-15
MLKVRDIMTTDVVSVKRETTIRELAEIFTKHRVGSVPVVDESGNLIGIVTESDLIEQDKSLHIPTVISLFDWVIYLESEKKFEKELQKMTGQTVGDLYTDTAEMVTPDTPVSEVADIMSSKKLHALPVVEGKRLVGMVSRIDLIRTMVK

SEQ ID NO: 44771 - protein, 338 aa, Oryza sativa (indica cultivar-group)
MHVFSSREEEHGSNDDSFRESLVSLLDNTRDYVMAPEVFEGVPVACDYLKGMDSDGMAASAVAAYSLDNNGQHAGVSSIEHGIASSPLLAYQLGKNSAVVQRSIQQQEVGSPMAAFLQQLIPTSVLDQSGIGFGGVCLDGSGLEASFCMRTSPDVSSFSGHRSATAEELMSTDTREQEITRLARSCSSSGSDRNKKKLSENSGLTLQIVLRSWHLKNLFRNHTQHQSPKVKLGEKITALQQIVSPFGKTDTASVLLETITYIKFLHEQIQLFSQPYMTNSTNKGHIHWGGEGKRKAGLEHDLRGRGLCLVPVSWTSQEYCDSILPECWAPAYRNYFYR

SEQ ID NO: 44772 - protein, 126 aa, Enterococcus faecalis V583
MTNKMINSAQAPATVGPYSHSVLAGNTLYISGQLGLDPQSGEMKTTVEEQAKQAFINLGSILKEVEMTYDNVVKTTVFLQHMSDFSKINEIYGNYFSEVLPARSCVEVAKLPKDGLFEIEAVAVKG

SEQ ID NO: 44773 - protein, 573 aa, Symbiobacterium thermophilum IAM 14863
MRVASVSEKVLNGVAAAAGVVIGPAFVYREGQPETAARAAAAPEEELARFEEARRRAENELNALAERADDQGREILTAHQLMLQDPELQNLVEAAIRDGQPAEEAVRTATEQFAAMLEALDDEYLRERAADVRDVGRRLVAALTGRTVGVVLQRPSVVVARDLAPTDTIGIDRSLLLGIVTEQGGPTSHTTILARSWGIPAVVATAGVLEAASDGMTVALDGDAGEVVLDPGAETRSRYEAAMARAREQAERDRAEASLPAETPDGVRVELAGNAGSPGEVAFAMEKGAEGIGLLRSEFLFMGRSTAPTEEEQYQAYAEALRNARGQRVIIRTLDIGGDKDVPYLGLAKEENPFLGVRALRLCFRRPELFQTQLRALLRASVHGRLAIMFPMVSGLSDLRRAKEALAEARRSLEAEGHPVADRYEVGIMVEIPSAALLADHLAREVDFFSIGTNDLVQYTLAVDRGNPELTEMYQPYHPAVLRLIDRIVQAAHAAGKWVGVCGEMGGLPEGALLLLGLGVDELSMAPALLPRIKRLVRSTPAAEARAVARECLELGTPEEVLALVGPLVRRVG

SEQ ID NO: 44774 - protein, 243 aa, Triticum aestivum
MRVAATRPASSAPVALLAALALLFLVGSASLAIGAMASHVLGGKSENPAAANSLETDGLARFAVDEHNKRENALLEFVRVVEAKEQTVAGTVHHLTLEALEAGRKKLYEAKVWVKPWLDFKELQEFRHTGDATSFTISDLGAKRGGHEPGWRDVPVHDPVVKDAASHAVKSIQQRSNSLLPYELVEIVRAKAEVVEDFAKFDILMKLKRGTKEEKMKAEVHKNLEGAFVLNQMQPEHDESSSQ

SEQ ID NO: 44775 - protein, 515 aa, Thermobifida fusca YX
MLNLSVLLEDGARNRPERDAIVFGDMRLNYALVNMIANQVANLLVSRGIRPGDKVALACPNVPYFPFVYFGALKAGAVVVPLNVLLTPREIEYHLRDSGAKALFAFTGTPELPLGERAWQAFQEVAECELYIDLPAAAGATTSAIPGAETFWAALNGQPGEFESVRTEGDDVAVIIYTSGTTGQPKGAQLTHTNLLFNAVASSALFDQAPDSHDVFLTVLPLFHIFGQTTMMNAALYRHGTMVLMPRFDGDEALSLMEKEKVTIFAGVPTMYWGLLNAQGDHDIKQISQTLHTAVSGGASLPAEVARKVKEKFGIEILEGYGLSETSPVVSFNNPKRKAKPGSIGLPIWGVEMKLVDENFNTIEGEGPGEIAVRGHCVMKGYHNRPEANAQVMRDGWFRTGDIARRDEEGFYFIIDRSKDMIIRGGYNVYPREIEEVLMTHPQVSLAAVVGVPHDTHGEEIKAFVIPAEGATLTEDELIAWAKERLAAYKYPRIVEFRTELPMTATGKILKRELR

SEQ ID NO: 44776 - protein, 261 aa, Arabidopsis thaliana
MGNHQADKKFAWVIKNFNSLDTTRVYSDTFKAGRCKWRLVAYPKRRDRYTTSFSLFLCVPDSESLPSGWRRRAKLIGYNKKAVYWFDEKDTTHGFESMFLLSEIQSSDKGFLVNGEVKIVAEVDVLEVIGELDVPEEPERIDINGFQVPASQVESMNSLFEKYRGFASKIFPKNQHLRKTFLDVVLSMTEILCKFPEELSSGDLAEAYSALRFVTKAGFKLDWLEKKLKETGKSRLQEIEEDLKDLKVKCADMDALLDFLR

SEQ ID NO: 44777 - protein, 223 aa, Zea mays
MLILVCDIVEPSTGELYARDPRSTAKRAEAYLKTTGIGDTVYIGPEAEFFMFDNVQFENSYSTSYYKIDDIELPTNTGTSYEGGNLGHRPRAKGGYFPVAPVDSAVDIRGEMVSTMLEMGLPCDKHHHEVAAAQHELGLTFGTMTLTADRMQIYKYVCHNVAQAYGKTVTFMPKPIKEDNGSGMHTHLSIWDKGQPLFAGNGYAGLSDTCLYFIGGIIKHAKA

SEQ ID NO: 44778 - protein, 372 aa, Serratia marcescens
MKSRAAVAFGPGKPLEIVEIDVAPPQKGEVLVKITHTGVCHTDAFTLSGDDPEGVFPAVLGHEGGGIVVEVGEGVTSLKPGDHVIPLYTAECGECKFCKSGKTNLCQAVRATQGKGLMPDGTTRFSYNGEPIYHYMGTSTFSEYTVCAEISLAKVNPQAPLDKVCLLGCGVTTGIGAVHNTAKVKEGDSVAVFGLGGIGLAVIQGAAQAKAGRIIAVDTNPEKFKLAGEMGATDFVNPNDYDKPIQDVIVELTDGGVDFSFECIGNVNVMRAALECCHKGWGESVIIGVAGAGQEIRTRPFQLVTGRVWRGSAFGGVKGRSQLPGMVEDAMAGKIRLDPFITHRLPLEKINEAFDLMHEGKSIRTVIHFGDK

SEQ ID NO: 44779 - protein, 200 aa, Zea mays
  misc_feature (194)..(194): Xaa can be any naturally occurring amino acid
NDIILSALQSSGKVAALASEENDLPIWISDGGPYVVVTDPLDGSRNIEVSIPTGTIFGIYNRLVEVDHLPLEERAQLNSLQSGTRLVAAGYVLYSSATILCISFGAEVFTFAQKLQLRIIAGQIYSVNDARYFDWPEGLRKYIDTIRQGKGQHPKKYSARYVCSLVADFHRTLIYGGVAMNPRDHLRLVYEANXPLSFLA

SEQ ID NO: 44780 - protein, 135 aa, Triticum aestivum
MASTTFRRFSVAAAAAAFIALAAFGSASASKTAFVKSTVKAHDVVIFSKSYCPYCKRAKAVFKELELKKDPYVVELDQREDGGEIQDALSDMVGRRTVPQVFIRGKHLGGSDDTVDAYENGELAKLLNISVKDDL

SEQ ID NO: 44781 - protein, 895 aa, Oryza sativa (japonica cultivar-group)
MVKPGLSSYAGKPQEAANSIAPLLEKAKGVVPKQLQKRTPLKLGATAGLRLIGDEKSEQILEAVRDLVHSKSNFQYKPEWISVLGGSQEGSNLWVALNYLLGKLGGDYSKTVGVIDLGGGSVQMAYAISSDAAENSPPVPVGKDPYVTKEYLKGKDYNLYVHSYLHYGLQASRVEILKTKNGQFSSCMLRGFNGTYKYNGEEYDAAASPEGADHGKCGEEAAAALGLDAPCESRNCSFNGVWNGGGGAGMADLYVASYFYDRAVHGGFVVDDAPSAVTTPAAFAEAASKACSLSSGEAAAAYPEAFDVQFICMDLTYQYTLLTKGFGQVWGLLRGVGVAAGYCHRSLVLPEESSVCMIHLAISRKDAYIYSLNLRAFHFIANFNLVNFEVTEFCAHIAASLRRHGVGGGGSSGGGGGGGGDGARAYTNTKLSATTEEAEAEAAEVRSPPAQGVESAVEATDRGEAPPEQPVAADSGASSAETPPSLLEQVTETPPPSPSSSSAAAAAAEAQVGGDHGGESCDVYKGRWVYDEGNAPLYKGSAWGVPYRAGYLHGERPPAKTTTRNGGGSPKGATSPVYACLSYNSNRFDAKLLLEKLRNKRLMFVGDSLNRNQWESMVCLVQSEAPWEKKSLVKNDSLNVFRLEEYNATIEFYWSPFLVESNSDDPNMHSIVDRIIKPTSIAKHAANWEGVDYLIFNTYIWWMNTPEMKILHGGSFSKKPVKYDEMERVAAYRKVLKTWSRWVEKHVDPKRSTVFFMSVSPVHMQSEGWGKPDAIKCFSETQPAINYTKKLEVGTDWDLFSTAHHVTKAMKRVPVHFINITALSEIRKDAHTSVNTLRQGKLLTKEQKANPRKFADCIHWCLPGLPDTWNEFIYGHIVSSPQRRPVEPIENQPQR

SEQ ID NO: 44782 - protein, 486 aa, Bifidobacterium longum DJO10A
MDLFRKKSVDQLVAESTPLKRTMRTFDLTMLGIGAIIGTGIFVLTGKGALTAGPALSVSFLLAAVCCGFAGLCYAEFAAMAPVSGSAYSYAYLAFGELIAFVIGWDLILEYALQAATVSAGWSGYFNKLLEGFGLHLPVELTAAYGTNPDVTTYFNLPGFVIVLIITWVLSIGINQTKRTNDVMVLIKLAIIVLFIVCAVWYVKPSNWQPFSPYGVYTFQPGSTQPYGIVPAASIVFFSFIGFDAVSSSAEETINPNKTLPRGILLSLAVSTVLYVIMTLIMTGVVPYKEFAKYIDAPVAGVILETGMNWLAVIVNLGALIGMTTVMLVQLYGQSRICYAMSRDGLFPKFFGHVHEKYRTPFKGTWFFGLLTAFAGGFININVLFELVNIGTLSAFIIVSAGILWMRKTQPNAPRGFRAPGVPVTPILAIVFCFVLIAGLNWETWVRFAVWFGLGLIVYFGYSRKRSKLGLEQKAGADAKVAATED

SEQ ID NO: 44783 - protein, 524 aa, Parvularcula bermudensis HTCC2503
MTDALDPSRHHDRLLVIDFGSQVTQLIARRLREDGIYCEIHPFNRVDAAFLEEFSPKGIILSGGPSSVRTATAPRPIEAIYAYGVPILGICYGEQCLVAQLGGEVERATHREFGRADVTVVSSSPLFQGVWTEGGTYPVWMSHGDRVIALPDGFHPIATTPSAPFAVIADELRNYYGVQFHPEVVHTLDGARLLSNFTRQICGLSGDWTMASFREEMTAKIKDQVGDGRVICGLSGGVDSAVAAVLIHEAIGDQLTCVFVDTGLMRQGEARAVVDLFREHYHIPLVHVEAEDLFLSKLEGVEDPERKRKIIGGTFIDVFEAEAKKIKGDFLAQGTLYPDVIESVSFDGGPSVTIKSHHNVGGLPERMNLKLVEPLRELFKDEVRHLGQELGLPEGFVKRHPFPGPGLAIRIPGAVTREKADLLRQADAIYLEEIRAEGLYDAIWQAFAVLLPVKTVGVMGDERSYDWVLALRAVTSTDGMTAESYPFEHRFLSRVATRLINEVDGINRVTYDVTSKPPGTIEWE

SEQ ID NO: 44784 - protein, 514 aa, Geobacter metallireducens GS-15
MKVVTGETMQRMDRRSIEEFGIPGIDLMENAGQGCAAAIIERFGPAAGRMVLVVAGKGNNGGDGYVIARLLQQEGWEVQTVVLALREEIAGDAKVNLDRLDPETVMFSPPPAGLAPFAPHLERASVIVDALFGTGLKSEVQGSFAEAINLLNAAGKPVVAVDIPSGIDAGTGRTLGVAVKADVTVTFALAKLGHVLYPGAELCGDLRVVDIGIPLQVAADAEGYDFVDHGTACRLVRPRDRRAHKGSFGHCLVVAGSTGKTGAAAMAANSAVRAGSGLVTLAVPERLNAILEMKTTEAMTLPLPDGGAGRLVQDSAPALLEAIGGKSAVALGPGISWHLDTARLIRHLVTKIETPLVIDADGLNALSEDPAILQRKRSNCIVLTPHPGEMARLTGTSTAIIEADRIAAAREFAEQNGVYMILKGARTVIAAPDGRVAINGSGNPGMASGGMGDVLTGILASLLGQGYEPFDACRLGVFIHGHAADLVAADKGEIGMSAVDVQERLPWAFKTLTL

SEQ ID NO: 44785 - protein, 407 aa, Parvularcula bermudensis HTCC2503
MPSDIQGALSRLSPLLDYEQHLQSIVGLLQSPTELIQRQLIIEREDGRSDALDAWRCRYNDFLGPTKGGLRFSPGVNADEVQRLAFLMTLKCALVGLPFGGAKGGVKVDISQCNDRERARIAHEFGRRFSDILGPERDIAAPDVGTGAPEMAAIARGYDRMGAGRGVVTGKPLDLGGIDLRFGATGKGAAIVVQSMRETLGLAEGKSARIAIQGFGGAGQAFARAMAENGDDLVAFADSTGTVSDPDGLNVEDMIEAKGQGNLSYTEESEAIFDKECDILCLAALGDAINRDRADRVGAKAVIEISNAGVAPEADASLRAKGVKICPDILVNAGGVIASYHEWVAYRTGNAQAIGDAEAQWRKSLISAASAVTEKCSVTDGDLRQAALLCALSRLDGAARHQGVYHR

SEQ ID NO: 44786 - protein, 131 aa, Brassica napus
MDQNPYRRKPSPISTTTTGGSNPLPTSELLPMKFLSFGTLKLTRTFTTCLILFSVLLAFSMIFHHHPSDPNRVMGFAEARVLDGRDYSNVTATNDSNDSDRLLGGLLATGFDEATCLSRYQSSLYRKPSSY

SEQ ID NO: 44787 - protein, 188 aa, Shigella flexneri 2a str. 301
MYERYAGLIFDMDGTILDTAPTHRKAWREVLGHYGLQYDIQAMIALNGSPTWRIAQAIIELNQADLDPHALAREKTEAVRSMLLDSVEPLPLVEVVKSWHGRRPMAVGTGSESAIAEALLAHLGLRRYFDAVVAADHVKHHKPAPDTFLLCAQRMGVQPTQCVVFEDADFGIQAARAAGMDAVDVRLL

SEQ ID NO: 44788 - protein, 531 aa, Symbiobacterium thermophilum IAM 14863
MTNTINELQDMGPGDAIFAIGTNTTECHPIIGIRMLEAHRRGARLIVADPRETELAKHADVYMRHNPGSDVALLNAMMYVIVTEGLADEAFIRSRTENFEACRETVLKYAPEKVEGITGVPAEKVRQAARLFATAENAATYYTMGITQHTSGVDNVLSIANLALMTGNLGKPKAGVNPLRGQNNVQGACDMGALPNVYPAYQPVTDPKNREKFEKAWGRPLSDRMGMAISDVLRGIEEGKVRFLYVMGENPMRSDPDVNHVRHCLEHVDFLVVQDIFLTESAALADVVLPGATWAEKDGTFTNTERRVQRVRKAMEPQGNARPDWMILRDIMRAMDYPADYNSPKDIFNELRTLAPSYAGVTYERLEKLGGLHWPCPNEEHPGTPILHVGKFSRGLGKFSAIEWRPPAELPDEEYPLVLTTGRRTAHYHTGTMTRNCWGLDGVAPEEWVEINPADAASLGVAHGDYVRVTTRRGSVVVRAEVTARVPKGVTFITFHYTEAAGNLLTNSALDPVSKTPEYKVCAVRVEKVSA

SEQ ID NO: 44789 - protein, 287 aa, Hordeum vulgare subsp. vulgare
RHNPLENAPDDPDALVLLPGLPHRVELRRSQMMDPAKMAWQWEYFKGVNAADQRGFGEVFNSFHDLEPDYVEHFQKTLGRRVWLVGPVALASKDMAVRGTDAPSPDADSCLRWLDAKPAGSVVYVSFGTLTKFAPAELHQLARALDLSGVNFVWVIGAAAGQDSAEWMPEAFAELIARGDRGFMVRGWAPQMLILSHAALGGFVTHCGWNSVLEAVSAGVPMVTWPRYADQFNNEKLVVELLKVGVSIGAKDYASGVEAHEVIAGEVIAESIQRLMESDHSHDAMES

SEQ ID NO: 44790 - protein, 324 aa, Pseudomonas stutzeri
MSQSSQLIATAQRTIRLEIEAVEQLNARIDASFVQACELILACKGRVVVVGMGKSGHIGRKIAATLASTGTAAFFVHPAEASHGDMGMITPDDVVLALSNSGTTSEIVTLLPLIKRLGITLISMTGSPSSVLAKAAAVNLDASVAIEACPLNLAPTSSTTASLVLGDALAIALLEARGFTAEDFAFSHPGGALGRRLLLKVEHVMHTGERLPRVPRGTSLRDALLEMTQKGLGMTVIVETDGRLAGIFTDGDLRRALDKGVDVRQTLIDEVMTVHGKTANAEMLAAEALKIMEDHKISSLVVIDEQELPIGALNMHDLLRAGVM

SEQ ID NO: 44791 - protein, 542 aa, Bartonella quintana str. Toulouse
MTIMTVLTTAFNDQKPGTSGLRKKVSVFQQPHYVENFIQSLFNNIGPLEGKLLILGGDGRYFNHTLLQVVLKMAAAHGVACVKVGKGGLLSTPAVSHLIRKYHAHGGIILSASHNPGGLEGDCGIKYNISNGGPAPASLCDAVFATSQHLSFYKIVEAPDIDLSTQGTTFVGAMQVDVIDPVADYVALMQEIFDFDCIAKAVAEGLTLRFDAMHAVTGPYAHEIFEKCLGFSEGTVVNGVPLPDFGGKPPDPNLVHAKDLYDLLMSDQGPDLGAASDGDGDRNLIIGRKQFVTSSDSLAIMADHAHLIKGYRQGIVGIARSMPTGRAADLVAEKKALNFFETPTGWKFFGSLLDAGKVTFCGEESFGTGSHHIREKDGLWAVLFWLNLLAVTGKTVAQITQQHWHTYGRFYTLRYDYEAVEACKARMVMDALCARLPKAGMEIVGLQVEKADDFTYHDPIDQSISTGQGVRIFFKNGARLVVRLSGTGTVGSTLRLYFEQYEADPCKHNQDPQKILQPLQKAALELLKIQQKLGCKQPDVIT

SEQ ID NO: 44792 - protein, 406 aa, Zea mays
MSRDRYFHRLLDLHLHANDDLFFPFPTPASSCPYITASSAHHRFLLDDHPFYPTSCPLGITSRSPIDDTFDLDLLLPLPLHAAVSAPPCAAFDFDPFLLDTLGHRISVLERALALAPPRRKYTYAAEANGRKLKWTAEDRPAGGRNLKWEAELRTPHTDGFDRKWKWESKESATGSTKVKWAKEIKGKGCLEPWSNSYSVEETYGEDDHADDDREKKKPTGVQKKVKGENKQQQKKQGNVEIVEIEDNTAGCVAIRKAFEMNHCKGKRKELSPQDAALLIQMNYRAHLAHRSQVLRCLRDLAVAKAKLKEIRSFFYNITYRRRIAYDNEERQRFAEKIIVLLLTVDALEGPDYMVRNARRSMLEELEGMLEIVEPQPPGKPRTLSRRRFDLPEGGAIEKETREEGK

SEQ ID NO: 44793 - protein, 399 aa, Escherichia coli B
MMTLNRYRLRHMAKQGNRSAKRVEKLLRKPDRLISLVLIGNNLVNILASALGTIVGMRLYGDAGVAIATGVLTFVVLVFAEVLPKTIAALYPEKVAYPSSFLLAPLQILMMPLVWLLNAITRMLMRMMGIKTDIVVSGSLSKEELRTIVHESRSQISRRNQDMLLSVLDLEKMTVDDIMVPRSEIIGIDINDDWKSILRQLSHSPHGRIVLYRDSLDDAISMLRVREAWRLMSEKKEFTKETMLRAADEIYFVPEGTPLSTQLVKFQRNKKKVGLVVNEYGDIQGLVTVEDILEEIVGDFTTSMSPTLAEEVTPQNDGSVIIDGTANVREINKAFNWHLPEDDARTVNGVILEALEEIPVAGTRVRIGEYDIDILDVQDNMIKQVKVFPVKPLRESVAE

SEQ ID NO: 44794 - protein, 142 aa, Oryza sativa (indica cultivar-group)
MASLVAVQPVAVKGLAGSSISGRKLAVRPSPRALCRTTRRPRAAVVAKYGEKSVYFDLEDIGNTTGQWDLYASDAPSPYNPLQSKFFETFAGPFTKRGLLLKFLLLGGGSLVAYVSASASPDLLPIKKGPHVPPTPGPRGKI

SEQ ID NO: 44795 - protein, 439 aa, Nostoc sp. PCC 7120
MVDAHEKKAPHQVVIIGGGFGGLYTAKTLATANVSVTLIDKRNFHLFQPLLYQVATGTLSPGDISSPLRAVFSKSKNTQVLLGEVKDINPKAQQVILDDKVVPYDTLIVATGANHSYFGKDHWKDVAPGLKTVEDAIEMRRRIFGAFEAAESETDPEKRRAWLTFVIVGGGPTGVELAGAIAELAYKTLKEDFRSIDTSETKILLLQGGDRILPHIAPELSQVAAESLQKLGAIIQTKTRVTNIENDIVTFKKGDEVKEIPSKTILWAAGVKASPMGQVLAERTGVECDHAGRVIVEPDLTIRDYKNIFVVGDLGNFSHQNGKPLPGVAPVATQQGEYVAKLIKKRLKGQTLPQFRYNDVGSLAMIGQNLAVVDLGLIKLQGFIAWVFWLLIHIYFLIEFDTKLLVVFQWAWNYITRNRRSRLITGREAFVEPKTVNQQ

SEQ ID NO: 44796 - protein, 453 aa, Pseudomonas stutzeri
MSILNDYKRKTEGSVFWAQRARSVMPDGVTADTRVFDPHGLFISDAQGVHKTDVDGNVYLDFFGGHGALVLGHGHPRVNAAIAEALSHGVQYAASHPLEVRWAERIVAAFPSIRKLRFTGSGTETTLLALRVARAFTGRRMILRIATHYHGWHDFSASGYNSHFDGQPAPGVLPEIAKNTLLIRPDDIEGMREVFAQHGSDIAAFIAEPVGSHFGVTPVSDSFLREGAELARQYGALFILDEVISGFRVGNHGMQALLDVQPDLTCLAKASAGGLPGGILGGREDVMGVLSRGSDRKVLHQGTFTGNPITAAAAIAAIDTILEDDVCAKINDLGQFAREAMNHLFARKGLNWLAYGRFSGFHLMPGLPPNTTDTGSITRAEVARPDVKMIAAMRMALILEGVDIGGRGSVFLSAQHEREHVEHLVTTFDRVLDRLADENLLSWQPTNLSGNQS

SEQ ID NO: 44797 - protein, 867 aa, Parvularcula bermudensis HTCC2503
MTSDNLLSPDMPVDLTNCDREPIHQLGHIQSFGFLFCLSSDWSILKVSENVNQFLPLQVSDLVGEHASRVLTPDALHDLRSQLQMLSHEDSVERVFHLQPFSCTDYLYDVALHMSGRSIILEFERSETSQHRDYTPTVRSMIGRVQQSSTLADLSKMASRHVRALTGFDRVMVYRFAPDGSGEVVAESKNADLDPYLNLRYPASDIPQQARALYVRNPVRIISDVHSVPVKIVPATDENEAPLDLSLSTLRSVSPIHIEYLRNMGVAASMSLSITYQGKLWGLIACHHYRPMVLSFEKRTACELFAQMLSFLVSDFESRAALDATTRSRTVHDRIMAMIAEGEGLADNFDILIDQMAAIIQFDGAALAIDDHIVRSGTTPSVQDIQGLLRFLNTTHGSEVYAADSLSRYYPQAQSFASHAAGLLALPVSRRPRDYLLLFRRELRRTVTWAGDPRKSATVPGPNGPRLTPRKSFEAWQEELSFHSAPWTEGEIAAADSLRVTLLEVVLRMTAAASEAQAAHKAQQDILIAELNHRVRNILNLIRGVITQSNVNLATAEQLSNVLEGRIDALARAHDQITDHNWGPQSVHNLINIETEAYGTDQLDRVKLTGTDAYLVPSAATTLSLVVHELTTNAVKYGALSVENGSIEIQLTEDESDLVITWRESGGPTILAPSRKGFGSTLIEKSIPYDLGGDASVSFPPEGLRGKFRIPGRFIDRFWEATQAELSVPKRAKAAAQEETLTLPPLASALIVEDNLIIALDTEEMLSALGVKTIDLASNMATADRLISKKKFSIVCLDINLGGEESFPLAERLSKTNTPHIFTTGFGAAGLPDQYETNAPILKKPYRLEDLKHAIARACSETLGQYR

SEQ ID NO: 44798 - protein, 104 aa, Zea mays
  misc_feature (91)..(91): Xaa can be any naturally occurring amino acid
MSGRGKGGKGLGKGGAKRHRKVLRDNIQGITKPAIRRLARRGGVKRISGLIYEETRGVLKIFLENVIRDAVTYTEHARRKTVTAMDVVYAXLKRQGRTLYGFGG

SEQ ID NO: 44799 - protein, 343 aa, Fulvimarina pelagi HTCC2506
MASRRQPDTFLKFPILIGDIGGTNARFAILKDAFADPKFFEIAETEKFETIDEAIQTNVLDRTSVQPESAVLAIAGPIGGDEIDLTNCHWVIHPRRMIADLGVEEVVVINDFEAQALAISALGEDAREEIGRGIHREGASRAVLGPGTGLGVAGLVRARNMWIPVAGEGGHIDLGARTERDRTIWPHLKTIEGRVSGEQILCGRGLVNLYQAICKADGIEPVHTRPADVTQAVEAGNDAQAREAVDLFSIYLGRVAGDIALIFIARGGVYIAGGIFKRIMKLVDQAKIRKAFEDKAPHSELMREIPLYVITEPQPALAGLAAFARSPRFFGLETTGRHWSIAK

SEQ ID NO: 44800 - protein, 130 aa, Methanosarcina barkeri str. Fusaro
MVLLDPLANALSTIKNAEAIGKSSCIIRPASKNIGNVLKVMQDLGYIGEFEFIDDGKAGIYSVTLVGRVNKCGAIKPRYSVGTGSFERWEKQFLPAKNFGALIITTSSGVMSQYEAREKKIGGQLLAYVY

SEQ ID NO: 44801 - protein, 389 aa, Triticum aestivum
MIPAVKLSPAAFSVTNQRSKSAFVPSVSILNMKKFASCSLRPLYLTWLDDPHTSELKPRRQLLDFRCAASAADDKESKAEVLPASSEAAQKLKISIYFATWWALNVIFNIYNKKVLNAFPYPWLTSTLSLACGSAMMLFSWVTCLVEAPTPKTDLDFWKALFPVAVAHTIGHVATTVSMSKVTVSFTHIIKSAEPAFSVLVSRFILGESFPMPVYLSLLPIIGGCGLAAATELNFNMIGFMGAMISNLAFVFRNIFSKRGMKGKSVSGMNYYACLSIMSLIILAPFAIAMEGPQMWAAGWQKALADVGPNVLWWIGAQSVFYHLYNQVSYMSLDQISPLTFSIGNTMKRISVIVSSIIIFRTPARAAAQSLVRPPAGRPYGRAPNALDA

SEQ ID NO: 44802 - protein, 360 aa, Medicago truncatula
MSSIIKFSRFFSAVMTVIIISPSLHSSHYPALAIRSSIIHHIPHHDYRFYFHTSPFFRNADQCEPISREIGACHPSLVHVAITLDVEYLRGSIAAVHSILYHASCPENVFFHFLVTDTDLETLVRTTFPQLRFKVYYFDRNIVKNLISTSVRQALEQPLNYARNYLADLLESCVKRVIYLDSDLVLQDDIAKLWNTDLGLNTIGAPQYCHANFTKYFTAAFWSDPVFSTTFEKRKACYFNTGVMVMDLVKWRKKGYTERIERWMEIQKVERIYELGSLPPFLLVFAGHVAAIEHRWNQHGLGGDNVKGSCRDLHPGPVSLLHWSGSGKPWRRLDESKPCPLDALWEPFDLYGHRRRYESL

SEQ ID NO: 44803 - protein, 226 aa, Xanthomonas oryzae pv. oryzae KACC10331
MTQIAALPFRPQAVIFDMDGLMLDSERAITACLVQAADEQGLQIEPAFWLRMVGTGDVACRLLLGERIGDASAEAMLAHAQRLYAAAVERGIPHRPGIIALLEYLAAQGMPRAVATSTQRPLALRKLEAADLLWRFDAVCTASDVVHPKPAPDIYLLAARALAVDPTLCLVLEDSPIGVRAALAAGMTPIQIPDLLEPDAAVRALGHRILPSLGDAQRLLEACLSG

SEQ ID NO: 44804 - protein, 545 aa, Candida albicans SC5314
MVEDKDIDLNINNLKIHDAPTRTPPVSSPPALPTPPTPSGISLNTTMQAKLMAFQQQRSKAAAAAAAAASVSSSSSGTQASSSSISASTSESSVSTIPANINRTVSGKKKPKPNLKLSDLPLSRNNSLHRSNTSASDSSVTTPEADTPTGKISNEPQPQGLFANYSDYVDIKSGQLNFAGKASLHSKGIDFSSGSSFRVSLDEFEYLEELGRGNYGSVSKVLHKPTGVLMAMKEVRLELDENKFTQILMELDILHKCDSPYIVDFYGAFFVEGAVYMCIEYMDGGSLDRIFGNDVGVKDEYELAYITESVILGLKELKDKHNIIHRDVKPTNILVNTQGKVKLCDFGVSGNLVASLAKTNIGCQSYMAPERINTMRPDDATYSVQSDVWSLGLTILELAVGHYPYPAETYDNIFSQLSAIVDGEPPKLYPKVYSKEAQIFVKSCLAKNPDLRPSYAALLNNPWLIKNRGKETNLAQTVKDRVEEIAKLEKNKSVSRSNSMNKSAAAVPPPRNVESVQSLLRNKVKAPALHRGGLQKVNRSFLNNH

SEQ ID NO: 44805 - protein, 113 aa, Photobacterium profundum SS9
METIDKIKQQISENPILLYMKGSPKLPSCGFSSQTSQALMSCGEKFAYVDILQNPDIRAELPVYAQWPTFPQLWIEGELIGGCDIVLEMFQKGELQPLIKEAAVRRDGEAAAE

SEQ ID NO: 44806 - protein, 353 aa, Zea mays
MRVNVLRRSNEESGGEIDWDNLGFGLTPTDYMYVTRCSPEDRGDFPRGELCRYGNIELSPSSGVLNYAQGLFEGMKAYRRPDRAGYTLFRPEENARRMQRGAERMCMPAPSVEQFVHAVRQTVLANRRWVPPQGKGALYLRPLLVGSGPILGLAPAPEYTFLIYAAPVGNYFKEGLAPINLVVHDEFHRAMPGGTGGVKTIANYAPVLRAQMDAKSKGFTDVLYLDSVHKRYLEEVSSCNVFVVKGGVVATPDTRGTILPGITRKSVIELARDRGYKVEERLVSIDDLMGADEVFCTGTAVVVAPVSTVTYQGERYEFRTGPDTVSQELYTTLTSIQMGMAAEDSKGWTVAVE

SEQ ID NO: 44807 - protein, 672 aa, Candida albicans SC5314
MSDISKQMNNLSVNDGANTVNNNNSFRGGRSQYVPPHLRNRQGGGNQSGSSSESSDVPFGGSQRGGFNSNGFNNNRGGFNNGGYNNNRGGFNNGGFNNRGNYNQSFGGRGGRGGFNNGGGRYQRPTPGVGKWQDGKHEPAPRNEKLEVELFGTADDSHFQSSGINFDNYDDIPVEASGDKVPEPITSFTAPPLDELLVENIQLSRFTKPTPVQKYSVPIVAAGRDLMACAQTGSGKTGGFLFPVLSESYMKGPAPVPESNGAFSSHKVYPTILVMAPTRELVSQIYEESKKFSYRSWVRACVVYGGADIGQQMRNMDRGCDLLVATPGRLKDLLDRGKVSLANIRYLVLDEADRMLDMGFEPQIRYIVEECDMPAVKDRQTLMFSATFPRDIQMLARDFLKDYVFLSVGRVGSTSENITQKILYVEDDEKKSVILDLLSANENGLTIVFTETKRMADNLADYLYDQGFPATAIHGDRSQYEREKALAAFKNGAAPILVATAVAARGLDIPNVSHVINYDLPSDIDDYVHRIGRTGRAGNVGIATAFFNRNNKNVVKGLIELLSEANQEVPDFLTKIAREGAFGKMTRGGGRGGSSRGPSRDFRRSGNSGWGNSGNSGWGNSGNASSSGWGGNSSSSYSNTNSNYGGGYNNNQRSNFSSGGSYGNQTGSNSWW

SEQ ID NO: 44808 - protein, 539 aa, Burkholderia vietnamiensis G4
MCKAAVTGIGCRSSMADLNPQITPAWQALERLAGHYALGFDLRQAFATEPKRFQQHSVRAPHMLVDLSKNLWDEPVVEQLLALAMQMGLPDRRSQLLNGEIVNHTEHQAAVHAALRLAFTSGTATALPAMAQNCADLSAMLAMAEIIRADVTVHDVVHIGIGGSSLGPELALQALRPYWRTQQRIHVVSNLDGHDLAETLAQCHPAHTLFVAASKSWSTFETLQNLHSATGWLQQSGINPADRIVAITAKPHVAQAAGVKHILRMPADLGGRYSVWSAVGLPVAVAIGKAGFRELLAGAAAMDAHFAQAPLVQNAPVLLGLLDVWYNSFLRMPSRCVAPYHHRLRRLPAYLQQLDMESNGKTVRQNGDAVAYATGMALWGESCTNGQHAFFQWLHQGPQRTQVEFVAASQAEHALPGHHTPLLANAVAQAQALMLGSKAGLGQLPGHQDFPGNRPSTFLLLDGPLSPPALGALLALYEHRTFVSGVVWGINSFDQWGVELGKELAQDILQRVPGGHWQGLDASTAGLLNAACVTSEAHS

SEQ ID NO: 44809 - protein, 362 aa, Oryza sativa
  misc_feature (259)..(259): Xaa can be any naturally occurring amino acid
MAASGVKRPPRPAPASSGVRKLILALAVFLPALLYSQLQPPPPKICGSPGGPPITGTRTRLKDGRYLAYLESGVPKEQAKYKIIFVHGFDSCRYDALPISPELAQELGIYQLSFDRPGYAESDPNLASTEKSIALDIEELADNLQLGPKFYLMGFSMGGEIMWSCLKHISHRLAGVAILAPVGNYWWSGLPSNVSWHVWNQQLPQDKWAVWVSHHLPWLTYWWNSQKLFPASSVIAYNPALLSEEDKLIMPKFAFRTYXPQIRQQGEYGCLHRDMTVGFGKWSWSPLELEDPFAGGEGKVHLWHGAEDLIVPVSLSRYLSEKLPWVVYHELPKSGHMFPLADGMADTIVKSLLLGDQPPQAS

SEQ ID NO: 44810 - protein, 1105 aa, Synechocystis sp. PCC 6803
MAIADKAYTMIGIEIPITSRTVLPMPRRNDLNKIMILGAGPIVIGQACEFDYSGTQACKALKEEGYEVVLVNSNPASIMTDPELADRTYIEPLIPEIVEKIIEKERPDAVLPTMGGQTALNLAVSLSKSGVLEKYGVELIGAKLPAIEMGEDRELFKEAMARIGVPVCPSGIASSIEEARQVAHEIGSYPLIIRPAFTLAGTGGGIAYNQEEYEEMVQYGLDQSPMSQILVEKSLLGWKEYELEVMRDLADNVVIICSIENFDPMGVHTGDSITVAPAQTLTDKEYQRLRDYSIAIIREIGVETGGSNIQFSVNPANGDVIVIEMNPRVSRSSALASKATGFPIAKFAAKLAVGYTLNEISNDITKKTPASFEPTIDYVVTKIPRFAFEKFPGAEPILNTQMKSVGEAMAIGRTFQESFQKALRSLETGRFGFGCDRHETLPTLSHLRSQLRTPNPERVFSLHHAFNLGMTVEEIHELTAIDPWFLDKLEDLVKTEKYMKQRSLKDLTAADLRYIKQQGFGDRQIAFATKTTEDEVRAYRKSLGITPVYKVVDTCAAEFEAFTPYYYSTYEPEECEVLPSDKPKVMILGGGPNRIGQGIEFDYCCCHAAFSLSDAGYETIMVNSNPETVSTDYDTSDRLYFEPLTKEDVLNIIEAENPVGIIIQFGGQTPLKLAVPLQKYLNSPDCPVQTKIWGTSPDSIDTAEDRERFEKILHELEISQPPNGIARDYEESRVVANRISYPVVVRPSYVLGGRAMEIVYSDEELERYMTYAVQIEPDHPILIDKFLENAIEVDVDSLTDSTGKVVIGSIMEHIEEAGIHSGDSACSIPYTSLSDNVLTTIRQWTEQLARALNVVGLMNIQYAVQGDQVYILEANPRASRTVPYVSKATGRPLAKIASLVMSGKTLEELGVTEEFIPQHVAVKEAVLPFSKFPGADTLLGPEMRSTGEVMGIDSDFGKAFAKAELGAGVILATTGTVFVSMSDRTKEAAVPVVRELIDLGFKVVATSGTQKVLREHGIEGVEVVLKLHEGRPHVIDWIKNGQIQFIINTPSGEESQLDGRTIRRAALDYKLPIITTIAGGKATVAALRSLQDHPLDVKALQDYLG

SEQ ID NO: 44811 - protein, 342 aa, Fulvimarina pelagi HTCC2506
MAETKGERPTEIDSVEPDRRKQTIAERDAAWEPKPYVSGETRVRGENSIFDPDFNKPQIQGPSAFITGWPVWHSRSPMIHGHWLKTHGIAGTYGRQGVPPEEFPFFLKKLRDKGFSGGNVTIPHKEAAFRHVDARDAAAEAIGAVNTLWFENERLIGGNTDAYGFAANLDERLNGWDSAEYAVVIGAGGAARAVIHALIKRGITHVFIVNRTVSRAENLVRDFGPKVSAHGEEERDDLLKIADLVVNTAPVPERDPELPAWFPEKLPDLSMMKRDAMVTDIVYSPLMTPILRAAEKEGLKHCDGLGMLLHQAVPGFERWFGKRPEVTGELRKMVLKDLGIEG

SEQ ID NO: 44812 - protein, 198 aa, Zea mays
MPVPLAPYPAPPAPFTPPNGAQSQLVCTGCRNLLMYPAGATSVCCAVCSTVTAVPAPGTEMAQLVCGGCHTLLMYIRGATSVQCSCCHTVNLAMEANQVAHVNCGNCRMLLMYQYGARSVKCAVCSFVTSVGVSTQSILFQKRMQLTNNVFCCRRLPLFRCYSYCETTCVSHKKQKTNRRVSLYSDLTWCRAEAQQLS

SEQ ID NO: 44813 - protein, 474 aa, Anabaena sp.
MTTPQEVLKRIQDEKIELIDLKFIDTVGTWQHLTLYQNQIDESSFSDGVPFDGSSIRGWKAINESDMTMVLDPNTAWIDPFMEVPTLSIVCSIKEPRTGEWYNRCPRVIAQKAIDYLVSTGIGDTAFFGPEAEFFIFDSARFAQNANEGYYFLDSVEGAWNSGKEGTADKPNLAYKPRFKEGYFPVSPTDSFQDIRTEMLLTMAKLGVPIEKHHHEVATGGQCELGFRFGKLIEAADWLMIYKYVIKNVAKKYGKTVTFMPKPIFGDNGSGMHCHQSIWKDGKPLFAGDQYAGLSEMGLYYIGGLLKHAPALLAITNPSTNSYKRLVPGYEAPVNLAYSQGNRSASIRIPLSGTNPKAKRLEFRCPDATSNPYLAFAAMLCAGIDGIKNLIHPGEPLDKNIYELSPEELAKVPSTPGSLELALEALENDHAFLTDTGVFTEDFIQNWIDYKLANEVKQMQLRPHPYEFSIYYDV

SEQ ID NO: 44814 - protein, 135 aa, Thermobifida fusca YX
MERTLVLIKPDGVRRNIIGEVISRIERKGLKIVAMELRTLDEETAKAHYEEHVEKPFFSSLVEFITGGPLVAMVVEGNRAIEAFRSLAGATDPVLAAPGTIRGDYGLDVQANIVHGSDSTYSAEREIKLFFPDLA

SEQ ID NO: 44815 - protein, 463 aa, Arabidopsis thaliana
MPNLDFDESFYFDPLMTCEERRKGSESFMLFVGSVLTLQAEANATLNRFYVKCEGVDQNSVLEWIPKVLKRGVLDIDLHIPSSRGFGSNSTFYPLPSEIFVSKTLVRLKIQFQDGVNVNVECDVSLPMLKTLHLDYVKMDTRMFQKLLSGCHMLKELLLMNLIWEESSEPEPCYVTVSVPTLKILKFSRFENFVKAKDFKPIVLWSFDIPNLVYLEYLDTIADKYQHVRFDSLVEARLGLCKTSKQIKNDNNNVTKLFMGICNVKILYLTEDALKVLGCCRETMPVFENLIQLTIKTGLHVGWKSLPPLLKNCPNLQTLVFEGLNHIYRKRRSCGDENRPCMCKNLDNMRVKKDIDACLSSSSVKVIKILNFGDTGDFCQFWEIEEDCEFWEIVEDVADHIKQVKQFLETMPDLEQVTLYYNTPQDEDVMKVFKKLKKLRRVASAKCEVQIISDNLNLSFTFR

SEQ ID NO: 44816 - protein, 413 aa, Methanosarcina mazei Go1
MSEDSAIRSSLEDIKSRVEFQLECGEIIPEDVKTLLTEIEILKVQNENMKARLLEASVATGRHLQEINKLKAHLEQLTEPPLFIATILEVNGEIALIRQHGNNQEVLTQIPEECLGKIEPGMRVAVNGAYSIISIVSRAADVRAQVMELINSPGIDYSMIGGLDDVLQEVRESVELPLTEPELFEDLGIEPPSGVLLHGAPGTGKTLIAKAIASQAKATFIRMSGSDLVQKFVGEGSRLVKDIFQLARDKSPSILFIDEIDAVGSMRTYDGTSGSAEVNRTMLQLLAEMDGFDPKGNVKVVAATNRIDLLDPALLRPGRFDRSIEVPLPDDKGRIEILKIHTRKMKLADDVDFEKLAKVMSGRSGAEISVIVKEAGIFVLRRRGKEITMADFMKAYDKVVNVQEPTIPQAMFV

SEQ ID NO: 44817 - protein, 142 aa, Alkalilimnicola ehrlichei MLHE-1
MFKDLEKARPGTRRDLPAVLAALPWNAQGLLPAIAQQHDSGEVLMMAWMNREALEETLRTGRVCYYSRSRRSLWRKGESSGQVQRLVELRLDCDGDTLLLRVDQTGPACHTGRRSCFYNRLDGDGLEVIAAPEIDPETLYHR

SEQ ID NO: 44818 - protein, 377 aa, Nepenthes alata
AVIGSGVLSLAWAIAQLGWIAGPAVMLLFSFVIYYTSILLADCYRVDDPIFGNRNYTYMDAVRSNLGGVKVKVCGLIQYLNLIGVAIGYTIAASISMMAIRRSNCFHNSGAKKPCHMSSNPYMIMFGILEIILSQIPDFDQIWWLSIVAAVMSFTYSTIGLSLGIAQVAANKAFKGSLTGISIGAVTQTQKIWRSFQALGDIAFAYSYSIILIEIQDTVKSPPSEAKTMKKASLISIVVTTAFYMLCGCMGYAAFGDIAPGNLLTGFGFYNPFWLLDIANAAIVVHLVGAYQVYCQPLFAFVEKSASGKWPKNAFINKGIKIQIPGFGAYDLNIFRLAWRTAFVITTTIISMLLPFFNDIVGILGAFGFWPFTVYFP

SEQ ID NO: 44819 - protein, 381 aa, Arabidopsis thaliana
MDLSGSRDVISSLPDDISSHILSFLPTKEAASTSVLSKKWRYLFAFVPNLDLDDSVYLNPENETEISTSFMDFVDRVLALQGNSPLHKFSLKIGDGIDPVRIIPWINNVLERGVSDLDLHLNLESEFLLPSQVYLCKTLVWLKLRFGLYPTIDVEDVHLPKLKTLYIEATHFEEHGVGLTKLLSGCPMLEDLVLDDISWFIWDFASVSVPTLKRLRFSWQERDEFPKSVLLDTPNLVYLKFTDTVAGKYPKVNLDSLVEAHIDLRLLKPLLINYHQGYGENDMVGNATDFIMRICNVKTLYLSANTLQVLTYSCDAIPIFNNLTHLTIESNPRVGWQSVPGLLKNSPNLETLIFQGLIHKATYRCGDVCLCKKPRKEILSC

SEQ ID NO: 44820 - protein, 482 aa, Escherichia coli B
MKLNDSKLFRQQALINGEWLDANNGEVIDVTNPANGDKLGSVPKMGTDETRAAIDAANRALPAWRALTAKERANILRNWFNLLMEHQDDLARLMTLEQGKPLAEAKGEISYAASFIEWFAEEGKRIYGDTIPGHQADKRLIVIKQPIGVTAAITPWNFPAAMITRKAGPALAAGCTMVLKPASQTPFSALALAELAIRAGIPAGVFNVVTGSAGAVGNELTSNPLVRKLSFTGSTEIGRQLMEQCAKDIKKVSLELGGNAPFIVFDDADLDKAVEGALSSKFRNAGQTCVCANRLYVQDGVYDRFAEKLQQAVSKLHIGDGLEKGVTIGPLIDEKAVAKVEEHIADALEKGARVVCGGKADERGGNFFQPTILVDVPANAKVSKEETFGPLAPLFRFKDEADVIAQANDTEFGLAAYFYARDLSRVFRVGEALEYGIVGINTGIISNEVAPFGGIKASGLGREGSKYGIEDYLEIKYMCIGL

SEQ ID NO: 44821 - protein, 376 aa, Nepenthes alata
AVIGSGVLSLAWATAQLGWIAGPTAMLLFSFITFYTSRLLADCCRSGDSFTGERNPTYMDAVRSNLGGIQVKICGLVQYANLFGVSIGYTIAASISMMAIKRSNCFHASDDKNPCQYPASPFMIIFGLTEIIFAQIPDFHRLWWLSIVAAVMSFTYSTVGVSLGIAQVAENGKIKRSLTGISIGTVSQAQRIWRRFQALGDIAFAYSYSLVLVEIQDTIKSPPSEIKTMKKATVMSIAVTTLIYLLCGCMGYAAFGDLAPGNLLTGFGFYNPYWLLDLANAAIVVHLLGAYQVCCQPIFAFIETTASNAFPDNEFITKEVEIPIPGFKPYKLNLFRLVWRTSFVGVTTTISILLPFSNGVVGLLGALAFWPLTVYY

SEQ ID NO: 44822 - protein, 104 aa, Triticum aestivum
  misc_feature (2)..(2): Xaa can be any naturally occurring amino acid
  misc_feature (56)..(56): Xaa can be any naturally occurring amino acid
  misc_feature (90)..(90): Xaa can be any naturally occurring amino acid
CXVPIAQSSISAKRGGQFVIDPATFPEGSAGAAWPFAGGFVMGSTVEGEGKASRPXVQVGVQHVACMGDVAVFIALSAAVDLCMDACKLXSHRLRKELCQDQDD

SEQ ID NO: 44823 - protein, 297 aa, Nepenthes alata
DQFDDTDPREKIKKGSFFNWFYFSVNIGALISSSLIVWVQENLGWALGFGIPAISMGIAIASFFSGTALYRLQKPGGSPLTRMCQVLVASFRKSKLALPEDSNLLYETSDENSVIEGGRKLEHTNDLKCLDKAAVVSDKEIKCEDFSNPWRLCTVTQIEELKILIRMFPIWATGIVFSAIYAQMSTMFVEQGEVMDRTIGSFTIPAASLSMFDTISVIFWVPVYDKILVPLARKSTGKQRGFSELQRMGIGLFISILSMAAAALVEMKRLQLAKELGLVDEDVAVPLSIFWQIPPYF

SEQ ID NO: 44824 - protein, 857 aa, Oceanicola granulosus HTCC2516
MQKERTYDEVTLITVDATMSAAIHGGRAKCLQRLVRLDMPVPRTVALSFGAVRRIAAGELPDLDTILRPFGPDPLVSVRPSSQDPDWGGPGAILNIGMCDSRHADMCATMGEAAATSLYLRFIQSYATEVARLEADSFELPDHPDRAALARALAAFEDEMDEPFPQDPARQLADVLKSMARAWEGTSARLLREAKGAPADAGLGLVVQAMALGVGQGECGSGVIQFIDAATGQRRITGRYLSQSQGRDALTAESGALYLTKDPRGPSLEEAHPDTFAKLVAFGDRSRERLREEMEIEFTVEDGRLKILDAVRVPRSNRAAVRIAVDLAADGVIPPEEAVMRIEPQALSELLHRQIDPGAPRDVITRGIAASPGAASGRIVFTATDAQAAAARGESCVLVRRETSPEDIRGMHAAAAVLTIRGGVTSHAAVIGRGLGLPCVVGASTLRIDRKRGCLIAPDGRRFAEGETLTVDGTTGDVIAGEPPMVEAALDGAFRQLLDWADGFRDIGVRANADTPADAQTARNFAAEGIGLCRTEHMFFEGERLSLMREMIFADAPDDRTAVLARLLPMQRGDFIELFKIMAGHPVCIRLFDPPLHEFLPSDKAGLRDLADILNLPLADVTARVEAMEEYNPMLGMRGVRLGVTVPEIYEMQARAIFEATIAASRKGAPVVPEIMIPLVSAMREVELVKNRIDAVAVNVHNETGAEFDYRLGVMVETPRAALRAGDIALHAAFLSFGTNDLTQMTYGLSRDDAGRFMSAYVSQGVYEEDPFHTLDLEGVGELLTIGAQRARSSCPEIMLSICGEHGGSRSAIAFSRARGLNYVSCSPFRVPVARLSAAQIALTDRNQLPGLAADRP

SEQ ID NO: 44825 - protein, 259 aa, Triticum aestivum
  misc_feature (199)..(199): Xaa can be any naturally occurring amino acid
  misc_feature (253)..(253): Xaa can be any naturally occurring amino acid
QVCTKKQAGTGPEFPGYRRPTRPKELLSRSTVPGYVYKAIDALPVTAHPMTQFTTGVMALQVESEFQKAYDKGMPKTKFWEPTYEDCLNLIARLPQVASYVYRRIFKDGKAIAADNTLDYAANFSHMLGFDDPKMLELMRLYITIHTDHEGGNVSAHTGHLVGSALSDPYLSFAAALNGLAGPLHGLANQEVLLWIKSXMEETGSYITTDQLKEYVWKTLKSGKVVPGYGHGVLRNTDPRYSCQREFALKYLXEDPLFQ

SEQ ID NO: 44826 - protein, 865 aa, Oryza sativa (japonica cultivar-group)
MLGGIIGGLTGNKNARLKGSLVLMRKNALDINDFGATVIERISEFLGRGVTCQLVSSSLVDPNNGNRGRVGTEASLEQWLTSLPSLTTGESKFGVTFEWEVEKMGIPGAIIVKNNHAAEFFLKTITLDNVPGHGAVVFVANSWIYPASKYRYNRVFFSNDTSLPSKMAAALKPYRDDELRNLRGDDQQGPYQEHDRVYRYDVYNDLGEPDSGNPRPVLGGSPDRPYPRRGRTGRKPTKTDPTAESRLSLLENIYVPRDERFGHLKMADFLGYSIKALVDGIVPAIRTYVDLTPGEFDSFKDILKLYEGGLKLPSIPALEELRKRFPLQLVKDLIPGGDYLLKLPMPHVIREDKKAWMTDDEFAREILAGVNPMVIARLTEFPPEPLDPARYGDQTSTITAAHVERGLEGLTVQQAIDGNLLYVVDHHDHFMPYLLDINSLDDNFIYATRTLLFLRGDGTLALAIELSLPHLQDDGLITARSTVYTPAAAAAPAPALEWWVWQLAKAYVNVNDYCWHQLISHWLNTHAVMEPFVIATNRQLSVAHPVHKLLLPHYRDTMTINGLARQTLINGGGIFEMTVFPRNDALAMSSAFYKDWSFADQALPDDLVKRGVRTDPASPYKVRLLIEDYPYANDGLAVCTPIEQWATEYLAIYYPNDGVLQGDAELQAWWKEVREVGHGDIKDATWWPEMKTVADVVKACATIIWIGSALHAAVNFGQYPYAGYLPNRPSVSRRAMPEPGTKEYDELARDPEKVFVRTITKQMQAIVGISLLEILSKHSSDEVYLGQRDTPEWTSDAKALEAFKRFGARLTEIESRVVAMNKDPHRKNRVGPTNFPYTLLYPNTSDLKGDAAGLSARGIPNSISI

SEQ ID NO: 44827 - protein, 178 aa, Prunus avium
MASAEIEFRCFVGGLAWATDNDALERAFSPFGEIIESKIINDRETGRSRGFGFVTFSNEKAMRDAIEGMNGQNLDGRNITVNEAQSRGSGGGGGGNGGGYSRGGGGGGYGGGGGYGGGGRREGGGGGYSRGGGGGGYGSGGGGYGGGGRREGGYGGGEGGGARYSRGSGGSEGGSWRS

SEQ ID NO: 44828 - protein, 369 aa, Gloeobacter violaceus PCC 7421
MQVKAAVAMEAGKPLQIESVELEGPKAGEVLVEIKATGICHTDAFTLSGADPEGLFPAILGHEGAGVVVEVGPGVTSVKLGDHVIPLYTPECRQCEYCLSRKTNLCQAIRTTQGRGVMPDGTSRFSLGGEPLYHYMGTSTFSNFTVLPEIAVAKIREDAPFDKVCYIGCGVTTGVGAVLYTAQVEPGANVVVFGLGGIGLNVIQGCRMVGADKIIGVDTNPAKKELAEKFGMTHFVNPKEVEGDLVPYLVELTKGGADYSFECIGNVNVMRQALECCHKGWGVSVIIGVAGAGQEIRTRPFQLVTGRIWKGSAFGGARGRTDVPKIVDWYMEGKINIDDLITHVLPLGEINQAFDLMHEGKSIRTVVTF

SEQ ID NO: 44829 - protein, 235 aa, Synechocystis sp. PCC 6803
MAELDAANLMKQAVGKAAADRVKSNTIVGLGTGSTTAYALEFIGDRLKKGELENVVGIPTSFQAEVLARKYGIPLTTLDVADRIDIAIDGADEVDPQKNLIKGGGAAHTREKIVDALAETFLVVVDSGKLVDKLGSTFLLPVEVIPMALTPVMRALAKLGGKPELRMGVKKAGPVVTDQGNLVIDVKFDAITNPAELEKTINNLPGVLENGLFVGVADVILVGEIIDGQPTVREF

SEQ ID NO: 44830 - protein, 381 aa, Haloarcula marismortui ATCC 43049
MTFEAADRVDSVPPSGIRRFFELAEEMDDIISLGVGEPDFSAPWSAREAAIASLERGQTSYTANRGKRELRERIADYEAATHNLQYDPDEEILVTAGASEGLDLAFRALLNPGDSIAIAQPCYVSYVPGATFAGIDVIDVPTRAEDEFKLTQEVLESSGAAEADALVYCFPNNPTGATMTAEEMADVAAFCRENDLLVFADEIYADLTYEHDHTSIATLPGMRERTVVFNGFSKAFAMTGFRLGYAMAPPEAVEAMNRIHQYSMLSAPTTAQHAAIEALDNCRDEVTDMAAQYDRRRKYVLTRFEEMGLDCFPAAGAFYAFPECPWDDAGEFAESLLQEKRVAVVPGTAFGEGGSGHLRVSYATGLDDLKEAMARIESFLN

SEQ ID NO: 44831 - protein, 99 aa, Humulus lupulus
TFDSIKEMPLVQSVVYVTLRLNPPVPLQFARARKDFRLSSHDSAFEVKKGELLCGFQSLVMKDPKIFSEPETFTPDRFMKDKDLLDYLYWSNGPQTGIT

SEQ ID NO: 44832 - protein, 122 aa, Fulvimarina pelagi HTCC2506
MAGESGGTLTTHVLDTATGQPARGLRIKLYWVGSSGARDQIADLTTNSDGRCDGPILGADDFQIGLYELVFEAGAYFDGLDLDLPDPKFLDEVVIRFGMSEHTHYHVPLLMSPFGYSTYRGS

SEQ ID NO: 44833 - protein, 241 aa, Brassica napus
  misc_feature (210)..(210): Xaa can be any naturally occurring amino acid
  misc_feature (236)..(236): Xaa can be any naturally occurring amino acid
DGNTQTKVMTSFVSVISLLLSFSLAIFSDAASFQKFPVPGKRSGPEAFAFDSTGKGFHTGVSGGKIFKYLPGKGYVDFGYITVSSKSQWCDGALGIAYMSKCGRPAGIAFNNKTGELYVADAPLGLHVIPSGGGYAKKIADSADGKPFLSLDDLDVDPTTGVVYFTSFSSKFSPGDVLKAVASKDASGKLFKYDPSKRVVTVLLEGLSGXPGCAVSSDGSFVLVSQFTKSNIKRYXIKGSK

SEQ ID NO: 44834 - protein, 485 aa, Burkholderia cepacia
MLKKSTTSSTANMCRVSVGSRSSSPLNNAVIAKVHEAGRAEVDAAVAAAQAALKGAWGRMSLAQRVEVLYAVADGINRRFDDFLAAEVEDTGKPMSLARHVDIPRGAANFKIFADVVKNVPTEFFEMPTPDGVGAINYAVRRPVGVVGVICPWNLPLLLMTWKVGPALACGNTVVVKPSEETPQTAALLGEVMNTAGVPPGVYNVVHGFGPNSTGEFLTSHPDVNAITFTGETGTGEAIMKAAADGARPVSLELGGKNAAIVFADCDLDKAIEGTLRSCFANCGQVCLGTERVYVERPIFDRFVSRLKKGAEGMQLGRPEDLATGMGPLISQEHREKVLSYYKKAVEAGATVVTGGGVPEMPEALKGGAWVQPTIWTGLGDDSVVAREEIFGPCALVMPFDSEEEVIRRANDNDYGLARRIWTTNLSRAHRVAGAIEVGIAWVNSWFLRDLRTAFGGSKQSGIGREGGVHSLEFYTELKNVCIKL

SEQ ID NO: 44835 - protein, 618 aa, Xylella fastidiosa Ann-1
MPRRRFVPSLSGRTIVNITTALPLPTHLLSEKVTAPLLGARKIYVTGSRQDIRVPMREIALTPSSARYGGNENLSLVLYDTSGIYTDPQATIDLACGLPRLRTAWIDERADTVEAKLHFKVPESVSVTAPPFPTPPQPLRARDNVAVTQLEYARRGLVTPEMEFVAIREQQRREQTVENLRGQRHAGDAWGALIGTPITPEFVRDEIARGRAILPNNINHPESEPMIIGRNFLTKINANIGTSALSSSIAEEVEKLVWAIRWGADTIMDLSTGRDIHATREWILRNSPVPVGTVPIYQALEKVGGHVDALSWDVFRDTLIEQAEQGVDYVTVHAGVLRDFIPLTASRLTGIVSRGGSIMARWCQAHRSENFLYTHFEELCEIMRAYDVAFSLGDGLRPGCIADANDAAQFAELEILGKLTHIAWNHQVQVMVEGPGHVPMQLIKANMDKQLAACGEAPFYTLGPLTTDIAPGYDHITSAIGAAMIGWYGTAMLCYVTPKEHLGLPNLQDVHDGIIAYKIAAHAADLAKGHPAAQARDDALSKARFEFRWQDQFHLSLDPEKALALHDESLPKEAHKRAAFCSMCGPQFCSMKISQEVRDASSTELSDANTDTNTNDGI

SEQ ID NO: 44836 - protein, 258 aa, Prochlorococcus marinus str. MIT 9301
MSSQKIFLFDFDGVIVDGMQEYWHSSLLACERYLNSPYISVDQKLYKRVPNSFKEMRPLVKYGWEMILIAHEIIKSENQLKNDNKDDFINNYHQNCQRILNENSWIAEDLQKMLDQSRKYQIDKDFKSWVNLHNPFFEIINFMKKLRRKEIKTGVITTKGKIFAEKILKQLNIFPEYIFGYESGTKIKIAKKLTKTYEILGFIEDRKKTLIEIKKNSETSHIPCFLADWGYLKESDRYNLSNEIKLLKLDKLEELVAI

SEQ ID NO: 44837 - protein, 393 aa, Taxus canadensis
MAYTAMAAGTQSLQLRTVASYQECNSMRSCFKLTPFKSFHGVNFNVPSLGAANCEIMGHLKLGSLPYKQCSVSSKSTKTMAQLVDLAETEKAEGKDIEFDFNEYMKSKAVAVDAALDKAIPLEYPEKIHESMRYSLLAGGKRVRPALCIAACELVGGSQDLAMPTACAMEMIHTMSLIHDDLPCMDNDDFRRGKPTNHKVFGEDTAVLAGDALLSFAFEHIAVATSKTVPSDRTLRVISELGKTIGSQGLVGGQVVDITSEGDANVDLKTLEWIHIHKTAVLLECSVVSGGILGGATEDEIARIRRYARCVGLLFQVVDDILDVTKSSEELGKTAGKDLLTDKATYPKLMGLEKAKEFAAELATRAKEELSSFDQIKAAPLLGLADYIAFRQN

SEQ ID NO: 44838 - protein, 263 aa, Brassica napus
  misc_feature (253)..(253): Xaa can be any naturally occurring amino acid
MAKKVLMTANGDEVSRNIAIQLAKHGCRLVLMGNEASLRSTVDYIRVSVDGAFPVELIGADMEADSEEDFYVAVQKAWTRLGSLDAFVNCCTYQGKMQDILRVSEDEFKKITRINLTATWFILKAVASMMKENGTGGSIVFLATIASAERGLYPGADAYATAAAAIHQLVRASAMSLGKHKIRVNMISRGLHLGDEYPVSVGIDRAQKLVKDAAPLGQWLNPEKDIYSTVIYLISDGSCFMTGTTVMVDGAQXLTRPRLKSYM

SEQ ID NO: 44839 - protein, 371 aa, Bacillus cereus
MKSRAAVAFKPGEPLQIVEIDVEEPKAKEVLVKILYTSVCHTDAFTLSGDDPEGVFPAVLGHEGAGVVVSVGDEVTSVKPGDHVIPLYTPECGECKFCRSGKTNLCSAVRETQGKGLMPDGTTRFSYNGEPLYHYMGTSTFSEYTVVNEINLAKIDENAPLDKVALLGCGVTTGIGAVHNTAKVEEGAVTAVFGLGAIGLAAIQGLVQAKASRIIAVDLNPQKWELAKKMGATDFVNPADYDRPIQEVIVEMTDGGVDYSFECIGNVEVMKSALEACHKGWGESIIIGVAGAGKEIHTRPFQLVTGRVWRGSAFGGVKGRSELPEMVEDYMHGDIDLDSFITHHLEFKDINAAFDLLHKGESIRTILTYGE

SEQ ID NO: 44840 - protein, 204 aa, Haemophilus somnus 129PT
MTNIKLNYHKTHFLMSAPNIKVLPEDSGIEIAFAGRSNAGKSTALNALTQQKNLARTSKIPGRTQLINLFQVEPNCKLVDLPGYGYAAVPEQMKLQWQKSLGEYLQKRECLGGLVILMDIRHPLKDLDQQMIEWAVSADLPVLLLLTKADKLSQSARSKQVKMVREAILPFQGDVQVEAFSAQNKIGIERLSEKLDQWFSPLFS

SEQ ID NO: 44841 - protein, 337 aa, Oryza sativa (japonica cultivar-group)
FASSPLLSKKRRARLLLLSTRAAMRAGDMPGRGARRRPDLTLPMPQRDAPTSLAVPLPLPPLEELERVRRVGSGAGGTVWMVRHRGTGKEYALKVLYGNHDDAVRRQIAREIAILRTAEHPAVVRCHDMYERGGELQILLEYMDGGSLDGRRIADERFLADVARQVLSGIAYLHRRHIVHRDIKPSNLLIDSARRVKIADFGVGRILNQTMDPCNSSVGTIAYMSPERINTDLNDGAYDGYAGDIWSFGLSILEFYMGKFPFGENLGKQGDWAALMCAICYSDPPEPPAAVSPEFRSFVGYCLQKNPAKRPSAAQLMQHPFVAGPQPQPLAAPPPSS

SEQ ID NO: 44842 - protein, 165 aa, Triticum aestivum
VAGSAQGGYLKDLSAPSGFKYVEGSRPWKLVERVDVALPSATQNELDEEDAKALVAAGCGFVAEGANMPCTLEAINVFEAARKEKGSKGVWYGPGKAANCGGVAVSGLEMAQNSARLQWTEEEVDAKLKNIMQTAFKTCYETAQEFAGEGELPSLVSGANIAGFL

SEQ ID NO: 44843 - protein, 106 aa, Oryza sativa
MAEEAQSHAREGGRHPRQPAGRENDLTTVELARFAVAEHNSKANAMLELERVVKVRQQVVGGFMHYLTVEVKEPGGANKLYEAKVWERAWENFKQLQDFKPLDATA

SEQ ID NO: 44844 - protein, 396 aa, Arabidopsis thaliana
MLRDGNKQSKNNVRFVRKSIKTTVKTSLQNRSSLKKPPVGRSKSRSISSIPSSAVASTLSLPEKVETKCLEEDTQGESSSSGNKDPTTKVLDVTAKPKSKRRKSFTSLLVNGSKFDEKNGETTEPEKLPSIDDESNQLEVAEYVDDIYQFYWTAEALNPALGHYLSAHAEVSPVTRGILINWLIEVHFKFDLMHETLYLTMDLLDRYLSQVPIHKNEMQLIGLTALLLASKYEDYWHPRIKDLISISAESYTREQILGMERSMLKQLKFRLNAPTPYVFMLRFLKAAQSNKKLEQLAFYLIELCLVEYEALKYKPSLLCASAIYVARCTLHMTPVWTSLLNNHTHYNVSQMKDCSDMILRFHKAAKTGNLRVTYEKYINPDRSNVAVLKPLDKLPL

SEQ ID NO: 44845 - protein, 550 aa, Haloarcula marismortui ATCC 43049
MPGGSPQTLRPFLWRAETLYPDTEVVSRTHEGIVRHDYAEYAERTAQLANAIEEAGYGDGERLGTFCWNHSRHFETYFGVPGTGAQLHTINPLLPDEHIQYIVSDAQDELIFVDESLLPKLEGAATADPESFETVEQFIVMSDSVPETELDAVAYESFIADQPTEYDWPELEEDRAAGLCYTSGTTGRPKGVEYTQQMLWSHTMAIQSPQGIPLDDDDVMMPVVPMFHVNAWGLPFSATAGGAKHVYPGPQPEPADLAKLIEEEDVTVTAGVPTVWLGLMEYIKENDVDLSSLERLIVGGSAAPEAMIRFFDDRDVELVHAWGMTETAPVGAVASLRSDLEDADYQTQLDKRSKQGLITPGLEFRVIDDNGDEVPHNGEDFGELHIRGPWVTTEYFKRPEANEQEFEDGYLKTGDVVSVDEDGYIKIVDRAKDVIKSGGEWISSLELENELIAHDDVNEAAVIGVPHERWQERPLAMIVPTADADEETLGDELREYILESYPKWWVPDNFVTIDEVPKTATGKFDKKSLRDEYADESLVEGRVPDDAAPE

SEQ ID NO: 44846 - protein, 727 aa, Solibacter usitatus Ellin6076
MNFKRMIGLDNLATEYTFARDSETGYTAASRIPAKWIATTCGYCSVGCGMEIGVRDNHAVAARPLAGHPVNRGKLCPKGLSEHHTIDTENRLKRPLLRKKGKLAEIGWDEATALLVEKFRATQQRYGANALGVISTGQLVTEEFYTLGKLVQLGFGTSNYDGNTTLCMATAVSGYKLSFGSDGPPGAYEDLEKADVILLIGANIAENHPILCQYIDSNPRKTLIVADPRVTKTAMIADLHLPLKPRSDLALLNGIAHVLVRHNLINRDYIDRHTTGFDDLSRFLENYPPAKVCEITGLTEDQLYKTAFLYARAKAGFIGWTMGVNHSTKGTETVNAICNLALLTGHVGRAGASPFSITGQCNAMGTRETGFASSLPGYRKFEDAQDRAELARLWKIDESRIPRKRGLAYPDIVEAAVGGTVRAMWIIATNPLVSFPNQSVLRQALSNLDFLVVQDGYHPTPTTELADLVLPAAIWGEKEGTYTNSERRVSKVNKAVEPVGEARSDFDIFLSVAAKLGCRDELFPGWQTPRDAFDEWREVSRGRLCDYSGITYELLAEQGAVQWPFPEGATFTQSSRLYADGRFPTADGRARLICGAWEAFPEQPNPQYPLVLNTGRTVEHWHTRTKTREVPILERLSPAAWLEMNPRDAGRMGLRSHDRVDVISRRGRVRSVELRLTEITAPGQVFMPFHYFESNANEVTQSAFDPVSREPNYKQCAVRVERTGAAV

SEQ ID NO: 44847 - protein, 801 aa, Solibacter usitatus Ellin6076
MKKLVVVGNGMAGVACVEQILKYRHEFQITIIGDETHVNYNRILLSSVLAGEKSADDIVLNDIEWYRANHITPRLGLRVAAIEAGERIVRGTDGSAIPFDKLILATGSTAFVPPVPGTDKQNVHVFRTLDDTRALLEKSRPGRKAVVIGGGLLGLEAARGLQVQGCDVTVVHLAPTLMERQLDAGGGAYLARKMENLGVKVLLGRQTQAMLGNGRVEGLRFKGGEEVEAELVVVAAGIRPNIELGRTAGLEVRRGIVVNDYMETSNPDIFAVGECTEHRGQIFGLVAPLMEQGKVLAATITGNRGPVFLGASTAAKLKIMGVEVFSAGSIDDTERGVETVRYEDPALGIYKKLLIKDNRLHGVILVGDASDDHRYKAWLTEATDLTPHRRHLLFPPPAQDAGLDVAQIPDRETICGCMGVTKGELITAIHQHGIATMTELKDRTRASTGCGSCGNLCARLLKAVAPEFEEEKQKVLCACVPFPQEKLREIVRSQQLRSVQDVLDVYGNGRGCEICKPALSYMVDMVWCGDHEEDRSARFINDRVHANIQKDGTFSVVPRMRGGVTTPAELRRIADVAEKYHVPLVKVTGSQRIDLLGVHKSDLPAIWSELGMPSGQAYTKGVRMVKTCVGSQFCRFGTQDAIAAGVDLETRLENLYSPHKFKMAVVGCPRNCAEATVKDVGLVGNEGSWQVVVGGAAGKSVRKADLLVTVETTDAALEAAEVFFQYYRENANYLERSYDFVERLGIEKVRKETVYSLPEVRRALLDRLHKSKDKSSDAWLERINPRPTQFVKIQPMETVSL

SEQ ID NO: 44848 - protein, 278 aa, Synechococcus sp. PCC 7002
MKLRSLLAAILALCIGVLTACSEAPDAATVDVKQLTYDEILNTGLANSCPQIANFTRGTIPIAPNETIEFSDLCLEPQTYFVKEEPLNKRREAEFIEGKPLTRYTSSLEQMTGKIKADSEGLLTLVEEDGIDFQPITVQLPGGDQVPFLFTIKNLVAQTSTPSDSINTSTDFIGEFRVPPYRGAVFLDPKARGTASGYDNAVALPSQADEEELTRANIKQYESRTGEISLQIAKIDEKTGEIAGTFESEQTSSTDMGAEDPEEVRIRGIFYARLKTAA

SEQ ID NO: 44849 - protein, 366 aa, Photobacterium profundum SS9
MTLSNLSSFFTCRVTKDSVILPPVIFHNKLSRGATVMTIKVGINGFGRIGRFVFRASVERNDIEVVGINDLIDVEYMAYMLKYDSTHGRFNGTVEVVDGNLVVNGNTVRVTAVRNPEELKWDEIGVDVVAEATGLFLTDETARKHITAGAKKVVLTGPSGDVPMFVMGVNSADYAGQDIVSNASCTTNCLAPIAKVINDKWGIESGLMTTVHATTATQKTVDGPSMKDWRGGRGASQNIIPSSTGAAKAVGKVIPELNGLLTGMAFRVPTANVSVVDLTVNLKTAATYEEICAEMKRASENEFAGVLGYTEDAVVSQDFIGEVQTSVFDAKAGVALTDKFVKLVSWYDNEIGYSNKVLDLIAHVSK

SEQ ID NO: 44850 - protein, 291 aa, Photobacterium profundum SS9
MDLRKLSTINALSDAVTICKFQGVKIVRVIHDTAEAGISLHGGHLIWFKPAGEQDVIWLSEKAEFDTTKAIRGGIPVCWPWFGKAATPSHGFARNSQWTLKEHRENSNGVIISLMLEDSESTREMWPHKFKNELIFEIGTELKVHLTSTNVDDHSWSYGGALHTYFTVADINTVEITDMGKEYIDSTQGDKAVQGGNTLVFTQEVDRVYTSPQDIITINDKNNTRQISVKNQGHNAAVIWNPWQDLSISMSGMADNSFETMVCVESTIYGQGIELAPGQSHTLSTLISVKK

SEQ ID NO: 44851 - protein, 234 aa, Brassica napus
  misc_feature (144)..(144): Xaa can be any naturally occurring amino acid
VFDSFQSLRLKSSEKKVSPAMWSLQGYYGLKPANRTVSEGGFLEMGTYNNKTETSHHHFSSNGGNNQYLRPFPSTNTPLNHHRKSRSLANALFDEVNQSPDNNTAQETSADKFRRRRQKSEADFSTRTPELLLKEENSSSNGGXFLSIAGKGLALRSKASSRTNLSSAESETSNFNPVPINLMDAPVSDSFSSVRKSSSASSLQDPEGNNSNGSSSLSLWPTSKWSLKPDLATP

SEQ ID NO: 44852 - protein, 145 aa, Alkalilimnicola ehrlichei MLHE-1
MENTLHAVLKDKGVALYSVDADVPVAEAIKTMADGHVGCVLVMEKGSLRGIFTERDVMIRVVHDGKDPAQTPVSEVMTREVAVVPPTMTVEEAMVVCLERRVRHLPVYDGSDLEGVVSSGDLMRWVIGDQKHMIDDLIQYIYIGR

SEQ ID NO: 44853 - protein, 449 aa, Oceanobacter sp. RED65
MSDLDSFYQWLEERNPGQEEFIQAVKEVVCDVHGLVEDEERYQNWNILERLTEPDRIISFRVTWQDDDGRIRVNRGWRVQYCGVIGPYKGGLRFHPSVNESILKFLGFEQTFKNALTTLPMGGAKGGSDFDPRNCSDGEIMRFCQAFMNELYRHIGENTDIPAGDINVSSREIGYLFGQYRRLANSFSGTLTGKDIEFGGSHVRLEATGYGLVYFISEMLKQDDEELKDKTIAISGAGNVALHAAKKAIQMGGKVITLSSSKGYLYVEQGLEEYHINELIERQGKCYSDSTELLKSINGDSNAKWHDDKTPWEVECDIALPCATQNELKLDDAKKLVKNKVKYVAEGSNMPCTQDAIDCFEESSIKHAPGKASNAGGVALSGFEMAQNASFTPMGYDDLDEKLKAIMTNIHTQCCEEGQQDNGFIHYRKGANLAAFKRVADAIVSQGVG

SEQ ID NO: 44854 - protein, 436 aa, Gibberella zeae PH-1
MSSDLSHQIQSKLDAAIDRYVARNPRSKALHEEALKSMPGGNTRTVLHTSPFPVAIKSGQGYQVTSEDGHVYTDLAGEFTAALYGHSNPVITSAIRHVLDNVGMNVGGHTAQEQLFARELCSRFNLEHVRFCNSGTEANIHALAAARAFTKKRRVVTFSGGYHGAVIGFKGGKPEANNVDTDDWVVARYNDLGSARAAIKSDGVAAILIEGMQGSGGGLPAMPEFLQGVQDIAAKAGVLFIIDEVMTSRLSGGGISELRGLKPDLKTFGKYLGGGLAFGAFGGRADIMAAFDPRSPNALSHSGTFNNNTLVTHAGHAGLTKIYTPEVANQFTKSGHELRERLNAVTEGTRVLFTGLGTIMGVHFTTHGDRVIERSGEVEEIDALRDLFWFEMLEEGFWVVRRGFIALVLGTPTAEFDRFVNCVEAWVSKHADLVKI

SEQ ID NO: 44855 - protein, 293 aa, Colwellia psychrerythraea 34H
MVSTFIKQHNLPEEFKLAVNEYYIPLADQIFNRFTQNKEAYFVGINGCQGSGKSTLTDFIASYLTTQYQLNVVVMSLDDFYFSSEKRRTLAQGIHPLLATRGVPGTHDVVELNHVLTQLKEKKTGFSIQKFNKATDNPYPEKQWPTIEKTADIIIVEGWCWGVEPQTVEQLKAPINELECQYDKTGQWRDYVNQQLKIAYKPLYKKMDFWLALQAPSFDCVYKWRLEQEQKLKDRNIGLVNSKIMSPAEILNFTQYFQRLSVQGCKTFSQSADAIFYLDYDRKITKMSITESV

SEQ ID NO: 44856 - protein, 143 aa, Oryza sativa (japonica cultivar-group)
MPVPLAPYPTPPVPFTPPNGAQSQLVCSGCRNLLMYPAGATSVCCAVCSTVTAVPAPGTEMAQLVCGGCHTLLMYIRGATSVQCSCCHTVNLAMEANQVAHVNCGNCRMLLMYQYGARSVKCAVCNFVTSVGASPGIDQKPSS

SEQ ID NO: 44857 - protein, 143 aa, Magnetospirillum magnetotacticum MS-1
MLVSDILAKKGNKIFKILPSKAMIDAVQGMAAFKVGAVLVVDEKDNTLGIFTERDVTRCLAAHGAPVLAEPVGDHMTRNPLTCQGSDTVASVMSTMSTHHFRHMPVMDNGQMKGIVSIRDLVSNSLERAEFEAEAMRAYVTAG

SEQ ID NO: 44858 - protein, 333 aa, Oryza sativa (japonica cultivar-group)
MAASLQAAATLMQPAKLGGRASSAALPSRPSSHVARAFGVDTGAAGRITCSLQSDIREVANKCADAAKLAGFALATSALLVSGASAEGVPRRLTFDEIQSKTYMEVKGTGTANQCPTVEGGVDSFAFKAGKYNMKKFCLEPTSFTVKAEGVAKNAPPEFQKTKLMTRLTYTLDEIEGPLEVSSDGTIKFEEKDGIDYAAVTVQLPGGERVPFLFTIKNLVATGKPESFGGPFLVPSYRGSSFLDPKGRGGSTGYDNAVALPAGGRGDEEELAKENVKNASSSTGNITLSVTKSKPETGEVIGVFESVQPSDTDLGAKVPKDVKIQGVWYAQLE

SEQ ID NO: 44859 - protein, 576 aa, Magnaporthe grisea 70-15
MDNHADSTAKTATAGEAETERIEVHDATQRVQEQAQTDRWRSIKANPKLVLLALFASFGGFEYGYQQGILSQSLAMYRFKENFPSVVSSPTATGWLTSILQLGGILGSLTAGILSEVISRKYTMFTACCWVILGSYLYIGATAGKPDLLYAGRFFTGLGVGLFSGVGPLYNAEISAPETRGFTVSFYQFATIFGIFLSFWVGYGSNYIGGHDATQSDMAWRLPSIIQGIPAILLAGGIWFMPFSPRWLVKKGRYEEARKTLAWIRKKELDDPLVEVELLEIRAQQLFEERAFARALPQYANKENRNPWVHEIVAYVQCFKTWDNVKRVATAWLVMFFQQWSGIDAIIYYATNVFMSFGFTEGTIALLATGVTGVVFLVSTIPAMLLIDKLGRKPMLYTGSIIMFLTMVTVGIVVAKFQHDWPNNPAAGWASVILIWIYIGAFGFGWGPASWVVISEIFPLSIRARGASIGASSNWLNNFAIAFFVPPMFQTLAWGTYIFFAGFLAAGIAWIYFYLPETKDVSLEEMDRVFGSHTGAEDARLLAEAQRDVGLIDFLRRAEGKSVDVEAEEKRQEPVV

SEQ ID NO: 44860 - protein, 363 aa, Buchnera aphidicola
MKQKYRIAILPGDGIGPEVMREAYKILNILKNDFLLPLEFQEFNIGGIAIDNEGLALPKKTLLGCENADAILFGSVGGKKWDTLPIDQRPERAALLPLRKHFNLFANLRPAKLYSELEYLSPLCSKITKNGFDILCVRELTGGVYFGHPHGRVKKDDIEYAFDTEVYYDYEINRIAHLAFQLARNRKNKVCSIDKSNVLNSSLLWKEIVEKVSNSYSDVRLSHLYIDNATMQIIKNPNQFDVLLCSNLFGDIISDECAAISGSIGMLPSASLNENNFGLYEPAGGSAPDIEGKNIANPIAQILSVSMLVRYGMHLTKIADQIDKSVISVLKRGYRTADISNNNNYLKTHEMGDVIADALINGK

SEQ ID NO: 44861 - protein, 361 aa, Alkalilimnicola ehrlichei MLHE-1
MTANILITPGDGIGPEIVAEARKLLEALRDDFGFDCTLEEAPIGGAGYEAHGKPLPEETLALAREADAILLGAVGGPRWEQLDRPLRPERGLLAIRAELGLFGNLRPAILYPQLAEASSLRHEIVAGLDIMIVRELTGGIYFGEPRGIRRLENGERQGYNTMVYSESEIDRVGRLAFDIASKRGSRVCSVDKANVLEVSELWREVMERVARDYPGVELSHMYVDNAAMQLVRAPKQFDVVVTSNLFGDVLSDCAAMLTGSIGMLPSASLDVNSKGLYEPVHGSAPDIAGKGLANPLATLLSVAMMLRYSLDQGALADRVQQAVGDVLNQGLRTPDIAARQSRTVSTAEMGDAVVAALRARG

SEQ ID NO: 44862 - protein, 272 aa, Nostoc sp. PCC 7120
MTIATSTKPQINWVNTLFFLGLHIGALFAFIPSNFSWAAVGVALLLYWITGGLGITLGFHRLVTHRSFQTPKWLEYFLVLCGTLACQGGPIEWVGTHRIHHLHSDTDPDPHDSNKGFWWSHIGWLIYHSPSHADVPRFTKDIAEDPVYQFLQKYFIFIQIALGLLLLYLGGWSFVVWGVFFRIVWVYHCTWLVNSATHKFGYRTYDAGDRSTNCWWVAVLVFGEGWHNNHHAFQYSARHGLEWWEVDLTWMTVQLLQILGLATNVKLADKKQ

SEQ ID NO: 44863 - protein, 337 aa, Spinacia oleracea
KLKVAINGFGRIGRNFLRCWHGRKDSPLDVVVINDTGGVKQASHLLKYDSILGTFDADVKTAGDSAISVDGKVIKVVSDRNPVNLPWGDMGIDLVIEGTGVFVDRDGAGKHLQAGAKKVLITAPGKGDIPTYVVGVNEEGYTHADTIISNASCTTNCLAPFVKVLDQKFGIIKGTMTTTHSYTGDQRLLDASHRDLRRARAACLNIVPTSTGAAKAVALVLPQLKGKLNGIALRVPTPNVSVVDLVVQVSKKTFAEEVNAAFRESADNELKGILSVCDEPLVSIDFRCTDVSSTIDSSLTMVMGDDMVKVIAWYDNEWGYSQRVVDLADIVANKWQA

SEQ ID NO: 44864 - protein, 303 aa, Solanum pimpinellifolium
MRSKDSKETTYISDTTSYRFPVESSQIPFAALQEATNNFNCNSLIGLGGFGTVYRGVLCDGTKVALKRCKLESSQGIEEFQTEIEMLSHFRHPYLVSLIGYCDENNVTILIFKYMENGSLSSHLYGSYLPTMTWEQRLEICIGAARGLYYLHKNAVIHRDVKSANILLDENFVAKTTDFGVSKTRTELDQTHVSTVVKGTLGYLDPEYVIRGKLTEKSDVYSFGVVLFKVLCARSAIVHYISKGLVTLAAWAMDSHKKGQLEQIVDPNLASKIRPKYLNKFGETAVKCLADSGVDRPSVGDVL

SEQ ID NO: 44865 - protein, 559 aa, Vibrio vulnificus YJ016
MSKKMFIRQAGNTLLNTPLLNKGSAFTLEERKNFNLIGLLPANIETIDEQVSRAYEQFSLFNSAMEKHIYLRNIQDTNETLYFRLINQHIEEMMPIIYTPTVGEACQKFSQIYRRNRGLFLSFEDQDELEAILNNAPNTHVKVIVITDGERILGLGDQGIGGMGIPIGKLALYTACGGISPEHTLPIVLDVGTNNSALLSDPMYMGWRHPRITGDQYDDFVDDCLKAIRRRWPNALIQFEDFAQANAMPLLMRYQNQFCCFNDDIQGTASVTVGTLLAAAHATGKKLSAQKVLFAGAGSAGCGIAEAIVAQMVSEGISVQQARSQVFMVDRWGMLEQEMPNLLPFQKPLAQPASLRTEWQIEANREISLLDVIQHAHPDVLIGVTGVPGLFNQEIIEAMAEDCERPVVMPLSNPTSRVEAKPEDILMWTQGQAIVATGSPFPDVVLAGKRYPIAQCNNSYIFPGVGLGVISANAHRVTNEMLQQASITLASLSPMLNGGNMLLPPLSEIQNVSRKIALEVAKKAVEQGKASHRTEERLLERIDEEFWYAQYCEYRRIAS

SEQ ID NO: 44866 - protein, 319 aa, Solanum pimpinellifolium
MGSKYSKATNSISDASNSRYGVPFENYRVPLVDLEEATNNFDDNFFIAEGGFGKVYRGVLRDGTKVALKRHNCDSQQSIEEFRTEIEILSRRSHPHLVSLIGYCDGRNEMILIYDYMENGNLKSHLYGSDLPSMSWEQRLEICIGAARGLHYLHTNGVMHRDVKSSNILLDENFVPKITDFGLSKTRPQLYQTHVSTDVKGTFGYIDPEYFIKGRLTEKSDVYSFGVVLFEVLCARSAIVQSLPSEMVNLAEWAVESHNNGQLEQIIDPNLAAKIRPESLRKFGETAVKCLALSSEDRPSMGDVLWKLEYALRLQESVI

SEQ ID NO: 44867 - protein, 209 aa, Neisseria gonorrhoeae FA 1090
MNLFQNAKFFTTVNHLKDLPDTPLEIAFVGRSNAGKSSAINTLTNHVRLAYVSKTPGRTQHINFFELQNGNFMVDLPGYGYAQVPEAVRAHWVNLLGDYLRHRKQLIGLVLIMDARHPLKELDIRMLDFFHTTGRPVHILLSKADKLSKNEQIKTLSQVKKLLKPYSDRQNISVQLFSSLKKQGIDEANRTVGSWFDAADAAASSPEEN

SEQ ID NO: 44868 - protein, 323 aa, Solanum pimpinellifolium
MGTNYSKPTTSINDASNLSNRVPFESFRVPFVDLQEATNNFDDKFLIGVGIFGKDYRGVLRDGTKVALKRHKPESPQGIEEFRTEIEILSHCSHPHLVSLIGYCDERNEMILIYEYMENGNLSKRLYGSDLCLPTMSWEQRLEICIGAARGLHYLHNSAVIHCDVKSTNILLDENFVAKITDFGISKTTPEFDQTHLSTVVQGSIGYIDPEYFIRGQLTKKSDVYSFGVVLFEVLCARPAIGRSHMISLAEWAVETQKMGQLEQIVDPTIVAKIRPESLRMFGETAVNCLASSSENRPSMGDVLWKLEYALRLQEPIIQDNPE

SEQ ID NO: 44869 - protein, 329 aa, Burkholderia pseudomallei K96243
MHAWSAQHVPPQGGKVAVVTGANSGLGWQIAQTLAAKGAQVVMGCRDTAKGELAAHAIRTRYPRARIEVEALDLADLASVCRFADAVADRHGRVDILCNNAGVMFLPLRHTRDGFEMQMGTNHLGHFALTGLLLPALRASHRARVVTMSSGFNRLGKIRLDNMLAERGYNKYRAYCDSKLANLMFTLELQRRFDQACLPILSVAAHPGYAATHLQFAGPEMANSSLGTFAMRLSNRLVAQSADVGALPAIHAATAVDVDGGAYIGPAHLCETRGYPAEARIPRQARDVRMGKRLWEKSEQLTGVRYLDTPPPPGSRRRASRDDATFGAL

SEQ ID NO: 44870 - protein, 233 aa, Photobacterium profundum
MTELTVNQPLNYRNTGFITSAPDIRHLPQDTGVEIAFAGRSNAGKSSALNRITDQKGLARTSKTPGRTQLINMFEVTQGCNLIDLPGYGFAQVPLELKIKWQKALGEYLQKRECLKGLVVLMDIRHPMKDLDQQMIFWAIESRLPVLVLLTKADKMKSGARKAQLLKVRESSKSFGGDVQIELFSSLKGIGLDQVRRKLDTWFGPELERQLMLAAAENGETYTGESLSDKSDD

SEQ ID NO: 44871 - protein, 490 aa, Xanthomonas campestris pv. campestris str. 8004
MPRFPDQLLYIGGRYVPARGGHTFEVVNPATGEVLANVHNADADDLDAAVDSAKAGQRHWAALTVVERSRILLRAVALLRERNDALAELETLNTGKPLSETRSVDIVTGADVLEYYAGVAQALQGVQVPLREGSFFYTRHEPLGVVGAIGAWNYPIQIALWKAAPALAAGNAMIFKPSEVTPLTALKLAEIFTEAGLPDGVFNVLPGDGASVGHALTEHPEIEKISFTGGTATGRKVMASASSSSLKDVTMELGGKSPLIVCADADLDLAADIAMMANFYSSGQVCTNGTRVFVPRALRTAFEARLLARVQRIHIGDPLDERTTFGPMVSAAHMQRVLEHIEQGKAEGARLLCGGERLRDGALAQGCYVAPTIFSDCTDVMTIVREEIFGPVLSLLTYDDEDEAITRANATSYGLAAGVVTPDLSRAHRLIHRLEAGICWINTWGESPAPMPVGGYKQSGVGRENGLATLQAYTRTKSVQVELERYASVF

SEQ ID NO: 44872 - protein, 53 aa, Oryza sativa (japonica cultivar-group)
GSVARLVRDNQTGRPKGFGFVKYSSQADAEKAVKAMDGRIIRGRLIFVEIAKE

SEQ ID NO: 44873 - protein, 827 aa, Propionibacterium acnes KPA171202
MKRLRGCALPILLTTLALAGCSSGRQTKGGGGGEANLKLPPLNEHVGNVSGTALLWIGLVICLFGLGFGLVTYSKLEKLPVHEAMHEVSELIYETCKTYLKQQAKFLMLLWAFIAAIIVVYFLLLEHMGAKVLIILLFSLVGMAGSFGVAWYGIRVNTFANSRTAHASLRGSPWATFDIPMRSGMSIGMVLISVELTLMLFIMLVLPGDLAGPCFIGFAIGESLGAACLRIAGGIFTKIADVGADLMKIAFHIKEDDARNPGVIADCTGDNAGDSVGPSADGFETYGVTGVALITFVLGAVPDQTEQVQLLVWIFVVRVVMLIASFVSYLINNAVAKARYGTVSEMDFEKPLSSLVWITSVMSILLTVLTTRWMLGSMGDGTMWWKLSIIISCGTLAGALIPELVKAFTSTNSRHVREVVTSAREGGASLDILSGLVAGNFSGFWLGIIIVALMGASFLVSGTGSGLGDMGTMSEVKWAVFAFGLVAFGFLGMGAVTIAVDSYGPVTDNAQSVYELSTIEDIPNVSDEFEKHYGFAPRWDIAKRILEAQDGAGNTFKATAKPVLIGTAVVGATTMIFSIIMMLTEGLSNAAEVNKLGLAHAPFLLGLITGGAVIYWFSGASMQAVTTGAYRAVEFIKNNMQLDQNATKASSKDSKKVVQICTEYAQKGMLNIFLGVFFAALGFAFVDPYFFIGYLISIAIFGLYQAIFMANAGGAWDNAKKIVEVDLDAKGTELHDASVVGDTVGDPFKDTSSVALNPVIKFTTLFGLLAVELAVSIGVGLLTYILAAVFILVACVFVYRSFYGMRIDSTKDPEEFGVVAKEAGSGS

SEQ ID NO: 44874 - protein, 340 aa, Glycine max
MSSVKELVESKCLSSVPSNYICLENPEDSILNYETDNIPTIDFSQLTSSNPSVRSKAIKQLGDACRDWGFFMLINHGVSEILRDEVIRTSQGFFDLTEKEKMEHAGRNLFDPIRYGTSFNVTVDKTLFWRDYLKCHVHPHFNAPSKPPGFSQTLEEYITKGRELVEELLEGISLSLGLEENFIHKRMNLDLGSQLLVINCYPPCPNPELVMGLPAHTDHGLLTLLMQNELGGLQIQHNGKWIPVHPLPNSFLINTGDHMEILTNGKYKSVVHRAVANTKATRISVGTAHGPKLDTIVGPAPELVGDDNTASYRAIKYSDYIELQQNHELDGKSCLDRIRI

SEQ ID NO: 44875 - protein, 57 aa, Zea mays
SNRGKRGIGFLPKNEISNGRWAMFGFAVGMLTEYATGSDFVQQMKILLSNFGIVDLD

SEQ ID NO: 44876 - protein, 110 aa, Brassica napus
MWKQILSKLPKKSSKNDHHHHRGREHGGGHSSSSSHASTSKSSDNGHGKSANSHTKNAPSGGRSAGNTNTNTNGGVFTPYEALPSFKDVPNTEKQNLFIKKLNLCRVVFD

SEQ ID NO: 44877 - protein, 363 aa, Buchnera aphidicola
MKKNYRIAVLSGDGIGPEVMQEACKILNVLKKYFFLSLEIQKFNIGGIAIEREGVALPKTTLLGCENSDSILLGSVGGKKWDNLPVEQRPERAALLPLRKHFNLFSNLRPAKLYPELKCLSPLRSDIVKNGFDILCVRELTGGIYFGEPKGFVNKNNTKYAFDTEIYHEYEIIRIAHLAFKLARSRKKKVCSIDKSNVLQSSILWREVVESVSKKYPDVHLSHLYIDNAAMQIIKDPNQFDVLLCSNLFGDIISDECATITGSIGMLPSASFNEKNFGLYEPAGGSAPDIEGKNIANPIAQILSLSMLVRYGMNLNQIADKIDKAVNNVLKKGYRTSDISHDNNFLKTDEMGDLIVDSLINGK

SEQ ID NO: 44878 - protein, 507 aa, Zea mays
  misc_feature (19)..(19): Xaa can be any naturally occurring amino acid
  misc_feature (38)..(38): Xaa can be any naturally occurring amino acid
  misc_feature (112)..(112): Xaa can be any naturally occurring amino acid
MGPPQPARPGVINIEACAXRPIAVDHRISLPYYFRIAXGLLRQANIYRNESNFLDLYVILLRYSSLLCETIPRHRDYHAFKLREKAFFDKLVDVIKELETLKPVVQRQIGQXNRGGTVESNMNSLNGDNGTTHRIEQHTPSSYTPQPFVGSTNGASQKSFHAGRQVASLLSVQKQYMNLPYPKEETLARHSILGPNGLNGRWNGPVTGIKVQYPSNFELTQNDITSLVPSILNQDDPQGPSTAPPPPDSPSNDNDDMKSVLSLDDGRWSVSADEHTSFTSANLEEELLQLNIKQPSPPPVLAEVQRPISPSRVADPTPGLPTSGTARFQNLHVPIKLMDCFLRVAESNTKRSLETCGVLAGTLKNRTFYVTTLIIPKQKSTSVTCEATNEEELFEVQDMGSLFTLGWIHTHPTQSCFLSSVDLHNHYSYQVMLPEAIAIVMAPTDTTRKHGIFHLTDPGGMGVIHDCQERGFHPHKAPLDGSPIYKQCSHVYMDTDIKFDMIDLRER

SEQ ID NO: 44879 - protein, 479 aa, Methanosarcina mazei Go1
MVAMKMQINGKAAGSCGGECFDVRNPATCELLEQVPRGTEEDVALAVEAALSAFEGWASISPQQRGMVFYRAAGLVRQRKEELAALLTQEQGKPLAEARNELEGFSHVLEYYCGLAGSLRGDFIPVTGNGYSFTVKKPLGVCAAIIPWNMPALIMGWKIAPALISGNTFVLKPASSTPLTNLTLASILNEAGLPAGVLNVVTGSGEIAGESLVRSPDVRKISFTGESGTGKRISELAASGMKRVTLELGGSDPMIVCDDANLESAVAGAIRGRFYNCGQTCTAVKRLYVFESVAREFIRKLEEGVKRLKVGNGLDKDTDMGPLNNHSQFEYIKELVAGIEEKGEGRIIAGGKAPSFKGMGKGYFFEPTLVSDVPGDSRLLKEEVFGPLLPIVTVRNLDEAIEEANRSIYGLGASIWTKDLDRIRMGCEQLNAGIIWVNQHLKVAPEVPFGGVKESGFGRENGPDILSEYLETRTIMLKT

SEQ ID NO: 44880 - protein, 303 aa, Solanum lycopersicum
MRSKDSKETTYISDTTSYRFPVESSRIPFAALQEATNNFNCNSLIGLGGFGTVYRGVLCDGTKVALKRCKLESSQGIEEFQTEIEMLSHFRHPYLVSLIGYCDENNVTILIFKYMENGSLSSHLYGSYLLTMTWEQRLEICIGAARGLHYLHKNAVIHRDVKSANILLDENFVAKTTDFGVSKTRTELDQTHVSTVVKGTLGYLDPEYVIRGKLTEKSDAYSFGVVLFEVLCARSAIGHYISKGMVTLAAWAMDSHKKGQLEQIVDPNLAAKIRQEYLNKFGETTVKCLADSGVDRPSVGDVL

SEQ ID NO: 44881 - protein, 319 aa, Solanum lycopersicum
MGSKYSKATNSISDASNSRYGVPFENYRVPLVDLEEATNNFDDNFFIAEGGFGKVYRGVLRDGTKVALKRHNCDSQQSIEEFRTEIDILSRRSHPHLVSLIGYCDERNEMILIYDYMENGNLKSHLYGSDLPSMSWEQRLEICIGAARVLHYLHTNGVMHRDVKSSNILLDENFVPKITDFGLSKTRPQLYQTHLSTVVQGTLGYLDPEYFIKGRLTEKSDVYSFGVVLFEVLCARSAIVQSLPREMVNLAEWAVESHNNGQLEQMVDPNLAAKIRPESLRKFGETAVKCLALSSEDRPSMGDVLWKLEYALRLQESVI

SEQ ID NO: 44882 - protein, 323 aa, Solanum lycopersicum
MGTNYSKPTTSINDASNLSNRVPFESFRVPFVDLQEATNNFDDKFLIGVGIFGKVYRGVLRDGTKVALKRRKPESPQGIEEFRTEIEILSHCSHPHLVSLIGYCDERNEMILIYDYMENGNLSKRLYGSDLCLPTMSWEQRLEICIGAARGLHYLHNSAVIHRDVKSTNILLDENFVAKITDFGISKTTPEFDQTHLSTMVQGSIGYIDPEYFIRGQLTKKSDVYSFGVVLFEVLCARPAIGRSHMISLAEWAVETQKMGQLEQIVDPTIVAKIRPESLRMFGETAVKCLASSSENRPSMGDVLWKLEYALHLQEPIIQDNPE

SEQ ID NO: 44883 - protein, 542 aa, Bradyrhizobium japonicum USDA 110
MLGLMQDWPLLCHRIIEHAARIHGKQEVVTRSIEGPIHRTTYAEIHKRALKVSQMLERDGIKLGDRVATIAWNTWRHLEAWYGIMGIGAICHTVNPRLFPEQIAWIINHAQDRIVMTDITFVPILEKIADKLPSVERYVVLTDKAHMPETTLKNAVAYEDWIAQADGKFKWKDFDENTAAAMCYTSGTTGDPKGVLYSHRSNVLHALMANNVDALGTSASETMLPVVPLFHANSWGIAFSAPSQGTKLVMPGAKLDGASVYELLSTEKVTHTAGVPTVWLMLLQHMTANNLKLPHLKMVICGGSAMPRSMIKAFLDMGSNVRHAWGMTEMSPIGSVAALKPPFQNATGDARLDVLQMQGYAPFAVEMKITDDAGKELPWDGKTFGRLKVSGPAVAKAYYRLDANILDEDGFFDTGDVSTIDEDGYMRITDRSKDVIKSGGEWISSIDLENLAVGHPAVAEAAVIGVFHPKWDERPLLIVQLKQGQQASREDILKYMDGKIAKWWMPDDVAFVEGIPHTATGKILKTALRDQFKDYRFPNAAA

SEQ ID NO: 44884 - protein, 320 aa, Solanum lycopersicum
MGSKYSKATNSINDASNLSYGIPFENYRVPFVDLEEATNNFDDKFFIGEGGFGKVYRGVLRDGTKVALKKHKRESSQGIEEFETEIEILSFCSHPHLVSLIGFCDERNEMILIYDYMENGNLKSHLYGSDLPTMSMSWEQRLEICIGAARGLHYLHTNGVIHRDVKCTNILLDENFVPKITDFGISKTMPELDQTHLSTIVRGNIGYIAPEYALWGQLTEKSDVYSFGVVLFEVLCARPALYLSEMMSSDDETQKMGQLEQIVDPAIAAKIRPESLRMFGETAMKCLAPSSKNRPSMGDVLWKLEYALCLQEPTIQDDPE

SEQ ID NO: 44885 - protein, 211 aa, Zea mays
GGGVTWSPREQLPPGILGPIKNKPFLLEDGRLLCGSSVESWNSWGAWVEVTKDAGWTWRKYGPICIKGQPLGVIQPVPYRTDDGTIRVLLRSFETIGHVCMADSIDEGVTWSYVRETELPNPNSGIDGVKMKDGRVLLAYNTFSRGTLKLAVSLNDGDSWDEVMTLEDTKGMEFSYPAVIQSMDELIHVTYTYNRTQVKHVVLRPSSMVKL

SEQ ID NO: 44886 - protein, 213 aa, Pseudomonas fluorescens Pf-5
MQLKNPILGLCQQATFMLSAAKVDQCPDDEGFEVAFAGRSNAGKSSALNTLTHASLARTSKTPGRTQLLNFFKLDDDRRLVDLPGYGYAKVPIPLKQHWQRHLEAYLGSRESLKGLILMMDIRHPMTDFDLLMLDWAVASGMPMHILLTKADKLTYGAAKNTLLKVQSQIRKGWGEAVTIQLFSAPKRMGLEEAYTVLAGWMELADKGAEAEA

SEQ ID NO: 44887 - protein, 502 aa, Synechocystis sp. PCC 6803
MANKFETVKATKDGLAVRAELEHFAQIGWENIPEEDRDLRLKWLGIFFRPVTPGEFMLRFRIPHGLLTSQQLQVIGDIINRYGDRGNGDITTRQNLQVRGIKIEDIPDIFSKLESCGLTSVQSGMDNVRNITGSPVAGLEKDELIDTRDLVQGVQDMITNGGRGNPEFTNLPRKFNIAIEGSRDNSVHAEINDVAFVPAYREGILGFNVVVGGFFSSRRCEAAIPLDAWVQPDQQVVDLCRSILEIYRDHGLRANRQKSRLMWLIDEWGVAKFREEVAAKLPFPLLTAAPKDELDWDKRDHLGVHPQKQAGLNYVGLHVPVGRLYANDFFELSRLADTYGSGEVRLTVEQNLILVNVPDEKLEALLAEPLLTKFRVDPHNLQRSVVSCTGAQFCKFALIETKNRALAMVAALEKELTVPKPVRIHWTGCPNSCGQPQVADIGLMGTKVRKDGKTVDGADVYLGGKVGKDAHLGTCVHKSIPCDELQPLLAQILIEQFGAVRR

SEQ ID NO: 44888 - protein, 211 aa, Pseudomonas syringae pv. syringae B728a
MQLKNPILGLCQQATFMLSAAKVDQCPDDEGFEVAFAGRSNAGKSSALNTLTHASLARTSKTPGRTQLLNFFGLDEDRRLVDLPGYGYAKVPIPLKLHWQRHLEAYLGSRESLKGLILMMDIRHPMTDFDVLMLDWAIASNMPMHILLTKADKLTYGAAKNTLLKVQAEIRKGWGDAVSIQLFSAPKRMGLEEAYTVLADWMELEDKAPAE

SEQ ID NO: 44889 - protein, 369 aa, Synechococcus elongatus PCC 7942
MKSRAAIAWAAGQTADDREVDVQAPQAGEVMVKLVATGVCHTDAFTLSGADPEGIFPCILGHEGAGIVVEVGEGVTSVAVGDHVIPLYTPECGECKFCKSGKTNLCQAIRATQGKGLMPDGTSRFSLNGQPIYHFMGTSTFSEYTVLPEIAIAKINPAAALDKVCLLGCGITTGIGAVLNTAKVEPGSTVAVFGLGGVGLSVIQGAVLAKASRILAIDINPDKAEFAKQLGATDFINPKDYDRPIQEVIVELTDGGVDYSFEAIGNVNTMRAALESCHKGWGESTIIGVAGAGQEISTRPFQLVTGRVWRGSAFGGVKGRSQLPGYVEQYLNGQIKVDEFVTETRPLEEINEAFEDMHAGKVIRTVITF

SEQ ID NO: 44890 - protein, 185 aa, Oryza sativa (indica cultivar-group)
MDLLQNYYGLARPPKGDPENEGTEMATYSIGQHTKARSLSTGFSLVNGEVDDAEKPIRRRQKSDAEFSTREGNSGGVLMKAGPGLALRPKSGSRPEINNSQQDLVATAVPSYGDGLQAVRKSSSTPEFQDSDNSIASVWLKSKWNLKPDAFTLPLPILLLDSIPKPIFDTFPKQIAAWRNKAARD

SEQ ID NO: 44891 - protein, 514 aa, Nonomuraea sp. ATCC 39727
MTDARFFKIYTGELRVPMRQVHLSNGSSVTLYDTSGPYTDPAYEPDLRRGLPRLREQWVRERQAVGHPVTQVGCARRGLVTREMEFVAVREGVTPEFVRQEVAAGRAIIPANVNHPETEPMIIGREFLVKINANIGNSAVSSSIEEEVEKMTWATRWGADTIMDLSTGADIRETREWILRNSPVPVGTVPIYQALEKVKGRPELLSWEVYRDTLIEQCEQGVDYVTVHAGVRLAHVPLTAGRKTGIVSRGGSIMAAWCLAHHRESFLYENFAEMCEILARYDVSYSLGDGLRPGSIADANDEAQFAELRTLGELTGIAREHDVQVMIEGPGHVPMHKIKENVDLQRELCDDAPFYTLGPLVTDIAPGYDHITSGIGAAMIGWYGTAMLCYVTPKEHLGLPDKDDVKTGVITYKIAAHAADLAKGHPQAQAWDDALSDARFEFRWEDQFDLSLDPETARSFHDETLPAAPAKTAHFCSMCGPKFCSMRISHEIRDAGYAEKAAEFRRLGGTLYVE

SEQ ID NO: 44892 - protein, 283 aa, Nonomuraea sp. ATCC 39727
MSQTPPPQNQPYPGHTGEMAPEPRDEMRDYVGRALLDGKKALITGGDSGIGRAVAVAFAKEGADVAIAYLTEHEDAAHTRKLVEQAGRRCVLLPGDLADRAHCSSVVEQAVSELGGLDVLVNNVAYQAPVSGLEELDDEQWEHTFAVNIHSYYRVTKAALAHLREGAAIVNTSSINGLRGNKSLIDYAATKGAINAFTYSMAQNLVERGIRVNAVAPGPVWTPLIPATMPEEKVEKFGKQVPMGRAADPDEIAPSYVFFASNRLSSYYTGEVLAPIGGRDAAG

SEQ ID NO: 44893 - protein, 115 aa, Lactobacillus sakei subsp. sakei 23K
MNPLIQEITKSQLRSDIPSFRPGDSVRVHVRVVEGTRERIQLFEGVVIKRHGVGVSETYTVRKISSGVGVERTFPLHSPRVAKLEVTRHGRVRRAKLYYLRALRGKAARIKEARR

SEQ ID NO: 44894 - protein, 191 aa, Triticum aestivum
  misc_feature (157)..(157): Xaa can be any naturally occurring amino acid
MESSSSSLLLSSYAGNNKRARDADHEPVSSAEADAAKRMKPEYLLDLLDDDTDAAAAGDLASVMRSLEEEICADDLTPPQPELGFLLEASDDELGLPPAAGASSSSDDAGGWEPEEPAGVFGEQIWGFGDEIEGAYAFGGVAYSPEAAVAAAAAAAXWCDDVLGAGLIGFGEESFGPSDLEVLRQETMPAV

SEQ ID NO: 44895 - protein, 297 aa, Rhodopseudomonas palustris CGA009
MSTSPEHKRTALVTGANSGLGKAIVTALAADGLRVGLVARDRGRGEAALADVRAATGNQDLHLFVADLADQESIRALAQDVRARFDRLHLLINNAGTAFPERRLSPQGIERAFAINHLGPFLLTNLLLDLIKASAPARIVNVGTRIDAAIDFDDLNWDKRPYGMMKGYAQSKLGNLHFTFELARRLEGSGVTVNCVFPGVFKSNLGGTDGAQGLFWKLLAKLGGWAIPKPESAAQRVLYLANAPELESVSGQYYANRKTIPAPAQALDAEANRRLWEISERMTGLTQSQTVGDQAAT

SEQ ID NO: 44896 - protein, 292 aa, Thermoanaerobacter tengcongensis MB4
MNERYELNKNLAQMLKGGVIMDVTTPEEAIIAEKAGAVAVMALERVPADIRARGGVARMSDPKIIKEIKAAVSIPVMAKVRIGHFVEAQILEALGIDFIDESEVLTPADEMYHINKWDFKVPFVCGAKNLGEALRRIAEGASMIRTKGEAGTGNVVEAVRHMRMINAEIKRLTTLGEEELMAAAKELQAPYDLVKYVAQHGKLPVVNFAAGGIATPADAALMMQLGADGVFVGSGIFKSQNPEKMAAAIVKAVTYYDKPEILAEVSEGLGEAMTGIDIRQLEEKDLYATRGW

SEQ ID NO: 44897 - protein, 493 aa, Rhodopseudomonas palustris CGA009
MAGIWTRKSLSSLQIEAAAGDSGDGEVRHLKRSLSAVNLVALGVGGIIGAGIFVLTGHAAAANAGPAVSLSFLLGAITCAFAGLCYAEMASTVPVSGSAYTYAYATIGELVAWIIGWDLILEYAVGAITVAIGWSGYFVSLLGNFGIHLPPQFTTAPLAYDAATHAWSTTGAFLNLPAIAIVVAIATLLVIGIQESARFNNVIVGIKLTVIALFLIFAAPMVTPANWVTAANPDGAFIPPAQENGIFGWSGVLRGAAVVFFAFIGFDAVSTAAQEAKNPQRDMPLGILGSLAICTVLYVSVAFVLTGIVPYDRLNVPDPIAVGIDAAGIGWLSSIVKIGVVTGLTSVILVLMLGQTRVLRAMAHDGLMPRGAAATHPRFRTPHVATIGTGVIVAGLAGVLPIGLVGELVSIGTLFAFAVVCVGVLALRIKHPEQHRPFKVPAIWLVAPAGAIVSFILMLGLPLDTWIRLAVWLAIGLAIYFLYGRHHSKPARR

SEQ ID NO: 44898 - protein, 222 aa, Triticum aestivum
  misc_feature (61)..(61): Xaa can be any naturally occurring amino acid
  misc_feature (72)..(72): Xaa can be any naturally occurring amino acid
  misc_feature (124)..(124): Xaa can be any naturally occurring amino acid
  misc_feature (166)..(166): Xaa can be any naturally occurring amino acid
MKLEIMPRQRALEAGQREEAMEMSGLELWKHEKPPKIFPMPPPLPPLLAAPGAGGYDEATXLVPPLNFAMVXTIGIYRSGLPAAANFRFLKSLNLRSIVYLCPEPYPETNTEFLEKNGIKLHQXFGIEGRKEPFVEIPDEKIREALKVVLDVRNQPLLIHCKRGKXRTGCVVGCMRKLQKWCLSSVFDEYQRFAAAKVRSTDLRFMELFDVSSLKHLTNSHC

SEQ ID NO: 44899 - protein, 227 aa, Ralstonia metallidurans CH34
MSLLHQARFFTTVNHLRDLPATAVPEVAFAGRSNAGKSTAINILCNQKRLAFSSRTPGRTQHINFFTVAPVKAPDPVGFLVDLPGYGYAEVSGSAKFHWQGLLSDYVQARTQLSGLILMMDARRPFTDLDCQMVEWFLPTGKPIHVLLTKADKLTTSDNAKALRETRKVLADYAAQMENPPALTAQLFSSLKRRGIEEAQRVVAGWLALPEAQPAVAKSDTPDTPQG

SEQ ID NO: 44900 - protein, 124 aa, Glycine max
MSLNLELNLTCESPRKKEEGYGYDMNEKKSSRSSPGGLRELREDLFTDQPSKFNKKDSDGKILSPSWLSLSEDDYKEMVATVCMRCHMLVMLCKSSPSCPNCKFMHPPDQNPSKFLKRRCSLFC

SEQ ID NO: 44901 - protein, 389 aa, Haloarcula marismortui ATCC 43049
MTENVVVLGSGYAGAGAIKSFEDELDGQTDVDVTWISETDYHLVLHESHRCIRDPSVQENIAIPVHEIKQPSTSFIQDEVVGIDTDAQEVALADSDTVEYDYLLVGLGSQTAFFGIEGLKEHALTLKSLDDALEIHDKIQQAAREASTNDPAQVVIGGAGLSGIQTAGEVAEFRDEHNAPIDIHLVEGLDQVLPNSDPELQGALRKRLEAADVNIKCGEFIGEVDEETVYIGDEDELEYDVLVWTGGITGRDCMQDVDLDKDERNHRVHAEGNFQTEDEHVFAIGDSALIDQPGDQPAPPTAQAAWQAAEVAGENLARAVRGQPLKTWTHKDKGTVVSVGEKAVAHDVVNMPIETFGGMPAKLLKKAIAARWINDMTGVGRAAKAWPDM

SEQ ID NO: 44902 - protein, 801 aa, Magnetococcus sp. MC-1
MTTISQPLRHTLIVAIIAIVALALLLDRLYEYQVVMAREIENQQLAEMHDSCYVLANDYSRYLLANKQSELRFSVASQGTRISLERLAVSNSEGIVIASSRSSDIDRKIAEIAPLFRLQDAQEARTHNQIVTRLSDDHNSVLGYVPVEMPSPTHSIRAQTRGLLFIHNTLHTLKAASWQNLTSPQSLLRWLVTFFLVTVLLLILLNRVLFRPLEHLEQMATRLAEGDWQATSTLSGKSELAHLGQVLNTMQRHILQERRSLQQSESRFRTLVETSPIPMLVTRAAPNQRVALMNRSFTDLFGYTVADVPDIHHWWPLAYPDPTYRQEIQQLWQARVEEMSLKKTQIMHPVTANVTCNNGNIRFIEVHMSVIDDHALVIFQDLTHRKQESEELRQAKEAAEAANQAKGDFLAVMSHEIRTPMNVMLGMVEVLQESTLDQEQQEQLHSVQKAGKNLLALINQILDLSKLDAGHLQLQPEALNLHELIKEVVGLVAVLASEKNLLLSHQIDTSVPQWILADELRLRQILFNLLGNAIKFTEKGSVNITLSMRDPQQLALVIRDTGIGVDPAHHHAIFEPFTQQDGTITRRFGGTGLGLTLSRRLVELMHGQIRMDSQLGCGTQFEILLPVERTQPPRSDQPQALSLGIIEAHPALAPTDTLCPRLDPALNLLLAEDSPDNQSLIKAYLKRTPHILTIVANGEEAVTAVGNGSYDLLLMDIQMPIMDGYTATRTIRQWEKAEARTPMLIVALTAHALVGDRERSLAEGCDLHLTKPIRKKDLLALLESIAQRLVRQDHQPPAETL

SEQ ID NO: 44903 - protein, 511 aa, Pelargonium x hortorum
MYNMSLYLLLGSSALAFAAYLVLFSFSKSRRRLPPGPKAWPIVGNLPHMGSMPHQNLAAMARTYGPLVYLRLGFVDVVVALSASMASQFLKTHDSNFSSRPPNAGAKHIAYNYHDLVFAPYGPRWRLFRKITSIHLFSGKALDDYRHVRQEEVGVLASNLARAVSTIVNLGQLLNICATNALGRAVIGKKVFKDGTDDVDPKADEFKSMVVELMVLAGVFNIGDFIPPLDCLDLQGVASKMKNLHKRFDAFLSAILQEHNINSAASATPSMLTTLISLKDSVEDSEGGKLTDTEIKALLLNMFTAGTDTTSSTVEWAIAELIRQPEILIRAQKEIDSVVGRDRLVTELDLSKLPYLQAIVKETFRLHSSTPLSLPRIATQSCEINGYHIPKGATLLVNVWAIARDPDVWADPLSFRPERFLPGSEKENVDVKGNDFELIPFGAGRRICAGMSLGLRMVQLLTATLLHAFNWDLPQGQIPQELNMDEAYGLTLQRASPLHVRPRPRLPSHLY

SEQ ID NO: 44904 - protein, 275 aa, Colwellia psychrerythraea 34H
MTQQTPDQYRVFGNPIEQSKSPAIHHIFADKSQQNIDYQKQLVDTKDFSNAVADFIRHGGKGANVTAPFKEQALAIADELTERATLAGAVNTLTFKNGKIFGDNTDGEGLVQDLITNKVILNESRVLLLGAGGAARGVLLPLLAQNPRSIVIANRTASKAATLCQHFSDIRLSASGYQDLEQQHFDVIINATSASLSGNLPPIPTSLLSQNVVCYDMVYGKDETPFLKWAKEHGAMKVIDGLGMLVGQAAVSFEVWRGVTPEVQPVIDKLRASLK

SEQ ID NO: 44905 - protein, 164 aa, Gibberella zeae PH-1
MSSSASGDSGGGRSMESRVGRSKQRYNTKGERLVAGIVPLTSDQNYVLLIQSTRRKGWVLPKGGWESDETCQEAAEREAWEEAGITVQISYDLGDIDEKRAPKSSSKDRSRYHFFEGTVTGEFDEWPESHKRERQWFTFTQAWEALSTRPELQEALQRSTVKRQ

SEQ ID NO: 44906 - protein, 132 aa, Haloarcula marismortui ATCC 43049
MMGPHSPRRYAFIADAVSGGMAFEPEELSPEEVTEQVDSVIEDNEVVLFMKGNELMPQCGYSKKALALLQQHRDDIETVDVLKATDAYREALERHSGRETIPQTFVDGEFIGGSDILEQLDERGELAQKVGQ

SEQ ID NO: 44907 - protein, 723 aa, Solibacter usitatus Ellin6076
MGNRPENQMPRTILPGKPYPQGATWDGTGVNVALYSERATRVELNLFDEVDAPASECITLRESSGYVWHGYLPGVKLGQLYGYRVHGPFDPENGDRFNPAKLLIDPYARAIAGSLNWKAPVFGYRLGDPAEDLSLDSEDDAQGVPKSVVTTSHFDWENDRPPLTPLHDTILYEVHVKGFTAQHPGIPEEMRGTYAGLAHPTSVEYLKKLGVTAVELMPVQEFLDDKILVDRGLRNYWGYNSINFFAPAARYCRSGDRGEQIGAFKAMVKALHRAGIEVILDVVYNHTAEGNQMGPTLSFRGVDNATYYRLADNRRYYMDYTGTGNTLNVRHPQVLKLVMDSLRYWVEEMHVDGFRFDLAAALARELHEVDRLSAFFDIINQDPVISQVKLIAEPWDVGEGGYQVGKFPVLWAEWNGRYRDVVRRYWKGDDGQLAELGYRLTGSSDLYQRDGRHPTASINFITAHDGFTLRDLVSYNSKHNEDNGEDNRDGANENYSNNFGTEGDTTDPQILELRARQTRSLLLMLLLSQGVPMICGGDEIGRTQRGNNNSYAQDNEISWYDWKLDTTQQELLEFTTRLVELRRAHPNLHRRKFFQDRGIDPGTPDRDIDGQTEQDVMWLRPDGGEMTPEEWHQGWVRCIGLQLNGRTLDDVNGAGEPIIDDSFMLIFNPHHEPVQFYMPEQGPSWEVLFNSQFAQQTENPVIGPGQSYELIAHSAAILREVKE

SEQ ID NO: 44908 - protein, 335 aa, Triticum aestivum
MFEDVPAGRYAAAPALAARFEAGSDVSPIKYEVVASPLFMGSGSNAALEAQGMNMMSGMPSYADDHHHHQRKEGINHPQQEHGNPMASFLQHISTRTSAAMHASLDYSGLGALDKICQDGRAMEAASPFSLRSLPDFGSIGGYKPTKESTLVPPYMRSADRPDRSRQEQEILPARSSSSGSGPPAATDRKKRTSEERRESTVKKSKQEASTASPPKQPVPKVKLGEKITALQQIVSPFGKTDTASVLFETIKYIKFLHEQVQLLSEPYTNASRSKGNCNNLLPWGDRAEASKGEGEHDLRERGLCLVPVSWTPEVYRDGNAMDYWTPAYRGCLYR

SEQ ID NO: 44909 - protein, 210 aa, Solanum lycopersicum
MNIFETYYSDSLILTESSSSSSSSSFSEEEVILASNNPKKPAGRKKFRETRHPIYRGIRKRNSGKWVCEVREPNKKTRIWLGTFPTAEMAARAHDVAALALRGRSACLNFSDSAWRLPIPASSNSKDIQKAAAQAVEIFRSEEVSGESPETSENVQESSDFVDEEAIFFMPGLLANMAEGLMLPPPQCAEMGDHCVETDAYMITLWNYSI

SEQ ID NO: 44910 - protein, 484 aa, Xanthomonas oryzae pv. oryzae KACC10331
MLLHLQCVCAPGLAWWRRFTWSFLMSFESLGLAPFLLRALAEQGYETPTAIQQQAIPLVLAGHDLLAGAQTGTGKTAAFGLPLLQHLGTSPQPVNGPRKPRALILTPTRELATQVHDSLRGYSKYLRIPSAVIYGGVGMGNQLDTLRRGVDLLIACPGRLIDHIERRSVDLSGIEVLILDEADRMLDMGFLPSIKRILTKLPRQDRQTLLFSATFEENIKQLALEFMRNPMQIQVTPSNTVAESITHRVHPVDGARKRDLLLHLLAQDSREQTLVFARTKHGSDKLALFLEKSGIKTAAIHGNKSQGQRMRALSDFKAGRVTVLVATDIAARGIDIDQLPKVINYDLPMVAEDYVHRIGRTGRNGSTGEAISLVAQDEAKLLRQIVRMLGRDVEIRDVPGYEPQTPIRWGNSAPGRAEQPGGDRAPRKSHARRPHGDAPRQAHAHAGPKKPGGQRSGGPRQANAGPGAGRRDGGRGGQRPSGTR

SEQ ID NO: 44911 - protein, 570 aa, Zymomonas mobilis subsp. mobilis ZM4
MTQKHPQTLVVDAPLSDAERLKRESNFLRGTIAEDLNDGLTGGFNGDNSTLIRFHGMYQQDDRDIRAERAEEKLEPRYAMMLRCRLPGGIISPEQWLKMDSFASEKTLYGSIRLTNRQTFQFHGILKKDLKTVHHLLHESGLDSLATANDVNRNVLCTSNPVESDLHAEAYEWAKKISEHLLPQTHAYAEIWLDQEKLATTDQEPILGATYLPRKFKTTVVIPPQNDVDIYANDLNFIAISENDQLVGFNVLIGGGLSITIGDKTTHPGVAKDIGYIEKEKVLAVAEAVVTTQRDWGNRSNRKNARLRYTLERVGLDVFKAEVEKRAGVTFEASRPFTLTGRGDRFGWVKGIDNQWHLTLFVENGRLLDYPHRPLKSGIAEIAKVHKGDFRLTANQNLIVAGVSEEDKDTIEKIARDHGLLENISELRKNSMACVSFPTCPLAMAEAERFLPNFLTKVEAVMTKYDIADEYIVFRTTGCPNNCGRSLLAEIGLVGRAIGRYNLYIGGDRVGTRIPRLFRENITEDEILSEVDSLIGRWAKERDGKEAFGDFVVRAGIVKAVTDPAIDFYD

SEQ ID NO: 44912 - protein, 297 aa, Thermoanaerobacter tengcongensis MB4
MPVFKGSCVAIVTPFTENGVNFDKLGELIEWHIKEGTDAILICGTTGEASTMTDEEQKEAIKFTVEKVAKRIPVIAGTGSNNTAHAIELSEYAQSVGADALLVITPYYNKTTQKGLVAHFTEIARHVDIPIIIYNVPSRTSLNMLPETYLEVKKKAENVVGVKEASGDISQIAEIARIMGKSFEIYSGNDDQVIPIMSLGGLGVISVTANIIPAKIHEMTTAYLNGDIEKARDMQLELNPLNKALFIETNPIPVKTAMNLMGFGVGPLRLPLVEMSEKNLEYLKSVLRQYGLLKEEN

SEQ ID NO: 44913 - protein, 107 aa, Arabidopsis thaliana
  misc_feature (9)..(9): Xaa can be any naturally occurring amino acid
WIWDMCLLXVAVVLVQKVPIPAGVWDSSCTHLLLCTVSCHIYMCLSVGTLGVSNACAGFSISDLQWDIKLPVSFVEHKMRSVERRSGLRLVSLPPVVRYNPLQCGSM

SEQ ID NO: 44914 - protein, 302 aa, Zea mays
MAIISDFKEDETPQQSAAVGPGVEETLVAALERTGGALPFLQAAIDVAHRRSGLFRDPSAVSKVTAMAAAVRAQVETEERAAREVKRKAEEAERKAAVEAQKADMEAATATAEEKLEKDRMDADKAEEGNVRQPNAGNGLDLEKYSWTQQLPEVNITIPVPQGTKSRFVVVDIKKNHLKVVLKGQPPIIDGELYKPVKVDDCFWSIEDGKTLSILLTKHNQMEWWKSVIKGGPEVDTQKVEPENSKLSDLDPETRQTVEKMMFDQRQKQMGLPTSDEMQKQEILKKFMSEHPEMDFSKAKMP

SEQ ID NO: 44915 - protein, 370 aa, Oceanobacter sp. RED65
MSKRDYYEVLGVDRQADAKEIKRAYRKLAMKYHPDRNPDDADADAKFKEASEAYEILGDQEKRAAYDQFGHAGVDGSAGAGAGGFGGGNFSDIFGDVFGDIFGGGGGRRGGPQRGNDLKYNLELSLEEAVKGTEKTIKVPTLVDCEVCDGSGAKAGSKPTVCGTCNGQGQVRMQQGFFAVQQTCPTCQGQGTIIKDPCDSCHGQGVKEETKTLNVKIPPGVDNGDRIRLNGEGEAGAMGGPAGDLYVEAHIKPHSIFERDGRNLYCDVPISIADAALGGEIEVPTLDGRVNLKIPAETQSGKLFRLRGKGVLPVRGGPQGDLLCRVMVETPVNLNDKQKEILREFQASLKGEKHSPRKKTWFDNVKAFFE

SEQ ID NO: 44916 - protein, 343 aa, Bartonella quintana str. Toulouse
MNECLGDIAQALVCAGKGILAADESTATIGKRFESIGVESNEDNRRAYREMLFTAKEAMESAISGVILFDETVRQRASTGQMLTDLIRNAGALPGIKVDTGAKPLAAFPQEMITEGLDGLRERLKDYYALGARFAKWRAVIAIDAYALPTKGAISQNAQALARYAALCQEAGLVPIVEPEVLMDGASRQHSITRCFEVTQAVLNMVFKELFEARVLFEGMILKPNMVIDGKDARTASVEEVAEKTVRVLKQTVPAAVPGIAFLSGGQSDEEATAHLSAMNALGPLPWKLTFSYGRALQAAALKAWGSHHQNIALAQKAFCHRARMNHLAALGKWTKEQERSCA

SEQ ID NO: 44917 - protein, 397 aa, Bartonella quintana str. Toulouse
MGFRTLDDVDVTGKRVLVRVDFNVPMSQGKVCDETRLKRHKETLLELQKRGAKLILLSHCGRPKGQGEPEFSLRPVVRVLEKIINQPVAFAPDCVGVAAQTAIEALQNGGLLLLENVRFHPGEEKNDCSFAEALAHNGDLYVNDAFSVSHRAHASVEGITHLLPSYAGRSLQCELQALEKGLDNPKRPVVALVGGAKVSSKLFVLNHLVEKVDYLVIGGGMANSFLAAQGVHIGKSLCEHALMQTIKKVIEKAQEYQCTLLLPVDAVVGFRFEKGAPHRLYDIGDIPDDGMILDIGTRSIAHINEVIDKAATLVWNGPLGVFEMSPFDQGTIAVARHAAECSLTGKCVSIAGGGDTVFALNHAGVANDFTYLSTAGGAFLEWMEGKVLPGIFALRQA

SEQ ID NO: 44918 - protein, 340 aa, Bartonella quintana str. Toulouse
MTVRVAINGFGRIGRNILRAIVESGRQDIQVVAVNDLGSVETNAHLLRYDSVHGHFPGSVQVLGDAIDVGCGLIKVTSERDPAQLPWKALDIDIALECTGIFTARDKASAHLSAGAKRVLVSAPSEGADFTVVYGVNHQSLSKEHRVVSNASCTTNCLAPVAQVLHNTVGIEKGFMTTIHSYTGDQPVLDTMHRDLYRARAAALSMIPTSTGAAKAVGLVLPELKGLLDGVSIRVPTPNVSVVDLTFTAKRSTMVEEINTAICTAARGELKGILDYTEEKLVSCDFNHNPHSAIFHNDQTKVIDGKLCRVLVWYDNEWGFSNRMADTAVAFAKTVDEERT

SEQ ID NO: 44919 - protein, 515 aa, Thermus thermophilus HB27
MRYADRVAGISWETIEEVRRRLKERPALHFIAGEFVPSESGETFPSLDPATNEVLGVAARGGEREVDRAAKAAHEAFQRWSRTKAKERKRYLLRIAELIEKHADELAVMECLDAGQVLRIVRAQVARAAENFAFYAEYAEHAMEDRTFPVDRDWLYYTVRVPAGPVGIITPWNAPLMLSTWRIAPALAFGNTVVLKPAEWSPFTATKLAEILKEADLPPGVFNLVQGFGEEAGAALVAHPLVPLLTLTGETETGKIVMRNAADHLKRLSPELGGKSPALVFADADLERALDAVVFQIFSFNGERCTASSRLLVEEKIFEDFVGKVVERARAIRVGHPLDPETEVGPLIHPEHLQRVLGYVEAGKREGARLLVGGERAKTSFRGEDLSRGNYLLPTVFVGENHMKIAQEEIFGPVLVAIPFKDEEEALRKANDTKYGLAAYVFTRDLERAHRLALELEAGMVYLNSHNVRHLPTPFGGVKGSGDRREGGTYALDFYTDLKTIALPLRPPHVPKFGK

SEQ ID NO: 44920 - protein, 210 aa, Shigella flexneri
MTNLNYQQTHFVMSAPDIRHLPSDTGIEVAFAGRSNAGKSSALNTLTNQKSLARTSKTPGRTQLINLFEVADGKRLVDLPGYGYAEVPEEMKRKWQRALGEYLEKRQSLQGLVVLMDIRHPLKDLDQQMIEWAVDSNIAVLVLLTKADKLASGARKALLNMVREAVLAFNGDVQVETFSSLKKQGVDKLRQKLDTWFSEMQPVEETQDGE

SEQ ID NO: 44921 - protein, 512 aa, Medicago truncatula
MALFFLFLLTLLVLISCASCQLQEFISIDCGGTRSNYTDTTTGLTWISDSEIMKHGETVEVKNPNGNKVQYQKRRDFPTDSRKYCYTLEAEERRRYLVRATFQYGSLQNGDTYPQFQLYLDATKWATVSIYDESRIYVKEMIFRAPSNSVDVCICCATTGSPFISTIELRPLNLSMYATDFEDDFFLKVAARINFGAPTGDAVRYPEDPYDRIWESDLGKRQNFLVGVAAGTERINTTRNIAIETREYPPVKVMQSAVVGTKGLLSYRLNLEDFPGNARAYAYLAEIEDLSQNETRKFKLEQPFIADYSNAVVNIAENANGSYTLYEPSYMNVSLEFVLSFSFKRTPDSTRGPLLNAMEISKYQEIASKTFKQDSNFVNAFSSLSDEIIPKNEGDPCVPTPWEWVNCSTATPARITNINLSGRNLTGEIPRELNNMEALTELWLDRNLLTGQLPDMSNLINLKIMHLENNKLTGPLPTYLGSLPGLQALYIQNNSFTGDIPAGLLSTKITFM

SEQ ID NO: 44922 - protein, 237 aa, Arabidopsis thaliana
MRDPDIVQNTRSLILLRVLTHEKLIQSHRYFFVGWIHKNLSRFRRKIRRRFLHCDFSGFGFFPRRFLFGFVLEKMACVIYYGPDGELKTWPKEREKVEDIALRYSQLNEALRRKKSVTLYDFLNKKKDKTNLEKKAMITDNDDLKTCLKNVNVLKSPIADHYFNDQISQLIQSLEPHVSKVQERIRFVESQKHKETKLDHQSLASIYSLNQSLNPSQFTLFLYNHGDNTMSQIPVTA

SEQ ID NO: 44923 - protein, 117 aa, Oryza sativa (indica cultivar-group)
MEVFYYLVFGGLAAVVAGLELGKSAKDRVTTSQAFNSFKNNYVLVYSLMMSGDWLQGPYVYYLYSQYGFDKGDIGRLFIAGFGSSMLFGTIVGSLADKQYVSSSSISSPIVTDCAPR

SEQ ID NO: 44924 - protein, 101 aa, Medicago truncatula
MYVQYSEQDGKPLPKFGEWDVNDPSSAEGFTVIFNKARDDKKIASASGRFPSQRRYDSRTGRTNDNNKNLKASSKVIVKLGDLFTIGFVCRKNGFALALRR

SEQ ID NO: 44925 - protein, 454 aa, Neurospora crassa
MSNLPSEPEFEQAYKELAYTLENSSLFQKHPEYRTALTVASIPERVIQFRVVWEDDNGNVQVNRGYRVQFNSALGPYKGGLRLHPSVNLSILKFLGFEQIFKNALYGLSMGGGKGGADFDPKGKSDAEIRRFCCAFMAELHKHIGADTDVPAGDIGVGGREIGYMFGAYRKAANRFEGVLTGKGLSWGGSLIRPEATGYGLVYYVGHMLEYSGAGSYAGKRVALSGSGNVAQYAALKLIELGATVVSLSDSKGALVATGESGITVEDINAVMAIKEARQSLTSFQHAGHLKWIEGARPWLHVGKVDIALPCATQNEVSKEEAEGLLAAGCKFVAEGSNMGCTLEAIEVFENNRKEKKGEAVWYAPGKAANCGGVAVSGLEMAQNSQRLNWTQAEVDEKLKDIMKNAFFNGLNTAKTYVEAAEGELPSLVAGSNIAGFVKVAQAMHDQGDWWSKN

SEQ ID NO: 44926 - protein, 800 aa, Rhodopseudomonas palustris CGA009
MFDSGHASRANARGPGRRWTMIVFGAFLLALRRAGRQCSQRRLRHMRSTSGGPRVLLRRLRETMAEQVSAQERLDKIVVLIAANMVAEVCSVYVLRIDNTLELYATEGLNREAVHQTVLNAHEGLVGLVASEATPLNLSDAQSHPAFSFRPETGEEIYHSFLGVPILRAGNTLGVLVVQNRAKRTYVEEEVEALQTTAMVLAEMIASGELSALAQPGAEPAARHSIHKTGAVLSDGIALGHVVLHEPRVVITNYIAEDLPKEIKRLDAALAKLRSDLDRMLERGDFAEGGEHRDVLEAYRMFANDHGWSHKLHEAVATGLTAEAAVERVQSDTRARMLRSTDPYLRDRLHDLEDLGHRLMRQLVGQDHAPSREQLPDNAILIARSMGPAALLDYDRKRLRGLVLEEGTANSHVSIVARALGIAAIGEVPNAPGIADPGDAIIVDATSGSIYVRPSAEIEAAYAERVRFRARRQAQYSALRDLPCATKDGQPIDLMINAGLTIDLPHIEDTGSSGIGLFRTELQFMVGQSLPRSSDQLALYRAVLDAAGSKPVTFRTLDIGGDKALPYMETVVEENPALGWRAIRLGLDRPGLLRSQIRALLRAAAGRYLRVMFPMISEVAEFDAAKSIIERELTYLRQHGHTLPERVDVGTMLEVPALLYQLDELFKRADFVSVGSNDLFQFLFAVDRGNSKVSERFDTLSAPILRALRDIVRKARAAKRSLSLCGEMASQPLAALALIAIGYRSLSVSALAHGPVKAMILGLDLAKAEAMIGPLLDAPAGSVSIRDKLIEFAEAHQLAL

SEQ ID NO: 44927 - protein, 510 aa, 'Flavobacterium' lutescens
MSFELLKALGLDATNSGTYLGDGEWSSATGAGTISPRNPTTGEVIAQVQATTEADYETILARAQQAFKVWRTTPAPRRGEAIRLCGEALRRHKDALGSLVALEMGKSKPEGDGEVQEMIDIADFAVGQSRMLYGYTMHSERPGHRMYEQYQPLGIVGIISAFNFPVAVWAWNSFLAAICGDVCIWKPSNKTPLTAIASMRICNEALREGGFPDIFFLINDAGTALSEKLVEDKRVPLISFTGSTQVGRIVNQKVAARLGRCLLELGGNNAIILDETADLKLAVPGIVFGAVGTAGQRCTTTRRLIVHESIYDNVLATLIKAYKQVEGKIGDPLDAANLMGPLNSPEAVQQFLASIEKAKAAGGTVQTGGTAIDRPGNFVLPAIVTGLKNSDEVVQHETFAPILYVMKYSTLDEAIEMQNGVPQGLSSSIFTTNLKAAEKFLSAAGSDCGIANVNIGTSGAEIGGAFGGEKETGGGRESGSDAWKVYMRRQTNTINYSDSLPLAQGIKFDL

SEQ ID NO: 44928 - protein, 668 aa, Bartonella quintana str. Toulouse
MINTEQQNQMANAIRFLAIDAIEKANSGHPGLPMGAADIATVLYTKFLAHDPKNPHWPDRDRFVLSAGHGAMLLYALLYLSGYEDISLEDLKNFRQIGSKLAGHPEYGHAAGIETTTGPLGQGLANAVGMALGERLQNARFGDIINHYTYALVGDGCLMEGIAQEAISFAGHLKLHKLIVLWDDNNISIDGEISLADSTDQMARFKASGWNTYKVDGHDQGAIARAIEAAQNSDKPTLIACKTTIGFGAPNKAGTNKVHGAPLGTREIAETRIALGWEAEPFVIPADILDNWRLAGLNAAKKRQKWKEKFADLPLSERIEFERLMRGDLVGGFDGAIDAYKQKLVEDCPCVATRKASEMALEVINETVIETIGGSADLTGSNNTKSSQMKSISAEDFSGRYLHYGIREHAMGAVMNGLALHGGCIPYGGTFLCFSDYMRPAMRLSSLMGLRVIYVMTHDSIGLGEDGPTHQPVEHLAALRALPNHFVFRPADAMETVECWQLALKARNTPSTLALSRQNLPLLRQEYEKENLCMLGAYELLTASDDAQVTLFSSGSELQIAVKAQALLEENAIPTRVVSVPCFELFAQQSLSYQRALVGDAPIKIAIEAAIRQGWDRFIGSDGIFIGMEGFGASGTIDALYAHFGITCENVVATVEKELEKINKENVR

SEQ ID NO: 44929 - protein, 486 aa, Glycine max
MAASRRLRDLQSQPANKICVDCSQKNPQWASVSYGVFMCLECSGKHRGLGVHISFVRSVTMDSWSEIQIKKMEAGGNDKLNAFLTQYGIPKETDIVAKYNSNAAAVYRDRIQALADGRPWRDPPVVKEAVRSSASKGKPPLSAGNNNNGGWDNWDPDDGFGSARGGADLRRNQSTGDVRGFGGGGNVSRSKSTQDMYTRAELEASAANKEDFFARKRAENESRPEGLPPSQGGKYVGFGSGPAPNQTGVNQQNDYLSVVSQGFGKLSLAAANVVQAGTKEFSAKVKEGGYDYKVNETVNVVSQKTSEIGQRTWGIMKGVMALASQKVEEFARDNPNWMSDNWQRNESDRNGFYQEFNRENNGRNSSTREGQHSSGGQTNTFHSSSWDDWGHNDSRKEETAKGSAPQSSGGKFDNNYNSSSWDDWDQEDTRKKEPAKGSAAHSSDGWAGWDNAKDDGFDDIYGSASNNKGGAHNDKSGAAWTGGGFL

SEQ ID NO: 44930 - protein, 312 aa, Rhodopseudomonas palustris CGA009
MSDTAKRQPRVLCIGIPVRDLTFRIEAVPGRGNKVPASSFGEICGGNALNAAIGIARLGGKAQMCGPMGDASEAAAGFIFDKLAEEGIGSSGLIHMPGLVTPISAVLVDPTGERTIVTFRDPGLWKVALPDADTLLKDCDAILTESRCSSFVTPLCAEATRRGIPVVVDVDNAMSMNEGLLTAASHLICSAEALHGTAGIADDAEALKKLATLTHAFVAVTRGPKGTLWLDDKQQFRETPAFPVHSVDTLGAGDIFHGGFTVAYGEGQDIAHALRFASAAAALKCTRPGGAFACPTRAEVDELLAKSPVGAL

SEQ ID NO: 44931 - protein, 294 aa, Triticum aestivum
MEQYEKVEKIGEGTYGVVYKARDRTTNETIALKKIRLEQEDEGVPSTAIREISLLKEMQHGNIVKLHDVVHSEKRIWLVFEYLDLDLKKFMDSCPEFAKSPALIKSYLYQILRGVAYCHSHRVLHRDLKPQNLLIDRRTNALKLADFGLARAFGIPVRTFTHEVVTLWYRAPEILLGARQYSTPVDVWSVGCIFAEMVNQKPLFPGDSEIDELFKIFRVLGTPNEQTWPGVSSLPDYKSAFPRWQAEDLATVVPNLEPVGLDLLSKMLRFEPNKRITARQALEHEYFKDMEMVQ

SEQ ID NO: 44932 - protein, 121 aa, Glycine max
MATDEQVHKVSLKVLVNKEQNKVLFAEAGKDFVDALLSILTLPLGTIARLVAKESNIPPVKFGSLSSLYESVSHLEDKYLRTQKCKEMLLQPRNSMESYCQHVKLNIDDTEPTKYLGRDHA

SEQ ID NO: 44933 - protein, 1073 aa, Oceanobacter sp. RED65
MPKRTDIESILIIGAGPIVIGQACEFDYSGAQACKALREEGYKVILVNSNPATIMTDPSMADATYIEPITVEAVTKIIEQERPDVLLPTMGGQTALNCALGLEKAGVLEKYGVEMIGANADTIDKAEDRDRFDKAMKKIGLECPKASIAHTMEEAWEVQKDLGFPCIIRPSFTMGGSGGGIAYNKEEFEEICTRGLDLSPTNELLIDESLIGWKEYEMEVVRDKNDNCIIVCSIENFDPMGVHTGDSITVAPAQTLSDKELQIMRNASLAVLREIGVETGGSNVQFGINPDNGRMVVIEMNPRVSRSSALASKATGFPIAKIAAKLAIGYTLDELQNDITGGRTPASFEPSIDYVVTKIPRFTFEKFPQADARLTTQMKSVGEVMAIGRTQQESLQKALRGLEVGACGFDPKVNLEDPEAAREKVIAELNTPGAERIWYIGDAFRLGMTVEEIFSHCKVDPWFLVQIEDLIKEEAAVAESALTSLDEDRIFRLKRKGFSDERLAQLLSVSEKAFRKHRQKLGIRPVYKRVDTCAAEFATDTAYMYSTYEEECEANPSEREKIIVLGGGPNRIGQGIEFDYCCVHAALASKEEGYEAIMVNCNPETVSTDYDTSDRLYFEPLTLEDVLEIADKEKPKGVIVQYGGQTPLKLANELEAAGVPIIGTSPEAIDRAEDRERFQQMIQRLGMKQPKNSTVTSEQEAIQKAAEIGYPLVVRPSYVLGGRAMEIVNDETALVRYMTEAVKVSNDSPVLLDYFLNQAVEVDIDAVCDGEDVVIGAIMQHIEQAGIHSGDSACSLPPYSLPEDVQDEMRAQVAAMARELGVVGLMNTQLAYQDGEIYVIEVNPRASRTVPFVSKCIGTSLAAIAAKVMTGKTLKELGFTEEIVPNYYSVKEAVFPFNKFQGVDPILGPEMKSTGEVMGAGKTFGEAFLKAQMGAGEKLPTSGKVFVSVRDADKTGVIPVAKGLEALGFELVSTSGTYKALSEAGVKVERVNKVNEGRPHIVDMIKNDEIAMTVNTTEGPRAIADSAEIRRSALQHKVYYTTTLAGAEAVVKGLESGGLQSVARLQDLHAGMK

SEQ ID NO: 44934 - protein, 212 aa, Gossypium hirsutum
MKVVGAVNTVVLHPNQTELISGDQNGNIRVWDLTANSCSCELVPEVDTAARSLTVMWDGSLVVAANNHGTCYVWRLLRGNQTMTNFEPLHKLQAHSGYILKCLLSPEFCEPHRYLATASSDHTVKIWNVDGFTLEKTLIGHQRWVWDCVFSVDGAYLITEMVKLLHPWVSKPNPWFPSKIKEKIFIYHLRLPSPPCLAPFCSLFLFNRSHFG

SEQ ID NO: 44935 - protein, 252 aa, Oceanobacter sp. RED65
MAKYEDLEGKIVLITGGSGDLGRASVLEFGKQKCRVYFTYNSSKDSADELVASAEESGFEAFPIRCNISDKEQVNALVNDIVEKEGKIDVLVNNAGIYKDNLFTSMTDEEFEQVIQTNLYGTFYCTKSVVDVMYRNRCGAIVNVSSIAGVTNSFGQANYSAAKGAVVSFSRTLAAELAPKNIRVNTVAPGLIDSSMVKRIPRNIMKQTLSGIPVKRLGKPEEIAKAIAFLASEDSSYVVGQTLIADGGLIMR

SEQ ID NO: 44936 - protein, 472 aa, Pasteurella multocida subsp. multocida str. Pm70
MNKEIKTQVVVLGAGPAGYSAAFRCADLGLETVIVERYSTLGGVCLNVGCIPSKALLHVAKVIEEAKALAEHGIVFGEPSTDVNKIRGWKEKVINQLTGGLAGMAKQRKVQVVNGYGKFSGPNTIIVAGEEGETTIKFDHAIIAAGSRPIQLPFIPHEDPRIWDSTDALKLKEVPENLLIMGGGIIGLEMGTVYHALGSKIDVVEMFDQVIPAADKDMVQIYTKRVAKKFNLLLETKVTAVEAKEDGIYVSMEGKASETRRYDAVLVAIGRVPNGKLIDAGVAGVEVDDRGFIRTDKQMRTNVPHIFAIGDIVGQPMLAHKGVHEGHVAAEVIAGMKHYFDPKVIPSIAYTEPEVAWVGKTEKECKAEGIAYEVAKFPWAASGRAIASDCADGMTKLIFDKNTHRVIGGAIVGTNGGELLGEIGLAIEMGCDAEDLALTIHAHPTLHESVGLAAEVFEGSITDLPNPKAKKK

SEQ ID NO: 44937 - protein, 118 aa, Triticum aestivum
  misc_feature (7)..(7): Xaa can be any naturally occurring amino acid
  misc_feature (10)..(10): Xaa can be any naturally occurring amino acid
  misc_feature (16)..(16): Xaa can be any naturally occurring amino acid
  misc_feature (38)..(39): Xaa can be any naturally occurring amino acid
  misc_feature (44)..(44): Xaa can be any naturally occurring amino acid
  misc_feature (52)..(52): Xaa can be any naturally occurring amino acid
  misc_feature (62)..(62): Xaa can be any naturally occurring amino acid
  misc_feature (79)..(80): Xaa can be any naturally occurring amino acid
  misc_feature (83)..(83): Xaa can be any naturally occurring amino acid
  misc_feature (90)..(90): Xaa can be any naturally occurring amino acid
  misc_feature (98)..(98): Xaa can be any naturally occurring amino acid
  misc_feature (100)..(100): Xaa can be any naturally occurring amino acid
  misc_feature (106)..(107): Xaa can be any naturally occurring amino acid
  misc_feature (110)..(110): Xaa can be any naturally occurring amino acid
  misc_feature (114)..(114): Xaa can be any naturally occurring amino acid
MAPAVTXSSXTTVAPXQGLKSTAGLPVSRRTSASLGSXXNGGRXRCMQVWPXEGIKKYETLXYLPPLATEALLKQVDYXXRSXWVPCLEXARWLRFRXHXQSPGNXXGRXWTMXKHGA

SEQ ID NO: 44938 - protein, 439 aa, Xylella fastidiosa Ann-1
MFELLIVIALIFLNGFFAMSEMSLMTSRKSRLKQMAHSSKHAAKALTLAQNPESFLSTVQIGITLIGILTGLFGGDAIGTAIGQWLTALTPQLGEYTSIIGKTLSVALITFLTLIFGELVPKRLALTHSEKIASTIAVPMSVLARIAAPGVWVLAKSTQLVLRVFGFGKIPSSAVTEEEIRLLVAESHEAGVIDDYERNMMNRVMRLGDRTADSLMTPRNRIAWLDNSADLEHNLEIMREHQFSRYPVYRSSDQDIVGILEVKSVITRIDSQTQTTLSLFQELCEPVFVSESTHALKLLEIFREEQQSMALVVDEYGEILGLVTISDLMGAVIGRLQNVENTDEDALMVTREDGSFLIDGTLPIEELREVLGTELPDGEENNYHTLAGMCISYFGRIPHVGEYFDWAGWRIEIVDLDGARIDKLLLQRLNKEKNHVPHK

SEQ ID NO: 44939 - protein, 604 aa, Aspergillus nidulans FGSC A4
MTSRKTQQEIDKTFKKVAEGIQTFEGIYEKIRAATNPTQRDKLEENLKREIKKLQRYRDQIKSWASGNEVKDKGPLLEQRRAIETCMEQFKAVEKEMKTKAYSKEGLSAASRLDPKDKEKVETCDFLSNMVDELQQKIEAMEAEEESLQMSMKKGKKDVTKTNRLADLAHFIERHKWHNGNIETSQVVDLKESIKYYVEDGNQIDYAGEDETLYDDLNMGDDAEAQFGIGGDNDRVSSQDTQSMQDEEVEAKPKPKAEASATSHRRPSAQMKSPLPVLATLHPSSSSSSASGMKPAPPPTRLPGETLKYASAAAAAAASDKNGVGIAPLPPPPGASPAFPSAVPASKASSTASPVVTLAQPVPKATPAAAIVAEEGRSRTPAFSPKVSAAVSASNTVPSTPAMDKAETASTKPPAAANGESNKENQAGEESIYHLPPGLQDLIHSFEVTKNRASANPSSQPPSVQRLLTASAANCPEPGDSEKPRHYKPQNPYNTPLYYPQEPLAILDDPRLYETGRIDTDTLFYLFYYRQGSYQQYLAAKALKGQSWRFHKQYQTWFQRHEEPKTITEEFEQGTYRFFDYESTWMNRRKADFKFIYKYLEDEL

SEQ ID NO: 44940 - protein, 436 aa, Oryza sativa (indica cultivar-group)
MAFSARRSLASGLSRHLSRRLHPSVSHLLPSHHDDHSENPSPPAQPPPLPSALRSPSRSQALGLPLPFGLLHASRRSLSTSPRSNDELDASAEVLSDAASSVSVPADVLADAAASVPVSAPAPFPGEVAAAAADSFAPVAALQHLIDGVHSLTGLNWWACIALTSLLIRTLTVPLLLNQMKATAMRPEIEAINLEMRTISSTRVAGNEKSSTRVTDEGSMSTDPQSMLEGKRKLGELFLRHGVTPLTPLKGLFIQAPIFMSFFFAISNMVEKVPSFKGGGIYWFTDLTTPDELLILPMLTSLTFLVTVELNMQDGMEGNPMLKTMKNFSRVMAVLTIPFTMSFPKAIFFYWVTSNLFSLGYGFVLRKPAVRSFLDLPPIETQFAPAQQPTFNLFGASKSVPAAGSSIAESDRSSSVLSQRFSDLENRAKSRRESQD

SEQ ID NO: 44941 - protein, 163 aa, Oryza sativa
CRVGRNPGRPRVRFDVCVKAKGDTHIDDHHSNEDIALAIGTALLEALGDRKGINRFGHFTAPLDEAAVEVILDLSGRPHLSCGLSIPTERVGTYDTQLVEHFFQSLVNTSGMTLHIRQLAGKNSHHIIEATFKAFARALRQATEYDLRRRGTVPSSKGVLSRS

SEQ ID NO: 44942 - protein, 355 aa, male-killing Rickettsia from Adalia bipunctata
GFMSTASCRSTITYIGGDKGILRYRGYDIKDLAEKSDFLEVAYLLIYGELPSSEQYNNFTKKVAVHSLVNERLHYLFQTFCSSSHPMAIMLAAVGSLSAFYPDLLNFKEADYELTAIRMIAKIPTIAAMSYKYSIGQPFIYPDNSLDFTENFLHMMFAAPCEKYKVNPIIKNALNKIFILHADHEQNASTSTVRIAGSSGANPFACVSTGIASLWGPAHGGANEAVINMLKEIGSSENIPKYIAKAKDKNDPFRLMGFGHRVYKNYDLRAAVLKETCKEVLKELGQLDGNPLLQIAIELEAIALKDEYFIERKLYPNVDFYSGIIYKAMGIPSQMFTVLFAIARTVGWMAQWKEM

SEQ ID NO: 44943 - protein, 444 aa, Glycine max
MAVSAAKFDVVILGASGFTGKQVLKEALKFLNSNHFTSLAIAGRDPSKLAQTLKWAAQPNPPPQIPILAADTADPPSLRSLCDQTRLLLNCVGPFRRHGEPVVAACVACGCDYLDITGESEFMERVEREYHAEATKKGSLVVSACGFDSVPAEMGFLFHSRQWVGPARPNRVGAYLSLESDKRIVGNFGTFESAVMAVKDLKEMERSRVTRVIPEIPGPPPKGEIIEHQKKIGLWGVTLPSADATLVGRTLSTLTESPHGLPGLNENAEMVEKRKAYWTSVKPAHFGVKIGSKSLLHVFGFILIGIIIGVLGRTSFGRWLLLKYPSIFTFGGFSKNGPSEEEIASASFKMWFVGHGFSNESLAAQGNTKPDMEIITRVMGPEMGYVTTPIIMVQCALVLHGQRKNLPKGGVYTPGIVFGPTDLQERLQQNGISFDVISKSSISS

SEQ ID NO: 44944 - protein, 887 aa, Pasteurella multocida subsp. multocida str. Pm70
MSDMLKNDVDPVETNDWLLAIDAVIREEGVERAQYIIEQLMQHARANNVSLPTGITTDYINTIPASEEPNYPGNLDLERRIRGAIRWNAIMMVLRASKKDLELGGHMSSFQSSATIYEVCFNHFFKARSAKNGGDLVFFQGHISPGIYARAFLEGRLTEEQMDNFRQEVHGKGLSSYPHPKLMPEFWQFPTVSMGLGPLNAIYQARFLKYLHNRGLKDTADQTVYAFLGDGEMDEVESRGAISVAAREKLDNLVFVINCNLQRLDGPVTGNGKIIQELEGLFNGAGWEVIKVIWGRRWDRLLQRDTSGKLLQLMMEVVDGDYQTMKAKDGAYVRKHFFGRYPETEALVAEMTDDEIWALNRGGHDPLKIFAAFNKAKQVKGKPVVLLVKTIKGYGMGEAAEGKNIAHQVKKMDMSGVKHVRDRFNIDIADADIENLPYIKFAEGSEEYKYLHERRQALQGYLPTRLPRFTEQLEVPELEEFAQLFEAQARPISTTMAFVRSLNVLLKNKSVGKRIVPILADEARTFGMEGLFRQIGIYNPYGQNYTPQDREQVSYYREAIDGQVLQEGINEQGATASWLAAATSYSTNDFPMIPFYVYYSMFGFQRIGDLMWAAGDQQARGFMIGGTSGRTTLNGEGLQHEDGHSHIQSLTIPNCISYDPAFAFEVAVIMQDGVRRMYGPEQENIYYYITTLNETYDQPAMPKGAEEGIRKGIYKFETVTGQGKGKVQLLGSGAILRHVREAAQLLANDFGVTSDVYSVPSFTEVAREGADADRWNLLHPEAKARVPYIAQVMNDAPAVAATDYMKLFAEQVRAYVPAASYRVLGTDGFGRSDSRENLREHFEVDARYVAIAALSELAKQGTIDKKVVADAIQKYGIDADKVNPLYA

SEQ ID NO: 44945 - protein, 446 aa, Colwellia psychrerythraea 34H
MHNKHTMMSPSEQNSLLRFDKENVWHPYTSMSEPLPSYLVDSAEGVTINLASGERLIDGMSSWWSVLHGYNHPKLNAALVEQASKMSHVMFGGLTHQSAITLCEKLINLTPEGLDKVFLSDSGSVSVEVAMKMALQYQHAVAEKKKITLTKTKLLTVKNGYHGDTFAAMSVCDPITGMHQIFEQVLMQHFFAPAPTIKFGEQWSSDDVTELTALFAEHHNDIAAFIIEPIVQGTGGMRFYHPEYLKACRLLCDKYDVLLIVDEIATGFGRTGKLFACEWAGINPDIMCLGKTLTGGYITLAATLCTTHIAQTISEGAAGCFMHGPTFMGNALACAVANASIDLLLENDWQSQVQAIENTLVSHLKPLEKHARVKDTRVLGSIGAIECKQNVNVAQIQKRFVELGVWIRPFGQLIYIIPPLIITTEQLITLVNAMATVLDEDECFKC

SEQ ID NO: 44946 - protein, 251 aa, Pseudomonas syringae pv. syringae B728a
MRRPMVAGNWKMHGTRASVAELIEGLCKQSLPGSVDIAVMPASLFTCQVVDGLKATSIIVGAQDAAIQAEQGALTGEVASSQLADAGCKLVLVGHSERRQLIGEQDDVLNKKFAAIQAKGLTPVLCVGETLEERKAGQTLEVVGRQLDSVIAEFGVNALVNAVIAYEPVWAIGTGLTASPQEAQEVHAAIRAQLAKENAEVAQGVRLLYGGSVKAANAVELFSMPDIDGGLIGGASLNADEFGAICRAAGN

SEQ ID NO: 44947 - protein, 479 aa, Aspergillus oryzae
MPDEKVRTPALDSYFAFTANLGTHTFFMVFLPILFWNGYTSLGRGMVNLLASGVYFSGFIKDLLCLPRPLSPPLQRITMSGSAALEYGFPSTHSTNAVSVAVYALALLNLPDSTLSPAVNVFLQGITYLYVTSIVFGRLYCGMHGFFDVVIGCLLGSLLAVIQYAYGTAFDEFVVSASGKQIMLVVLVILALIRLHPEPADDCPCFDDSVAFAGVILGLQVAYWHVVKTDITWDDPVPATVPYRFEDLGVLKTAMRLILGVALIVVWREVMKPSLLRVLPPVFRGLEKLGLLLPRRFFTAASQYTKVPTQLKDHEVFPTFSEIPSIFSNIRHPRRRAISVGPQSEADAYETLAYREKRRRESLSNSNRTSPLVEEDSRQDISEGHHPQLSRKRSKLHEYETMMGTGNPRLATGVDGAEAPPLTEPFPDLVLDPEPDEEEMFARIKRPRVRYDVEVVTKLVVYSGMWFFSFLFLPISDHD

SEQ ID NO: 44948 - protein, 227 aa, Aspergillus oryzae
MSEATNITQPPAYSKKFVVVGDGGCGKTCLLISYSQGYFPEKYVPTVFENYITQTVHRASGKTVELALWDTAGQEEYDRLRPLSYPETDLLFVCFAIDCPASLENVMDKWYPEVLHFCPTTPIILVGLKSDLRNKRTCIELLKTQGLTPVTPEQGQTVARRMNASYIECSSKEMRGVDGVFEMAVDTVVSAEEQFSWNNRQNHSASGKATGGGGGPKKVKKRTCKIL

SEQ ID NO: 44949 - protein, 575 aa, Pasteurella multocida subsp. multocida str. Pm70
MISGIPASPGIVFGKALVLKEEKIVLDMQKISESQIDSEIARFYQGRNAAVEQLSAIRDRAAKTLGEEKAAIFEGHLMILEDEELEEEIIDYLRTNKVNAGVAASKIIDQQVTMLSEIDDEYLRERAGDIRDIGNRLIKNILGMHIVDLGDINEEAILVAYDLTPSETAQLNLDKVLGFITDIGGRTSHTSIMARSLELPAIVGTNHVTSQVNTGDYLILDAVNNVVYVNPSQDEITRLKGLQQKLLEEKAELAKLKDLPALTLDGHRVDVVANIGTIRDVDGADRNGAEGVGLYRTEFLFMDREQLPTEEEQFVAYKDVVEAMNGRLVILRTMDIGGDKELPYLNLPKEMNPFLGWRAIRIALDRREILHAQLRAVLRASAFGKLAVMFPMIISVEEIRELKSVIETLKQELRNEGKAFDESIQIGVMVETPSAAVNAKFLAKEVDFFSIGTNDLTQYTLAVDRGNELISHLYNPMSPSVLSLIKQVIDASHAEGKWTGMCGELAGDEKAAVLLLGMGLDEFSMSAISVPRIKKLIRNVNYEDTKALAMKALQQPTAVEIEQLVEDFLAEKALN

SEQ ID NO: 44950 - protein, 166 aa, Olea europaea
LASMTSVLLGYDIGVMSGAAIYIKDQLHVSDVKLEIVVGIINFFSLVGSALAGRTSDWIGRRYTMVLAGAIFFVGAILMGFATNYSFLMFGRFVAGIGVGYALMIAPVYTAEVSPASSRGLLTSFPGSFINIGVLLGYVSNYAFSKLPANLGWRFMLGIGAIPSIG

SEQ ID NO: 44951 - protein, 251 aa, Triticum aestivum
MDHAADAQRTDLMTITRHALNEQGRHPESRGDFTILLSHIVLGCKFVASAVNKAGLAKLIGLAGETNVQGEEQKKLDVLSNEVFVKALVSSGRTCVLVSEENEAAIFVDAPLRGKYCVCFDPLDGSSNIDCGVSIGTIFGIYMIKDKDNATLEDVLQPGTDMIAAGYRMYRSSCTLVLSTGNGVNGFTLDPSLGEFILTHPNIKIPNKGKIYSVNEGNARNWDAPTANQHCRYVERCKFPQDGSSPKSLRY

SEQ ID NO: 44952 - protein, 197 aa, Wolbachia endosymbiont strain TRS of Brugia malayi
MVRRITLNSNFMFGASDIKSLPNESAPEIAFAGRSNVGKSSLINLLINSKKAARVSSKPGCTRQINFYSMYNDKFRLVDLPGYGCSHASKDETIQYLGLVEYYLIHRRNLRRVFVLIDSKVRLKEIDKDFIYWLTYNNINFDVVLTKIDKVDRENLDAIIESTRKWINNESVSIRQISVRVKYEMTKVRDEFFKFTR

SEQ ID NO: 44953 - protein, 95 aa, Zea mays
  misc_feature (62)..(62): Xaa can be any naturally occurring amino acid
ADLVADEIAVQAAFFFFGTNDLTQMTFGYIRDEVGKFIPDYLAQGILQHDPFEVLDQRGVGXLVKLATQRGRRARTNLKVGICCEHRGKPSPVVF

SEQ ID NO: 44954 - protein, 322 aa, Desulfitobacterium hafniense DCB-2
MKQLWLFNQINSDLQRVEKELHAYIKTDFPILDQSAVQLLEAGGKRLRPAFTLLAGKFYGYPIDRLLPVAMALELIHMATLVHDDVVDASMTRRGRPTVKAKWGNVVSIATGDYLLAKALELLAQINHPEVSKILAEVSVEMSQGEIQQIKASNDVNQNLKQYYYRIKRKTAMLISASCKLGALISAAPRREVWALGAYGHALGMAFQIVDDVLDVTAEASELGKPVGGDIRQGIMTLPLILALHQSGERERLHELLVKPEKDEDDVREAIKMIKDSGAIADSMHYVDLYISKANSYLQELPNVPTRKALVDLAYFVKERKF

SEQ ID NO: 44955 - protein, 207 aa, Xanthomonas campestris pv. vesicatoria str. 85-10
MSLLIEQARYHLSAHNARQLPDDGGYEVAFAGRSNAGKSSALNALTRQNALARVSKTPGRTQQLVFFQIQPERYLVDLPGYGYAKVPQDLQAHWQAFIDRYFRTREALRGLVVVMDIRHPLKDYDLQMLGYAAERGLPAHGLLTKADKLGRGQQMQTLQKVKKEVTSRFGDSVTVQTYSGESRQGVDELRAIVGAWLGLDVETTAAE

SEQ ID NO: 44956 - protein, 1073 aa, Pseudomonas syringae pv. syringae B728a
MPKRTDIKSILILGAGPIVIGQACEFDYSGAQACKALREEGYRVILVNSNPATIMTDPAMADATYIEPIKWQTVAKIIEKERPDALLPTMGGQTALNCALDLEREGVLEKFGVEMIGANADTIDKAEDRSRFDKAMKSIGLACPRSGIAHSMEEANAVLEKLGFPCIIRPSFTMGGTGGGIAYNREEFEEICARGLDLSPTKELLIDESLIGWKEYEMEVVRDKKDNCIIVCSIENFDPMGVHTGDSITVAPAQTLTDKEYQILRNASLAVLREIGVETGGSNVQFGICPNTGRMVVIEMNPRVSRSSALASKATGFPIARVAAKLAVGYTLDELSNEITGGKTPASFEPSIDYVVTKLPRFAFEKFAKADARLTTQMKSVGEVMAIGRTFQESLQKALRGLEVGVCGLDPKLDLSHPESMSTLKRELTVPGAERIWYVADAFRAGMTVEEIFAMNMIDPWFLVQIEDLIKDEEKIKTLGLSAIDRDVMFRLKRKGFSDARLAKLLGVTEKNLRTHRHKLEVFPVYKRVDTCAAEFATDTAYLYSTYEEECEANPSTRDKIMILGGGPNRIGQGIEFDYCCVHAALALREDGYETIMVNCNPETVSTDYDTSDRLYFEPVTLEDVLEIVRVEKPKGVIVQYGGQTPLKLARALEAAGVPIIGTSPDAIDRAEDRERFQHMVERLNLRQPPNATVRSEDEAIRAAAKIGYPLVVRPSYVLGGRAMEIVYQEDELKRYLREAVQVSNDSPVLLDHFLNCAIEMDVDAVCDGTDVVIGAIMQHIEQAGVHSGDSACSLPPYSLPAHIQDEMREQVKKMALELGVVGLMNVQLALQGEDIYVIEVNPRASRTVPFVSKCIGVSLAMIAARVMAGKTLKELNFTKEIIPNFYSVKEAVFPFAKFPGVDPILGPEMKSTGEVMGVGDTFGEAFAKAQMGASEVLPTGGTAFISVRDDDKPLVEAVARDLINLGFEIVATAGTAKLIEAAGLKVRRVNKVTEGRPHVVDMIKNDEVTLIINTTEGRQSIADSYSIRRNALQHKIYCTTTIAAGEAICEALKFGPEKTVRRLQDLHAGLKA

SEQ ID NO: 44957 - protein, 352 aa, Oryza minuta
MGKPGKLALPSHESTIGKFLTQSGTFKDGDLLVNKDGLRIVSQSEEGEAPPIEPLDHNQLSLDDLDAIKVIGKGSSGIVQLVRHKWTGQFFALKVIQLNIQENIRRQIAQELKISLSTQCQYVVACCQCFYVNGVISIVLEYMDGGSLSDFLKTVKTIPEPYLAAICKQVLKGLMYLHHEKRIIHRDLKPSNILINHMGEVKISDFGVSAIIASSSAQRDTFTGTYNYMAPERISGQKHGYMSDIWSLGLVILELATGEFPYPRRESFYELLEAVVEHPPPSASADQFTEEFCSFVSACLQKKASDRSSAQILLNHPFLSMYDDLNIDLASYFTTAGSPLATFNTSNRYDDR

SEQ ID NO: 44958 - protein, 444 aa, Synechocystis sp. PCC 6803
MITSPTNLNSLPIPPGDFGLPWLGETLNFLNDGDFGKKRQQQFGPIFKTRLFGKNVIFISGALANRFLFTKEQETFQATWPLSTRILLGPNALATQMGEIHRSRRKILYQAFLPRTLDSYLPKMDGIVQGYLEQWGKANEVIWYPQLRRMTFDVAATLFMGEKVSQNPQLFPWFETYIQGLFSLPIPLPNTLFGKSQRARALLLAELEKIIKARQQQPPSEEDALGILLAARDDNNQPLSLPELKDQILLLLFAGHETLTSALSSFCLLLGQHSDIRERVRQEQNKLQLSQELTAETLKKMPYLDQVLQEVLRLIPPVGGGFRELIQDCQFQGFHFPKGWLVSYQISQTHADPDLYPDPEKFDPERFTPDGSATHNPPFAHVPFGGGLRECLGKEFARLEMKLFATRLIQQFDWTLLPGQNLELVVTPSPRPKDNLRVKLHSLM

SEQ ID NO: 44959 - protein, 161 aa, Glycine max
  misc_feature (133)..(133): Xaa can be any naturally occurring amino acid
  misc_feature (142)..(142): Xaa can be any naturally occurring amino acid
  misc_feature (145)..(145): Xaa can be any naturally occurring amino acid
MACLMSRTGREMQRYNSSGGRQVVGCIPYRYKEDNDGNVSNELEVLVVSSQKGQALMFPKGGWELDESVEEAASRESLEEAGVTGIVQHELGQWSFISKRLGTYYEGHMFPLLVKEQLDLWPEKDLRRRIWDXLMKPREVCXHWXMKGSITFSLERTLQEK

SEQ ID NO: 44960 - protein, 543 aa, Oryza sativa (japonica cultivar-group)
MAMSATSSNLIVYLVHKYNVKAIHAAQISNVVRGCMQLAPVLAAALSDAFFGPYPIAVAGLVFSLLSFVLFTLTAALPSLLPPPCQRGAGGGGATATSCEPPNAAQSAVLYAALCLLAAGNGGTRYNMAALGADQFAGEGQPRRRRQGGGFFSCYFAFLYASYATGDTVLVYVQDGVSWALGFGVCVATTGLALAALLLGSRHYRRPVPKGSPFTAMARVAVAAARKATVDLGSRVQYYHGCNRDDAVPRADQAPSDRFRFLNRAAMVVAGETREEDGSVAKPWRLCTVQQVEDVKSVVRVLPLWSSGILVSVTVNAQVSLTVLQALTMDRAVGPRFAVPAASITVTVLAAFVLAAALFDRVAAPLCAAAGKLAITPLRRVGLGHALNVASMAVAALVERRRIGAARGRAAAAAAVVPMSVLWLVPQLALTGAEEALHLPGNTALFYGELPASLRGTATAMPPLFIAAGSYLSAAAVDAVKRGTTWLPDDLNASRLDCVYWTLAVLAAVNLGYFLLCATTYKYNNYGGDDGNVKAQTQTDDVS

SEQ ID NO: 44961 - protein, 474 aa, Pseudomonas putida KT2440
MQTQMLINGQLVAGQGPAWTVLNPALGTALAQINEATEAQVDSAVRAADQAFDSWSQTSPKERSQALLALADAIEAHGDELARLESQNCGKPLSAALNDEIPAIADVFRFFAGAARCLGGSAAGEYLPGHTSMIRRDPLGVVASIAPWNYPLMMLAWKIAPALAAGNTVVIKPSELTPLTALRLGELAQDLLPPGVLNILFGRGQTVGNPLITHPKVRMVSLTGSIPTGAHIISATADSVKRMHMELGGKAPVLVFDDADIDAAIDGIRTFGFYNAGQDCTAACRLYVQDGIYERFVERLGKAVASLKPGLQESEETELGPLISAQHRDKVAGLVQRAIAQPHIRLVTGGKPIAGDGFFFEPTVLADALQDDEIVRNEVFGPVVSVTRFTDEAQALEWANDSNYGLASSVWTRDTGRAHRLAARLQYGCTWVNTHFMLVSEMPHGGQKHSGYGKDMSMYGLEDYTCVRHVMIKH

SEQ ID NO: 44962 - protein, 392 aa, Oryza minuta
MGKPGKLALPSHESTIGKFLTQSGTFKDGDLLVNKDGLRIVSQSEEGEAPPIEPLDHNQLSLDDLDAIKVIGKGSSGIVQLVRHKWTGQFFALKVIQLNIQENIRRQIAQELKISLSTQCQYVVACCQCFYVNGVISIVLEYMDGGSLSDFLKTVKTIPEPYLAAICKQVLKGLMYLHHEKRIIHRDLKPSNILINHMGEVKISDFGVSAIIASSSAQRDTFTGTYNYMAPERISGQKHGYMSDIWSLGLVILELATGEFPYPRRESFYELLEAVVEHPPPSASADQFTEEFCSFVSACLQKKASDRSSAQILLNHPFLSMYDDLNIDLASYFTTAGSPLATFNTSNYKQLLSLSLFHPFCHRHMLVPFFMIPIDEPFKGTLHSCFHRQPVR

SEQ ID NO: 44963 - protein, 161 aa, Zea mays
  misc_feature (65)..(65): Xaa can be any naturally occurring amino acid
MKAGRKNLRRACDEGAAVTLAEGESIMQVLTLRGSNVIEVIDGEGIKSLALFPAKFQKSFWIKNXGRDQALESGSKIACVVSQVLYHEQVRALEKSGNWPAIFNSTPNEASEAGTQAQIAAKIDELPDSDEDDNLPPVEANTNRNRPYELYYDSDSGGSDS

SEQ ID NO: 44964 - protein, 563 aa, Oryza sativa (indica cultivar-group)
MSLWKHPAAAGDGEVVETVVELLARVRGMVPPALGAAGAAEGFPGRWKAIAAKLEGLPACLSDLSSHPCFAKNALCRELLQSVAATLAEAAELAARCREPPAAGKLQMQSAIDALAGKLDLNLRDCALLVKTGVLSDAFTPPPPTDEATSTATAAQADVRELLARLQIGHTEAKSRAVDGLLEALNKDEKSVLSVLGRANVAALVQLLTAPATKVREKAATVICQLAESGGCEGLLVSEGALPPLIRLAESGSLLGREKAVITLQRLSMSSDTARAIAGHGGARPLIEMCQTGDSISQSAAAGALKNLSAVPEVRQALADEGIVRVMVGLLDCGTVLGSKEHAADCLQNLTSSSDSFRRAVVSDGGLRSLLVYLDGPLPQESAVSALRNLVSAVSPDSLVSLGVLPRLAHVLRVGSTGAQQAAAAAICRISTTTDMKRVVGEHGCVPLLVRMLDAKSNGAREVAAQAMASLVGYPPNAREVRRDGKSVPCLVQLLDPSPANTAKKYAIACLLSLAAAKRCKKLMISHGAIGYLKKLSDMDVAGAKKLLERLERGKLRSLFSRD

SEQ ID NO: 44965 - protein, 604 aa, Nicotiana tabacum
MDVRRRSEKPAYPTKEFAAGEKPLKPHKQQQQQDNSLLIASDALPLPLYLTNGLFFTMFFSVMYYLLSRWREKIRNSTPLHVVTFSELVAIVSLIASVIYLLGFFGIGFVQSFVSRDNNDDSWDVEDENDEQFLLEEDSRRGPATTLGCTAVPPPPARQVVPMVPPQPAKVAAMSEKPAPLVTPAASEEDEEIIKSVVQGKMPSYSLESKLGDCKRAASIRKEALQRITGKSLEGLPLEGFDYESILGQCCEMPIGYVQIPVGIAGPLLLDGREYSVPMATTEGCLVASTNRGCKAIYASGGATSVLLRDGMTRAPCVRFGTAKRAAELKFFVEDPVKFETLAAVFNQSSRFARLQRIQCAIAGKNLYMRFVCSTGDAMGMNMVSKGVQNVLDYLQNEYPDMDVIGISGNFCSDKKPAAVNWIEGRGKSVVCEAIITEEVVKKVLKTEVAALVEPNMLKNLTGSAMAGALGGFNAHASNIVSAVFIATGQDPAQNIESSHCITMMEAVNDGKDLHVSVTMPSIEVGTVGGGTQLASQSACLNLLGVKGANREAPGSNARLLATIVAGSVLAGELSLMSAISAGQLVKSHMKYNRSTKDVTKASS

SEQ ID NO: 44966 - protein, 548 aa, Aspergillus nidulans FGSC A4
MASHTKDALLSRRYIEGQIAAGKHIIIFDDRVLKVDSWIKFHPGGDKSIKHMVGQDATDEINALHSVEARQRMLAFQIGRIQGPWVNFLPPIQGGKFRHYDENADSEEDDTSGQSQPPSPIFDAVDAAPGVRRQYASSETSVSTPASESSEPKPFFLDARTREEIVLDTAKYPSLDAKTQQDIKRRYRELNKRIEAEGLYDCNYFSYFIEACRYTLFAGLSYFFLRLGWYSVSAVFLGCFWHQLVFSAHDAGHIAITHNYQVDSIIGILIADFLGGLSLGWWKRSHNVHHIVTNEPEHDPDIEHMPFFAISHRFFMNLRSTYYDRVMYFDAFSNFMLKYQHYLYYPILLFGRFNLYRLSWEYLILGQGPRKGPAWWHRWFEIAGQIFFWIWFGYGVLYCSIPTWGSRLSFLFISHMVTAPVHVQITLSHFAMSTADLGVQESFPQKMLRTTMDVDCPTWLDFFHGGLQFQAIHHLYPRIPRHNLRRTQKLVLEFCRDTGIPYALFTFTDGNKEVIGRLGDIAKQVYSSKYAARADRFNILDAFSQEGL

SEQ ID NO: 44967 - protein, 604 aa, Nicotiana tabacum
MDVRRRSEKPAYPTKEFAAGEKPLKPHKQQQEQDNSLLIASDALPLPLYLTNGLFFTMFFSVMYYLLSRWREKIRNSTPLHVVTFSELVAIASLIASVIYLLGFFGIGFVQSFVSRDNNDECWDVEDENDEQFLLEEDSRRGPATTLGCTAVPPPPALQIVPMVPPQPSKVAAMSEKPAPLVTPAASEEDEEIIKSVVQGKMPSYSLESKLGDCKRAASIRKEALQRITGKSLEGLPLEGFDYESILGQCCEMPIGYVQIPVGIAGPLLLDGREYSVPMATTEGCLVASTNRGCKAIYASGGATSVLLRDGMTRAPCVRFGTAKRAAELKFFVEDPVKFETLAAVFNQSSRFARLQRIQCAIAGKNLYMRFVCSTGDAMGMNMVSKGVQNVLDYLQNEYSDMDVIGISGNFCSDKKPAAVNWIEGRGKSVVCEAIITEEVVKKVLKTEVAALVELNMLKNLTGSAMAGALGGFNAHASNIVSAVYIATGQDPAQNIESSHCITMMEAVNDGKDLHVSVTMPSIEVGTVGGGTQLASQSACLNLLGVKGANREVPGSNARLLATIVAGSVLAGELSLMSAISAGQLVKSHMKYNRSTKDVTKASS

SEQ ID NO: 44968 - protein, 1170 aa, Gibberella zeae PH-1
MPLNLATTLAGRAPALLRHGRRVPRALPSRSFSSVSPFAASCRVSMAATRPANSKRLGTLKVMRGYSSVAQDAPNPRAYLDSGVIKPSQTVDVKKVLVIGSGGLAIGQAGEFDYSGAQALKALKEAGVASVLINPNIATIQTNHSLADEVYYLPVTPEYVSYVIEKEKPDGIFLSFGGQTALNLGVEMQRLGLFEKYGVKVLGTSVRTLELSEDRDLFARALEEINIPIAKSIAVGTVEEALEAAETVGYPIIVRAAYALGGLGSGFANNEEELRNMAARSLTLSPQILVEKSLKGWKELEYEVVRDANNNCITVCNMENFDPLGIHTGDSIVVAPSQTLSDEEYHMLRSAAIKIVRHLGVVGECNVQYALQPDGLDYRVIEVNARLSRSSALASKATGYPLAYTAAKIGLGHTLPELPNAVTKTTTANFEPSLDYIVTKIPRWDLSKFQHVKRDIGSAMKSVGEVMAIGRTFEESFQKAIRQVDPRFVGFQGDKFEDLDFELQNPTDRRWLAVGQAMLHENYSVDKVHELTKIDKWFLHKLQNIVDCTRELEQAGGLQSLKKDQVLKAKKMGFSDRQIANAVKSTEDEVRAYRLSFGIHPWVKKIDTLAAEFPANTNYLYTTYNGSTHDVTFEDNGTIVLGSGVYRIGSSVEFDWCAVSATRALREMGEKTIMINFNPETVSTDYDEADKLYFDELSYERVMDIYELEKSKGVVVSVGGQLAQNIALRLQETGGANVLGTDPRDIDKAEDRQKFSEILDSIGVDQPAWKELTSVKDAEKFAEEVGYPVLVRPSYVLSGAAMTVISSKADLKDKLEAASNVSPDHPVVISKFIEGAQEIDVDGVSANGELILHAVSEHVEQAGVHSGDATLVLPPANLDSTTMERVKEIAKKVAQAWKISGPFNMQIIKAENPEGGEPLLKVIECNLRASRSFPFVSKVLGTNFIDAATKALVGKNVPPTTDLMAVKRDYVATKVPQFSWTRLAGADPFLGVEMSSTGEIACFGKDLVEAYWTSLQSTMNFRMPEPGEGLLFGGNVSKPWLTQVVDYVAPLGYKLYAASPEVKEFIEAKSKSKVEVEVIEFPKEDKRALREVFKKYDIRGCFNLAESRGKTTLDVDYVMRRNAVDFGVPLFMEPQTAILFAQCMSEKLPRSEGIPAEVRRWSDFIGGKPL

SEQ ID NO: 44969 - protein, 658 aa, Oryza sativa (japonica cultivar-group)
MGISAAAAAAPFLLLVALLLLLPSPAAAFSFTYNFTSADTAPSGIAFQGDAFFNKFIRLTRDERIGPITSSAGRAFFSRPVPLCDPVSRRRASFSTAFSFSIAAPDPSAASGDGLAFFLSPFPSVLPNSSAGGLLGLFNSFSRRGRSGGASRARSTARRAHARVAYDGQAKNLTVALSYGDAAAAAALTDPVLWYAVDLMEYLPDAVAVGFSAATGEAAELHQVLYWEFTSSIDTKEETVILWVVLGLCGLLLVLVAAGVLWFVSQWRKAGELADGDIDEEMGYDELADEEFFVESGPRRFRYSDLAAATKNFSDERKLGQGGFGAVYRGFLKELGLAVAIKRVSKGSTQGRKEYAAEVRIISQLRHRHLVRLVGWCHEHRGDFLLVYELMPNGSVDRHLYGGGGGSKKAGGAAPPLSWPTRYNVALGLASALLYLHEECPQCVVHRDIKPSNVMLDATFSAKLGDFGLAKLVEHGSQPHTTVLAGTLGYLAPECVITGRASRESDVYSFGVVALEIACGRRPAELDEGGPEQGEAGAVGVGALRQESHPRSRGPEAQWQVRPRADGAAHGGRIVVRAPRPRAPAEHQAGAERAQVRGAAAVAAAQDAGAVVLPAAGLGRSGVRRRHVEHRWPRRQLSFTAYRSGRLYGVVFDTLTCA

SEQ ID NO: 44970 - protein, 260 aa, Zymomonas mobilis subsp. mobilis ZM4
MEACGINGDYSRFPVHPDHLAQAIKALPAWGMRGVNVTVPHKQAVIPLLDEIDPLAEKAGAVNIVRVAEDGRLQGYNSDITGFMEALQPAIKAQGAGLRKAFIVGAGGAARAVALGLTEAGFTCQIVNRNFEKARALARDIGALRGDIEFHSLEDNREPEFTLQDGELGVIVNATTLGMSGQPPLDLSLEKVDPRSLVYDIVYVPLETPLLKAAKARGMQTIDGLSMLIGQAAAAFELFYDRKPPRDQDQALRALLTKKA

SEQ ID NO: 44971 - protein, 348 aa, Candida maltosa
MLSTTTSTLYTQLPVISSTPFIRLASTLATSKLPHSKQVVGSQPSVFDIKTKIYTSEAITDNNDTEFITKAAYAHPEFPQQDCENVTVTHREVRSLGDKISYNGIRFFRGCFDLVTGYAVPKTNNPDEYKGTRWEMTEGKWMTRCIFLESVAGVPGSVAGFLRHLHSLRMLRRDKAWIETLYDEAYNERMHLLTFIKIGKPSWFTRSIIYVGQGVFTNVFFLLYLLNPRYCHRFVGYLEEEAVRTYTHLIEEIDTKGKLPGFENMKIPEIAVQYWPELTPESTFRDLILRIRADEAKHREVNHTFANLEQAKDRNPFALQIEGSSDPNPNHGLHVMRPTGWERKELKL

SEQ ID NO: 44972 - protein, 106 aa, Glycine max
  misc_feature (12)..(12): Xaa can be any naturally occurring amino acid
APPPIMLEHDKXMSVQELPANSTVVDLMERVGANSPRWSPCSFPLKEELRPRVNHKPISDPNRKLSMGDVVELTPALPDKSLSEYREEIQRMYERGGFALATTPRS

SEQ ID NO: 44973 - protein, 371 aa, Candida maltosa
MIAASTYKRIPNIISRTSIKPTQFIRLVTTTKTPPSPSPTGLGNPNPKAVPIDKEDTEAPGFIKAKRAPFGIETKVYNNEGIEAQDDDKFLTPSPYPHPDFTEAGVYRVKFTHRPPVTVGDKVSYYGTMFCRKCFDFVTGYAVPPKDQPDKYIGTRWEMTEGKWMTRCIFLEAVAGIPGSVAGLIRHLHSLRMLTRDKAWIQTLNDEAYNERMHLLTFIKIGKPSWFTRTIIYVGQGVFTNLFFMVYLMNPKYCHRFVGYLEEEAVRTYTHLLAELNVPGKLPDFEKMVIPTIAVQYWDELSPESSFKDLILRIRADESKHREINHTFANLEQYVDRNPFALQIKGLDKPQPNNNLDVVRPEGWERKDLYL

SEQ ID NO: 44974 - protein, 329 aa, Glycine max
KNNYWMELARPASSRRKLKDLLHQSGNRLCADCNAPDPKWASANIGVFICLKCCGVHRSLGTHISKVLSVTLDDWSEDEIDAMIEVGGNVSANSIYEAYIPEGYTKPGPDAGHEQRSKFIRSKYELQEFLKPSLRIVSGKSSLQSSSAKSSFMDSFKSTSSSQRMEGMVEFIGMLKVKVIKGTNLAIRDIKSSDPYVVLSLGQQTVQTTIIRSNLNPVWNEEYMLSVPEHYGQIKLKVFDHDTFSADDIMGEADIDLQSLITSAMAFGDAGMFGDMQIGKWLKSDDNALIEDSTVNIVDGKVKQMMSLKLQDVESGELDLELEWIPLEQ

SEQ ID NO: 44975 - protein, 482 aa, Salmonella typhimurium LT2
MQLNDSTLFRQQAFIDGDWRDARGGDVIPVSNPANGKPLGNVPKMGAEETRDAINAANRALPAWRALTAKERANILRRWFNLMMEHQDDLARLMTLEQGKPLAEAKGEISYAASFIEWFAEEGKRIYGDTIPGHQADKRLLVIKQPIGVTAAITPWNFPSAMITRKAGPALAAGCTMVLKPASQTPFSALALAELAQRAGIPAGVFNVVTGSAGDIGGELTSNPLVRKLSFTGSTEIGRQLMEQCAKDIKKVSLELGGNAPFIVFDDADLDKAVEGALASKFRNAGQTCVCANRLYVQDGVYDRFAEKLNQAVNKLAVGDGLQADVAIGPLIDEKAVAKVQEHIADALEKGARVITGGEAHKLGGNFFQPTILADVPDNAKVAKEETFGPLAPLFRFSDEADVIRQANDTEFGLAAYFYARDLSRVFRVGEALEYGIVGINTGIISNEVAPFGGIKASGLGREGSKYGIEDYLEIKYMCIGL

SEQ ID NO: 44976 - protein, 359 aa, Ralstonia eutropha JMP134
MNANEVSRADDHSVSLFGLGDATPHERVMLVTEEKTGLRAIIAIHSTARGPAFGGCRYWSYGSDLAAMEDALRLSRGMSLKNAMADLPFGGGKAVILRGDGQHERNAMYQAFGRAVQVLAGTYITGEDVGTSVADMLAVREVTPYAAGIPRPDGFGGNPSPKTALGVFAAIERGASHVFGARELSGLRVAVQGLGAVGWALAERLHRAGCKLVVADIDDSRTAAARRAFNAVVVAVDDIATQDVDILAPCALGATLHRQSIPALRARLVAGAANNQLATNGDGDALHERGIAYLPDYLVNAGGIISCVREYQGGFAEADVDAEVLRIANRVDSLFVRASSAGEPLSRAADRWALEKLAS

SEQ ID NO: 44977 - protein, 427 aa, Salmonella typhimurium LT2
MNTNNALMQRRHNAVPRGVGQIHPIFAERAENCRVWDVEGREYLDFAGGIAVLNTGHLHPGIVSAVEAQLKKLSHTCFQVLAYEPYLALCERMNQKVPGDFAKKTLLVTTGSEAVENAVKIARAATKRSGAIAFSGAYHGRTHYTLSLTGKVHPYSAGMGLMPGHVYRALYPCPLHNISDDDAIASIERIFKNDAAPEDIAAIIIEPVQGEGGFYAASPAFMQRLRALCDQHGIMLIADEVQSGAGRTGTLFAMEQMGVAADITTFAKSIAGGFPLAGVTGRADVMDAIAPGGLGGTYAGNPIACAAALAVLDIFEQENLLQKANTLGKTLRDGLMEIAETHREIGDVRGLGAMIAIELFENGDPGKPNAALTADIVTRAREKGLILLSCGPYYNILRILVPLTIEASQIRQGLEIIAQCFDEAKQA

SEQ ID NO: 44978 - protein, 466 aa, Salmonella typhimurium LT2
MGQLSESHALGGGLKSRHVTMLSIAGVIGASLFVGSSVAIAEAGPAVLLAYLFAGLLVVMIMRMLAEMAVATPDTGSFSTYADKAIGPWAGYTIGWLYWWFWVLVIPLEANIAAIILNSWIPGIPVWLFSLVITLALTGSNLLSVKNYGEFEFWLALCKVIAILAFIALGATAISGFYPYAEVSGISRLWDHGGFMPNGFGAVLSAMLITMFSFMGAEIVTIAAAESDTPDKHIVRATNSVIWRISIFYLCSIFVVVALIPWNMPGLKSVGSYRSVLELLHIPHAKFIMDCVILLSVTSCLNSALYTASRMLYSLSRRGDAPAIMGKTNRSKTPWVAVLLSTGAAFLTVIVNYYAPAKVFKFLIDSSGAIALLVYLVIAISQLRMRKILLAQGGEIKLKMWLYPWLTWLVIGFICFVLVVMLFRPAQQLEVISTGLLGLGIIGTVPIMSRWKKLIRWQKAPLQNLR

SEQ ID NO: 44979 - protein, 514 aa, Ipomoea nil
MGSCNSIPSSPFAATSAGGESDPPPPKNDITVLPPSQPPPPRPFLSGVGRVLGRPMEDVHSTYIFGGELGRGQFGVTYLVTHRKTRERLACKSIATRKLLSKDDVDDVRREVQIMHHLTGHRNIVELKGTYEDRNHVHLVMELCAGGELFDRIIAKGHYSERAAAGLCRQMVTVLHYCHSMGVMHRDLKPENFLFLSSDENSPLKATDFGLSVFFKPGDTFKDLVGSAYYVAPEVLRRNYGPEADIWSAGVILYILLSGVPPFWGENEQSIFDAVLRGHLDFSSDPWPSISSSAKDLVKKMLRSDPKERLSATDVLNHPWMREDGDASDKPIDIAALSRMKQFRAMNKLKKVALKVIAENLSEEEIIGLKEMFKSIDTDDSGTITYEELKAGLTKMGTKLSESEVRQLMEAADVDGNGTIDYLEFITATMHMNRVEREDHLYKAFEYFDKDKSGYITMEELEHSLKKYNITDEKTIKEIIVEVDTDNDGKINYDEFVAMMRKGTPDLVINRRRR

SEQ ID NO: 44980 - protein, 380 aa, Pseudomonas syringae pv. syringae B728a
MAKRDYYEVLGVERGSSEADLKKAYRRLAMKHHPDRNPDDKASEELFKEANEAYEVLSDASKRAAYDQYGHAGVDPSMGGGGGFGGGAGGANFSDIFGDVFSDFFGGGRAGGGGGRGGAQRGSDLRYTLELNLEEAVRGTNVNIRVPTLVNCKPCDGSGAKKGSSPVTCPTCGGIGQVRMQQGFFSVQQTCPRCHGHGKIISDPCDSCHGEGRVEESKTLSVKVPPGVDTGDRIRLSGEGEAGTQGGPTGDLYVVINVREHAIFQRDGKHLFCEVPISFTDAALGGELEVPTLDGRVKLKIPEGTQTGKQFRLRGKGVAPVRGGGAGDLMCRVAVETPVNLSKRQRELLEEFRTSLENDESHSPKASGWFEGVKRFFGDL

SEQ ID NO: 44981 - protein, 526 aa, Aspergillus oryzae
MVLADSNAKGFAASTRLTRTINGVGVCAEPTALNRHRSMGAGILTIYRDFGLEHASKAVEDAFSANIVSLLQAGCFFGSLISAPLSDRFGRKLALGLAGLIFCVGSTLQVATLGREAVMFVGRFVGGLAVGAASMLVPLYTAECSPPHIRGRLVGIFEIGVQVGMCIGFWINYAVDQIMAPSTSQWLTPFAIQFIPGGLLIIGLLFLPESPRWTARVRGKRLARQTLSYLRGLPESHPSVESELNDIITQLEDERADKPGKRLWIEIKELTHPGIRARLFLGFMIMVFCQMAGSNAINHYSPLIFRSIGLTGRKTTLISTGLYGVVRLVAVCIAMYWTVDGFGRTRMLMWGSALMVRHTSAGSYAAAVFIFIYAFGFCFSWAGVPWIICSEIYPLRVRSLCMAICTATHWLLNFVIARSFPYMIRNMKYGTYFFFASFLTLAIPFVWLMVPETKELKLEEVDGVFRNRTSWGRREPQLPCGDHADPCSLDAERGKTERVRDVKSAGVKEVEKIDTLKRYWLNTLPD

SEQ ID NO: 44982 - protein, 405 aa, Oryza sativa (japonica cultivar-group)
MRSMPFQLKNGHHHHGAMEGKPPVTPMQQQQQHAPPPRVSRFRRLLVRVSASERLAGDGKERGEKEAEKVSASAAGGEVEAGSVGLDRMVLSFMEDSAAVERPQRGRCNCFNGSNYEESDDEEGFFLPSDHSSASAPAAAGDALESLKGLVQSASVAERNLLADASRIAERCCKGSKGKAECRRAVADGLRALGYDAAVCRSRWEKTSSYPAGEHEYIDAVVGEEVRLIVEVDFRSEFEVARSTKAYRAALQALPPLFVGTPDRLGQIVAVVAEAARQSLKKKGLHFPPWRKPEYMRAKWLSPHVRSGDKAAAAAKTVTSTTSATATPVSAASFSGAFELLFDRKQSGEIPAAEKITVVVSPSPWRPTEEASKKKPPPSPSPPQLWQQHQQPPKAKVVTGLAAVL

SEQ ID NO: 44983 - protein, 396 aa, Glycine max
MVAEAEVACQQNVGVLDVKHFPNKGSDVHQIGDADANSPPCFDRVRATESVSAELLTSQEDVKSADRISDAALESAVLQSIPCIRSGSFADIGPRRYMEDEHIRIDDLSSHLGSLYNFPQPSAFYGVFDGHGGPEAAAYIRKNVTKFFFEDVNFPRTSEVDNVFLEEVEDSLRKTFLLADSALADDCSVNSSSGTTALTALIFGKLLMVANAGDCRAVLCRKGEAIDMSQDHRPIYPSERRRVEELGGYIEDGYLNGVLSVTRALGDWDMKLPKGAPSPLIAEPEFRQVALTDDDEFLIIGCDGIWDVMSSQHAVSLVRKGLRRHDDPEKCARDLVMEALRLNTFDNLTVIIVCFSSLDHVEPEPSPPRQRKLRCCSLSAEALCSLRSLLEGSASN

SEQ ID NO: 44984 - protein, 194 aa, Ustilago maydis 521
MSELRRKLVIVGDGACGKTCLLIVFSKGTFPEVYVPTVFENYVADVEVDGRHVELALWDTAGQEDYDRLRPLSYPDSHVILICFAVDSPDSLDNVQEKWISEVLHFCHSLPIILVGCKKDLRHDPKIVDELRKTSQRPVSAEEGMAVAQKIGAVRYLECSAKTGEGVREVFEHATRAALVQRSRGSRKKGCTVL

SEQ ID NO: 44985 - protein, 392 aa, Oryza sativa (indica cultivar-group)
MAAERKDVGILAMDIYFPPTCVLQGVLILQTFACFCGCVCGGGGAQYEKEEKIGEGTYGVVYRARDKVTNETIALKKIRLEQEDEGVPSTAIREISLLKEMHHGNIVRLHDVIHSEKRIYLVFEYLDLDLKKFMDSCPEFAKNPTLIKSYLYQILRGVAYCHSHRVLHRDLKPQNLLIDRRTNALKLADFGLARAFGIPVRTFTHEVVTLWYRAPEILLGSRQYSTPVDMWSVGCIFAEMVNQKPLFPGDSEIDELFKIFRVLGTPNEQSWPGVSSLPDYKSAFPKWQAQDLATIVPTLDPAGLDLLSKMLRYEPNKRITARQALEHEYFKDLEMIQIALRCCYTHLSGVPLGLGSTGGHASLVLSKILSRLVACVRHHQTRVPQRLIMNMH

SEQ ID NO: 44986 - protein, 307 aa, Thermus thermophilus HB27
MVEKPAIALVGESLVDLVLEGESPLAFTGTLGGSVLNTATVLARLGYPVRFFSEVGEDWLSAWSEVEMARRGLNPKLQRHPGPMPLALVRLDPEGNARYSFHRPFQAPFLPESGALRGVGAFHFGSLFALEARTAKGVAALLEEAARAGALLSYDPNLRGLPSPEERARVEAYLGRVDLLKLSLEDARLLFPEAPLEAVRRLPPRLKVLTLGPEGALAFLGEGEVRVPGVRVRVVDTVGAGDTFTAGLLALLLRRGGGRGVLEGLDLEGLREALEAAVALSALACTVRGAGLPEEGLAAWRARWLAG

SEQ ID NO: 44987 - protein, 175 aa, Triticum aestivum
MAPTVMASSATSVAPFQGLKSTAGLPVSRRSNGASLGSVSNGGRIRCMQVWPIEGIKKFESLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 44988 - protein, 378 aa, Arabidopsis thaliana
METTPKRSKTLLMSNGEERRSMTFGIEMLPDDLVLSCLARVPRMYYPILSLVSKRFRSFLTSTELYQTRNLLGSTESFLFVCLRIVNDSNPLRLFTLCRRPNSLTKVMVPILSPDSIPKFLPDVVLVGSNIYVIGGLINNNASHKVMVMDCRSHTWREAQGTCVARVSPSACVLDGKIYVAGGCKNLDATMWMEVFDTKTESWEFVSSPGEEICRDLTSCESIGYDGNVYVESMKTYGLYELHKGRWREGQYSMSRGGSLSSQCVIDNVLYRSWSYMVEWYDSENKLWNSLKGLEKLFIVTNQYVPTKCVNYGGKLAVFWLEKVYAKHLHQETKIWCAVITIERRKKEEIWGTREWFDLVFTTNEEMVDLTHVFAATL

SEQ ID NO: 44989 - protein, 252 aa, Lactobacillus delbrueckii subsp. lactis
MSRTPIIAGNWKLNMNPKETVEFVNAVKDQLPDPSKVESVICAPAVDLDALLKAAEGSNLHVGAENCYWENSGAFTGETSPAVLKEMGVQYVIIGHSERRDYFHETDEDINKKAKAIFANGLTPILCCGESLEIREAGKEKEWVVSQIKADLEGLTSEQVSKLVIAYEPIWAIGTGKTASSDQAEEMCKTIRETVKDLYNEETAENVRIQYGGSVKPANIKELMAKPNIDGGLVGGASLVPDSYLALVNYQD

SEQ ID NO: 44990 - protein, 849 aa, Fervidobacterium pennivorans
MFRDSSMGLLKKLSVITLIVFALSISFAETELIIHYHRWDGNYDGWNLWIWWVEPISKEGAAYQFTEKDDFGVVAKVKFPETLTKVGIIVRLGEWREKDVAMDRFITIKDGKAEVWLLQGIEQIYTTKPDTSPRVLFAQARDQYTIEAYLTGQVDTTKVGAKVTVDGQPLKIARVEKANPTDISRTNHVKVVLAEPIKLEDVNKDVQVEIEGYKPARVIMMEILDKIYYDGPLGFEYTPEKTTIRVWSPVSKTVDVLLYKNWDDKEPTQVVPMKYIGNGAWEAVLEGNWDGWFYKIRYFSYGEYRESVDYFSKAVTKNSAKSAIIDFSKTNPESWEKVARPPLVAPEDAIIYEIHIADMTGLDNSGVKNKALYLGLTEKGTRGPNGVTTGLDHLVELGVTHVHILPMFDFWTGDEADKDFERSYNWGYDPYLFTVPEGRYSTDPINPYTRIIEVKQMVKALHENGIRVILDMVFPHTWGVGVMSPFDQAVPYYFYRIDKTGAYLNESGCGNVIASERPMMRKYIVDTLKWWVTEYKIDGFRFDQMGLMDKVTMLAIKSELSKIEPSVVLYGEPWGGWGAPIRFGKADVGGTGIAAFNDEFRDALRGSVFNATVKGFLMGALAKETGVKRGVAGSIEYDEVIRSFAKDPQETINYVEVHDNHTLWDKNYLAAQADTTVKWTEEMLKDAQKLAGAILLTSQGIPFLHAGQDFARTKKFDENSYKSPISINGLDYARKAEFIDVFNYYKGLIELRKSHIAFRQRTAEDIRKKLTFLPSPRKMVAFVLKDEKDPWKEILVIYNGDTKDQQFTLPDGTWNVVVDKDNAGTKVLYQVSGKINIKAISAMVMYKGN

SEQ ID NO: 44991 - protein, 446 aa, Oryza sativa (japonica cultivar-group)
MDSIMEPYVADLLADDITASMVELLPGDGGAAQMDVGVLDAYLRAIGALPAHPAAPGADLAAAAEVESMASNDDTNGVLYDWDTKVDVKVPCALLPPPPGFPPLPVPGLADEPVYAAPARHLPPPPGFPPLPVPGLADEPVYAAPARRLPPPPGFPPLPVPAKAEPVYAAPVDEGDAIRAFMQQLEWSEQYNGDNDAPAPDNSTASRPQLCAPYDDDIDANLRDMEKDAAQRPSPDYLDTVQGGQISAAARASLVAWMGRLTHRYELAAGTLHRAVSYFDRFLSVRALPSYTAHQLSLVAATAVYTAAKYEDQGTVFKLDAREIASYGEFASAQEVLAMEREMMAALGYRLGGPNAETFVEHFTRYSKGKEELRVQRLACHVADRSLESYGCLGYLPSMVAAAAISIARWTLNPPGALPWSSELQELTGYSSQDISSCILTVLNTQ

SEQ ID NO: 44992 - protein, 334 aa, Zea mays
  misc_feature (85)..(85): Xaa can be any naturally occurring amino acid
MSTVPREFAGLDPRSADFHPALTRCPVTCGFCCAGRLIRRAPWMNSRRSRSVKLVSARANGDGALEVDVPEEEGDARMSSSAANXVYWCIGRGRSVIYRYSSKGGDPQAEATAALCLDRSPPHHRHYVHTSGRRSYGYLTADGHTFFAIIDPSVGSAGALQFLERVRDAFRSSAGVGGRQPHESLVPAVQRLVASLEKMPHAAFVLDGAGAGAGDGDGCTSSSKAPLLGKSGSRKEKRRSRDKLSSSAAGAGAGGCEDEHHGTRAVRIDVMPAEDVGGMSLERSGSQSRLRRQQSSRSLWMRHVKVIVAVDAVVCLVLLAAWLAVCKGFQCVSG

SEQ ID NO: 44993 - protein, 414 aa, Oryza sativa (japonica cultivar-group)
MNGSSGSQGHNVNGGQKKVQHASPLTLNNGSKHRPLTPMRRCRGVACVVIILSTAFTLIVFIAPITTFLVRLVSVHYSRKATSVLFGMWLSLWPFLFEKINKTNVVFSGESVLPKKRVLLFANHRTEVDWMYLWDLALRKGYLGYIKYILKSSLMKLPVFSWAFHIFEFIPVERKWEIDEAIIQNKLSAFKDPRDPLWLAVFPEGTDYTEKKCIKSQEYASEHGLPILKNVLLPKTKGFLCCLQELKSSLDADIRFHFCEKLEVLLLIYDVTIAYKHRLPDFLDIIYGTDPSEVHIHIRTVKLCDIPTSEDEVTDWMIERFRQKDQLLSDFFMQGHFPDEGTEGDVSTPECLANFIAIVSSTGFFLYLSLFSSVWFKVYVLLSCAYLTFVTYFSIQPPQLICSSEGGTHAKKVL

SEQ ID NO: 44994 - protein, 432 aa, Pseudomonas syringae pv. phaseolicola 1448A
MRVISQNLTAWSAGLIVVVIFLSAWLSHPQHRISAFVVSTAPVDAESVAPKASYISRFASSDLDDFVHSSAVTALPGGDLMSVWFAGSREGAGDVEIRTSRFDASNGEWGGEQVLATRASTQSGTGKYIRKLGNPVIALAPDNRLWLFYVSVSVGGWAGSTVNAMVSSDMGASWSPPWQLVTSPFLNISTLVRGAPVFHTDGSIGLPVYHEFLGKFAEYLYLSADGEVIDKFRISRGKNSLQPTVVPLDGQRAVALLRYAGETLHRVLASRTEDGGQTWSEPQPLTPSNPNSSLAAVGVPGKGLLVALNDLREGRFKLSLYSTDEQMKVWRPLPDLDKSPDPLGTPFALEAYKAAIGEGFRASSGARRQPMEAEFLSNLDQRVCSAQGCDFEYEYPYFIRSPDGLYHLVYSWNNTFIKHVSFNEAWLAEQLL

SEQ ID NO: 44995 - protein, 883 aa, Zea mays
  misc_feature (276)..(276): Xaa can be any naturally occurring amino acid
  misc_feature (632)..(632): Xaa can be any naturally occurring amino acid
MAPAPCGRSSQRVFHFGKGKSEGNKNMKELLGGKGANLAEMASIGLSVPPGFTVSTEACQQYQEAGRALPPGLWAEVLDGLRWVEEYMGAALGDPRRPLLLSVRSGAAVSMPGMMDTVLNLGLNDQVAAGLAAKSGDRFAYDSFRRFLDMFGNVVMDIPHALFEEKLEAMKKAKGLKNDTDLTATDLKELVSQYKNVYVEAKGEPFPSDPKRQLELAVLAVFDSWESPRAKKYRSINQITGLRGTAVNVQCMVFGNMGNTSGTGVLFTRNPNTGHXKLYGEFLVNAQGEDVVAGIRTPEDLDAMKNLMPQAYKELVENCNILESHYKEMQDILFTVQESRLWMLKPRTGKRTGKSAVKIAVDMVNEGLVERRAAIKMVEPGHLDQLLHPQFENPSAYKDQVIATGLPASPGAAVGQVVFTAEDAETWHSQGKSVILVRAETSPEDVGGMHAAAGILTERGGMTSHAAVVARGWGKCCVSGCSGIRVNDAEKVVKIGGNVLREGEWLSLNGSTGEVILGKQPLSPPALSGDLGTFMSWVDDVRKLKVLANADTPEDALAARNNGAEGIGLCRTEHMFFASDERIKAVRQMIMAPTVELRQQALDRLLPYQRSDFEGIFRAMDGLSVTIRLLDXPSTRFLPEGNVEEIVRELCSETGANQEDALARIEKLSEVNPMLGFRGCRLGISYPELTEMQARAIFEAAIAMTNQGVQVFPEIMVPLVGTPQELGHQVALIRQVANKVFTSMGKTIGYKIGTMIEIPRAALVADEIAEQAEFFSFGTNDLTQMTFGYSRDDVGKFIPIYLAQGILQHDPFEVLDQRGVGELVKLATERGRKARPNLKVGICGEHGGEPSSVAFFAKTGLDYVSCSPFRVPIARLAAAQVLV

SEQ ID NO: 44996 - protein, 405 aa, Vibrio vulnificus YJ016
MAGVLGMILAGGEGSRLRPLTESRSKPAVPFGGSYRLIDFALNNFVNADLMRIYVLTQFKSQSLFHHMKKGWNINGITDRFIDPIPAQMRTGKRWYEGTADAIYQNLRFMELSEPEQVCIFGSDHIYKMDIKQMLSFHKEKQAALTVSALRMPLAEASQFGVIEVDAEGRMVGFEEKPSAPKSIPGDPDFALVSMGNYIFEADVLFAELIEDADNENSSHDFGKDIIPKMFPRGDVFVYDFSQNRISGEKAEVYWRDVGTIDAYWQAHMDLLKTDAPFSLYNRKWPLHTYQPPLPPATFTDSDNGRVQIIDSLVCNGSYVRGSRIEKSVLGFRSNIASACDISESILLGDVKVGEGCVLRRVIVDKDVDIAPGTQIGVNLQEDKKVFHVSDDGIVVIPKGARVGY

SEQ ID NO: 44997 - protein, 329 aa, Ralstonia eutropha JMP134
MKTRTMSVPLDPELAAIVAAMREARAPAPFSGSPEHARERMRSAILAARARTPLPEVGAIEDGIAVHDGQRVPVRVYRPRTASAMLATVVFFHGGGFVLGSVELMDDIARKLCRDLDAVVVSVDYRLAPEHPFPAAHDDALAATSWAIRNVSALGGNPARIAVAGESAGANLAASTALLLRDQGETLAAQLLIVPGVDLARDTQKLEAARGEFPMLSPTDLRDISRLYMGERAALAGRFPPSPMHAVNVHRLPPAVVAVAGHDPLCEEGTRYAARLEAAGVPVCLLRFDDMFHPFFGFFEASASARRANNAICHTFKSWLHQHASPTST

SEQ ID NO: 44998 - protein, 1133 aa, Yarrowia lipolytica CLIB122
MIARSLLRLAKPQLRAGIAVRTKLTQFPVRKYTTTPEYAGAGILSQVADKELVDVSKVLVIGSGGLSIGQAGEFDYSGSQAIKALREEGKQSILINPNIATNQTSHFLADEIYYLPVTPEYIIHIIEREQPDGILLTFGGQTGLNVGVQLNKMGVFDRYNVKVLGTPIKTLETSEDRDLFAKALREIDIPTAESIAVENVDDALKAAESVGYPIIVRSAYALGGLGSGFANNEDELRNLAAQSLSLAPQILVEKSLKGWKEVEYEVVRDRNNNCITVCNMENFDPLGIHTGDSIVVAPSQTLSDEEYHMLRSAAIKIIRHLGVVGECNVQYALQPDGLDYRVIEVNARLSRSSALASKATGYPLAYTAAKIALGYTLPELPNAVTKTTSANFEPSLDYMVTKIPRWDLAKFSNVKRDIGSSMKSVGEVMAIGRTFEESFQKAIRQVDPSFVGFQGHPDFANNKEFLEDTLANPTDRRWLAVGQALLHENYTVDQVHDLTKIDKWFLYKLMNLVEMQRELESHKSLNGLNQDILQRAKKLGFSDKQIALAVGSDEMSVRARRKSFGITPFVKRIDTLAAEFPADTNYLYTTYNASSHDIDFNEHGTLVLGSGVYRIGSSVEFDWCAVSTVRALREAGKKTIMINYNPETVSTDFDEVDRLYFEELSFERTMDIYELEHAQGVVVSVGGQLPQNIALTLQEQGANVLGTDPLSIDKAEDRHKFSSILDSIGVDQPDWSELTSVAEAKEFADKVSYPVLVRPSYVLSGAAMSVIYNESELEHKLNNASAVSPDHPVVITKFIENAHEIDVDAVASNGKMLVHAISEHIENAGIHSGDASLVLPPQDLDDKTMARLKEIAEKVAAAWEISGPYNMQIIMVPNGTDEPALKVIECNIRASRSFPFVSKVLGVNFIEVATKALMQENVPAPVDLMKIDRPYVATKVPQFSFTRLAGADPYLGVEMASTGEVACFGADKLEAYWTSIQSTMGFKVPQPPCGVLLGGDLTPQLIEIAKNSANTGYKLYCASPELAQILTEATSTNVSTIEFPKTDKRALREIFQKYDIQCVYNLTRSRAESLLDENYVMRRNAIDFAIPLFNEPQTAKLMSECLLTRINKKTGEIPPEVRRWSEFIGGKPV

SEQ ID NO: 44999 - protein, 140 aa, Pinus pinaster
ELQDLQRDPPTSCSAGPVGEDLFHWQATIMGPTESPYAGGVFFVMIHFPPDYPFKPPKVNFQTKVYHPNINSNGSICLDILKEQWSPALTISKVLLSICSLLTDPNPDDPLVPEIAHIYKSQRSRYEETARAWTQKYAMN

SEQ ID NO: 45000 - protein, 256 aa, Colwellia psychrerythraea 34H
MTRQAIVAANWKMNGDSALVDTMVSGLADIELSSHVDVVICPSFPYLSELNQKIKAANLNEAIHVGSQNVSEHESGAYTGEVSTAMLQNLAINYVIVGHSERRSIFKETSTQVAKKVHAALNAGLTPILCIGESEAERATGETETVLSAQIQPVIDEIGIEKFKDVVIAYEPVWAIGTGKTASSAMAQETHQFIRKFLAQQNEQVADKVPLLYGGSVNAANCEELFAQTDIDGGLIGGASLKAEQFKIICSAAKGK

SEQ ID NO: 45001 - protein, 428 aa, Colwellia psychrerythraea 34H
MTTSNQELQNRKTKVIARGQGNMYPVYVERAENSEIWDVEGNRYIDFGAGIAVCNTGHSHPKVVAAAKAQLDKFSHTCVMVNPYEVAVELAEKLIDIAPGDSEKKAIFVSTGAEAVENCVKIARAHTGRRGVIAFNGGFHGRTNLTMALTGKITPYKNLFGPFPGDIFHAPFPIECHDITVKQSLKALENLFKVDIAPSDVAAIIVEPVQGEGGFYAAPTEFLQALRQLCDQHGIMLIADEIQTGFGRTGKMFAFEHSGVEADLMTMAKGIAGGFPIAAVVGKSEVMDAPLPGGLGGTYGGSPVACAAALAVLDIIEEESLVERSAHIGEQFNHRLSQLKTAFPELVLEVRNQGSMIAMELIQNGDAEQPNTELTQAIIAHAAKNGLVLLACGFYGNVIRFLPPLTITDEVLTEGLDAFENMFKELAK

SEQ ID NO: 45002 - protein, 482 aa, Bradyrhizobium japonicum USDA 110
MDVNLLISGRDQAASTGKVFERRNPLSQEVASRAAAATVSDADAAVAAASAALAAWSALGPNARRALLLKAADALEAKRDAFIRIMMAEIGTTEVWSAFNVKLATGMLREAASLTTQVAGEVIPSDKPGCLAMAVRQPAGVCLGIAPWNAPIILGVRAVATPLACGNTVVLKASEICPGTHRLIGEVFRDAGFPPGVVNVLTNAPADAPAVVERLIANPAVRRINFTGSTRVGRVIAELAGRHLKPVLLELGGKAPLVVLDDADLDAAVAAVAFGAFINQGQVCMSTERVIVDESVADQFVAKLAKKAGALPAGDPRSGPVVIGSMIDEAPARHVVALIDDAIGRGAVKLAGGERAGTVVPATVLDRVVPGMRIYSEESFGPVVSVIRARGVDDAVRLANDTEYGLSAAVFGRDVARALTVAQRIESGICHVNGPTVHDEAQMPFGGVKGSGYGRFGGQAGIAEFTDLRWITIETQPQHYPF

SEQ ID NO: 45003 - protein, 475 aa, Thermus thermophilus HB27
MEVKEAPTEALIGGAWRRLERRFPVVSPATGERVAEVADCGEEEAREALEEAVLAFPAWSRATAYERAQVLRRWYERILEHQEPLARLMALEMGKPLKEGRAEVAYAAGFVEWYAEEAKRVYGETVPSQFPHKRILVRYEPVGPVYGITPWNFPAAMVTRKVAPALAAGCTFVLKPAEESPLTALYLAKLFLEAGGPPGVFQVLPTSRPAEVSRPFLEDERVRKLTFTGSTEVGVRLYGEAAKTLKRVSLELGGGAPVLVFADADLDRAVEETLRAKFRNAGESCVAANRIFVQAEVAEAFAEAYARRVQALKVGDPLSEETDVGPLVNEAALRKVRTHVEDALAKGARLVAGGEAKGLFFAPTVLLDVKPESLLFREETFGPVAPLTVFREEEEAVRWANGFPVGLAAYVFTRDLSRAFRVAEALEYGIVGVNDGVPSTPQAPFGGVKRSGLGREGGKWGLLEYLEVKYVSLGL

SEQ ID NO: 45004 - protein, 322 aa, Moorella thermoacetica ATCC 39073
MKELALWQEVQADLQQVEAELLRQVDAPDPVLSQAARHLVQAGGKRLRPAFAILAARCCGAPLERILPLAVALEMIHMATLVHDDVIDASPIRRGRPTVWARWGQELSLHTGDYLFARSLILVATYDDPRIPSVLASVSVKMVQGEIQQMAAAFDLDITLRDYLDRIYRKTALLIAASCELGAIAAGADTATIRHLRYYGRNLGLAFQITDDVLDMVADPEQLGKPIGGDLRQGVITLPAIYALQASPKKQKLIHLLGKRDKTQAEIQEAIQLIKDCGGIKYALDIAEGYLERARKQASYLPPGVARDTLTSLTYYIRTRGF

SEQ ID NO: 45005 - protein, 506 aa, Aspergillus oryzae
MNVNMFKAGDDILQDVDQSCKDRLPAVEELPLPPSFTWGTATAAYQVEGGAFQDGKGKSIWDTFTHLDPSRTNGENGDIACDHYNRMAEDVVLMASYGVDVYRFSIAWARILPLGGRGDPINEKGIAFYNNLIDCLLEHNIEPVVTLYHWDVPQGLYDRYGAFLDTTEFRADFEHFARLCFSRFGDRVKRWITFNEPYIISIFGHHSGVLAPGRSSATGGDSRTEPWRVGHTIILAHTAAVQAYATDFQPTQKGDISIVLNGHYYEPWDAGSEEHRLAAQRRLEFYIGWFGDPIFLGKDYPAPMRAQLGSRLPEFTSEELDLLRRSAPINSFYGMNHYTTKYARALPDPPAEDDCTGNVEEGPTNSEGKTMGPLSGMSWLRVTPAGFRKLLNWVWDRYRRPIVVTENGCPCPGESQMTKEQALDDQFRIRYFGLYLDAISRAIYDDGVKVEGYYVWSLMDNFEWSAGYGPRYGITHVDFTTLVRTPKQSAKYLHHSFNKRRATSLR

SEQ ID NO: 45006 - protein, 334 aa, Pasteurella multocida subsp. multocida str. Pm70
MAIKIGINGFGRIGRIVFRAAQHRDDIEVVGINDLIDVEYMAYMLKYDSTHGRFDGTVEVKDGNLVVNGKTIRVTAERDPANLKWNEIGVEIAVEATGLFLDDATARKHITAGAKKVVLTGPSKDATPMFVSGVNFDTYAGQDIVSNASCTTNCLAPLAKVINDKFGIKDGLMTTVHATTATQKTVDGPSAKDWRGGRGAAQNIIPSSTGAAKAVGKVIPALNGKLTGMAFRVPTPNVSVVDLTVNLEKPATYAEICAEIKRASENEMKGVLGYTEDAVVSTDFNGCALTSVFDAAAGIALTDTFVKLVSWYDNETGYSNKVLDLVAHVYNYKG

SEQ ID NO: 45007 - protein, 952 aa, Sulfurospirillum multivorans
  misc_feature (187)..(187): Xaa can be any naturally occurring amino acid
MEKTTERALSTTVGRRSFLKMAAVASVFGATSGFAGENVTRAATEEEVKNPFPGSKKVKTICTSCSVGCGVIAEVQNGVWVRQEVAQDHPISLGGHCCKGADMIDMVRSEVRLKYPMVKENGQWKRLSWDDALNRIATKLADLKKKDGADSVQFLGSAKMGNEQAYYFRKFAAFYGTNNTDHQARIXHSSTVAGVANTFGYGAMTNSLGDIQKSKAIIIFGANPAVNHPVGFQHFLKAKERNNSQLIVIDPRFTKTAAKADIFAQIRPGTDIPFMYGMLNIIFKNGWEDKEYIHDRVFGMEKIREEALKWTPELVADVTGVPAEKLIQITTLYAKNRPGTLIWAMGLTQHSIGTSNTRMAPILQLALGNMGKAGGGTNILRGHDNVQGATDMGCLADSLPGYYGLAEGSWKYFAKQWGVDYEYLVSQFKDASWMTKNGFSLARWWAGVEGVKSDDKIENAGTTLKALVVMGNGITSIAQQAKIKEALDNLELIVLADPFVNEAAILTDKKDNVFILPAATQFETSGLVVATNRSAQWRYKVVEPLYESKADQDIMFELAKRLGFYDLYTKAMFMQETKDGKLEMIPEKKAFTWPEDATNEIARIIKTIGLTGWTAERVKKHTDNWHMFDEVTGAGMGPMKGEYYGLPWPCWTKTHGGSPNLYDTSIPVSAGGMGFRNNFGLEKDGVNLLAEKGSFPKGSKIEAGYPEITKANIEAVLGITLTEEEKAAMGANWKVDNSNLIVQKALDAGLCPYGNAKARAIVWNFPDHIPMHREPLHSPRTDLTLKYPAYPDKANHFRVMTKYISVQSAQDYAKDFPINMVTGRLVTMNGAGIENRASKYIAALTPEMFCDIHPDLALKHDIKNGAMMWVHSPEGTKIKVKAKYSHSVLPDMVFMPFHFAGYFQGTDRTGNFPAGTKPYASGESVNTVTNYGYDIITQIPETKGGLCRIEKA

SEQ ID NO: 45008 - protein, 295 aa, Mycobacterium smegmatis str. MC2 155
MDSFESDKPGADQDLNDQHNVISYPGHTEDMADKPRDEMAQYVGRGLLEGKRALISGGDSGIGRAVAVAFAKEGADVAIAYLDEHDDATHTASLVERTGRRCLRLPGDLSEVEQCRAIVSRTAGALGGIDIVVNNVAYQRPTEKFTDISDEQWRHTFAVNIDSFFYVTKAALEYLPDGGAIINTASINGLRGNKTLIDYSATKGAVIALTYALAQSLTERRIRVNCVAPGPVWTPLIPATMDAERVESFGEQAPYNRAAQPDEIAPSYVFFAADQLSSYYTGEVLAPIGGETLPG

SEQ ID NO: 45009 - protein, 187 aa, Ustilago maydis 521
MARGSAKKTASGNAFLLRLLRNGFLATNTIYLLVRFWLLRSSVTKRIVFGYVASEAVAVSLWWTLQSMAAQGNDLQQSGLTQYMFDVIYVTWFVQLASLVWSKLWYLYLIIPGYAAYVIYQKILLPYLFRGQSPFGSIQRLLGASGSAAAGATVNAQQQPTETMSKRQQKLQARAAKGDARVQIRKH

SEQ ID NO: 45010 - protein, 420 aa, Triticum aestivum
  misc_feature (255)..(255): Xaa can be any naturally occurring amino acid
  misc_feature (266)..(266): Xaa can be any naturally occurring amino acid
  misc_feature (272)..(272): Xaa can be any naturally occurring amino acid
MENMRSENNRGAAMEGVKLASEAAANTNRRALRDIKNILGAPHQPQAVSKRGLQEKPAAGAKSQAGAVGHRPVTRKFAAILQQTQPANAPLAPIGSERQKRNADTAFNAPSDMECSKASDDDLDEMMTNELKEIDMEDTEEEEEMPDIDSCDVGNSLAVVEYVDEIYSFYRRTEELSCVSPTYMAHQSDINEKMRGILIDWLIEVHYKLELLGETLFLTVNIIDRYLARENVARKKLQLVGVTAMLLACKYEEVXVPVVEDLILIXCDRAYXREDILNMERMIVDRLEFNMSVPTPYCFMRRFLKAAGSDKKLELLSFFLIELSLVDYKMLKFQPSMLAAAAIYTAQCTLNGCMSWNKCCELHTKYSEEQLMDCSTMMVELHRGAARGKLTGVHRKYSTFKYGCAAKSEPAAFLLDARRA

SEQ ID NO: 45011 - protein, 202 aa, Triticum aestivum
EMEKGNKEIDYYLRSQVEQLSKRVKEMKQGQMVSLVATLERGVGKKLREKELEVEAMNRKSQELNEQIRQVAMQVQSWQSAALYNESVASTLKTQLMQVVADHANRTREGCGDSEIESAAASGQKNINAASGGFFQSSLLPGVKSCVAAGGLAACRLCGAKEAAVLVMPCRHLCLCADCDRVADACPVCQYPKSGSVEINLS

SEQ ID NO: 45012 - protein, 947 aa, Arabidopsis thaliana
MANLIRTDHQQHIPKKRKRGESRVFRLKTFGESGHPAEMNELSFRDNLAKLLEFGHFESSGLMGSWSFQLEIQRNPNPLYVLLFVVEEPIEASLNLRCNHCQYVGWGNQMICNKKYHFVIPSKETMAAFLKLEGGGYAFPEKESFSHLVELQGHVLHGFFHSNGFGHLLSLNGIETGSDLTGHQVMDLWDRLCTGLKARKIGLNDASHKKGMELRLLHGVAKGEPWFGRWGYRFGSGTYGVTQKIYEKALESVRNIPLCLLNHHLTSLNRETPILLSKYQSLSTEPLITLSDLFRFMLHLHSRLPRDNYMSNSRNQIISIDSTNCRWSQKRIQMAIKVVIESLKRVEYRWISRQEVRDAARNYIGDTGLLDFVLKSLGNQVVGNYLVRRSLNPVKKVLEYSLEDISNLLPSSNNELITLQNQNSMGKMATNGHNKITRGQVMKDMFYFYKHILMDYKGVLGPIGGILNQIGMASRAILDAKYFIKEYHYIRDTSAKTLHLDRGEELGIFCTIAWKCHHHNNEIKVPPQECIVVKKDATLSEVYGEAERVFRDIYWELRDVVVESVVGGQIEITRVDEMALNGNKGLVLEGNVGMMMNIEVTKCYEDDDKKKDKRIECECGATEEDGERMVCCDICEVWQHTRLTKSTKKNRLLINSQRRRRPKRSGLETMIKSEADLSDVIVIRDVWAYNLESEFDLIRGIVEDYPFISMDTEFPGVIYKADLDVLRRGNPNYLYNLLKSNVDALSLIQVGLTLSDADGNLPDLGGQKNRRYIWEFNFRDFDVERDPHAPDSIELLRRHGIDFERNRREGVESERFAELMMSSGLICNESVSWVTFHSAYDFGYLVKILTRRQLPVALREFLGLLRAFFGDRVYDVKHIMRFCEQRLYGGLDRVARSLEVNRAVGKCHQAGSDSLLTWQAFQRMRDLYFVEDGAEKHAGVLYGLEVF

SEQ ID NO: 45013 - protein, 329 aa, Chlamydophila pneumoniae CWL029
MPSPMISTDVCQDILGKQKEAVDFFFQAFQPKEAMQLAEKILGHSGWVFFSGVGKSGCVARKLVATLQSLSERALFFSPVDLLHGDLGLVSPGDIVCLFSKSGETQELLDTVPHLKSRRAILVAITSMPYSNLAALSDLVVILPSVAELDPFNLIPTNSTTCQMIFGDFLAMLLFHSRGVSLSTYGKNHPSGQVGMKANGKVKDFMFPKTEVPFCHLGDKVSFSLEVFSAYGCGCVCIVDPQFRLMGIFTDGDLRRSLASYGGEVLSLSLEKVMTANPRCITEDSDIAIALQLMESSSPVAVLPVLDNEENRHVTGLLHMHTLAKAGLL

SEQ ID NO: 45014 - protein, 193 aa, Aspergillus nidulans FGSC A4
MADKKPSDPTQTNPRGIPVAPFVDNVSDYVSSRADVEPTMRSFQEMISKYQFMEVNTSRRAAGLREKIPDIKKTLEMVTFLKARKESSSATPLETNFELNDTLYARATVDPAHTEEVYLWLGANVMLAYPIAEAQAMLEDKLAAAEQSLANCDEDLEFLREQITTLEVATARVYNWDVVQRRKERAEGKEETS

SEQ ID NO: 45015 - protein, 352 aa, Glycine max
MAPSFDFASSLLCTEDSTVFDESHNNGGTMMTAMGVYEDTRSPRRRHFDEEPDELPLLSDESLVMMVEKECQHWSGLRYLNKFQTGDLDFGARMEAIDWIHKVRSHFGFGPLCGYLSINYLDRFLFAYELPKGRVWTMQLLAVACLSLAAKLDETEVPLSLDLQVGESKFLFEAKTIQRMELLVLSTLKWRMQAITPFTFLDYFLCKINDDQSPLRSSIMRSIQLISSTARGIDFLEFKPSEIAAAVAMYVMGETQTVDTGKAISVLIQHVEKERLLKCVQMIQELSCNSGSAKDSSASVTCLPQSPIGVLDALCFNYKSDDTNASSCVNSSHNSPVAKRRKLNKTCGAEQL

SEQ ID NO: 45016 - protein, 155 aa, Solanum tuberosum
  misc_feature (143)..(143): Xaa can be any naturally occurring amino acid
TTLMDVLAGRKTGGHITGNIYISGHPEKQETFARVSGYCEQNDVHSPCLTIHESLLFSAWLRLSSQVDVKTQKAFVEEVMELVELTSLRRALVGLPGVDGLSQSKGKRLTIAVELVANPSIVFMDEPTSGLDARSAAIVLITXKNIVYTGRTILC

SEQ ID NO: 45017 - protein, 155 aa, Solanum tuberosum
TTLMDVLAGRKTGGYIDGSIKISGYPKKQETFARISGYCEQNDIHSPYVTVYESLVYSAWLRLPQDVDEHKRMMFVEEVMDLVELTPLRSALVGLPGVNGLSTEQRKRLTIAVELVANPSIIFMDEPTSGLDARAAAIVMRAVRNTVDTGRTVVC

SEQ ID NO: 45018 - protein, 441 aa, Brassica napus
MGSTPAEVPCDVVSDNRSGLGGGISDVYGEDLATLDQLVTPWVSSVASGYSLMRDPRYNKGLAFTDKERDAHYLTGLLPPVVLSQEVQERKLMHNLRQYTVPLQRYMALMDLQERNERLFYKLLIDNVEELLPVVYTPTVGEACQKYGSIFRKPQGLYISLNEKGRILEVLKNWPQRGIQVIVVTDGERILGLGDLGCQGMGIPVGKLSLYTALGGIRPSACLPITIDVGTNNQKLLDDEFYIGLKQRRATGQEYADFLHEFMCAVKQNYGEKVLVQFEDFANHNAFDLLSKYMDTHLVFNDDIQGTASVVLAGLIAAQKVLGKSLADHTFLFLGAGEAGTGIAELIALKISKETGAPIEETRKKIWLVDSKGLLVSSRKESLQHFKQPWAHEYEPVKDLIGAVNAIKPTVLIGTSGVGQTFTKEVVEAMATNNEKPLILA

SEQ ID NO: 45019 - protein, 155 aa, Solanum tuberosum
TTFLDVLAGRKTSVHVEGEIKVGGYLKVQETFARVSGYCEQTDIHSPQITVEESVIFSAWLRLHPQIDSKTKYEFVKEVLETIELDGIKDTMVGMPGVSGLSTEQRKRLTIAVELVANPSIIFMDEPTTGLDARSAAIVMRAVKNVADTGRTIVC

SEQ ID NO: 45020 - protein, 341 aa, Staphylococcus epidermidis RP62A
MATNIAINGMGRIGRMVLRIALNNKNLNVKAINASYPPETIAHLLNYDTTHGVYDKKVEPIESGIKVNGHEIKLLSDRNPENLPWNEMDIDVVIEATGKFNHGDKAVAHINAGAKKVLLTGPSKGGDVQMIVKGVNDNQLDIDTYDIFSNASCTTNCIGPVAKVLNDKFGIINGLMTTVHAITNDQKNIDNPHKDLRRARSCNESIIPTSTGAAKALKEVLPEVEGKLHGMALRVPTKNVSLVDLVVDLEQNVTVTQVNDAFKNADLSGVLDVEEAPLVSVDFNTNPHSAIIDSQSTMVMGQNKVKVIAWYDNEWGYSNRVVEVADKIGQLIDDKAMVKAI

SEQ ID NO: 45021 - protein, 719 aa, Gibberella zeae PH-1
MAGFFNKIKGSGTATTTTPNKQDAVAKKKEEPVLDLTPLEKMLQNAGSLRDDGTDRFFGLENALFYSESFRNNVVNYPPISPTETNGSRPKVPITIRPPPTDPVENAPKQKGLSTSQVIKQRQNSSHQLPGQVGVRPEDKPDTPEYKKKQAMIKGPILELARENATSYGMDECTFTGLKDIFLALLESNTHTGVLSPQRFLEIFKRDNEMFRNSMHQDAHEFYGLVLNDVINSVESAARQMKLQAPTNGTDGLANSVEHVLGSAMANHVAGTSSPATGWVHDIFEGVLTSETKCLTCETASQRDETFLDLSIDLEEHSSVTSCLRKFSAEEMLCERNKFHCDHCGGLQEAEKRMKVKRLPKILTLHLKRFKYTEDYSRLQKLFHRVVYPYHLRMFNTTDNAEDPDRLYELYAVVVHIGGNAYHGHYVSIIKVPGRGWILFDDEMVEPVDKNFVRNFFGDKPGMATAYVLFYQETTFEKVREEQEKEGMEEVKLASEAANLAQENGDKPDTSPLKRQATQPMSPLAHHESMANLAHARTAPAMPSAPPPDASPPPTATTNGLSRVQTQKEEVKSKEDKKREKKEREAAEKAEKLAEKEREKQAKLDDKKRREDNLRAMQQTRRNENDELAKVLEASKKSAAQEDEARKKENGTPQSNGILDRTKRGSKSMSRKSFSLFHKDKSGAQAPDTPNGDSSEKHDKLKDRLSFSLGRKKSTNLLS

SEQ ID NO: 45022 - protein, 201 aa, Yarrowia lipolytica CLIB122
MSFRGRGGFRGGRTGAPMQMGPPDQVFEMGAFLHACEGDIVCKSINEKIPYFNAPIYLENKTQVGKVDEILGPMNDVMFTIKPSEGFQAASFKSGDKFYIGGDKLLPLERFLPKPKATGVKKPKAAGGRGGARGGARGGFGGRGGARGGFGGRGGARGGFGGAPRGGRGGFGAPRGGRGGFGGRGGGRGGFGGGRGGRGGY

SEQ ID NO: 45023 - protein, 424 aa, Bordetella parapertussis 12822
MSDTTPAWMAQGYPHIWLPYAQMKTAAPPLPVVRSHGSLLELADGRTLIDGVASWWTACHGYNHPHIAQAVREQLDRMPHVMFGGLAHEPALNLASRLSALLGPGLERVFYTDSGSVAVEVAMKMAVQFWLNQGERGRTRFVAFRGGYHGDTFGTMAVCDPDEGMHAMFRGLLPEHDVLALPRDEAALAALQAHLERHAGRIAGMLVEPLVQGAGGMLLHDPQVLARLRELADRYGILLIFDEIFTGFGRTGTMFAFEQAGVRPDIITLSKALTGGTLPLAATVASARVFEGFWSDDPGHALMHGPTFMGCALACAAANASLDLFEREPRLRQVAALEQALRAGLEPCRDLPWVRDVRVLGAIGVIELDGIGARDDLRRRLVDAGVWVRPFGNIVYLTPAFTIAEDELQALLAAVRQVVAERRP

SEQ ID NO: 45024 - protein, 274 aa, Zea mays
  misc_feature (241)..(241): Xaa can be any naturally occurring amino acid
  misc_feature (247)..(247): Xaa can be any naturally occurring amino acid
MAASRLLRPASRLMASTRQAPAFRPAFRAAALTPSIARRGYASGQKEMTVREALNEAMAEEMERNDKVFVLGEEVAQYNGAYKVTKGLLDRFGEKRVIDSPITESGFAGLTVGAALAGLHPVCEFMTFNFAMQAIDQIINSAAKTHYMSGGIQPCNITFRGPNGFAAGVAAQHSQDYTAWYGSIPGLKVVSPYSAEDAKGLLKAAIRDPNPVVVLENELLYGLSFPVSEEVQRDDFVIPFXKAKIEXPGKDLHIVTLSRCVGQSLVAAETLKSK

SEQ ID NO: 45025 - protein, 333 aa, Pasteurella multocida subsp. multocida str. Pm70
MKTLGQFIVEKQAEYPNAKGELSGILSSIRLVAKVIHRDINKAGLTNNIIGTSGAENVQGETQMKLDLFAHNTMKQALISREEVAGFASEEEENFVAFDTERGRNAKYVILTDPLDGSSNIDVNVAVGTIFSIYRRVSPIGTPVTLADFMQPGNRQVAAGYIVYGSSTMLVYTTGNGVNGFTYDPSLGVFCLSHENIQIPANGKIYSINEGQYLKFPQGVKKYIKYCQEEDKATHRPYTSRYIGSLVSDFHRNMLKGGIYIYPSATNYPNGKLRLLYEGNPMAFLAEQAGGMASDGYQRILDIQPTELHQRVPLFLGSKEMVEKAQDFMKTFG

SEQ ID NO: 45026 - protein, 160 aa, Ustilago maydis 521
MAAENAPMELDSPSTKQPRFQVKKWNAVCLWSWDIQVEDRLLLVVQCQTDAIGCWDVAVDLALDRLPHQCAICRNHIMDLCIECQANQGSATTEECTVAWGQCNHAFHFHCISRWLKTRQVCPLDNRDWELQNFNSLAPFILTRLALILLAPAHSNRYGR

SEQ ID NO: 45027 - protein, 343 aa, Bradyrhizobium sp. BTAi1
MRAVVIHAPKDLRIDSFPDPAPGAGEVRVKIEAGGICGSDLHYYHHGGFGTVRIKQPMALGHEIAGVVAAVGAGVSGLSEGTRVAVNPSLPCGQCAYCREGLRNQCLDMRFMGSAMRDPHIQGGFREYVTVDAAQAVPIAPSLSLGEAAMAEPLSVCLHAAHQAGSLLGKRVLVTGCGPIGALSILVARYGGAAEIVTTDVADAPLAVAGRLGASHAFNVGTEPSALDPWRAGKGQFDVLFEASGNQSALRSALDVMRPGGVIVQLGLGGEMTLPLNTLVTKELQLRGTFRFDREFELALRLMGEGLLDVKPLISATLPFQEAIAAFELASDRSRSMKVHLTF

SEQ ID NO: 45028 - protein, 394 aa, Triticum aestivum
  misc_feature (56)..(56): Xaa can be any naturally occurring amino acid
  misc_feature (388)..(388): Xaa can be any naturally occurring amino acid
QVCTKKQAGTGPEFPGYRRPTRPSMFSVAEQQQAKADWDAESHRDDEDYASDPGAXDDIEDSRNSPLISRQATSVEGKEIAAPHGSIMGGVGRSSSMQGGEAVSSMGIGGGWQLAWKWTEREGADGQKEGGFQRIYLHEEGVSGDRRGSILSMPGGDIPPGGEYIQAAALVSQPALYSKDLIEQQLAGPAMVHPSEAVAKGTKWAELFEPGVKHALFVGIGLQILQQFAGINGVLYYTPQILEQAGVGVLLSNIGLSSSSASILISALTTLLMLPSIGIAMRLMDMSGRRFLLLSTIPVLIVALAVLVLVNVLDVGTMVHAALSTISVIVYFCFFVMGFGPIPNILCAEIFPTSVRGICIGICALTFWIGDIIVTYTLPVMLKAIGLXAGIFGI

SEQ ID NO: 45029 - protein, 299 aa, Bradyrhizobium sp. BTAi1
MVEFAQEDGSLFRRGFGGDTLNTALYLARLGVPTSYVTALGDDPLSAMMLAAWQAEGINTAEVLRVDGRVPGLYMIERDAKGERSFLYWRDRAPARELFDRADPAMLDRLSRFDLIYLSGISLSLYSETGKAKLRELLTVARKRGARVAFDGNYRPRGWPSREAAQRAFRAILPLVDLALPTLEDEQMLFGDSDVSVSLRRFKDAGVREIVVKRGARGCLIDADGVLVDITPPQVMQPVDTTAAGDSFNAAYLAARLNRVPPRKAALAGHRLAGAVIMSPGAVIPRAAMPKDILVQSET

SEQ ID NO: 45030 - protein, 539 aa, delta proteobacterium MLMS-1
MNTQVRPVLLAILDGWGEAPAGPGNAVALAATPNMDRWRRQYPLTTLVAHNGAVGLPKGQMGNSEVGHLNIGAGRTVYQEFTRISLAVENGEFYDNPTLVETVERVRETGGALHLLGLLSDGGVHSHLEHLIALLELARRRGLAKVYIHAFMDGRDTSPHGGRGYMETLLAAIDRLGVGQVATVCGRYYAMDRDKRWERLQLAWEAVVEGSGQYTAAEPLAAVDEAYNRGETDEFIKPTVVVAAGAAPVKIDHGDGVIFFNFRADRARQLTAALSQDDFAGFERPRRPALSALTTMTRYEKDFELPVAFPPQTLERIMGEEVSRHGLKQLRIAETEKYAHVTYFFNGGREEPFDGEERALIPSAREVATYDLKPEMSAAEVTAELLRRLQPAAAPAAAANAAAGGPATTSPYALVVLNFANGDMVGHSGVLPAAIKACEAVDHCIGQVVEAFTAVGGAVLITADHGNAEEMLDEQGNPMTAHSCNPVPLLLIDPGARQPGTLRDDGTLTALAPTILDLMGLPVPREMDGGSLLQPAGGR

SEQ ID NO: 45031 - protein, 443 aa, Triticum aestivum
MYGGDEVSAIVIDVGSYSCKAGYAGDDTPKCVFPSVVGSIEQTGDTDEAKPEKEADSGSDPKNGSKPMDVDKAKTKRKFYLGQELEFRRDHMEVISPLKDGTVMDWEVVDNIWNHAFRRRLLINPEEHPMLIAEPSTNSGQQREKAAELMFEKYKVPALFLAKNAVLTSFASGRATSLVVDCGGGSTVVSAVHDGYVLQKSVATSPIGGEFLTDCMMKSLESKGVVIRPRYSFKKKEVSPGDYKVVDLDFPNTTDSYRLYHMRAIASDIKETVCRVPDTPFDEVAYANVPTTSYELPDGQTIEVGAERFKIPDILFNPFLSQTIPGIDGFGDSTSIRGLPRMVLESVNRCDVDIRKELLSSILLSGGSSSILQLKDRLEKEVLEESPQNARVKVLASGNSTERRFSVWIGGSILASLGSFQQMWFSKAEYEEHGVSYIQRKCP

SEQ ID NO: 45032 - protein, 100 aa, Brassica napus
MTEVVLHIYDVTNSGSEKTNNTILQINRFFKDGIGLGGIFHSAIQVYGDEEWSYGFCEQGTGVFSCPSSKNPMYTYREKIVLGKTDCTIFMVNQILRELS

SEQ ID NO: 45033 - protein, 321 aa, marine gamma proteobacterium HTCC2207
MSNTKSKLTQLKEMTTVVADTGDFDAIAQYSPEDATTNPSLLLKAAQMPAYRGLVDSIVSTTMNGRQSSNEQLADCMDRLAVGFGEKILEQIPGRVSTEVDARLSFDANASIAKARHLINLYEQAGIGRERVLIKMASTWEGIRAAEQLEKEGINCNLTLLFNFTQAVAAADAGAFLISPFVGRILDWYKNSTGLTEYEPADDPGVQSVTRIYNYYKQTGYNTVVMGASFRNTEEITELAGCDRLTISPQLLQALDDDYGTLERRLDPADTGSTIHYSLGGESGFRFELNQDAMATEKMAEGIRGFVADQMKLETWLKDLD

SEQ ID NO: 45034 - protein, 325 aa, Oryza sativa (indica cultivar-group)
MVEAEATKGPHRDLLDDAAISRRRWRRAAVAGGGSGRADTADTPHASSVVPLLCYVLPSLSDPKLACVASSFLSTSDSARRAALALIVATASSPLEQWMKRFEEAERLVADVVERIAERESVSPSLPQELQRRTAEIRRKVAILETRLDMMQEDLSQLPNKHACKSLKELNKLAAKHSTLSSKVKEVGAPFTRKRFSNRSDLLGPDDNHAKIDVSSIANMDNREIIELQRNVIKEQDDELDKLEETIVSTKHIALAINEELDLHTRLIDDLDEKTEETSNQLQRAQKKLKSVTTRMRKSASCSCLLLSVIAVVILVALLWALIMY

SEQ ID NO: 45035 - protein, 998 aa, Picea glauca
MSREVPLHFLFFCIILTISSCFAIRGSQEGLILQELKRGFDDPLEVFRNWNEHDNSPCNWTGITCDAGEKFVEEVDLSNTNIIGPFPSVVCRIDGLKKLPLADNYVNGSIPADLRRCRKLGYLDLSQSLIVGGLPDFISELSRLRHLDLSGNNLSGPIPPAFGQLLELQVLNLVFNLLNTTIPPFLGNLPNLLQFNLAYNPFTGTVPPELGNLTKLQNLWLAGCNLVGEIPETLGNLAELTNLDLSINRLSGSIPESITKLDKVAQIELYQNLLSGPIPVAMGELKALKRFDASMNMLNGSIPAGLGSLNLESLNLYQNDLVGEIPPGLGSFASLTELKLFSNRLTGRLPESLGRYSDLQALDIADNLLSGSLPPDLCKNKKLEILSIFNNVFAGNIPESLGTCTSLNRVRLGGNKFNGSVPSSFWGLPHISLLELKDNNFEGLISPDIANAKCLSQLVINGNTFTGSLPTEIGELRNLSEIIASNNFLTGALPPSVGKLQQLGKLDLSNNQLSGELPAEISSCKQLGEINLSKNQFSGSIPASVGTLPVLNYLDLSDNLLTGLIPSEFGNLKLNTFDVSNNRLSGAVPLAFANPVYEKSFLGNPELCSREAFNGTKSCSEERSERAKRQSWWWLLRCLFALSIIIFVLGLAWFYRRYRNFANAERKKSVDKSSWMLTSFHRLRFSEYEILDCLDEDNVIVSDGASNVYKATLNNGELLAIKRLWSIYKTNASNDNGFQAEVDTLGKIRHKNIVKLWCCCSKSDSNLLVYEYMPNGSLGDLLHGPKASVLDWPIRYKIALGAAQGLAYLHHGCVPAIVHRDVKSNNILLDEDYVAHVADFGVAKILQSCARGADSMSAIAGSYGYIAPEYAYTLKVNEKSDIYSFGVVILELVTGRRPVDPEFGENKDLVKWLCNKIEKKNGLHEVLDPKLVDCFKEEMTMVMRVGLLCTSVLPINRPSMRRVVEMLQEANPHHKAKATGKDGKLSPYYCEEPTICIV

SEQ ID NO: 45036 - protein, 371 aa, Oryza sativa
MDAMTKQEILLEKKRVITVQGRDKAGRPIVRIVGKNFPARELGGGGHAEAALKGYVRRRVTPAIGDAEFVVVYMHSGVDRRENFPGVGAVRTAYESMPAAVRERLHAVYFLHPGLQSRLFFSTLGRFLFSSGLYGKLRYVSRLEYLWAHVRKGELDVPEAVRRHDDELEQRPLMDYGIEASERTSKNGPKPHCTPPSPPKHRRHLNHMNMARSNLLCCLGTRREDNARQRQTRPTPRPRLRRLMSGMKRVFGRSPPCGQTAVAPDSGIVVVEPRRQTAARRVGKGARDGGVNNREEISREEAAAATIQAGFRGHLARRAFRALRSLVKLQALARGSYVRKQAGVAIRFMKVLVRLQVRVRARQLLHRSKDQ

SEQ ID NO: 45037 - protein, 155 aa, Solanum tuberosum
TTLMDVLAGRKTDGYIEGTISIPGYPKQQETFARIAGYCEQTDIHSPHVTVYESLLYSAWLRLPREVDTETQKSFIEEVMELVELTPLREALVGLPGVNGLSTEQRKRLTVAVELVANPSIIFMDEPTSGLDARAAAIVMRTVRNTVDTGRTVVC

SEQ ID NO: 45038 - protein, 466 aa, Bacillus cereus ATCC 10987
MKTVVVIGGGITGLSTMFYLEKLKKDYNIDLNLILVEKEEYLGGKIHSVEEKDFIMESGADSIVARNEHVMPLIKDLNLEEEMVYNETGISYIYSDNTLHPIPSDTIFGIPMSVQSLFSSTLVSTKGKIVALKDFITKNKEFTKDTSLAVFLESFLGKELVERQIAPVLSGVYSGKLNELTMASTLPYLLDYKNKYGSIIKGFEENKKQFQSAGNKKFVSFKGGLSTIIDRLEEVLTETVVKKGVVTTAVSKQGNRYEVSFANQESIQADYVVLAAPHDIAETLLQSNELNEQFHTFKNSSLISIYLGFDILDEQLPADGTGFIVTENSDLHCDACTWTSRKWKHTSGNQKLLVRMFYKSTKPVYETIKNYNEEELVRVALYDIEKSLRIKGEPEVVEVTKWKDLMPKYHLEHNQAVQTLQEKMKDLYPNVYLAGASYYGVGIGACIGNGKNTANKIIATLNEPTN

SEQ ID NO: 45039 - protein, 651 aa, Moorella thermoacetica ATCC 39073
MGDKVFYVTTPIYYPSDKLHIGHALTTTMADTLARYKRLRGYDVYFLTGSDEHGQKIQRKAREANLEPIQYVDRIVATFQELWRRLNISYNDFIRTTEPRHARVVQALLQKIYDQGDIYKSTYEGWYCTPCETFWTERQLVDGNCPDCGRPVELVKEESYFFRMSKYADRLLQYIKDHPDFIQPVTRRNEMISFIEGGLEDLCISRTTFDWGIPVPMDPKHVIYVWFDALTNYISALGYGTADDHLFRKYWPAAVHLVGKDIVRFHTIIWPIILMAAGIEPPRQVFGHGWLLVDGGKMSKSRGNVVDPMILIDRYGSDAIRYFLLREMPYGADGYYSEEALINRYNTDLANDFGNLLSRTTAMIEKFNGGVIDPPSAPEPLDEELKNLAAGIPDEVDNALNHYEFARALAAIWRLVNRANKYIEETAPWALARDPGQKQRLQTVLYNLAEAVRQATIMVGPFMPGVPDRVWDQLGLKDVPAALTWESLATWGGIPAGTRVRRGEALFPRIDLKEGEIPVAEKATEPVKVAEAAPAGGAVARPGEEEITIEEFARIKLRVALVLEAEKVANADKLLKLRVRVGNEERTIVAGIARYYQPEELVGKKVVIVANLKPARLRGIVSQGMVLAAVDDESLSLVTPERAIKDGAQVR

SEQ ID NO: 45040 - protein, 300 aa, Oryza sativa (japonica cultivar-group)
MADEWWSASQRSHGTSACSAAPSPLTADRVSCGWTSPAAAAAAESTSSITFQDPSRSSAAHHQPLSDAASSLGDPHMVDWTQAFLRRAPLHGLSFDAGEPAVAPATHSITTSFGDYQHSASYDAAAAVMQFSQTPRAPSLPAAAQMQFLSGSYQLPFGGAPPLPSQLLLQAMQPKPSCSSNANTLLAKVRKEKLGDRITALQQLVSPFGKTDTASVLHEAIEYIKFLHEQVASLSSPYLKNGNPLQHFQQKGSESTKDAEQPKPDLRSRGLCLVPVASTYTVASETVPEFWHPTFGGTFR

SEQ ID NO: 45041 - protein, 399 aa, Mesorhizobium loti MAFF303099
MSGSALYETFARAPLAFDHGEGTWLVTDKGERYLDFAGGIAVNSLGHSHPHLVAALTEQAAKLWHVSNLYEIPGQSRLGQRLVDATFADKVFFTNSGAEALECAIKTARRYHFVKGHPERFRVITFEGAFHGRTLATIAAGGQYKYLEGFGPKVEGFDQVGFDDIDAAEKAITPETAAILIEPVQGEGGIRPVPTQSLKRLRQLCDQHGLLLIYDEVQCGIGRTGKLFAHEWSGVAPDIMAIAKGIGGGFPMGACLATDEAAVGMTAGVHGTTFGGNPLAMAVGNAVLDVVLEDGFLEDVQRKALLMKQGLAAIADEFPDVVEDIRGTGLMLGLKCAMPNTKVNMALRDQHLLAVPAGDNVIRLLPPLTVTDAEIHEALNRIRAGAKGLADAIAVAAAK

SEQ ID NO: 45042 - protein, 989 aa, Arabidopsis thaliana
MKAKYGERSQGTYFMAGEDLISKLPDSLITQILLYLPIKDIVRTSSLSSRWKSLWLLIPRLDLDSEEFQDYNAFVGFMNKFIDFSGEEKICLDKLKLSSRKTVNDLPCVTRWIDFVVRRKLKHLDVECLVNRKFLEEMPLSLYVCDTLVNLRLHRVLLGKFEAVSLPCLKTMRLEENVYANDVVLESLISSCPVLKDLIILRMFEDNVKVLRVHSLTLTSLNIDFNFGEGDDFVDGFDKKVSGVLIDAPRLKYLKFQDDLSGSKIITNSGSLAKVNVVYVFNENDCADVVDIPRRNMVRNFLTSISGVSDMKISQHFVEFLYYYKDFDPLPQFCNLSRLKAEISLYFLEILPTILESCPNLKSLVMEFYLQEEDEPIIFSSVPRCLVSSLESVEIKKFNGRPAKMEMILANYFLENEAVLKKFTLRLYCGKVEEESVIFMELLKFRKCSASCEVVVQRIETYPTMIHSESVGAATFAAIGFFGSEESMITCLECFSQKRNQMSNRGDRISSLPDELLCQILSNLPTKNAVTTSILSTRWRSIWLSTPVLDIDIDAFDDATTFVSFASRFLEFSKDSCLHKFKLSVERDDVDMCTIMPWIQDAVNRRIQHLEVDCRFSFHFEAVYLTLYLSETLVSLRLHFVTLHRYEFVSLPNLKVMHLEENIYYCLETLENFISSCPVLEDLTVVRIVDIITEKILRVRSRSLNSLKLVLDSSNGWFIDDIDEWKVIIDAPRLAYLSLKDDQSASFVISNLGSSAKADIKVSFNVNDIWDLPVTFERSNVGKLLTGLSSIRDLTISGTTLMIICHYLKHEPMPQFCNMVRLNARFYDCDLEMLPCVLESCPNLKSLVLKLKGEMETEETSFSSSVPKCLQSSLENVEIIRPNYGNGEEMKLSKYFLENSGLLSSAETEQQSRVSSVPPCFLSSLEFVEIRSRLCRKRYVMKVARYFAKNSVMLKKFVYVGRVSIQEEDLLALLWRYSICEIEVRGLRR

SEQ ID NO: 45043 - protein, 395 aa, Pseudomonas syringae pv. phaseolicola 1448A
MPSSACYRSPRRPNLLKPRFPMPTADTRQDAFLPTPYAQNHAANLHELADGTLLCTWFAGTQEGMADIFVLLSRRDPATGVWSEPQKMSEDSSRSEQNPILFQAPGGPLWLIWTAQISGNQETAIIRRRLSLDNGQSWGPIDTLFDKPGTFVRQPPVVLDNGDWLLPVWYCITGPGEKWVGNHDVSAVMISTDQGHSWTRHDVPDSTGSVHMNVHQLPDGSLLGLFRSRWADFIYSSRSTDRGRSWSAPTPTELPNNNSSIQFVKLATDELALVYNPVSAEGHAQRRASLYDEIEDEGDDRVTPGARQDGKAAVWGIPRAPMSLAISRDGGHSWPTRLDLELGDGFCLTNNSQEKLNREFSYPSIIQAADGSLHVAFTYFRQKIKHVHLPLNAIR

SEQ ID NO: 45044 - protein, 349 aa, Lactobacillus rhamnosus
MKASMLEDLNKFSVKEIDIPSPKKDEVVVKVMAAGTCGSDSHKMISGWKYGYPAVMGHEFSGIVTQLGENVSNVSVGQHVAVAPFIPCFKCHYCQIGLFQMCENYSMLGQQKFGGFEQYVSVPARNVLDIGKMSFEEGALIEPMAVAAHAVMGIKPELGDTVAVFGLGTVGDLVVRLLISSGATNVIGIDIDDQKLEKGLDEGCTHVINSAKESLEEKIMEYTDGLGVDISMECAGSKITEEQTLLVTKRRGKVGFVGIAYSDVLLHQKAFENIFRHELTVTGFWNSYSAPFPGREWTNSIQLVNRGRIKIKDLITHRFELEDMQKAFNMITTRSESFNKVMFFPNGIN

SEQ ID NO: 45045 - protein, 814 aa, Oryza sativa
MAAAAARRGSSLLSRCLLSRPSAAASPAVPSALRRADGTQGLLPGILQRFSTAAVAEEPISPPVQVNYTQLLIDGKFVDSASGKTFPTLDPRTGELIAHVAEGDAEDINRAVHAARKAFDEGPWPKMTAYERSRILLRFADLIEKHNDEIAALETWDNGKPYAQAANIEVPMVARLMRYYAGWADKIHGLVVPADGPHHVQVLHEPIGVAGQIIPWNFPLLMFAWKVGPALACGNTVVLKTAEQTPLSALFASKLLHEAGLPDGVVNVVSGFGPTAGAALASHMDVDKIAFTGSTDTGKVVLELAARSNLKSVTLELGGKSPFIIMDDADVDHAVELAHFALFFNQGQCCCAGSRTFVHERIYDEFVEKAKARALKRVVGDPFKNGVEQGPQIDDEQFNKILRYIKYGVDSGANLVTGGDRLGDKGYYIQPTIFSDVQDNMRIAQEEIFGPVQSILKFNDLNEVIKRANASQYGLAAGVFTNNLNTANTLTRALRVGTVWVNCFDVFDAAIPFGGYKQSGIGREKGIDSLKNYLQICAGDGEDGRQWGSTAPWVVPRCGVRRAKAPGLVLLLCRRPAEPRPPSYPFFHLRRPWRLPWHWEEWVGCGREEAAAQFPLDLVVSQLADLVEAGRAWRPHRPPLHPLPRPHLAHQSRRLCVPAPAAAGDARSGDSGGPGGDGGSGGAVGGGLEGGGFGGRRGAGSEAFPAGEGWEVRGDGARLRGALRQHHLLRRHGAAPVLPAAASVVRRRPSSLGQIWERREEGMGGQGWRRHFLPLASPSRRTRSSPPVTAAVTGGGVEREERNEEGMWREEELI

SEQ ID NO: 45046 - protein, 211 aa, Brassica napus
  misc_feature (196)..(196): Xaa can be any naturally occurring amino acid
MRPWRRKKMSEQREWFLKNGSTFLQELIADSNGISNPIRFFSSDQILKATDRFHPNCFISRHRFFTWYKGVIEDRPYAIKKFTDSWFSEESEREVYDDIVLSARVSNHTSFLKLLGCSLEFPLPVIVFEYPENGVLNEQGACEDGTLLPWNVRLKIAKEVAVAVTNLHTAFPRIIIHRDIKPTNVFLDKNWNAKLXDFTFSVSLPCGEVLD

SEQ ID NO: 45047 - protein, 668 aa, Haemophilus somnus 2336
MVTRRELANAIRFLSMDAVQKAKSGHPGAPMGMADIAEVLWRDFLNHNPTNPQWANRDRFVLSNGHGSMLIYSLLHLTGYDLSIEDLKQFRQLHSKTPGHPEYGYAPGIETTTGPLGQGITNAVGMAIAEKTLAAQFNRAGHDIVDHHTYVFLGDGCLMEGISHEACSLAGTLGLGKLIAFYDDNNISIDGHVDGWFTDDTQKRFEAYGWHVIPAVDGHNAEQIIEAIKQAQAEKNKPTLIMCKTIIGYGSPNKQNTHDSHGAPLGDEEIALTRQALNWNYAPFEIPADIYAKWNAHEKGQVAENAWNEKFAAYEKAYPELAVEFKRRLNGELPANWATESQAFIEKLQANPANIASRKASQNAIEAYAKLLPEFLGGSADLAGSNLTLWSGSKPIRATENIDGNYINYGVREFGMSAIMNGIALHGGFIPYGATFLMFMEYAHNAVRMAALMKQRSLFVYTHDSIGLGEDGPTHQPVEQTTALRLIPNLETWRPCDQVESAIAWKAAVERQDGPSALIFTRQNLAQMNRTSEQLENVKRGGYILRACCEKGDCPDLILIATGSEVELAMKAAEALDAEGVKVRVVSMPSTNVFDKQDVAYREAVLPSAVTKRVAIEAGISDFWYKYVGTNGRIVGMNSFGESAPADQLFKLFGFTVENIVAKAKEIL

SEQ ID NO: 45048 - protein, 128 aa, Candida glabrata CBS 138
MSAVGSLIFCDDCGNLLDNPEDKINNSNVIECSQCQAEYAKSQFTNLKVVTSTSEDAFPSSLRLKRSVVKTHLKRDELKDDGATIKEKCPKCGHDEMRYQTLQLRSADEGATVFYTCIKCNYKYRTNN

SEQ ID NO: 45049 - protein, 433 aa, Oryza sativa (indica cultivar-group)
MADQLISTADHDTLPGNYVRPEAQRPRLADVLSDASIPVVDLANPDRAKLVSQVGAACRSHGFFQVLNHGVPVELTLSVLAVAHDFFRLPVEEKAKLYSDDPAKKIRLSTSFNVRKETVHNWRDYLRLHCYPLHRYLPDWPSNPPSFREIISTYCKEVRELGFRLYGAISESLGLEQDYIKKVLGEQEQHMAVNFYPKCPEPELTFGLPAHTDPNALTILLMDQQVAGLQVLKEGRWIAVNPQPNALVINIGDQLQALSNGRYKSVWHRAVVNSDKARMSVASFLCPCNDVLIGPAQKLITDGSPAVYRNYTYDEEIISTYCKEVRELGFRLYGAISESLGLEQDYIKKVLGEQEQHMAVNFYPKCPEPELTFGLPAHTDPNALTILLMDQQVAGLQVLKEGRWIAVNPQPNALVINIGDQLQVMHISVSLSD

SEQ ID NO: 45050 - protein, 140 aa, Glycine max
MAKKRKRSSDAPAPAAVEKPDDSAPERPERTLFGFKDSADDPASKDAGQFFRNKEKVLITCSRRIIYRYRHLMQNVVSLLPHAKKDSKVESKQSKGSALNELVELRSCSSCLFFECRKQKDLYLWMVKSPAGPSVKFLVN

SEQ ID NO: 45051 - protein, 87 aa, Nicotiana glauca x Nicotiana langsdorffii
GQGRCPRDALKLGVCANLVGGLVGAIVGSPPTLPCCSLIAGLADLEAAVCLCTAIRANVLGINLNVPLSLSLVLNNCGRNPPTGFTC

SEQ ID NO: 45052 - protein, 283 aa, Crocosphaera watsonii WH 8501
MNKKPNYYNHNGFLMPMGFPIEGFTSALQYQAQESDIFLVTYPKCGTTWTQYILWLMQHQGEPLSPSEKLETYIPHLEEVGKETVEKLPKPRVIKTHLPYNLTPYNPQAKYIYVARNPFDCLVSFYHHTRGFVQHYDFTDGTFDDFFECFIRGKVDFGDYFDNLVPWYEHKDDPNVLFFTYETMKADLKSIIIKIGNFLGNKYLYTVENESIINKIIVNSSLQKMKKDQQRWSSKRPENMPSFVRKGKVGSWKDYFSPEQKQRLTEKFIMKTAGTGLENLWLD

SEQ ID NO: 45053 - protein, 420 aa, Zea mays
  misc_feature (24)..(24): Xaa can be any naturally occurring amino acid
  misc_feature (176)..(176): Xaa can be any naturally occurring amino acid
  misc_feature (395)..(395): Xaa can be any naturally occurring amino acid
PPAQVDVGLSDGSFARGAVPSAQXGASTDDVIYEALELRDGGSDYLGKGVLKAVNNVNSIIGPAIVGKLDGTSNEWGWCKQKLGANAILAVSLAVCKAGAMVQKIPLYQHIANLAGNKTLVLPVPAFNVINGGSHAGNKLAMQEFMILPTGASFKEAMKMGVEVYHHLKSIIKKNXKKYGQDATNVGDEGGFAPNIQENKKGLELLKAAIEKAGYTGKVFIGMDVAASEFFSEKDKTYDLNFKEENNDGSNKISGDSLKDLYKSFVSEYPIVSIEDPFDQDDWTTYAKLTGEIGQQVQIVGDDLLVTNPTRVAKAINEKTCNALLLKVNQIGSVTESIEAVRMSKRAGWGVMASHRSGETEDTFISDLSVGLATGQIKTGAPCRSERLAKYNQLXLRIEEELGVAAVHAGAKFRAPVEPY

SEQ ID NO: 45054 - protein, 373 aa, Staphylococcus epidermidis RP62A
MAELKRGLEGVIAAETKISSIIDSQLTYAGYDIDDLAENAQFEEIIFLLWNYRLPNENELSELKEKLFDYMTLNNRVYKHFEEYVTDHVHPMTALRTSVSYVAHFDPEAENESDENKYDRAIRIQAKIASLVTAFARVRDGKEPVKPNSELSYAANFLYMLRGELPTEVEVEAFNKALILHADHELNASAFTARCAVSSLSDMYSGVVAAIGSLKGPLHGGANERVMSMLKEIGSIDNVDHYLDERFANKDKIMGFGHRVYKDGDPRAKYLREMSRKITEETGQSELFEMSLAIEKRMKEEKGLIPNVDFFSATVYHSMNIPHDLFTPIFAVSRTSGWIAHILEQYRDNRIMRPRAKYIGEQNRKYVPIEERP

SEQ ID NO: 45055 - protein, 237 aa, Triticum aestivum
  misc_feature (159)..(159): Xaa can be any naturally occurring amino acid
MAPAVMASSATTVAPFQGLKSTAGLPVGRRSSGSLGSVSNGGRIRCMQVWPIEGIKKFETLSYLPPLSTEALLKQVDYLIRSKWVPCLEFSKVGFVFREHNSSPGYYDGRYWTMWKLPMFRCTGRHTVLNEVEEVKKEYPDAYVRVIGFKTWPQGQGVXFIPFKPPGCQGTREGPNHKTKTRAQYPEEGLFENLPILAQKPRLGRNLDFRPRRTNTFRSKIRYRGKRTAPKQKSLLE

SEQ ID NO: 45056 - protein, 370 aa, Pseudomonas syringae pv. phaseolicola 1448A
MIKSRAAVAFEAKKPLEIVEVDVAMPKAGEVLLRVVASGVCHTDAYTLSGADPEGIFPSILGHEGGAIVEAIGEGVTSVAVGDHVIPLYTPECRQCKFCRSGKTNLCQAIRATQGKGLMPDGTTRFSYKGEPIFHYMGTSTFSEYTVLPEISVAKIDKQAPLEKVCLLGCGVTTGIGAVLNTAKVKPGDTVAIFGLGGIGLSALIGAVKAKASRIIAIDINPAKFEIAKQLGATDCVNPKDFDRPIQEVIVDMTDGGVDFSFECIGNVQLMRAALESCHKGWGESVIIGVAGAGQEISTRPFQLVTGRVWRGSAFGGVRGRTELPSYVDMAQTGEIPLDTFITHTMGLEDINKAFDLMHEGKSIRTVIHF

SEQ ID NO: 45057 - protein, 271 aa, Escherichia coli
METYAVFGNPIAHSKSPFIHQQFAQQLNIEHPYGRVLAPINDFINTLNAFFSAGGKGANVTVPFKEEAFARADELTERAALAGAVNTLMRLEDGRLLGDNTDGVGLLSDLERLSFIRPGLRILLIGAGGASRGVLLPLLSLDCAVTITNRTVSRAEELAKLFAHTGSIQALSMDELEGHEFDLIINATSSGISGDIPAIPSSLIHPGIYCYDMFYQKGKTPFLAWCEQRGSKRNADGLGMLVAQAAHAFLLWHGVLPDVEPVIKQLQEELS

SEQ ID NO: 45058 - protein, 322 aa, Staphylococcus epidermidis RP62A
MKKIAVLTSGGDSPGMNAAVRAVTRTAIYNNIEVYGVYQGYQGLLDDDIHKLELGSVGDTIQRGGTFLFSARCPQFKEEDVRKKAIENLRKRGIEGLVVIGGDGSYRGAQRISEECKEIQTIGIPGTIDNDINGTDFTIGFDTALNTIIESVDKIRDTASSHARTFIVEVMGRDCGDLALWAGLSVGAETIVLPEVNTDIKDVAEKIEQGIKRGKKHSIVMVAEGCMSGQECADELTKYINIDTRVSVLGHIQRGGSPSGADRVLASRLGGYAVELLKQGETAKGVGIRNNQLTSTPFDEIFAESNRKFNSQMYELAKELSI

SEQ ID NO: 45059 - protein, 299 aa, Yarrowia lipolytica CLIB122
MSTVEKSFEEQFKLQAGLAQMLKGGVIMDVVNAEQAKIAQEAGAVAVMALEKIPADIRADGGVARMSDPAMIKEIMAAVSIPVMAKCRIGHFVEAQIIEEIGVDYIDESEVLTPADQFHHINKRDFKVPFVCGAKNLGEALRRIHEGAAFIRTKGEAGTGDVTEAVKHMRTIQSEINKTRHMSEIELYTYAKEIGASFDLLKITAKEGRLPVVNFAAGGVATPADAALCMQLGCDGVFVGSGIFLGNNPAERAKAIVQAVTHYKDPKVLAEVSSNLGPAMVGRTVESLRAHDKLASRGW

SEQ ID NO: 45060 - protein, 317 aa, Rhizobium leguminosarum bv. viciae 3841
MHHCSRSGTVLSRYSFLFLGWNNNIFFVQNASGRRCLLAADAKETGSMTVEWKDMMLDKVAIGPVSARIYQGADYGKGPPIVLYLHGGAFLDSDKNVDRPVAMSLAKAGAIVVAADYSSLSGNLFPQALEVSFSVFTYLANKRAGLGDRKSLLFVAGEEAGGNVAAGVALKARDQMPDALDGQVLISPLLDPFMGTSSIRKAEAIGMRQRWTEGWSHYLSGGGCHPYAAPCLCSRISGVAPALIFTAEDDPLHDETIGYGARLKQAGVGVRQHVLPAGTGWPSIYGGKSDGAPDWQENVSRHFGSFLRDVSVQPQLH

SEQ ID NO: 45061 - protein, 510 aa, Bacillus anthracis str. A2012
  misc_feature (56)..(56): Xaa can be any naturally occurring amino acid
MLASYIEWKEECVDHLNGIYAFAVWDEQKEQVFIARDRLGVKPLFYKYDSGRLLFXSELKAILAHPDVKAEVTLEGLSEIFGLGPSRTPGHGIYTGIKELRPGHAMTFSKNGLCIWRYWNVESKKHEDSFEETVEKTRFLLQDAITRQLVSDVPLCTFLSGGVDSSAITAIAAKEYEKSGKGQLHTYSVDYEDNDKYFKANAFQPNSDAPFIHLMTETFQTIHHRCVISNEQLAQYLTEAVLVRDLPGMADIDSSLLWFCREIKQDFVVGLSGECADEIFGGYPWFYREDDLQSSAFPWMRSTEAREQLLKKEWRNKLNLQQYVQQRYEESIQEVPILDGESPLEAKRRQLFYLNMVWFMTTLLDRKDRMSMGASLEVRVPFADHRLVEYAWNIPWEMKMYKNREKGLLRKALEGLLPNDILYRKKSPYPKTHNPHYTKAVTVWIQDLLTDKGSILHELFDKEQLSGLIESGGSAFQTPWYGQLMTGPQLLAHLAQIHVWFKEYGVNIKE

SEQ ID NO: 45062 - protein, 1020 aa, Lactobacillus plantarum WCFS1
MPKNNAIHSIAVIGSGPIKIGQAAEFDYAGTQACLSLKAAGYHVILINSNPATIMTDTATADEVYLEPLTLTSVTKILRAAHPDALLPTLGGQTGLNLAMALDQAGVLNELKIQLLGTSLATINQAEDRAAFKTLMKRLHQPIPASTTVHHVTSALSFAEKIGYPVIVRPAFTLGGSGGGIANNAAELTQTLQRGLTMSPVTECLIEQSIAGFKEIEFEVMRDNQGTKIIVCSMENFDPVGIHTGDSIVYAPVQTLTDTEYQQLRTAALTIVEALDIRGGYNVQLAQDPNSRQYYVIEVNPRVSRSSALASKATGYPIAKIAADIAIGLNLSEIKNPVTQTTYAAFEPALDYVVAKIPRFAFDKFPTADAHLGTQMKATGEVMAIGSTLEEATLKAIASLEIDPKTQASLTPDHHVTTTEYIDQLTHPTDQRLFYLLAALQAGWPLAKLATLTQITPFFLSKLQHIAQLIRNIKQVPTSQHLLSAKKYGVSLATMAHYAQTSVATIAAMTADLPFVYKMVDTCAGEFASVTPYFYSTAFGQTNESHPLGHSILVLGSGPIRIGQGIEFDYTTVHCVKAIQQAGYHAIIVNNNPETVSTDFSTSDKLYFEPLTIERLMPIIALEQPAGVIVQFGGQTAINLAHQLTKLGVTVLGTSVSATDLTEDRQSFADCLRLLKIAQAAGTTVTELSGARQAAHAIGYPLLVRPSFVLGGRAMAIVHNDHELTPVIKSAVAAGHGAPILMDQYLAGTECEVDVLSDGTSCFIPGIMEHIEGAGVHSGDSITVYPPQHLSPAVQDKIVTIATKLAQHLHCVGMMNIQFVVTDDVYVIDVNPRASRTVPYMSKVTHLPLAQLATRLILGQSLATLGLVPGLLTPAPQQIAIKAPVFSFNKLPQSPVVLSPEMKSTGETLGIGPTFTTAWHAAMADSYHLETWQTVDGLITDIATVAQPAVQELFAANHLTVTTIANTTDWPAKTKAVGFTLNDQPDNPVAIAALNHGQPLITAIDTLKTLLAVTPTPATI

SEQ ID NO: 45063 - protein, 338 aa, Zea mays
DQIWASDSVLPSTSIPSGFAAEFSFSSSASEASPIPAMSLPAISLYTSPPGAVYSSEFDPTSRGSSPCTTAALLPPAASHRLPSGGGGGGGGLSCLFSSPAAAAAPPRNPAHDDLGALWHDRSDDLSAAAGGGGYPYSHSHSSSPLKWRDPHHHHSPVSVFQGLSSSSPSRSPPASWLAARDRERLFAGFVRNALGSCVDYAPPTSPRPEVGAGELAFELDENLLEAGPACEPYARELLTSAQDCHRIFHEELVVRAFLEAEKAHRGQMRASGDPYLQHCVETAVLLAKIGANATVVSAGLLHDSIDDSFIDYDHIFHIFGAGVADLVEGSHNISSLT

SEQ ID NO: 45064 - protein, 162 aa, Glycine max
MYHGKFSLTPKNEVKDLTGSSFPSYKHSSQLDPIDVSSSSDDENDLPNDDVSNQLVLYDPVANGNNAIELAPDPLQCEPPLLPRSKPSHSVPRALPSVGVFTVQCASCLKWRLIPTKEKYEEIREHIIEQPFVCQKAREWRPDVSCDDPEDISQDGSRVWAI

SEQ ID NO: 45065 - protein, 247 aa, marine gamma proteobacterium HTCC2207
MGKPLIAGNWKMHGTAESARKLATEVSHHNAQETAAEIIIFPPLVHISAVSDALSDSSISVGAQNVSQYSNGAYTGEVSAEMLLDQGCKYVLVGHSERRAILGESDQTVAEKFRAAQNAGLIPILCVGESLQQRQQDATLEVVAKQISAVIDLVGLDRVCQSVIAYEPVWAIGTGETASPEQAQDVHAVIRTQLGEAGRSTTLLYGGSVNKSNAAELFKQPDIDGGLVGGASLEADEFLNIAQLVEA

SEQ ID NO: 45066 - protein, 482 aa, Arabidopsis thaliana
MSATLKNPVIKLKLLIDEEKNKVVFVEAGKDFVDLLFSFFTLPMGTIVRLLEMYKKSQKIAIGCFSNIYASVVSMGIEHFLTEACKQMLLYPGSLNHEKCRNLKLRVDDSEATKYFVCPKFVEREQCTESYSNFNTSRCSCGVLMNEVTQLDGRGGLASAGNGVEGGVFVRSDHTSFMITDDLKVEITSVRLTLNVLKDLGYVDCEKLDEKIHDVNLEEVPTLLECLSTSDNPLTDTFLKKKSSYSTKRIQKLPSPGLCEDREESTPDQTITLNVVKKEGNILFVECGDDFVDLLFTFLAIPLESAWGIAGDGIIIGCIGNLSKSFKDLSVDPGREAKCVLPHYYKCQKQLLDAVTTHKPPTFYLYVSSMASNHIREYRLSEDSSKPLVYFWDELMPMISIDPKSKGSTNTTDESTIPSGGFMKRGTKFMITDDLIITPLNSTSTIGLVKEKQIRLDDVEVQEIIIRKEEQSANLKKPKIET

SEQ ID NO: 45067 - protein, 393 aa, Chaetosphaeridium globosum
MTKTKQIKNFTLNFGPQHPAAHGVLRLVLEMNGEVVERAEPHIGLLHRGTEKLIEYKTYLQALPYFDRLDYVSMMAQEHAYSLAVEKLLNCEVPLRAQYIRVMFCEITRILNHLLALTTHAMDVGALTPFLWAFEERERLMEFYERVSGARMHAAYIRPGGVAQDLPLGLSEDIYKFTQQFASRIDELEEMLTNNRIWKQRLVDIGVVTAQDALDWGFSGVMLRGSGINWDLRKAAPYDVYQQLDFDVPVGTRGDCYDRYCIRVEEMRQSLRIIAQCLNAMPTGMVKVDDRKITPPSRSQMKQSMESLIHHFKLYTEGVSVPEGSTYTAVEAPKGEFGVFLVSNGTNRPYRCKIRAPGFVHLQALDFMSKHHMLADVVTIIGTQDIVFGEVDR

SEQ ID NO: 45068 - protein, 146 aa, Thermus thermophilus HB27
MNRGALIKLVESRYVRTDLPEFRPGDTVRVSYKVKEGNRTRIQDFEGIVIRIRRNGFNTTFTVRKVSYGVGVERIFPLHSPLIQKIDIVQRGRARRAKLYFIRNLSDREIRRKLRADRKRIDKDRAAERAAKEEVQKAQEPEASQE

SEQ ID NO: 45069 - protein, 389 aa, Lactobacillus plantarum WCFS1
MTMQHVFPTYQRFPFAITDGQGVHLTDNHGKTYLDFTAGIGVCNFGYHQPQIQAAVTQQLTHIWHTSNLYENELQDAVAGLLANGEERLVYFANSGTEANEAALKLARKYTGKTGILAFQHSFHGRTYGAMSMTGNPHIQAGYAPLVPGITFATYNDDAALDKITPELAAVILEVVQGEGGVFAGQTAWLQAVNAKCQATGVLLIIDEVQTGIGRTGYRMAYEGYGLDPDIYTVAKGLANGLPVGAMVGRRQLATAFGPGSHGSTFAGNAVAMAAAKCVLPQLTPALLTTVRAHAKLVWQSLATQVEPIPVVKQITGKGLMIGIHLDEQIPVNQVITRLQVEGLLTLSAGDNTLRLLPPIVMQPADLLAGIALIAKVLTTLTTEVTTNE

SEQ ID NO: 45070 - protein, 226 aa, Methanothermobacter thermautotrophicus str. Delta H
MEVFMNLKKMAALRAVDEIDDGDVVGLGTGSTTHYFIEELGRRVREEGLEVMGVPTSYQSMFLAAESGIKVTSLAEHDVDVAVDGADEVDPDLNLIKGGGAAHTLEKIVDSSAASFIVIVDESKLVERLGAFPLPVEVIPAACRPVKLKLESMGASVNIRSSEGKDGPVVTDNGNFVLDAAFGVIDDPGAMESRLNNIPGVVENGIFAGIADMVIAGTSEGLKILR

SEQ ID NO: 45071 - protein, 409 aa, Moorella thermoacetica ATCC 39073
MNYVLIGNSVAAVNAVAGIREYDREGDITIVSAENYYAYGRPLISYWLEQRVNEKNLPYRPETFFARNKVRVLLGRRAVRLDPEARQVFLDNGESLPYDRLLLATGGRPFLPSINGLTPENHYTFMTYDDARRLEKAASPGREAVILGAGPTGLKAMESLVRRGVKVTLVELADRIWAPALDPEAASMVAGFLQDRGVNIYLNDTLDGVRRGDNGRLDLELKSGRRLAADILVVAIGVRPNVELLQDLPGATINRGVVVGADLSTGLPGVYAAGDVVAGNPPLLPHAAIQGKIAGRNMAGGRETYKPIPPYNALGILGLHIISIGLSAAGEGYEILQEADPAARVYRKLVLQDNRLVGGLLINKIDRAGIYRYLIEEGIEVTSFKDRLLQPDFGLLSLPDTIWQQQLAK

SEQ ID NO: 45072 - protein, 126 aa, Triticum aestivum
  misc_feature (54)..(54): Xaa can be any naturally occurring amino acid
  misc_feature (74)..(74): Xaa can be any naturally occurring amino acid
  misc_feature (83)..(83): Xaa can be any naturally occurring amino acid
  misc_feature (85)..(86): Xaa can be any naturally occurring amino acid
  misc_feature (88)..(88): Xaa can be any naturally occurring amino acid
  misc_feature (90)..(90): Xaa can be any naturally occurring amino acid
  misc_feature (94)..(94): Xaa can be any naturally occurring amino acid
  misc_feature (109)..(109): Xaa can be any naturally occurring amino acid
  misc_feature (111)..(111): Xaa can be any naturally occurring amino acid
  misc_feature (114)..(114): Xaa can be any naturally occurring amino acid
  misc_feature (123)..(123): Xaa can be any naturally occurring amino acid
MPDPTVPCRTAVTSASRRCLRKSPCFKTQKVRITNFLDERSAYLTNSPKDADTXFDMIGAKRHERLHSNWGTKXWERPDSKMXSXXGXKXNAKXEIEMNKGVRNSKTDXRXENXGFLKNLGRXKQT

SEQ ID NO: 45073 - protein, 482 aa, Ralstonia eutropha JMP134
MQLRDPSLFKALACIDGQWVGADSGATIEVTDPATGEIVAKVPDLRAAETERAIAAAERAQKGWARKTGKERAIILRRWFDLMIANTDDLAYLMTREQGKPLDEAKGEIAYAASFLEWFAEEAKRVDGEVLASPAADKRLVTLRQPVGVCAAITPWNFPAAMITRKAAPALAAGCAIVIKPAELTPLSAFALAELAHRAGVPAGVLQVVTGDARTIGAVLTASPIVRKLSFTGSTEVGRILMAQSAATVKRLSLELGGNAPFVVFDDADVDAAVDGAIAAKFRNGGQTCVCANRFYIQDGIYDAFATKFAQRASQLRVGNGLEQGVVIGPLIEEAAVEKVTSLVDDATSKGGRLLTGGLKHQLSGTYYAPTVIADATATMRVAREEIFGPLAPLFRFKRDEDAVAAANATEYGLAAYLYTRDIARAWRTAEALEYGMVGLNTGLISNEVAPFGGIKQSGLGREGSRHGIEEYLETKYLCLQM

SEQ ID NO: 45074 - protein, 187 aa, Oryza sativa (japonica cultivar-group)
MVYHSSFVDDTGITKACGCPLLPLKTHIRGPAPAFDQEPCQAADLCRAITDKADIVDEAITFFRANVFFKNFNVKSPADKLLIYLTFYINIALKRLEGCRTLAVGTKAIINLGLEKVPVPGEPGFPFPGLFTLPQSQEEAELLRNYLKQIREETSGRLLNCAYRANGTPNKWWLAFAKRKFMNIVIL

SEQ ID NO: 45075 - protein, 447 aa, Ralstonia eutropha JMP134
MTITSPKLPQAAELDLKAHWMPFSANRNFHDDPRMVVAAKGRWLIDDQGRKVFDGLSGLWTCGAGHARAEIQAAVASQLGTLDYSPAFQFGHPQSFMLAERIAELFPGDLNHVFYTGSGSECADTAVKMARAYWRIKGQPAKTKLIGRARGYHGVNIAGTSLGGIGGNRKMFGQLMDADHLPHTLQADCAFTKGQAETGGVELANELLKLIELHDASNIAAVIVEPMSGSAGVIVPPKGYLQRLREICTQHGILLIFDEVITGFGRLGKASGAEYFGVTPDIANVAKQLTNGAIPMGAVIASSEIYNTFMAQPTSGHAVEFGHGYTYSGHPVACAAGLATLDLLARENLIQQAADLAPHFEQAIHGIRGAKHVVDIRNCGLAGAIQMAPRDGDATIRPFEAGLALWKKGFYVRFGGDTLQFGPAFNTTISELDTMFDSVGAVIETLA

SEQ ID NO: 45076 - protein, 508 aa, Ralstonia eutropha JMP134
MEQSKVKHIGMLVETDILIIGSGFSGLGMAVAMKREGKHDFLVLERAEDVGGTWRDNHYPGAACDIQSHLYSYSFRPNPRWSRVYASQPEIHAYLRDTAEAEGVLSHLRFGETVLKAEWLVERGGWRVATTNGEYFAPVLVSAAGHLSDPSYPDIPGLDKFKGKVFHSARWDHSYDYSGKRVGVLGTGASAIQIVPELAKSAGRLTVFQRSAPYVIPRRDHVYSEAEKGLFERFPDVAQELRDELFWGNESRFPQRRQVPAFIEQIKSTALNHLRNQVLDDSLREKLTPQYAIGCKRILISNDYYPTLQKENVALETSGIASMDENGVILKNGERVDLDLLVVATGFEAADLPIAEVIHGTNGLSLAEKWKSGGQAFACTSVAGFPNFFFMLGPNTGLGAGSMVFMIETQINYIREGTNYVFENEVTVDPNAAAEREYVEGIYRRSAGTVWVEGGCSSWYLHPSNGKLTTLWPDFMTQFRKENGSFSPRGYEISPRNVAAMPAQMEEA

SEQ ID NO: 45077 - protein, 387 aa, Pseudomonas syringae pv. syringae B728a
MPINVEDYYSAETFKKMKAFADKQETPFVVIDTDIISKAYDDLRAGFEFAKVYYAVKANPAVEVINLLKEKGSSFDIASIYELDKVLSCGVGPERMSYGNTIKKSKDIRYFYEKGVRLFATDSEADLRNIAKAAPGAKVYVRILTEGSTTADWPLSRKFGCQTDMAMDLLILARDLGLVPYGISFHVGSQQRDISVWDAAIAKVKVIFERLKEEDGIVLKLINMGGGFPANYITRTNSLETYAEEIIRFLKEDFGDDLPEIILEPGRSLISNAGILVSEVVLVARKSRTAVERWVYTDVGKFSGLIETMDEAIKFPIWTEKKGEMEEVVIAGPTCDSADIMYENYKYGLPLNLAIGDRMYWLSTGAYTTSYSAVEFNGFPPLKSFYL

SEQ ID NO: 45078 - protein, 444 aa, Moorella thermoacetica ATCC 39073
MDDKEKRAAVLQQAEEWGVKFVRLQFTDIFGVLKNVAIPVDQLPKALNNELMFDGSSIEGFVRIEESDMYLRPDPDTFVVFPWRPHEGSVARLICDVYNPDGTPFAGCPRSTLKRVMAEAAEMGFTMNAGPEAEFFLFHTDADGRPTLETQDRAGYFDLTPVDLGEDARRDMVLTLEQMGFEIEASHHEVAPGQHEIDFKYAEALTTADRIATFKFVVRTIAQRHGLHATFMPKPIYGINGSGMHANLSLSKDGKNAFDDPSDELGLSQVAYHFIAGIMAHARALTAVTNPTVNSYKRLVPGYEAPVYIAWSPRNRSPLIRVPAKRGASTRIEVRHPDPSCNPYLALAVLLKAGLDGIKKGLTPPPPTDKNIFAMTPAELKAEGIGVLPGSLEEALAALEQDEVIREALGPHIYERLTLAQKMECEEYRTRVHQWEIDQYLTKF

SEQ ID NO: 45079 - protein, 443 aa, Moorella thermoacetica ATCC 39073
MNEQLTKEDVLQMVEEMNVRFIRLQFTDIFGVLKNVAITPAELEKALDGELMFDGSSIHGFVRIEESDMYLRPDPTTFAIFPWRPMDGAVARLICDVYNPDGTPFAGCPRGVLKRVLAEAEAMGYTMYAGPEAEFFLFHTDGQKPTLVTHDQAGYFDLSPVDLGEDARRDMVLSLEAMGFEVEASHHEVAPGQHEIDFKYDNALATADKIATFKFVVRTIAQRHGLHATFMPKPVAGINGSGMHTHQSLFKEGQNAFYDPDDPLQLSKVAYYYIGGLMHHARALAAITNPTVNSYKRLVPGFEAPVYIAWSPRNRSPLIRVPAKRGASTRIELRNPDPSCNPYLALAVMLKAGLDGIKKQIQPPAPTERNIYEMTPAERRDLGIGSLPGDLKDALAELSRDEVIREALGDHIYQHFVEAKEKEWEQYRIQVHQWEIDHYLTLF

SEQ ID NO: 45080 - protein, 773 aa, Oryza sativa
MAPADIPPPLEGKKRRIGVMTSGGDAPGMNGSVRAVVRMALHSNCEAYAIYEGYDGLVKGGDMIKEMKWEDVRGFLSEGGALIGTARCMEFMQRDGRRTAAKNMILKGIDALVICGGDGSLTGADRFRDEWPSLLEELVERKELTKDQVAPFKHLNIVGLVGSIDNDLSMTDATIGCYSSLARICEAIDSVDTTATSHQRAFVVVTMGRHCGWLTLMAGVATGSDFIFIPKQPAKEGWEGNMLHIIQKHRAMGKRKTIVIVAEGAIDENLNKITPHQIKEILSEAGLDTRVTTLGHVQRGGQPAAYDRMLSTLQGAEAVKAVLEATPETPSPVICMIENKIVRRPLLEAVAQTKKVAEAIEKKDFKTAMDLRDAEFSEYFKAYQITTAAEQPNLMLPKEKRMRVGIIHVGAPAGGMNAATRAAVAYCLARGHTPVALHNGFPGLIRHHSDKPLGAVRDIDWLDAETWANKGGSEIGTNRGLPSEDLETVAYVFKEYKIEALFVVGGFEAFTAVSELRKGREHYKSFKIPMVILPATISNNVPGTEYSIGSDTCLNALIQYSDACRQSASASRRRVFVVETQGGESGYIATIAGLSIGAFAVYTPEDGISLKMLDHDIDALRDAFTKDKGQNRAGKVILVNEKASKTYSVQIIADMIAEAGKGKFESRHGVPGHFQQGTIPSPMDRVRAVRFAFRSMEHIEQYAGMDPDDIDDDAMSTAVIGIKGAKVLFSPMEAIEKKETDWHRRRPKKEFWMELKQYVDILSGRPPNNKAQH

SEQ ID NO: 45081 - protein, 613 aa, Moorella thermoacetica ATCC 39073
MCGITGWVDWELDLTGQKNILEAMTATLACRGPDAAGTWVAPRVALGHRRLVVVDPAGGGQPMVRRRGNQTFVLTYNGELYNTGEIREELLSRGYTFRGHSDTEVLLTAYMEWGVECVRRFNGIFAFAIWDEARERLFLARDRLGVKPLFYATLPHSFLFGSELKALLAHPAIKPEVDAEGLAEVFVLGPARTPGHGVFHNLAELKPGYYMTYDRQGLRLHQYWALQSHPHTDNLETTIAKVRQLLQDTVERQLVADVPVCTLLSGGLDSSAVTVFAARAFQGRGQGHIHTWSVDYIDNDRYFQPSHFQPNPDAPWVKLVSEHLETIHHYVYIDTPELVDSLKAAMRARDLPGMADVDSSLLLFCREVKREATVALSGEAADEVFGGYPWFRSEKALAANTFPWNRAGQERIRLLSPELKAMVRPEEYVARRYREALAEVPALPGEEARAARLREISYLSLTRFMPVLLDRKDRMSMAVGLEVRVPYCDHRLVEYVWNIPWEMKFVGQMEKGILRRALAGILPAEVINRRKSPYPKTYNPAYLEAVRNWMLDILADPASPLLPFIDVAAVKALTQSREVFNLPWFGQLMSGPQLFAYLAQIDTWMREYGVSVR

SEQ ID NO: 45082 - protein, 884 aa, Coxiella burnetii RSA 493
MVAKNINLQDIDPVETQEWKEALDSVVEYENVDRAEFILEKLLAHARNVGVSVPTGIHTPYLNTIPAETEAQLADDEIKVMQRLTNYLRWNALAMVMRVGRKKAGLGGHLSSYASMATLFEVGLNYFFRADDLVFFQGHSAEGIYARAFLEGRLSERDLIHFRQEALTKGISSYPHPFLMPDFWQFPTVSMGLGPLMAIYQAQLLKYLHHRKLVDTAGRKVWAFCGDGETGEPETLGGLLVASREKLDNLIFIVNCNLQRLDGPVSGNGKIIQELEGLFRGAGWRVIKVIWGQDWERLFKKDKSGLLLKRVSEMVDGEYQACFSKDGAHLREHFFGKYPELLELVSDMSDDELKQLTDGGHDPQKVYAAYTEAMKDCGKPTVILTKTVKGYGYGKEGESQNIAHNLEEISEEGLKIFRQRFDLPLSDKQLRDLEFYKPDDNSPELNYLRKQREKLGGPLPARDGKFESIKVPDLSLFEPVLKGTEERSVSTGAAFSRIMGLMLKDKNIRDRIVPIVADEARTLGLEGLFRQTGIYAVEGQKYTPEDQSKLIFYREDKTGQLLQQGISEAGAMASWIAAATSFANNNYPLIPVYTYYAMFGYQRVGDLVWAAADMHARGFILGGLAGRTTLPGEGLQHQDSHNLLMFSMVPTCRSYDPAFGYELAVIIQDGLRRMYQDKENVFYYLTLMNESYQHPPMPKGVEESIVKGMYLFKKGNGKLSKRVQLLGAGAILREVIAASEILEEQFKVAADVWSVPSFNLLRHDIESVDRYNRLHPDTAPKQNYVQKCLDNQKGPVIAATDYMKLLANQIREAVKQPYYVLGTDGFGRSDTRPALRDFFEVDAKMVVYTALKALADQNEFEKDQLLSAMKKLGIDPNRPDPWTV

SEQ ID NO: 45083 - protein, 474 aa, Coxiella burnetii RSA 493
MTKEIKTEVVVLGSGPGGYAAAFRAADLGKKVVLVERYETIGGVCLNVGCIPSKALLHVAKVIDDAKDMSSFGIDFGKAALEIEKIRSWKENVVKKLTGGLKMMAKQRKVEIITGYGKFSSSNELAVENKEKSVTKIKFDQAIIAVGSLPVKLPFIPDDPRIMDSTGALELEDVKGHLLVLGGGIIGLEMATVYHALGTKISVVEMMDQLIPGADADVVKPLHQRIQKRYEEILLKTKVTKIEPKKDGLYVTFEGENAPKEPKKYDRILVAVGRSPNGKLIDAEKAGVKVDDKGYIAVDKQMRTNVSHIYAIGDVVGQPMLAHKATYEGRLAAEVIAGIKHYNDARCIPAVAYTDPEVAWVGLTETQAKEKGIKYEKGVFPWAASGRALSLNRSEGSTKLLFDEKGTVIGGGIVGVNAGDLISEVALAIEMGCDAEDVGLTIHPHPTLSETVMMACEMFEGTITDLIPPKKKDK

SEQ ID NO: 45084 - protein, 542 aa, Zea mays
MDANTLLLPCSDGAVAGAVDFRGRPASRSGTGRWSAAMFVLGVEIAERFAYHGVSANLISYLTGPLGESTAGAAAAINAWSGVATMLPLLMACVADAWLGRYRTIVLASLLFVVSMGMLTVSALPAFHHDGCSSYASASRPLACSPPPVQVGVFYVSLYLVALAEAGHKPCAQAFGADQFDQNDPKESASRSSFFNWWYFGMCSGTAVTTLVSSYIQDNVGWGLGFGVPCLVMLFALLMFLLGTRNYRYYTSTESSPFARLATAFVALIKGSKSRQHDGTLASDDAGHREEVKGVLRLFPIGATCIIYAVIFSQSSTFFTKQAATLDRRVGSTLRVPPAALQTFISVTIMAFIPVYDRAFVPLARRLTRLSSGITMLQRIGTGLVLALVAMVVAALVEMRRLAVARDAGLVDQPKAALPMSLWWMVPQYVLFGLSDVFAMIGLQEFFYDQVPDALRSLGLAFFLSIFGVGHLFSSFIISAIDGATKKSGASWFSNNLNRAHLDYFYWLLAGLCAVELAAFIIVSRVYVYKKRMSHDNNAAAM

SEQ ID NO: 45085 - protein, 897 aa, Burkholderia sp. 383
MTAPLALPDIDPQETREWLDALESVIALEGRPRAHFLLDQLSDLDAARHGDLHGRVTTAYVNSVPRERQPAYPGDLALERRLNAMIRWNAMVMVLRAGRHSNVGGHIATYQSAAVLYDVGFDHFFRGRTDTFDGDMVYIQGHSAPGIYGRAYLEGRITDAQLDNFRRETGREAGRDGLSSYPHPRLMPDFWQFPTVSMGLGPLTAAYQARFMRYLEYRGLKAHQGRKVWAFLGDGEMDQPESLAAISLAGRERLDNLIFVVNCNLQRLDGPVRGNGKVIQELEGTFRAAGWNVIKVIWGAGWDRLLERDTTGLLRRRMMECVDGDYQTFKSQSGAYVREHFFGKYPELLELVADLSDDDIWKLARGGHDPEKVHAAYAQAMRADGRPTVVLAKTVKGFGMGEAGEGQNVNHQLKKMSADAVRAFRDRFALPVSDAQLDELPYLKPEPGSAEARYFEERRAALGGHVPARLSHVEPLPVPPLAAFDGQLKDSGERGLSTTMAFVRILGTLLKDPALGKLVVPIVPDESRTFGMEGLFRQIGIHSHLGQLYTPQDAGQLSYYKEAKDGQILQEGINESGAIASWIAAGTAYSNHGLPAIPFYIFYSMFGLQRVGDLAWAAGDARTRGFLLGATSGRTTLMGEGLQHDDGHSHVLSSVIPNCVSYDPTYAYELAVIVRDGLRRMFAEQEDVYYYITLLNENYPHPALPDGAEAGILKGLYLLREDTSRAADTPRAPHVQLMGSGAILREVLAASDLLAQDFGVSSDVWSATSLNELRRDGLAAERWNLLHPEQAPRVPYVQQCLDGRTGPVVVATDYMKIVGDQIRAFVDGRRFVSLGTDGFGRSDTRDALRTFFEVDRHFIVIAALKALADDGAIPRARVGEAIRRYGIDIDKVDPASV

SEQ ID NO: 45086 - protein, 511 aa, Synechococcus sp. RS9917
MERRYGGQLLDPWSETPCHQQPMASAPLPLAAAPIKFGTDGWRGILGVDISVERLLPVAAASAQELAARAPEGLRSRTVVIGYDRRFLAPELAAAIAAAVRGCGLEPLLTDTPVPTPACSWAVVQRQALGALVITASHNPPEWLGLKIKGPFGGSVEGDFTAAVEQRLAVGGITPPVAGETSRFDGRGEHLDGLRRKLDLPSLCRGLEAMHLRVIVDPMHGSAAGCVAELLGDGINDRRLVQEIRSQRDPLFGGHPPEPLAPYLGDLIAAVKQATAAGQHAVGLVFDGDGDRIAAVDEEGRFCSTQQLMPLLIDHLARARQLPGSVVKTVSGSDLMRLVAEDLGREVLELPVGFKYIAAEMLAGEVLIGGEESGGVGFGMHLPERDALFAALLVLEALVEGGQPLGARIHALQQRCGGASHYDRLDLRLADMDCRRRLETLLAEEPPQEVAGAPVQEVIRTDGVKLRLGPSHWLMLRFSGTEPLLRLYCEGPDAARVAAVLDWARALATAV

SEQ ID NO: 45087 - protein, 372 aa, Burkholderia sp. 383
MQTARSGPPVRTPDTRRAAAACLERLLTQRLAPRGRAVSPLGAMRAAADCLERDAATSERVWIVRADAREPSADTGAHRRISAWPLRFLDARKRFEKPLLYLLHARATDRLRLASVETIDRGIFVNDAETVASSWPKGVTPDVPHWLAANPACTPYDPASGHEAIAILRHALRTLYVAGQPGFCYLASHDNLVPDAKPLSATAARDAFSGMVRAGRRAAAGAAAQIRLCGAGSTLAQVMEAADLLHDEWRVDSTIWSCPSYTQLARDGHAADRWNLLHPQDEPQIAHVRRCFGDSRTPVLAVTGYAGHVAAQIGAFVPARFAVLGADLAGPSPGTRVPGARWIAAVALRLLADDGRVPADWAAQAMRRYASG

SEQ ID NO: 45088 - protein, 121 aa, Arabidopsis thaliana
MAGAGTSMLGSLLVFTVILSLQEIYRGKLASSELFTILGGFTSSLLFLFSLTFIGNFQESSGIKSGWGAVILAEIIALIAAGTVHRVCITTCFLFSAGLLYEVNKISGYMLSKTESKSKRH

SEQ ID NO: 45089 - protein, 358 aa, Arabidopsis thaliana
MTMDSKVCSVRFHLRRSKEEEEDTMDLSIKQVDLLNQVEISRVYHCDGLLLCVAKDNSRVVVWNPYLGQTRWIRPRTESNIGDSYALRYDINRNHKILRMVQTRNVSVYRYEIYDLRSNSWRVLEVTPNGEMDPNHPLYGVSVKGNTYFFAHEDSSSGEIDEDGDIIDLEDFLLCFDFTTETFGLRLPLPFHSTIDATVTLSCVRDQQLAVLYHNEGLHSDDRFTTVEFWVTTSIEPNSVSWSKFLTVDMRPLALTGVRFDNDMGATFFIDEDEKVAVVFDLDGYLSTESARYHTAFISGKDGFFKPVTLGVAPNVGEPCPRTGHIPTTYRPPLVCSSTYLPSLVQVNQQRKRKERHV

SEQ ID NO: 45090 - protein, 463 aa, Ehrlichia chaffeensis str. Arkansas
MVILNGQQVVSFEKSCGVAIDELICRAGKAISDVIFKLFPKQPVAIISGPGNNGKDGIVTAKILKAHGWPVVLMLYNCTTDIDEDWVVPLTYDNVVNCQSCLVIDALFGIGLSRNIPENLSCIFHYINDSNNKVVVAVDIPSGINCDTGQVMGCAIRADVTVTFSVLKIGHVLFPGCDYSGKVHVVDIGIDIDDSKVVIRKNAPALWKHKMPKLEYTSNKYNRGYTLVCSVGNKSIGASKLVAMSALRVGSGIVSIACDSNAVAFYASCLTSIMYKLYDDVINDDRITSIVIGPGCGINDITKQRTMDILNKQNCVLDADSISVFSDSYEVLFSKIQHNVVMTPHEGEFKRIFPFLTGGKIEMAREAASLSKAVIVLKGPDTVIADPIGNVVVNNAPFSLATAGSGDVLSGIIGGLLSSGMSPFDAACCGVWIHTECARKYGIGLIADDIILEIPQVLKKLFC

SEQ ID NO: 45091 - protein, 612 aa, Triticum aestivum
  misc_feature (407)..(407): Xaa can be any naturally occurring amino acid
MAMDDVAFAAGSSSSAMDALAASSSSSSAAPADPSHGWQKVTYAKRSSRKPAAVAPAAAAAPDLGGKPGVFDGLDKRSQERHRAIQAARDATAGYYDDDDDAANAARVPWGSRSSDEGSDSDGAAAKDRAQAEAPKKPKKPKVKKPKVTVADAAALIDAESLAAHLVDISASYENQEGIQLMRFADYFGRAFANVSAAQFPWAKMFKESPMPKMVDVPLSHVPEPVCKTASDWISQRSPDALGEFVLWCIDSIMSELSGPTVGPKGAKKVVQQTPKAQVAIFVVLALTLRRKPDVLINLSPKIVGNSKYLGQEKLPIIAWVINQASQGDLVSGMFSWSHSLFPTVCAKSSGNPQSRDLVLQLLERFLTTPNASKARAMLLNGAVRKGERLVPAGTLDLFMRCTFPVXNARVKATERFEAAYPIIKELALVGTPGSKAVKQASQQLLPLAVKGMQENNAELAKEATDVFIWCLTQSPESYKLWDKLHAENIQASVAVLRKITADWKTLSPKLNSEALKATLKSLKAKNEAALEEAEDSGEKAFIKEADKYCKAIIGRLSRGATCLKGSLLVIALAAGAGFMLSPNLDLTADLEKLQAMASELQAVASEYLRSF

SEQ ID NO: 45092 - protein, 384 aa, Zea mays
  misc_feature (159)..(159): Xaa can be any naturally occurring amino acid
MATAFSLRAAAPATAPRAVSRSTSAARVVPVASALAGRGRLVARAAVTAKADVPSSTSDGHEVLLFEALREALMEEMELDPTVCVFGEDVGHYGGSYKVTKGLADTFGDLRVLDTPIAENSFTGMGVGAGMKGLRPVVEGMNMGFLLLAYNQISNNCGXMLHYTSGGQFKIPLVIRGPGGVGRQLGAEHSQRLESYFQSIPGLQMVACSTPYNAKGLMKAAIRSENPVVLFEHVLLYNLKEKIPDEEYVLCLEEAEMVRPGEHVTILTYSRMRYHVMQAAKTLVNKGYDPEVIDIRSLKPFDLHTIGNSIKKTHRVLIVEECMRTGGIGASLRSAIVDNFWDYLDAPIMCLSSQDVPTPYAATLEDATVVQPAQIVAAVEQLCA

SEQ ID NO: 45093 - protein, 515 aa, Triticum aestivum
MPSTLISLTVATAALVIAIAVACYPRKYRGLRLPPGPPGWPIVGNLFQVAFSGKKLIHYLRDLQQEYGPILTLQMGVRTVIIISGAEVAHEALVEKGAEFATRPAVESSGRNIFSHKLTVNSAVYGARWRSLRRNMVSGMLSNSRLQESQPARMRAMDRFMSRIRAEVSASPNGGSVWVLRNARFALVCILLELTFGLLDLDDQLILQVESVLKRVVLTLGMRMDDYLPCLRPFFWRKQSHVLAVRREQIDTLLELINRRRAVLRDMQRSPPDPNVAAAFSYLDSLLEGRFGGCNAMASDEELVTLCTEVLNAGADTTATAVEWAMARIIDNPRIQARLHEEITRKVGNTRPVDDKDTDNMPYLQAFVKELLRKHPPTYFLVTHAAVHPGSKLAGYDVPTDANLDVFLPTISEDPKLWDRPMEFDPDRFLSGGEKADITGSAGVRMIPFGAGRRMCPGSAMGTVHIALMVARMVQEFEWCAHPSQPALNYEEMVQFTVVMEQPLLAMVKPRKLSY

SEQ ID NO: 45094 - protein, 373 aa, marine gamma proteobacterium HTCC2207
MAKRDYYDVLGVDKGASAAEIKKAFRRVAMKFHPDRNPEGADAEDKFKEAQEAYEILGDDDKKAAYDRFGHAGVDGNSGGGQRGGGGGFGDVFGDVFGDIFGGGGGRGGPARGSDLRYDLQLDLEDAVRGKTVQIDVPTMTTCDPCDGSGARRGSSPVTCTTCNGAGQVRMSQGFFSVQQACPQCRGRGQMISDPCGSCHGQGVIEEQKTLSVKIPAGVDTGDRIRLGGKGEAGPQGGPPGDLYVQMVVRDHPIFVRDDANLHCEVPISFAQAALGGELEVPTLSGKVKLKIPAETQSSKLFRLRGKGVAPVRGGGVGDLLCRVVLETPVNLSSEQRELLKKFEESLAGKSKHSPRSSNWFDGVKKFFDNLTS

SEQ ID NO: 45095 - protein, 1072 aa, marine gamma proteobacterium HTCC2207
MPKRTDIKSILILGAGPIIIGQACEFDYSGAQACKALREEGFRVILVNSNPATIMTDPAMADATYIEPVEWRTVEHIIAQEKPDALLPTMGGQTALNCALDLAKHGVLEKYGVEMIGANADAIDKAEDRERFDKAMKAIGLDTPNSGIAHSMEEAIQVSDRFGFPCVIRPSFTMGGSGGGIAYNREEFEEICRRGLDLSPTNELLIDESLIGWKEFEMEVVRDRKDNCIIICAIENLDPMGIHTGDSITVAPAQTLTDKEYQIMRNASIKVLREIGVETGGSNVQFAVNPEDGRLIVIEMNPRVSRSSALASKATGFPIARVAAKLAVGYTLDELQNEITGGATPASFEPSIDYVVTKIPRFAFEKFEQADQSLTTQMKSVGEVMAIGRTFQESLQKALRGLEVGASGFDPKITDETENPEAVLNSELAVAGPDRIWYLGDAFRHGMSLDDVFARTKVDPWFLVQIEDLIKDELVLAQHSLSDLDEKSLYRLKRKGFSDRRIGDVLGCGETAVRELRYDLGLHPVYKRVDTCAAEFSTDTAYMYSTYEEECEARPSNRDKILVLGGGPNRIGQGIEFDYCCVHAALAMREDGYETIMVNCNPETVSTDYDTSDRLFFEPVTLEDVLEIVRIEKPKGVIVQFGGQTPLKLARALEAAGVPIVGTTPDAIDRAEDRERFQQMIQKLGLLQPQNATARSADQAVELAKEIGYPLVVRPSYVLGGRAMEIVYKEDELRHYMKTAVQVSDDSPVLLDFFLPNAIEMDVDAVSDGEQVVIGAIMQHIEQAGIHSGDSACSLPPYSLGEDIQNEMREVCKKMALELGVRGLMNVQLALQDGLIYVIEVNPRASRTVPFVSKCIGTSLAKIAARCMVGQSLESQGFTKEIIPPYFSVKEAVFPFNKFPGTDPILGPEMKSTGEVMGVGATFAEAYGKAELGASDEIPTSGTAFVSVRERDKHQVAALATQLSDLGFKLVATAGTAKLIKQAGLAVTIVNKVKEGRPHIVDMIKSDKINLIINTTEGRQAISDSSAIRYSAEQHRVYYTTTMAGGNAVCQALNFDGETTVRRIQTLHEEIA

SEQ ID NO: 45096 - protein, 263 aa, Thermus thermophilus HB27
MLRFAVLGHPVAHSLSPAMHAFALESLGLEGSYEAWDTPLEALPGRLKEVRRAFRGVNLTLPLKEAALAHLDWVSPEAQRIGAVNTVLQVEGRLFGFNTDAPGFLEALKAGGIPLKGPALVLGAGGAGRAVAFALREAGLEVWVWNRTPQRALALAEEFGLRAVPLEKAREARLLVNATRVGLEDPSASPLPAELLPEEGAVVDLVYRPLWTRFLREAQERGLKVQTGLPMLAWQGALAFRLWTGLLPDPSGMEEAARRALGV

SEQ ID NO: 45097 - protein, 431 aa, marine gamma proteobacterium HTCC2207
MSGVKALLQRQSKQIQDQSGAASLPFFIIFEYAKDAIETMTDQALMNTYGTRAATLVKGDGAWLWDADGNRYLDALSGIAVCGLGHSHPAVAKAVAEQATTLTHCSNFFTIPNQELLAEKLCTASGMDNVFFGNSGAEANEAAIKMARLHGRKKGIKLPTVLVMDNAFHGRTLATLSASGGRRVQAGFEPLVRGFARAIFDDMESLTTVADNNASICAIFVEPIQGEGGIRVASPEYLQQLRAFCDQRGWLLMLDEVQTGNGRTGKYFYYQHSGIMPDVVTTSKGLGNGVPIGACLAHGEAAELMKPGNHGSTFGGNPLACAAALATITTLQDENLSARAEALGDRIMAGFRTALAGVEHVVDIRGKGCMIGIELNKPCKSLFPAAMAAGLIINVTADSVIRLLPSFIMTDDEADQVVAILAPLIKDFTQD

SEQ ID NO: 45098 - protein, 495 aa, Pseudomonas aeruginosa PAO1
MSIAIDPSVSAFLRSPHGLLIDGESGPARSGADMPLYDPATGAELARVARAGAEDVDRAVAAARRAFEGNWAGQRPADRERLLLRLAERIEAHGEQLAQLETLNNGKSINLSRALEVGASVEFIRYMAGWATKIEGRSLDLSIAAVPGARYRAYTVPEPVGVVGAIVPWNFPLLMAIWKIVPALACGCTVVLKPADETPLTALRLGQLCLEAGIPPGVVNIVTGTGAEAGAALAAHPGIDKLAFTGSTPVGKLIGHAAVENMTRFSLELGGKSPVIILDDTSLDMAAAGSAGAIFFNQGQVCTAGSRLYVQRKRFDQVLERLAAIAGDLSIGPGLDPTTQINPLVSARQQERVLGMIESGVAEGASVVCGGARQGETGFYVQPTILADVTPGMQVVREEIFGPVLVATPFDDLDEAVRLANDSIYGLGASIWSNDLRQVMDLVPRIKAGTVWVNAHNLLDPSMPFGGFKQSGIGREMGHAAIEAYTENKSVCIAY

SEQ ID NO: 45099 - protein, 413 aa, Yersinia pestis biovar Microtus str. 91001
MSRCIDVRNLCVYSGVTFSRSRLVEINMTRKQATIAVRSGLNDDEQYGCVVPPIHLSSTYNFIDFNQPRTHDYSRRGNPTRDVVQRALAELEGGAGAVMTSSGMSALHLVCTTFLQPGDLLVAPHDCYGGSYRLFDSLSKRGAYRVLFVDQGDEAALNCALAEKPKLVLIETPSNPLLRVVDIAAICQAARAAGALTVCDNTFLSPALQQPLSLGADLVVHSCTKYLNGHSDVVAGAVIAKDPELVVELAWWANNIGVTGAAFDSYLLLRGLRTLSPRMAQQQRNADDIVRYLQQQPLVKKLYHPSLPQHPGHEIACRQQSGFGAMLSFELDGDEQVMRRFLSALELFTLAESLGGVESLISHAATMTHAGMAAEARIAAGITDSLLRISVGIEDSEDLIADLDHAFQLAVTR

SEQ ID NO: 45100 - protein, 395 aa, Synechococcus sp. RS9917
MSTTTLPERAAVVIVGGGMAGLSCAAALARQDVGDVVLLEAQTLAHAGASSFGESRMYREMYSDPVLCRLAQEANRLWREEERHAGEALREPHGLLFYGESWEEETIEGSIPGARRVMDDQGIPYEALNAEAIAARFPLRPKPNFTGLFEPTAGAVRSDKVVAHWIRTARAAGHQLIEHCPVAGIDARGGGVSLENGHHISADQVVVACGIWSQLLLAPLGLAPKLEVWPMLWAHYTVDPALAERYPQWFCFQRERGDDGGLYYGFPVLSCTADGRPRIKAGIDWAPEALRVQDPNAMTREVPARLLELLDNFLFNALEGVQERVDTVISPYSMASDVNFVLDRLTPTLSVFAGGSGQAFKFAPLIGESLARLASGRPPAVDLTCWSHQRDAVRA

SEQ ID NO: 45101 - protein, 371 aa, Berberidopsis corallina
AAGALKSYKLAAKAISRLQSLPSGTISLLCDVLVQEVSDLTGYDRVMVYKFHDDEHGEVVAECRRPELEPYLGLHYPATDIPQASRFLFMKNKVRMICDCLAPPVKVIQDKRLAQPLSLCGSTLRSPHACHAQYMANMGSIASLVMSVTINEEDDEMESDQQKGRKLWGLVVCHHTSPRFVPFPLRYACEFLIQVFGVQVNKEVELAAQLREKHILRTQTVLCDMLLRDAPVGIVTQSPNVMDLVKCDGAALYYRNKFWLLGVIPTEAQIRDIAEWLLEYHGGSRGLSTDSLMEAGYPGALVLGDAVCGMAAIRITSKDFLFWFRSHTAKEIKWGGAKHDPDDKDDGRKMHPRSSFKAFLEVVKRRSLPWE

SEQ ID NO: 45102 - protein, 533 aa, Cryptococcus neoformans var. neoformans B-3501A
MSPPPKHITILGGGLSGLSTAYHLSRVLPASTKISLVEGTSRVGGWIDSQKHELGFKDQRGQMREGVVGIETGPRSIRPRGSRGAASMLKMLEDLGLENDIMPIPFSHPSAQNRFLLDYSTSKLTALPSSLTSFLGRQPPLLKGLLSAGLSEPLKPKAPRKHLTADKDESVDAFFRRRFGDNVADNLASAMVHGIYAASSSQLSLRSAFPSLWEAERKYGSVVIGMLLGTKTAAEKAEEKREWEELGEVGKEREKWSLYGIKGGLGTMTDKLLDRISSRGVEIILGEPVRKIELSSNQKIAIHTHSHSLSTSHVISALPPRVLARTLSSPLPHLTHNPSTCVGVVNVVYPLPPTSIHSAGFGYLVPRPPTNLNPNPSPNPSGVLGVIFDSTALPPHPPELGGQVTKLTLMMGGPYWANYSPRISPPSDPEELLPLAIQHLNTIFPHLRNVKPILTVCNIHHNCIPTYLPGHGARLREMHEAIESGEWNGKLSLVGSGYGGVGVNDCVLSGVDVARRLAKGKEVTGLEAWKDWE

SEQ ID NO: 45103 - protein, 391 aa, Carallia brachiata
DLEPVNPADVPVTAAGALKSYKLAAKAISRLQSLPSRNMSLLCEVLVKEVRDLTGYDRVMVYRFHDDEHGEVVAESCRTDLEPYLGLHFPATDIPQASRFLFMKNKVRMICDCLAPPVKVVQDRRLAQPLSLCGSTLRAPHGCHAQYMANMGSIASLVMSVTINEDDAEMDSGQQNGRKLWGLVVCHHTSPRFVPFPLRYACEFLIQVFGVQINKEVELATQMREKHILQTQTVLCDMLLRDAPVAIVTQSPNVMDLVKCDGAVLYYRKKTWLLGITPTEAQISDIAEWLLECHSGTTGLSTDSLMEAGYPGASDLGDAVCGMAAVKITAKDFLFWFRSHTAKEIKWGGAKHDPHNKDDGKMMHPRSSFKAFLEVVKWRSLPWEDMEMDAI

SEQ ID NO: 45104 - protein, 834 aa, Cryptococcus neoformans var. neoformans B-3501A
MGDIIEGTKPTLDDLWAGDEDQKPQTPPVSPPRSPSFKHEHKSPFPGSTSPPPASPIGEEDLKPRTARASSSTSKVKSRKASPEEFKPVLIDDLPTAWDEAHETFEALEKCVYERKDIGLSKENDEMMVCECVYNRHDPDADPCGPDSDCINRALYIECIAGECRAGKHCHNQQFSKRQYANVDVVLTEKKGYGLRASSTIPANTLIYEYIGEVVAEKTFRKRMQQYADEGIRHFYFMMLQKEEYIDATKKGGIGRFANHSCNPNCEVQKWVVGRRLRMGIFTKRDVIKGEEITFNYNVDRYGHDAQTCYCGEPNCVGTIGGKTQTDIGTMNDLFLDALGITDEVEAMGMKGSKKKKSRQLDEDFVPILRPISAHEVQKVAAAIRQSMENKKMMSRLLQRIQMTDDGAMHRQLMRMHGFSLMYMVLTELADDNEIVLLALESMNKWKLQIRNKIEDSKIEEPVKALSQSGDEKICGLAKQLIEYWSTLELSYKIPRVSKIASLDADDEAGTQTIAEANVVSAARRPDAWENTQEIQIDIAPVRPRTLPVSRPRPPPPPPPLPVKKPALNSMSSTDRLKLDAIIAMAEQTVQAQAAAAAVEATASPQAGSSRSGSRPAEDEERRKRQKRTHMTEEELAEQKERRLRKLIGAVVVKSMNKYKDMMEHDTFKKYARECTDTLVKKEKKRNPSYQDVKHPSLSDDKKAKIKSFTKDYTHKILKHLKEKGKLRNPKSSSSLRTNSNDPRQAASSSTNGDTPSISTTPSQGATQRLRDGELVDDIFGADEDMVMDLDEDTPEMQNDHPAPPSVPPATPPLPPVHVEVVDNVSTPTSQWET

SEQ ID NO: 45105 - protein, 201 aa, Synechococcus sp. RS9917
MRTGTIHRVTGETDVRVKLNLDGSGSCTVSTGVPFLDHMLHQISSHGLIDLEIEARGDTHIDDHHTNEDVGIAVGQALAQALGDRRGIHRFGHFLAPLDEALVQVALDCSGRPHLSFGLQIPAQKIGSYDTELVKEFFVAVVNNSGLTLHIRQLDGVNSHHIVEACFKAFARALRLATEIDPRRAGAVPSSKGVLEQAGAG

SEQ ID NO: 45106 - protein, 346 aa, Arabidopsis thaliana
MAVTLRLTNSLAFSSHPLTSSVLFRGSKSIGTITKIASTIRTVKMAAFAGSDSETTSSTSRVIDSHLHIWASPQEAETYPYFPGQEPTLTGDVNFLLKNMEEARVDGALIVQPINHKFDHSLVTSVLKRYPSKFVGCCLANPAEDGSGITHLENLVLESNYRAVRFNPYLWPSGQKMTNAVGKALFSKAGELCVPVGFMCMKGLDLHIAEIEELCTEFPKTTVLLDHAGFCKVPENGEAKLAYSQLMKLSRFPQVYVKFSALFRISRTGFPYQDLSPLLSQLVSHFGANRVMWGSDFPFVVLECGYKEAKEAVTIIAKEASLSSSEMDWILGKTLMQLFPGQWVLP

SEQ ID NO: 45107 - protein, 391 aa, Celastrus scandens
  misc_feature (303)..(303): Xaa can be any naturally occurring amino acid
  misc_feature (389)..(389): Xaa can be any naturally occurring amino acid
DLEPVNPADVPITAAGALKSYKLAAKAISRLQSLPSSNMSLLCDVLVKEVSELTGYDRVMVYKFHDDDHGEVVAECCIPDLEPYLGLHYPATDIPQASRFLFMKNKVRMICDCLAPPVKVLQDKRLAQPLSLCGSTLRSPHGCHAQYMANMGSIASLVMSLTINEDDDETNSDQQKRRKLWGLVVCHHTTPRFVPFPLRYACEFLIQVFGGQINKEVELATQLKEKHILRTQTLLCDMLLRDSPVGILTQSPNVMDLVKCDGAALYYRNKFWLLGVTPTEIQIKDIAEWLLDYHSESTGLSTXSLMEAGYPDASILGEAVCGMAAVKITSKDFLFWFRSHTAKEMKWGGAKHDPADKDDGRRMHPRSSFKAFLEVVKRRSLPWEDVEMXAI

SEQ ID NO: 45108 - protein, 392 aa, Cissus sicyoides
DLEPVNPADVPITAAGALKSYKLAAKAISRLQSLPSGNISLLCDVLVKEVTELTGYDRVMVYKFHEDEHGEVIAECLRADLEPYIGLHYPATDIPQASRFLFMKNKVRMICDCLAPPVKIVQDKRLAQPLSLCGSTLRSPHGCHAQYMSNMGSVASLVMSATVNEEDEDDTESEQQKGRKLWGLVVCHNTSPRFVPFPLRYACEFLIQVFGVQINKEMELAAQMKEKHILQTQTVLCDMLLRDAPVGIVTQSPNVMDLVRCDGAALYYQKKFWLLGVTPTEAQIRDIVDWLLECHSGSTGLSTDSLMEAGYPAAPALGDAVCGIAAIKITSNDFLLWFRSHTAKEIKWSGAKHDPDDKDDGRKMHPRSSFKAFLEVVKRRSLPWQDIEMDAI

SEQ ID NO: 45109 - protein, 516 aa, Arabidopsis thaliana
MARSVDTEAMTTRDPSSKRGGWKTFPFMIATLLGLSIASFGWVMNLVVFLIKEFNIKSIAATQNSNIVNGCVSMLPVVAAILADSFFGNIPVISVSAFISLLGIILLTMITSLDHLRPPPCETGSILCESPSKLQLGILYIALALVIIGSAGTRFTLASAGANQYEKPKEQGSFFNWYFLTLYTGAITGATAIVYTQENASWKLGFGLCAVANLISFIVFVSGKRYYKHDKPMGSPFTNLIRVVVAATRKRKAVISSREEDYHHGLGREGKTSSAMPSKSFRFFNRAALKTEDDSVNNNWRLCSVQEVEDFKAVFRVLPLLLAIIFVSTPMVTQTSLIILQALVTDRGLGPHFKIPAGSLQVIVIITACIVILMNNCLVYPMYQKLAHKPLTPLQKVGIGHVFIILSMAISAIVEAKRLKTVTNGHSMSVLWLHRDFIASVVIGISFYLSTALITLIQKTTKWLPNDINHGRVDNVYWLLVIVGVLNYFLVCAWFYRYRNLNDDDDQEQDPKDDTT

SEQ ID NO: 45110 - protein, 533 aa, Oryza sativa (japonica cultivar-group)
MACRVSFTLSMEISQAFVFASLLLLLLLTWLLFHLLSYQAPPPNGDGGRRIPSPPALPVVGHLHLLKKPLHRSLAALAARYGGGAGLLLLRFGARPVVLVSSQAAADECFTAHDAALAGRPGLASRRLLTDGCPTIATAGHSARWRHLRRLATVHALCARRLAATSPARDAEARAMAARLYSSSSSSSAASAVVVGVKPAAYGFVASVIMSMVAGERMAEEDVLRFKAITEAGLAAAGAANRQDFLPFLRLLDFGRARRRLAGIAKERHDFGQRIVDEYRRRHRRRLAVAADDFSSSPPRRTVIGDLLRQQESSPESYADEVIRTVCLSLLQAGTDTSASTIEWAMALLLNNPDVLRKATDEINSVVGMSRLLQEPDLANLPYLRCIITETLRLYPLAPHLVPHEASRDCMVAGHVIARGTMVLVDVYSMQRDPRVWEDPDKFIPERFKGFKVDGSGWMMPFGMGRRKCPGEGLALRTVGMALGVMIQCFQWERVGKKKVDMSEGSGLTMPMAVPLMAMCLPRVEMESVLKSL

SEQ ID NO: 45111 - protein, 122 aa, Brassica napus
  misc_feature (26)..(26): Xaa can be any naturally occurring amino acid
MNPRREPRGGRSALFDGIEEGGIRAXSYASHEINEHENERALEGLQDRVILLKRLSGDINEEVDTHNRMLDRMGNDMDSSRGILSGTMDRFKTVFETKSSRRMLTLVASFVGLFLVIYYLTR

SEQ ID NO: 45112 - protein, 333 aa, Zea mays
MPVCFLPASMAGQVQRTAPSSSSPSPRQLPVINLGRLGKDPATRALAIQDITRACREQGCFQVVNHGVSKPVMAGAFEAASEFFQLSPEHKELFASTDIGRPVRYDTSSRDGISRARSFLKHYANPLEDWVQYWPLHPPSYRKKMGEYAVEIQRVSMQLMDAILQGLGLKPLYMQEKLDKGVQFLALNSYPQFSHRGDKVGLAPHSDYGFLTILMQSSPGLEVMPHDRDTWTPVPAIPGALHVHVGDHLEVLSNGRLKSLVHRAILNPDEARISIASIHGLSKDEKVCCAEELVDEVNPAMYRESSFQDFLDFLPSNINNYKRFVESLKIDRA

SEQ ID NO: 45113 - protein, 611 aa, Candida glabrata CBS 138
MADNQNGNEGDLHPLALLMDELKHDDIANRVEAMKKLDTIAIALGPERTREELIPFLTEVAQDDEDEVFAVLAEELGKFVPLVGGSQYINVLFPTLEILAATEETLVREKALASLNKVVKDMTIEQLLHDYVPLLDRLANADWFSSKVSACGLFKVVISRVKDDTLRKNLLALYSQLIQDDTPMVRRAAARNLPSIIDQLRENPGLSCEDDWEYVSEMFKKVITDNQDSVKFLAVESLIAILKFFNAKGDSSHTEALLAYALKLAKDEAWRVRYMVAEKFEDLADEISQLDKVVDHLLEPFLSLCEDNEGDVRKAIAGHVSGFSKHIKDASIIEAKIIPAIYTLSIDENETVRASLAQSITGMSSLLPKESVTENLLPIVLNMLKDEFPDVRLNIIASLKNINKVVDTKILSESLIPAINELAKDINWRVRMAIIDYLPVIGEQLGKSFFDEQLIDLCMTLLWDPVYAIRNATVKILTKLTEFFGSDWCRDEILTKLLTVDAETLENFIYRFTVLSALRELTSAVSSDITLEHILPYIVKLSDDKVPNIRFNVAKAYTVICENLKNNKTKNLKEIFEEKMLPSFKKLQGDSDVDVKYFANENLEKCQLLIN

SEQ ID NO: 45114 - protein, 108 aa, marine gamma proteobacterium HTCC2207
MDIMETIREQVENNAIILYMKGSPNQPQCGFSARTVQALMECGQRFAYVDILSNPEIRANLPAYGNWPTFPQLWIKGELIGGCDIIADMHQKGELKPIMDEAAPAPEA

SEQ ID NO: 45115 - protein, 235 aa, Triticum aestivum
AYLGDTPEQVCTKKQAAYRSGIPGISSTHASDEGGYSMKELNSVEWHCSGTPKVLLPVANGIEEMEAIILVDALRRANADVVVASAEDGVVVTARYGTRIVADVMLDEAADRAPFDLIIVPGGMPGAKTLGGCEQLVALLKKQAEANRPYGAIGAATAHVLEPHGLLKGKKATTCASMAGLLADGGECENRVVVDGNVITSRSPGTAMEYAAAVVEKMMGRDEARRLAEGLLFLS

SEQ ID NO: 45116 - protein, 328 aa, Arabidopsis thaliana
MSSPERKRKKRSLEPSPESTPNPSLPDDLIVSILARVSRLYYPILSLVSKSSRTLVTSPELYKTRSFFNRTESCLYVCLDFPPDPNPRWFTLYRKPNQNITEKTKNSSGSHTWHEAPSMRMKRNYPAANVVDGKIYVAGGLEEFDSSKWMEVFDIKTQTWELVLSPLAERFIYRSLVIEGEIYIFGDKVVTYKPKEDRWGGVGEHQSMDLGLFFHSYCVIDNVLYCYRPGGIKWYESEKRSWRKLRGLKGLSKLASSCVKLADYGGKMALLWDKYIPCSGNKSHSISCAVVSLERCKNQGIRGKVEWFDDMLTVPSSYNFVGALAATL

SEQ ID NO: 45117 - protein, 450 aa, Candida albicans SC5314
MGCKYKMILMLKPLKKIFMMLWLSPEPYRSKMSLHLKKSGFQRAARTDKGVHAAGNVISLKMIIEDPEIINKINDLLPKQIRIWGIQRATKGFDCRKCCSSRIYEYLLPTFSLLPPKPKSVLSELVKEKELENPDLFEDDQEGIDWWENVKSKILASGITQEQIDSITSSYDEQQQQQHHQQQQQADEEERDISELSFTKLIKQIKTIENQSRRSYRISSSRLQHFREVMKQYEGTHNFHNFTVGKPFKDTSANRFMIKTIVSDPFVIEGTEWISIKIHGQSFMLHQIRKMIAMAALVVRLSLPCGIINNFFQSTKINIPKAPALGLLLENPVFDGYNIKLTKSDYEPIDFTKFDKEMNEFKMKYIYDKIYAEESKENIFYGFFGYIDAYRGNKNEDGEPIQNGASIFDFLFNYTERVENTKNKDAKNTSKTEESKPEESKPEESKSEQS

SEQ ID NO: 45118 - protein, 377 aa, Musa x paradisiaca
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDALMKILTERGYSFTTTAEREIVRDIKEKLAYVALDYEQELENAKSSSSVEKSYELPDGQVITIGAERFRCPEVLFQPSLIGMEAAGIHETTYNSIMKCDVDIRKDLYGNIVLSGGTTMFPGIADRMSKEITALAPSSMKIKVVAPPERKYSVWIGGSILASLSTFQQMWISKGEYEESGPSIVHRKCF

SEQ ID NO: 45119 - protein, 352 aa, Cenarchaeum symbiosum
MEPGKPLEVSELESPSPRGEEVIVKVTSAGVCHSDLHLWEGGYDMGDGEFLKVTDRGIKYPVTPGHEIAGTVLEAGPDAKGFSKGDPVLIYPWVGCGRCPACREGSENLCDTPGSVGLFLDGGYAELVRVPSYRYLVGIDGIDPDGATSLACAALTAYNSVKKADAASPGFIVVIGAGGLGLMGVQIAKAVTKAKIICVDLDDNKLKMAREMGADFVVNSNVIGSVSAGSGSAAQKIISLCDGKGAESVIDFVNSPQTAQMGLAVLRKRGSLILVGLFGGKMELSLVTIPLKSITIQGAYTGSYSDMKELVELARKGIIKPKITRRYGLDEANEALGDLKARKINGRAVINP

SEQ ID NO: 45120 - protein, 375 aa, Xanthomonas campestris pv. vesicatoria str. 85-10
MTPILFVDRDGTLITEPADYQIDAYEKLRFVDHVIPAMLKLRDAGYQFVIVSNQDGLGSESYPRASFEGPNNLMLQIFASQGIEFRDVLIDCSWPADNAPTRKPGIGLMVPYLQDRSIDWARSAMVGDRITDIQFAHNLNIRGFQLRTDEFGGEWDWPGIAHELADAPRRAVVQRNTKETRIRVELDLDRVAEPKTATGLPFFDHMLEQIGKHGGFALEIRAEGDLHIDEHHTIEDTGLALGQALREALGNKRGIGRYGFDPESSPWRVAGDKAQHGFTLPMDETIASAALDFSGRPYFVFDGEFKRERVGDMPTELVPHFFRSICDASGLNLHLTVRGENDHHKVEACFKALARALRQAIRREGTALPTTKGAL

SEQ ID NO: 45121 - protein, 244 aa, Zea mays
  misc_feature (68)..(68): Xaa can be any naturally occurring amino acid
  misc_feature (148)..(148): Xaa can be any naturally occurring amino acid
MGQGGEVKAAPAVRVLVVDDSPVDRKVVELLLRNHNHQGGAAPFHVTAVDSGKKAMEHLRLMEQGGQXLDSCAADANRITIDIVLTDYCMPEMTGYDLLKAIKALSSPNPIPVVVMSSENEPQRISRCLTAGAEDFILKPLKTKDVQXRLRNCSSAARPRDDAAHQCESLRRSSRKLRSDQVAAPGHRSQPTTGLTMVLHASSIELSHYFQFLLKFVLLAYAVLCLTELLHRWSNGSVLSLWSA

SEQ ID NO: 45122 - protein, 201 aa, Xanthomonas campestris pv. vesicatoria str. 85-10
MATGDALATLDWSKGDGLLPVIVQDADTLRVLMLGYMNVEALAVTRQRGDVTFFSRSKQRLWTKGESSGNVLRVVSIQTDCDADTLLVQARPHGPTCHLGRTSCFPSAPGQFLGSLDALVAERERERPHGSYTTKLFEQGIRRIAQKVGEEGVETALAGVVQDDDALLGESADLLYHLIVLLRARGLGLGDAVALLESRHQ

SEQ ID NO: 45123 - protein, 444 aa, Streptomyces avermitilis
MVPHAGDARDAEAKHDARTRGWETTMSALSPHLRQATPVVAVRGEGVHLYGEDGRRYLDFTAGIGVTSTGHCHPRVVAAAQEQAGTLVHGQYTTVLHPPLRRLVDRLGEVLPAGLDSLFFTNSGSEAVEAALRLARQATGRPNVLVCHGGFHGRTVAAAAMTTSGTRFRSGFSPLMSGVVVTPFPTAFRYGWDEETATRFALQELDYTLRTISSPDDTAAIIVEPVLGEGGYVPATRAFLEGLRERADRHGFVLILDEVQTGVGRTGRFWGHDHFGVTPDILITAKGLASGFPLSGIAASAELMGKAWPGSQGGTYGANAVACAAACATLDVVRDEKLVDNAEAMGARLRAGLAAVAATTPAIGDVRGLGLMLASEFVTEDGGPDPETAARVQRAAVDEGLLLLLCGAWNQVVRMIPALVIDEAEVDEGLRAWSAAVEVGVPAR

SEQ ID NO: 45124 - protein, 368 aa, Corylopsis glabrescens f. gotoana
ALKSYKLAAKAISRLQSLQSGNISLLCDVLVKEVSDLTGYDRVMVYKFHEDEHGEVVAECRREDLEPYLGLHYPATDIPQASRFLFMKNKVRMICDCLAPAVKVNHDKRLAQPLSLCGSTLRSPHGCHAQYMANMGSIASLVMSVTINEQDDEIESEQQQGRKLWGLVVCHHTSPRFVPFPLRYACEFLIQVFGVQISKEVELAAQLREKHILRTQTMLCDMLLRDAPVGIITQSPNVMDLVKCDGAALYYRKKFWLLGVTPTEMQIRDIVQWLLEYHSGSTGLSTDSLVEAGYPDALILGDAVCGMAAIRITSKDFLFWFRSHTAKEIKWGGAKHDPDDKDDGRKMHPRSSFKAFLEVVKRRSLPWE

SEQ ID NO: 45125 - protein, 427 aa, Cryptococcus neoformans var. neoformans B-3501A
MAQTTKPVLVIYGATAYTAQQLFTYLEEHPEAGDFDFILAGRNQTKLDKLNGSLKIQREVIACELSDEEGVEAMVKRGNVIVNFAGPYRWHNAEAIIRACSKAGKHYIDLCGESAWLAKDIIPKYHSIASSTGACIVPSCGFDSVPSDLVVHLANQTLQTVRPGSTLADSTSIFKVKGTISGGTVQSMITLTELPKEERRAGEFTLCPGIQLPSTPPALTFSLPSTPLTPARFASFFFMYVYNRTVVRRSQFLSGALSTKSGGKVMKYAEGLDIGYGKFGSALATIGMMVFGGLFFGFKCLRNIILRYLPKQGEGAPLEQLKAGHYQVTNLSIEESSAPDHKPVKILTRFDGEGDPGYLNTCYLLAESALALVLPAPKGTSRPPLAKAGGLLTPATAMGDVLIERLRKSGKFQITSEVLSEEKKKDI

SEQ ID NO: 45126 - protein, 153 aa, Burkholderia sp. 383
MSTTVAQLLKAKPDSGRTIYTVTKTDLVYDAIKLMAEKGIGALLVVDGDDIAGIVTERDYARKVVLQDRSSKATRVEEIMTAKVRYVEPSQSTDECMALMTEHRMRHLPVLDGGKLVGLISIGDLVKSVIADQQFTISQLEHYIHGTPAVTSA

SEQ ID NO: 45127 - protein, 368 aa, Daphniphyllum macropodum
ALKSYKLAAKAISRLQSLPSGNISLLCDVLVKEVSDLTGYDRIMVYKFHEDEHGEVIAECRRPNLEPYLGLHYPATDIPQASRFLFMKNKVRMICDCLALPVKVKQDKRLPQPLSLCGSTLRSPHGCHAQYMANMGSIASLVISVTINEEDEEMESDQLKGRKLWGLVVCHHTSPRFVPFPLRYACEFLIQVFGVQISKEVELGTQMREKHILQTQTVLCDMLLRDAPVGIVTQSPNVMDLVKCDGAALYYRKKFWLLGVTPTEAQIRDIAQWLFEYHSGSTGLSTDSLVEAGYPSALILGDAVCGMAAIKITSKDFLFWFRSHTAKEIKWGGAKHDPDDKDDGRRMHPRSSFKAFLEVVKRRSLPWE

SEQ ID NO: 45128 - protein, 391 aa, Euonymus alatus
DLEPVNPADVPITAAGALKSYKLAAKAISRLQSLPSSNMSLLCDVLAKEVSELTGYDRVMVYKFHDDDHGEVVSECCRPDLEPYLGLHYPATDIPQASRFLFMKNKVRMICDCLAPPVKVLQDKRLSQPLSLGGSTLRSPHGCHTQYMTNMGSIASLVMSVTINEDDDETNSDQKIGRKLWGLVVCHHTTPRFVPFPLRYACEFLIQVFGVQINKEVELAKQLKEKHILRTQTLLCDMLLRDAPVGILTQSPNVMDLVKCHGAVLYYRNKFWLLGVTPTETQIKDIAEWLLDYHSESTGLSTDSLVEAGFPDASILGEAVCGMAAVKITSKDFLFWFRSHTAKEMKWGGAKHDPGDKDDGKRMHPRSSFKAFLEVVKQRSLPWEDVEMDAI

SEQ ID NO: 45129 - protein, 234 aa, Brassica napus
  misc_feature (50)..(50): Xaa can be any naturally occurring amino acid
MGESKGYERGGRVIPNVNSYNVSLKLSPLVSFWDCIVRTMRYSYIPEWLXVLEIQEIMDHCVCKQVQSVASKLKKKKAHGKDEFDRVKQAEKKKRRLEKALATSAAIRAELEKKKQKKLEEQQRLDEEGAAIAEAVALHVLLGEDSDGDDSSRVMLGEEKGFKMDMFRGESYAVQGIGFVSNGCGLGDGNWSPFASDVWDDNMGMSTDLIAAQAVSSLQISENSDGNTLVFNGL

SEQ ID NO: 45130 - protein, 370 aa, Gunnera monoica
  misc_feature (180)..(180): Xaa can be any naturally occurring amino acid
  misc_feature (366)..(366): Xaa can be any naturally occurring amino acid
ALKSYKLAPKPISRLQSLPSGNISLLCDVLAKEVSDLTGYDRVMVYKFHEDEHGEVVAECRRPDLEPYLGLHYPATDIPQASRFLFMKNKVRMICDCMALPVRVIQDNKLPQPLSLCGSALRSPHGCHMQYMANMGSIASLVMSVTINEDEEEEEEESNRQTRRKLWGLVVCHHTSPRFXPYPLRYACEFLIQVFGVQINKEVELAAQMREKHVLRTQTVLCDMLLRDAPIGIMTQSPNVMDLMKCDGAALYYKNKIWLLGVTPTELQLRDIAQWLLENHNSSTGLSTDSLLEAGYPNATILGDLVCGMAAVKITSKDFLFWFRSHTAKEIKWGGAKHDPGEKDDGRKMNPRSSFKAFLEVVKRRXVPWE

SEQ ID NO: 45131 - protein, 391 aa, Ixonanthes chinensis
DLEPVNPADVPVTAAGALKSYKLAAKAISRLQSLPSRNLSLLCDVLVKEVSDLTGYDRVMVYKFHEDGHGEVVAECCRPDLEPYLGLHYPATDIPQASRFLFMKNKVRMICDCRTSSVKVVQDQKLTQPISLCGSTLRAPHGCHAQYMANMGSIASLVMSVTINEEDDEIESDHQKARKLWGLVVCHHTCPRFLPFPLRYACEFLMQVFGVQVNKEVELAVQMREKHTLRTQTVLCDMLLRDAPVAIVTQSPNVMDLVRCDGAALYYRKKFWLLGVTPTEPQIRDIVEWLLEYHSGSTGLSTDSLMEAGYPGASILGDAVCGMAAIRITSKDFLFWFRSHTAKEIKWGGAKHDPGDKDDGRKMHPRSSFKAFLEVVKRRSLPWEDVEMDAI

SEQ ID NO: 45132 - protein, 388 aa, Triticum aestivum
MDNSAPPVIIVGAGPSGLAASACLARRGVDSIVLERDDCVGSLWQKRAYDRLHLHLPKQASALPHLPHDDDAPAYLPRDHFVRYLDAYADRFAVRARLRLRREVRSARFVDGRWEVEAVNLATGDAEQYTARFLVVATGEFDEKVLPEVPGLDTFHGEAIHAGEYRSGEGMRGKEVLVVGCGNSGMEIALDLAQAGAAASIVVRGELHLMTREIMNASTALFAYLPVWMIDRLALFACRVVFGDTARHGLRRPDVGPFTRKIQSNVYPVIDVGTYDKIKSGQIKVLPAITSIEGDVVEFAGGERRRFDAIVFATGYRSTAKKWLKSDDGGLIGDDGMASGRSPKGENGLYRAGLAGRGIYGSGTDGEFIAEDISRLLRQGSGDDDDGV

SEQ ID NO: 45133 - protein, 412 aa, Rickettsia sibirica 246
MPIKILMPALSPTMTEGNLARWLKKEGDKVNPGEVIAEIETDKATMEVEAVDEGILAKIVIPQNSQNVPVNSLIAVLSEEGEEKTDIDAFIAKNNSVSPSPKTDANLLKPQENIANVEEQVTVIKHDASKIFASPLAKRLAKMRNIRFESVKGSGPHGRIVKQDILSYTPSTAHNKIVSRNPEEYRLVPNNNIRKIIAKRLLESKQTVPHFYLSIECNVDKLLDIREDINKFFSEDKSTRISVNDFIILAVAKALQEVPNANASWGEDAIRYYNNVDISVAVAIENGLVTPIVKNANQKNILELSREMKALIKKAKDNKLTPEEFQGGGFTISNLGMYGIKNFNAIINPPQSCIMGVGASAKRAIVKNDQITIATIMDVTLSADHRVVDGAVGAEFLAAFKKFIESPVLMLI

SEQ ID NO: 45134 - protein, 584 aa, Candida albicans SC5314
MDVKRPKKIFTRSQIIDLIADGKVIVIYKNNVLNLTSWIKKHPGGDKAAYHMVGKDATDEMHAYHCDETVDTFTRFKIGEIEGPRWENLLPPIQGGIYAKGGHYGSLNNKNTSNKKTLDSKLDNDSSNSTSDLECLTTTNSCDSDISETEIANYKGIGFVPSVKPVVPQNQLVSKSNMDIVFPIIDEETKKKVIRNPKTLLNNYDNKLSQEDVMSLPALDYDSQQVLRDKYNELHQTIIDYGLYECDLWDYVREVTKIGSLFLYSLSFLKINQLFLSAVFMGMAWHQGTFIAHDAGHIGITHNYQIDNIFGMLIADWFGGLSLGWWKRNHNVHHLITNDPVHDPDIQHLPFFAVSVRLFQNVYSTYYDKILPFDKFSQFLIPLQKYLYYPILCFGRFNLYRLSWTHVLCGQGPRQGKAAWFRYFEFFGLSFFFYWFFYLLVFKTIEGGWNRFNYVMVSHITTMLVHVQITLSHFAMSTADLGVSESFPSRQVRTTMDVDCPEWLDFLHGGLQFQAIHHLFPRLPRHNLRKAQPFVIKFCEEVGLSYSIYGFGEGNEIVISRLADIGKQCSIFLDATKHYEGDLY

SEQ ID NO: 45135 - protein, 139 aa, Moorella thermoacetica ATCC 39073
MAVERTFSMIKPEGVRRGLVGAILARLEQKGYRIVALKMLRLTPEMAAAHYAEHRDKPFYQDLINHITSGPVVAMVLEGPGVIAGLRRLMGATNPQEAAPGTIRGDFALETSDNVIHGADSPASAEREIALYFTPAELG

SEQ ID NO: 45136 - protein, 495 aa, Mesorhizobium loti MAFF303099
MNLPPNALWIDQDDYDVRGFSHGLYIDGRWRPSSDGRVIDVVDPSSGSVIAAVPDATLEDALAAVDAAAKAATAWRETAPRKRSEILRRCFELMVERSETLAMLISLENGKALRDARGEVAYAAEFFRWNAEEAVRITGEFGTAPSGANRIVVDYEPIGICVLITPWNFPAAMATRKIAPALAAGCTVILKPASETPLTAYALAALYSEAGVPAGVVNVLTTTSPGPLTSAMLADPRVRKLSFTGSTGVGRTLLGEAAKHVVSCSMELGGNAPFVVFDDADLDAALDGAMIAKMRNAGEACTAANRIYVQSGIHDAFADGLRKRMAALKVGPGMSADTECGPMITRKAVDKIDRLVKDAVGRGAKVLCGGSIPEEEGFFYPPTVLSQVPPDADMAHEEIFGPVAPVTRFETEAEVIMHANNTEYGLAAYIYTRDVGRGLRVASRIEAGMIGLNRGLMSDPAAPFGGVKQSGLGREGGQHHGIAEFMEAKYIAVTF

SEQ ID NO: 45137 - protein, 475 aa, Arabidopsis thaliana
MATLYSQVPSVSAVFSLYTSFSAITMLFRTILNEIVPKRIREYIAMKAVDFFSSYFQSDFTFVIEQRWEFVENQTFRAAEVYLPTCLAGLSTGKLLVGSSNLKNPAAEPKLGIPVNTKIIDNFEGIHLEWTLHSVETKKYLPEKRYFHLTCKKEFREKIMTDYFTYLAKSAEKIMSHRENLKIYTYNQDRSKWESAIFEHHTTFETLAVEPDLKKTLIDDLDAFSKGKDFFKSVGRAWKRGYLLYGPPGTGKSSMVAAIANHMKYHIYDLQIQSVRDDGELREILTSTKNRSILLIEDIDCGADASRRRQSKKKEEDGGEDDGEPQKRKKKFEVGISLSGLLNFVDGLWSSCGEEKIIIFTTNHKEKLDPALLRPGRMDVHILMDNCTPFVFKKLVALYLKTDEHVLFDPIEKLIIEVSSTPAEVTQQLMASKNADIALKGLAEFLENKKLKKGEDSSVEEEGEIEDAETKEAET

SEQ ID NO: 45138 - protein, 108 aa, Archaeoglobus fulgidus DSM 4304
MELQFDEKGLIPVITQDVKTKEVLMLAYANEEAIKLTLKTGFAHYWSRSRKKLWKKGETSGNVQRVVEIRYDCDCDALLYLVEQKGNACHTGNYSCFYRRLEGDEVRC

SEQ ID NO: 45139 - protein, 119 aa, marine gamma proteobacterium HTCC2207
MTNKVSIIAALEKEQMSKEIPDFSPGDTVVVQVKVKEGTRERLQAFEGVVLAKRNRQLNSAFTVRKISNGIGVERTFQTYSPLVDSIEVKRRGAVRRAKLYYLRERSGRSARIKEKLNK

SEQ ID NO: 45140 - protein, 157 aa, Methanothermobacter thermautotrophicus str. Delta H
MIRVKDAMQSDVITVKRTSSIHDAARVLRENRISGAPVVDEDGKLVGIISEGDIMRLIEVHSPSLNLIMPSPLDLLELPLRMKHEYDEIARGIRKAAVMRVEEIMTPKVVTVPPHASVSDAAELMERHDIKRLPVIDENGRLAGIITRGDIIGAFVK

SEQ ID NO: 45141 - protein, 321 aa, Nicotiana tabacum
MSTASINSCLTISPAQASLKKPTRPVAFARVSNSSSSPSVPSLIRNEPVFAAPTPIINPILREEMANESYEQAIAALEKLLSEKGELGPIAAARVDQITAELQSSDGSKPFDPVEHMKAGFIHFKTEKYEKNPALYGELSKGQSPKYMVFACSDSRVCPSHILNFQPGEAFVVRNIANMVPAYDKTRYSGVGAAIEYAVLHLKVENIVVIGHSACGGIKGLMSLPADGSESTAFIEDWVKIGLPAKAKVQGEHVDKCFADQCTACEKEAVNVSLGNLLTYPFGRDGLVKKTLALKGGHYDFVNGGFELWGLEFGLSPSLSV

SEQ ID NO: 45142 - protein, 521 aa, Arabidopsis thaliana
MDSCCNFSLGTKTVLAKDSFKNVENKFLGEKIKGSVLKPFSSDLSSKKFRNRKLRPGVAYAIATSKNAKEALKNQPSMFERRRADPKNVAAIILGGGDGAKLFPLTKRAATPAVPVGGCYRMIDIPMSNCINSCINKIFVLTQFNSASLNRHLARTYFGNGINFGDGFVEVLAATQTPGEAGKKWFQGTADAVRKFLWVFEDAKNRNIENIIILSGDHLYRMNYMDFVQHHVDSKADITLSCAPVDESRASEYGLVNIDRSGRVVHFSEKPTGIDLKSMQTDTTMHGLSHQEAAKSPYIASMGVYCFKTEALLKLLTWRYPSSNDFGSEIIPAAIKDHNVQGYIYRDYWEDIGTIKSFYEANIALVEEHPKFEFYDQNTPFYTSPRFLPPTKTEKCRIVNSVISHGCFLGECSIQRSIIGERSRLDYGVELQDTLMLGADSYQTESEIASLLAEGNVPIGIGRDTKIRKCIIDKNAKIGKNVVIMNKDDVKEADRPEEGFYIRSGITVVVEKATIKDGTVI

SEQ ID NO: 45143 - protein, 173 aa, Brassica napus
MANQGAKKRKDENARHMAKLRRIIIACNVVYVIVRMVIFHSSFTWKHWIGLVVTSIGYGVPYKFLDGMAKPSVSDDGELIDGGFDMSTGGICGYLHDVLYITCFVQLASIISGKFWYTYLVIPAFGAYKASGLIRGFMSQGSEGGVEDEKTRKKREKMERKAFRGQAVRTRSR

SEQ ID NO: 45144 - protein, 476 aa, Xanthomonas campestris pv. vesicatoria str. 85-10
MFKQLWATKHPHASHEAADGLGLQRALGPWGLTALGIGAVIGGGIFVITGQAAADHAGPAIMLSFVLAAVCCAFCAMAYAEFAAMVPVSGSAYTYTYATFGELAAWLIGWMLVLEYGVSASAVAVSWTGYFLSLLEHFDIHLPAAFVSAPLDGKLQPTGAIANLPAAGIVLLLTWLCYVGIRKSSAMNMAMVILKTGLILLVIAVGWKYVDTSNWHPFIPANEGPGKYGMEGVLRGAAMVFFAYIGFEAVSVAAQESHRPQRDLPIGMILSLVICTVLYIAMAAVMTGLVPYTLLGTDEPVVTAVAAHSQLAWLRVVVEVGALIGLSSVVLVMIIGQPRIFMIIARDGLLPSIFTRIHPKYRTPHVNTVITGVGIALLAAVFPLDVLGELTSMGTLIAFAAVCAGVLILRRTHPELPRPFRMPAAWLICSAGVLSCLALLSAMTLHNWMLMGLWTLVGLVIYFGYGYRHSRLRDGR

SEQ ID NO: 45145 - protein, 490 aa, Xanthomonas campestris pv. vesicatoria str. 85-10
MLKSLLRVKSIEPAGHVDAGEPVEGSLQGEATLQRTLTAKHLIMLGIGAVIGAGIFVLTGQAAANHAGPAVMLSFVFAGIACAFAGLCYAEFAAMMPVSGSAYSYSYATLGEGIAWFIGWCLVLEYLFAGSSVAVGWSAYLISFITGTLGLPFPAELAGAPLAWDGHGFVSSGNLVNLPAVLIVAAVSILCYVGVTQSAFANAIVVAIKVVVICLFVGFGISYIDPANWHPFIPENTGPGQFGWDGVFRAASIVFFSYIGFDAVSTSAGETKDPQKNMPIGILVSLAICTVIYIIVCAVLTGLLPYTQLGTAKPVATALEAHPQLTWLKTAVEIGAIAGLSSVVLVMLMAQPRIFYTMAKDGLMPKLFGKVHPKFRTPYVGTLFVGVVAALLAGVIPLNVLGELVSMGTLLAFATVCAGVLVLRFTKPDLPRPFRVPLAMVICPLGALACLFLFFQAFQEHWKVFVGWTVIGLAIYFGYGIHHSRLAKRA

SEQ ID NO: 45146 - protein, 376 aa, Klainedoxa gabonensis
AAGALKSYKLAAKAISRLQSLPSRNMSLLCDVLVKEVSDLMGYDRVMVYKFHEDEHGEVVAECCRPDLEPYLGLHYPATDIPQASRFLFMKNKVRMICNCQAPSVKVIQDNKLPKPVSLCGSTLRAPHGCHAQYMANMGISASLVMSVTINEDDDNMDNDQAKARKLWGLVVCHHTSPRFVPFPLRYACEFLIQVFGVQINKEVELAAQTREKHILQTQTVLCDMLIRDAPEGIITQSPNVMDLVKCDGATLYYRKKFWLLGVTPTEAQIKDITEWLLEYHSGRTGLSTDSLMEAGYPGASVLGEAVCGMAAIRITSKDFLFWFRSHTAKEIKWGGAKHDPDDKDDGRKMQPRSSFKAFLEVVKWRSLPWEDMEMD

SEQ ID NO: 45147 - protein, 456 aa, Chromobacterium violaceum ATCC 12472
MSEAHTGLQRELKNRHIQLIALGGAVGTGLFLGSASVLKSAGPSMILGYAIAGFIAFMIMRQLGEMVAEEPVAGSFSHFAYRYWGRFPGFLSGWNYWVLYVLVSMAELTAVGAYVQYWWPHVPAWLTALVCFVCINGINLANVKSYGETEFWFALIKVAAVIGMILFGGYLLLSGSGGPQASVSNLWNDGGFFPHGVKGLFMMMAVIMFSFGGLELIGMTAAEANDPQKTIPKAVNQVIYRILIFYIGSLVVLLSLYPWNKVAAGGSPFVMIFEQIGAGFTAHALNFVVLTAALSVYNSCVYATSRMLFGLARQGNAPRALGKLDTRGVPVYATLFSAAATFACVILNYLLPGEALGLLMSLVVAALVTNWAMISLTHLKFRRAKGGQKLVFPSFWFPLSNWICLAFMVMILGILLFTPGMAVSVYVLPVWLGLLWLGFRLKKPSPAEARLAGENA

SEQ ID NO: 45148 - protein, 448 aa, Psychrobacter sp. TAD1
MSISKAIEKVEARYAHQPEFIQAVKEVAITIKPLYDAHPEYDKLKVFERLVEPDRVFGFRVNWEDDNGEIQINRGWRVQFSNALGPYKGGLRFHPTVNQSVLKFLGFEQIFKNALTGLPIGGGKGGSDFDPKGKTDSEIRRFCYAFMRELHHYVNKDMDVPAGDIGVGGREVSYMFAMYKNLTRESTGVITGKGVGFGGSLMRTEATGYGAVYFLQNMLAAQNESIEGKKVLVSGAGNVSLHAAEKATLIGAIVLTVSDSKGTIYDAKGLNQEKIDWLKVQKDQHKPLADYVEVFGGEWMADQKPWSIKADIAIPSATQNEINEEDAKLLVDNGVKYIVEGANMPLTAEAIDYIRLHRVHYAPGKAANAGGVAVSALEMSQNSVRQYQTFEQVDERLQGIMKDIHDSSAQASEMYGQTDEGYIDYMSGANMVGFKRVADALVAFGILN

SEQ ID NO: 45149 - protein, 290 aa, Triticum aestivum
HEDNADITLSCAPVGESRASEYGLVKFDSSGRVVQFSEKPKGDDLEAMKVDTSFLNFAIDDPAKYPYIASMGVYVFKRDVLLNLLKSRYAELHDFGSEILPRALHDHNVQAYVFTDYWEDIGTIRSFFDANMALCEQPPKFEFYDPKTPFFTSPRYLPPTKSDKCRIKEAIISHGCFLRECKIEHSIIGVRSRLNSGSELKNAMMMGADSYETEDEISRLMSEGKVPIGVGENTKISNCIIDMNARIGRDVVISNKEGVQEADRPEEGYYIRSGIVVIQKNATIKDGTVV

SEQ ID NO: 45150 - protein, 391 aa, Liquidambar styraciflua
DLEPVNPADVPVTAAGALKSYKLAAKAISRLQSLPSGNISLLCDVLVKEVSDLTGYDRVMVYKFHEDEHGEVLAECRRPDLEPCLGLHYPATDIPQASRFLFMKNKVRMICDCLAPPVKVNQDKRLTRPLSLCGSTLRSPHGCHAQYMANMGSIASLVMSVTINEDDDEMESDQQKGRKLWGLVVCHHTSPRFVPFPLRYACEFLIQVFGVQINKEVELATQLREKHMLRTQTVLCDMLLRDAPVGIVTQSPNVMDLVKCDGAALYYRKKFWLLGVTPAEAQIRDIAQWLLEDHNGSTGLSTDSLVEAGYPDALILGDAACGMAAIRITSKDFLFWFRSHTAKEIKWGGAKHDPDEKDDGRKMHPRSSFKAFLEVVKRRSLPWEDVEMDAI

SEQ ID NO: 45151 - protein, 376 aa, Meliosma squamulata
  misc_feature (222)..(222): Xaa can be any naturally occurring amino acid
  misc_feature (306)..(306): Xaa can be any naturally occurring amino acid
TAAGALKSYKLAAKAISRLQSLPSGNITLLCEVLVREVRDLTGYDRVMVYKFHEDEHGEVIAECRRSDLEPYLGLHYPATDIPQASRFLFMKNKIRMICDCSSQPVKIIQDKRLAQPLSLGGSTLRAPHGCHAQYMANMGSIASLVMSVTINDDDDDDDDTSESDKKKGRKLWGFVVCHHTSPRFVPFPLRYACEFLSQVFGIQLNKEVELAAQLKEKHILXTQTMLCDMLLRDAPMGIITQSPNVMDLVKCNGATLYYNNKFWLLGITPTEEQIRDIIGWLFENHDQSTGLSTDSLVEAGYPGAXFLGDAVCGMAAIKITSKDFLFWFRSHTAKEIKWGGAKHDPIDKDDGRKMHPRSSFRAFLEVVKWRSIPWE

SEQ ID NO: 45152 - protein, 575 aa, Cryptococcus neoformans var. neoformans JEC21
MKGGRFLLPALFKTLLLPPLIAALFIHHFPSLFLPFSALIYLISFPALYVFRSYASLVASSWKASALGAIDIPRVNGTWPLNIDILLNWAKSGTEEEVGRMMVLMGRQYGGTYNTRVLGEDQIISSDPKVIKHVLIDDFDNFVKGQKFKERAQDFLGDGIFNSDGDNWKFHRSFMRPFFQPKYISPLHFSTNVQNFFAKLPSYGKAFDMQARIGQLALELAIMWLCGEDMSGDASNVARTEEWKKAKGEISWAMTEAQKIVGKRVKIGTIWPLFEVRHDPLERPMKVIRAFFRPIISRALNRKRQRCKLDNTEDVYMIDRLVEATDDIKLVEDQLINVLLASRDTLASLLTFSVYAIVLHPDFAARLKDEVFTIANQECEVTKDTIRQLRYCRAFINEVLRLFPPVPLNIRRTLRPSLLPTPNHLAYMPANTSIILATILMQRDPAVWGEDAQVFNPDRWLEGGGLGKEKEGFMSWNLGPRMCLGQSFALAITHTFLVYFFRHIAHVGTLVGHNTTVQLALDAQPPETVLPKEWMTPEGGDGRARGGRDKVWIVADVVLAIKGGLWIRFGAEETE

SEQ ID NO: 45153 - protein, 370 aa, Paeonia sp. Qiu 95-090
AGALKSYKLAAKSISRLQSLPSGNVPLLCDILVKEVSDLSGYDRVMVYKFHEDEHGEVVAECRRPDLGPYLGLHYPATDIPQASRFLFMKNKVRMICDCSAPSVKVTQDKSLPQPLSLAGSTLRSPHGCHAQYMANMGSIASLVISITINDGDDEMESGQQKGKRLWGLVVCHHTSPRFVPFPLRYACEFLIQVFSVQINKEVELAVQLREKHILRTQTVLCDMLLRDAPVGIITQSPNVMDLVKCDGAALYYRKKFWLLGVTPTEAQIKDIAEWLLEYHSESTGLSTDSLMEAGYPGASILGDVVCGMASIRIASKDFLFWFRSHTAKEIKWGGAKHDPDDKDDVRKMHPRSSFKAFLEVVKRRSLHWE

SEQ ID NO: 45154 - protein, 402 aa, Helicobacter hepaticus ATCC 51449
MKETGIELMKNTKSVRDIDVKDKRVLIRVDFNVPMDEDFDISDDTRIREALPTINYCIDNHAQNIVLVSHLGRPKGRNAEFSLKHVLKRVERLLGRDIAFAETIENVENLQQQSKSGSVILLENIRFYEGEEKNDEELSTKLASICDVYINDAFGTSHRAHSSTCGIAKYAKECVAGLLLKKEIDSFAKAMANPLKPVLLIVGGSKVSSKLALLYNILDVVDKIIIGGAMSNTFLKARGFDMQKSLVEDDLVSEARKILDKAKEKKVKIYLPVDVVSTDDIKEHRHIKITPAQDIPEGFMAVDMGPATSKLFSEVVRDSQTIIWNGPLGIYEIQAFSRGTFNLAHAVSDTYAFSLIGGGDTADAIDKAGERDNMSFISTGGGASLELLEGKILPAFEVLERK

SEQ ID NO: 45155 - protein, 251 aa, Fusobacterium nucleatum subsp. vincentii ATCC 49256
MRRLVIAGNWKMYKNNKEAVETLTQLKNLTKDIKNVDIVIGAPFTCLSDAVKTVEGSNVKIAAENVYPKIEGAYTGEISPKMLKDIGVTYVILGHSERREYFKESDEFINQKVKAVLEIGMKPILCIGEKLEERESGKTFEVLSKQIKGGLADLSKEEAGKVIIAYEPVWAIGTGKTATPEMAQETHKAVRNVLAEMFGKDIADKMIIQYGGSMKPENAKDLLSQEDIDGGLVGGASLKADSFFEIIKAGN

SEQ ID NO: 45156 - protein, 559 aa, Moorella thermoacetica ATCC 39073
MSKVPSDIEIAQAAKMKPVMELARGLGIQEDEVELYGKYKAKISLDVYRRLKDKPDGKLILVTAITPTPAGEGKTTTSVGLTDALARLGKRVMVCLREPSLGPSFGIKGGAAGGGYAQVVPMEDINLHFTGDIHAVTYAHNLLAAMVDNHLQQGNVLNIDPRTITWRRVIDLNDRALRNIVIGLGGKANGVPRETGFDISVASEVMACLCLASDLMDLKERFSRIVVGYTYDGKPVTAGDLEAQGSMALLMKDAIKPNLVQTLENTPAFIHGGPFANIAHGCNSIIATKTALKLADYVVTEAGFGADLGAEKFYDVKCRYAGFKPDATVIVATVRALKMHGGVPKSDLATENLEALREGFANLEKHIENIGKFGVPAVVAINAFPTDTEAELNLLYELCAKAGAEVALSEVWAKGGEGGLELARKVLQTLESRPSNFHVLYNLDLSIKDKIAKIATEIYGADGVNYTAEADKAIQRYESLGYGNLPVVMAKTQYSFSDDMTKLGRPRNFTITVREVRLSAGAGFIVPITGAIMTMPGLPKRPAACNIDIDADGVITGLF

SEQ ID NO: 45157 - protein, 421 aa, marine gamma proteobacterium HTCC2207
MIMHHAISSQDGNLFIESTALSTIAGQLGTPCYVYSKAAISNNFLAYQSALVDKEHLICYAVKANSNIAVLQTLAELGAGFDIVSIGELERVLRAGGDPAKVVFSGVAKTASEMQRALELGIHCFNVESEAELELLNSTASSCGATAAVSLRVNPDVDAQTHPYISTGLKENKFGIDINLAAQVYQRAAQMAHINVVGVDCHIGSQLVDIAPFVSALERLLALVDELAGLGIALKHIDIGGGLGVRYDDEEPPTPQSYMSAILPLLMDRSETLVLEPGRSITANAGVMLTQVQYLKSNGEKNFAIVDAAMNDMIRPALYQAWMDIQSISTGNSESAVYDVVGPVCETGDFLAKDRPLSICAGDYLCLMSAGAYGFVMSSNYNSRPRAPEVMVDGDQIHLVRQRETIEDLLSGESLLPAVVR

SEQ ID NO: 45158 - protein, 878 aa, Rickettsia sibirica 246
MKKLIYYFGSNGSDGNASMKNILGNKGAGLAEMSNLKLPIPDGFTITTELCNYFYTHNNNFPKNFQSDLKKAITELEIITGKIFGSTSNPLLLSVRSGSTVSMPGMMDTILNLGMNNEVCNALADSCGDKRFALDSYKRFLEMYGSTVLSIPSDLFEQIYEKHKMQADIHKDRDITVELLEKIIDDFKRLHIKYTKQLINDPYEQLESAIKAVLHSWMSNRAVIYRKINNISEDFGTAINIQAMVFGNLGKTSATGVAFTRSPSTGEKKLFGEFLINAQGEDIVSGTRTPMPIIANDSNSMQAMMPEVFKELSQIAQKLEEHYLDMQDIEFTIENNKLYILQTRTAKRTAIAAINIAVQMVEEKLISKEQALMRIDPESLNQLLHTRIDYSKGLTSIAEGLPASPGAATGIAVFSPYDAEKLSHHHKVILVRHDTSPEDINGMHVSSGILTIRGGMTSHAAVVARGMGKPCVCGTNNLSIDEKKQILTAGDIVIKQGDIITIDGGSGKIFLGEMPLIQPTFSEESKLILDWADEISSLKVRANAETVNDALVSVKFGAQGIGLCRSEHMFFDKNKIPLVRDMIIAPDIERRKLAVQKLLPLQTEDFKALFRVMKDKPVNIRLLDPPLHEFLPTTEEDKKNLANSLNLPLSMINQRLHAMHEVNPMLGHRGCRLGICSPEIYQMQIEAIFTAIFELHKKEHIECNLELMIPLISNVGEIQKLKMDIYAVIEELEQRYRYKFSFTLGTMIELPRAALGSKKIAKEVDYFSFGTNDLTQTTYGISRDDIASFLPYYLEEKIFESDPFTTLDEEGVGELIEIAIKRGKSSNANLKLGACGEHAGNPASIEFFHRMNLNYVSCSPYRIPIARIAAAQAKIKHG

SEQ ID NO: 45159 - protein, 245 aa, Blastopirellula marina DSM 3645
MRVAAGIFQIYVTLVGRVSMRRVNIRTMQKLISGLSQFQKSDYQHKQSLFAELAHGQSPHTLFITCSDSRIDPNLITRSDPGDIFVLRNAGNLIPRKGQASGEAATIEYAIKALKVQDIVVCGHSGCGAMNAVLQAGSCDELPAVAAWLQNTDGLTQRTLQRNGEQSPERMLELVIQENVRMQLENLEAMRCVADALSSDQVQLHGWAYDIGSGNVEMLDREQDAFVPLSEATFGEIDGSTSGYA

SEQ ID NO: 45160 - protein, 453 aa, Archaeoglobus fulgidus DSM 4304
MEEFEGEAIVEAENVVSIMLRREAAERADEILHFSYWSGEIKELDAPGYLDRWQKKCYHATCSLDEGEILLVVGPPGSGKTTFIAEAARKLSEEERVWVTSNTNIAVDNVLEKLERALRIGHPSKITAGVRRHSVEYNLLSGIRFSDYREYASKVAEAYREIARIQNDMIRKGKIVVGSTILKGMMSALKNYDFDTVIIDEASNTCISTALLALEKAEKAVVVGDPYQLPPVYEVGGHKAAKFSAYNFLINIYGKNLWLRRHYRSNAKIAEFAARHVYGFLEIDEKCRRIKIEPCKTTIPEVGDPEKPLVFIDCNGVERREGRSKVNEEEAEVVAMIAEELAECVGEENVGVITPYVKQAELIRGILSEFGVMVEVSTVHSYQGREKDVVIYSITATGNPYFASEKRLFNVALTRARKKFIAVGNSKALEGKNLLLTRFMVAAIKEGGFVRLR

SEQ ID NO: 45161 - protein, 556 aa, Candida albicans SC5314
MNYTRVNSSEELEVYEEVGRGGFGVVYRGIIKSTNQEVAIKQIDLEKDSTDLIEINKEIQIISECHCQQITSYMGSFVKNYKLWVIMEFIDGGSIFELLKPGPIDDEKIVSFILYEILLALNYLHNQGKIHRDLKSQNILISKTGDIKLTDFGVSTQLSSNFSKRNTTVGTPYWMAPEVIVNNNGGHSYKADIWSLGCCCYEMFTGKPPLQSKYPPMRALRLISKCQKNQDFIKLIELNELDISWEFKDFLHQCFIEDPKLRASASKLLKHKFITKHIHDKDKIKLLKKLITKKQLWNQQNHIVKTQNYYVPTEIYNNQLKWNMDDQNGNENQQTELTKESGDQHTGNTIKFDISSLMLNNDLEDDIEEDVEDDAHEERKSSPSSEPNDDIIGFFKNDFNNILTKIFNKIDNRNQLSRLQYDQLVEMNNLMGQLITNDNGGTNNNRKILLFQYLKYLIKELLKEKNSHINRLILPSSILHNTGTNGITTNISGNTLVNNNNHVTNMTNFTTNGILSSTTSTTTVNHNRTTSHTWTKFDEIESSLLESWINRMEQDN

SEQ ID NO: 45162 - protein, 241 aa, Pseudomonas aeruginosa PAO1
MVFQHDIYAGQQVLVTGGSSGIGAAIAMQFAELGAEVVALGLDADGVHAPRHPRIRREELDITDSQRLQRLFEALPRLDVLVNNAGISRDREEYDLATFERVLRLNLSAAMLASQLARPLLAQRGGSILNIASMYSTFGSADRPAYSASKGAIVQLTRSLACEYAAERIRVNAIAPGWIDTPLGAGLKADVEATRRIMQRTPLARWGEAPEVASAAAFLCGPGASFVTGAVLAVDGGYLCA

SEQ ID NO: 45163 - protein, 396 aa, Staphylococcus aureus subsp. aureus MRSA252
MTKSEKIIELTNHYGAHNYLPLPIVISEAEGVWVKDPEGNKYMDMLSAYSAVNQGHRHPKIIQALKDQADKVTLVSRAFHSDNLGEWYEKICKLAGKDKALPMNTGAEAVETALKAARRWAYDVKGIEPNKAEIIAFNGNFHGRTMAPVSLSSEAEYQRGYGPLLDGFRKVDFGDVDALKAAINKNTAAVLVEPIQGEAGINIPPEGYLKAIRELCDEHNVLFIADEIQAGLGRSGKLFARDWDNVKPDVYILGKALGGGVFPISVVLADKEVLDVFTPGSHGSTFGGNPLACAASIAALDVIVDEDLPGRSLELGDYFKEQLKQIDHPSIKEVRGRGLFIGVELNESARPYCEALKEEGLLCKETHDTVIRFAPPLIITKEELDLALEKIRHVFQ

SEQ ID NO: 45164 - protein, 514 aa, Arabidopsis thaliana
MKMMMMIILLLCSIILITILFFKKQSRGKKSNAPPSPPRLPLIRNLHQLGRHPHRSLCSLSHRYGPLMLLHFGSVPVLVVSSADAAKDVLKTHDRVFASRPRSKIFDKIFYNGRDVALAPYGEYWRQMKSVCVLHLFSNKMVRSFRDVRQEEISLMIEKIRISSSLRINLSEILVNLTNNVICRVALGRKYGGKTDFKDLMKRLTRLLGEFSVGSYVSWLAWIDWIRGLDGQLIKISNDLDEFLERVVQDHVDGDGHKNDFVDFLLTIEREKSVGFEIDRLSIKAIILVKGRYENKFKFTDELVYNHSSCFGFQDVFVGDMDTTYTLLEWAMTELLCHHECLDRLQEEVRMVCKDKSGVSEDDLQDMKYLKAVIKETLRLHPPLPLMVPHESTHDVKLRDYHIPAGTHVMINAWAIGREAATWGPDAEEFRPERHLNSYVDYRGQDTELVPFGAGRRICPAISFAVVLDEVVLANLVHQFDWTLPEESTEYQTDVAESTGMAVHRMFPLFAMTT

SEQ ID NO: 45165 - protein, 548 aa, Methanothermobacter thermautotrophicus str. Delta H
MVFTEDTIGEFFEKQVERYADKEFIVYPDRDLRFTYREFNERVNLLAKGLLSIGIGKGDHVGIWATNVPDWLTFLFATAKIGAVLVTVNTAYKSHELEYVMKQSDMKALAIIDGFRDVDYVQTLYELVPELKTHERGHLRSERFPELRSVIYIGAQKHRGMYNTNELMLLGKHVPDTELRTVMSTLKNTDVINMQYTSGTTGFPKGVMLTHRNILNNGYYIGERQRFTEEDRLCLPVPLFHCFGIVLGVLALLTHGGTLVMIELFDPLLVLAAVEKERCTALYGVPTMFIAEFTHPMFDMFDLSSLRTGIMAGSPCPIEAMKRVMNDMNMKEVTIAYGLTEASPVFTQTSVDDPIEKRVETVGTPLPHIEVKIVDPETGEELGPGEPGEICCRGYNVMKGYYKMPEMTAEAIDEDGWLHSGDLAVMDEDGYYSIVGRIKDMIIRGGENIYPREIEEFLHTMPGVKDVQVVGIPDEKYGEIVGAFIIREDGADILEEDVRDYAIQRIARYKVPKHVFFVDEFPLTASGKVQKFKLREMAVELLKKKEQP

SEQ ID NO: 45166 - protein, 534 aa, Arabidopsis thaliana
METPTMKPDTVLILDYGSQYTHLITRRIRSLNVFSLVISGTSSLKSITSYNPRVVILSGGPHSVHALDAPSFPEGFIEWAESNGVSVLGICYGLQLIVQKLGGVVVEGESKEYGKMEIEVKGKSEIFGSESGGEKQMVWMSHGDEAVKLPEGFEVVAQSAQGAVAALESRKKKIYGLQYHPEVTHSPKGMETLRHFLFDVCGVSADWKMEDLMEEEIKVINKTVASDEHVICALSGGVDSTVAATLVHKAIGDRLHCIFVDNGLLRYKEQERVMDTFERDLHLPVTCVDASERFLSELKGVVDPETKRKIIGREFINIFDQFAQELEKKHGKKPAFLVQGTLYPDVIESCPPPGTDRTHSHTIKSHHNVGGLPKDMKLKLIEPLKLLFKDEVRELGRILNVPVGFLKRHPFPGPGLAVRVLGDVTQGNALEVLRQVDEIFIQSIRDAGLYDSIWQAFAVFLPVRSVGVQGDKRTHSHVVALRAVTSQDGMTADWFNFEHKFLDDVSRKICNSVQGVNRVVLDITSKPPSTIEWE

SEQ ID NO: 45167 - protein, 368 aa, Ranunculus sp. Qiu 95024
MKSYKLAAKAISKLQAMPSGNIPLSCDMLVQEVRDLTGYDRVMVYKFHEDDHGEVIAEWRVSSLEPYLGLHYPATDIPQASRFLFMKNKIRMICDCSAIPVKVVQDKKLGQPLSLGGSALRAPHGCHAQYMSNMGSVASLVMSVTINEDDEQMETGQQKGRKLWGLVVCHHTSPRFVPFPLRYACEFLIQVFGMQINKEVELANQTREKHILHTQTVLCDMLLRDAPIAIVTQSPNVMDLVMCNGAALYYRDRLCLLGVTPTDDQIRDIAQWLLEYHNESTGLSTDSLMEAGYPSASLLGNAVCGMAAIKITSKDFLFWFRSHTAKEIKWGGAKHNPAEKDDRWKMHPRSSFKAFLEVVKHRSLPWED

SEQ ID NO: 45168 - protein, 136 aa, Salmonella enterica subsp. enterica serovar Typhi
PEIGYTPGVETTTGPLGQGLANAVGLAIAERTLGAAQFNRPDHEIVDHYTYVFMGDGCLMEGISHEVCSLAGTLGLGKLIGFYDHNGISIDGETEGWFTDDTAKRFEAYHWHVVHDIDGHAPEAVKKAILEAQSVK

SEQ ID NO: 45169 - protein, 371 aa, Reinwardtia indica
GALTSYKIAAKAISRLQSVPSGSINLLSDVLVNELRDLTSYDRVMVYRFHEDEHGEVVAESIAPGLEPYLGLHYPATDIPQASRFLFMKNKVRMICDCLAPSVKVTQDRNLAEPINLSGSTLRAPHGCHAQYMANMGSIASLVMSVTINDNEDGNEMESDQMMGRKLWGLVVCHHTTARFVPFPLRYACEFLIQVFGVQISKEVELEAQRKEKHIIQTQTVLCDMLLRDAPVAIMTQSPNVMDLVKCDGAALLYRKKCWLLGVTPTEEQITDITEWLLEYHNDSTGLTTDSIMEAGYPGASVLASTICGMAAIRITSKDFMFWFRSHTAKEIKWGGAKHDPDDKDGVRKMHPRSSFKAFLEVVKWRGLPWE

SEQ ID NO: 45170 - protein, 468 aa, Azorhizobium caulinodans
MKTAKEVLDFIKSNDVKYVDLRFTDPRGKWQHVTFDITMVDEDFFAEGQAFDGSSIAAEAINESDMLLMPDVTTACVDPFFSETTLSVVCDVLEPTTGEPYGRDPRGIAKKAMAYLQSTGIGDTVFFGPEAEFFIFDDVKFKADPYNTGFKLDSIELPTNGDTDYEGGNLGHRIKTKGGYFPVPPLDSAQDMRSEMLASMAKMGAKVEKHHHEVASAQHELGLKFGQLVTMADHLQVYKYCIHQVANIYGKTATFMPKPVYGDNGSGMHVHQSIWKDRKPLFAGDKYADLSQECLWYIGGVIKHAKSLNAFTNPLTNSYKRLVPGYEAPVLLAYSARNRSASCRIPYTNNPKAKRVEVRFPDPGANPYLAFSALFMAGMDGILNKIDPGSAMDKDLYDLPPAELKQIPTVCCSLREALESLAKDHDYLLKGDVFQKDFIESYIDLKMQEVARFEMTPHPVEFEMYYSV

SEQ ID NO: 45171 - protein, 343 aa, Myxococcus xanthus DK 1622
MKGAAMRATVLHKPGDVRFEERAEPKILAPTDAIIRLSATCVCGSDLWPYRGVQAVTEPTPMGHEYCGIVEEVGSAVASVKPGQFVIGSFFASDNTCPHCKAGYQTSCQHREPVSGAQAPRMRVPLADGTLVVTAEVPPDALVPSLLAVSDVFGTGWFAADAANVNPGSTVVVVGDGAVGLLAVLSAKQMGAERIIAMSRHETRQALAREFGATDIVSVRGDEGVARIKELTRGIGADSVLECVGTQESMLQAIGAARPGGFVSYVGVPHGVSLDGEKLFFSHVHLHGGPAPVRRFMPQLIDLVWSRKVNPGKVFDLTLPLEKVAEGYRAMDERRAIKALLRP

SEQ ID NO: 45172 - protein, 363 aa, Sabia swinhoei
TAAGALKSYKLAAKAISRLQSLPSGNISLLCDVLVREVSDLTGYDRVMVYKFHEDEHGEVIAECRRSDLEPYLGLHYPATDIPQASRFLFMKNKVRMICDCSARPVKVVQDKRLARPLSLCGSTLRAPHGCHAQYMANMGSIASLVMSVTINEDDDDEMESDQKKGRKLWGFVVCHHTSPRFVPFPLRYACEFLIQVFGIQVNKESELAAQLREKHILQTQTMLCDMLLRDAPVGIVSQSPNVMDLVKCSGAALYYKNKFWLLGVTPTEEQIRDIIGWFVENHDQSTGLSTDSLMEAGYPGASVLGDAVCGMAAIKITSKDFLFWFRSHTAKEIKWGGAKHDPVDKDDGRKMHPRSSFKAFLE

SEQ ID NO: 45173 - protein, 245 aa, Bacillus cereus ATCC 10987
MIKLVLIRHGQSLWNLENRFTGWTDVDLSENGLSEAREAGAILKKNGYTFDVAYTSVLKRAIRTLWIVLHEMDLAWIPVHKCWKLNERHYGALQGLNKDETAKKYGEEQVHIWRRSIDVRPPALTEDDPRYEMNDPRYKALKKGELPLTECLVDTEKRVLAYWHSEIAPSLKSGEKVIISSHGNTIRSLVKYLDNLSSDGVVSLNIPTSIPLVYELDDNLRPIRHYYLSMDGEVPEGEIPKHISF

SEQ ID NO: 45174 - protein, 368 aa, Sapria himalayana
ALTSFRLAAKAISRLQAISSGSISKLCNVLVKEVSHLTCYDRVMVYKFHEDEHGEVIAECIRPDLEPYLGLHYPATDIPQAARFLFMKNKVRMICNCMASPVKVLQAEGLDKPLSLCGSTLRSPHRCHEQYVANMNSIASLVLSVTINEEDGEMESTQSRPARLWGLVVCHHTSPKFVSFSLRYACEFLIQVFGIQINKEVELEAQRKEKHILQTQTLLCDMLVRDSPVGIITKSPNVMDLVKCDGAALFYRNKIWLLGLAPSEMQIRDIAEWLLECHGKSTGLSTDSLMESGYPGASLVGSSVCGMAAIRVTSKDFIFWFRSHIAKEFRWGGAKHGRHDKDDGRKMHPRSSFKAFLEVVKWRSLPWE

SEQ ID NO: 45175 - protein, 1076 aa, Ehrlichia chaffeensis str. Arkansas
MPKRTDIESILVIGAGPIVIGQACEFDYSGTQACKVLKQEGYRIILINSNPATIMTDPEIADSTYIEPITSNIIEKIIIKERPSAILPTVGGQTALNAAINLCELGILEKYNVKLIGATKEAIKKAEDRNLFRQAMDKIGVKYPKSIIIRSVDEINDALEYIGLPAIIRPSFTLGGIGGGISYNKEEFHKNVSHGLNISPISEVQVDESIIGWKEFEMEVMRDNKDNCIVVCSIENLDPMGVHTGDSITVAPALTLRDVEYQKMRDISFSILREIGVDTGGSNVQFAVNPKNDNDLLVIEMNPRVSRSSALASKATGYPIAKVAAKLAIGYSLDEIQNDCTEVIPASFEPSIDYIVTKIPRFNFDKFRGTEKELSTSMKSVGEVMAIGRSFPESLQKALCSLEAGYSGLNEYFDQNIEIDQLYNSLVKLSPDRIFIIADALRHNISIEEINKITGYDPWFLTQIKNIIQCEQQIQKNGLPKEAEGLLLLKKMGFSDIRLAYLSKTTVEYIEDLRKSLSIKPVYKHIDTCAGEFKTNASYMYSCYEGNTINVTECESVVTNNKKVIILGSGPNRIGQGIEFDYTCVHAAHTIRQMGYESIMINCNPETVSTDYDISDKLYFSPLTRESVLDIIYKEQETNSLLGVIVQFGGQTPLKLAKVLQEKNINILGTSFDSIDLAEDRMKFQQLLTQLNLKQPSNITCNSIHEVYECIKDLVFPILARPSYVLGGQSMSIIRDSNALSNYLTTYKNIFDHGSLLLDQFLTHAIEVDVDAICDGEKVYIAGIMEHIEEAGVHSGDSACSLPSYSLTSEITDAIAEQTKKIALALQVRGFINIQYAIQDGEIYILEVNPRASRTVPFIAKATGIPIAKIATEVLLGKKLPNALEEKLTHVAVKEAVFSFSRFPNIDVLLGPEMKSTGEVMGIDKSFEIAFAKAQMAAGYELPTKGTAFISVKNSDKPLIVKTAQILKDIGFTIFSTKGTSTYLNEAGITTEHVNKVREGRPHILDLLQDDKINLVINTSEGIKSFSESSSIRKTALIKKIPYSTTIPGARALALAIKTLKKQGIHVESMQEYTKK

SEQ ID NO: 45176 - protein, 383 aa, Ehrlichia chaffeensis str. Arkansas
MKKIQDFSCSGKTVLLRADLNVPVDNGIVLDDTRIVRLTTTIKYLLSNDAKIVIMSHYGSPKSYDKEFSLKFVVEYLNKIFATNVVFIDGVIGDYVEQTIQSVPAGTILLLENLRFYAEEEKNDLNFAKQLALLADIYVNDAFSCLHRKHASIDAITRVMPSFIGFNFQEEMKYLSCVVSNSEKPVAVIVGGSKISTKVHMLKNLIKKIDFLIVGGAIANNFLLSQGLKIGKSLYEELEKDLVTEIVDLAKRYECKIIVPVDYVVAKNYICGDSTIKDNDTLESDDMILDVGPQTVNMIAATINKCRTVLWNGPCGMFEKEPFSKGTFSVANLLSKLTKVGKLKSIVGGGDSICAIKLSGLSNEDFTYISTGGGALLHFLSIA

SEQ ID NO: 45177 - protein, 873 aa, Ehrlichia chaffeensis str. Arkansas
MSEKLIYYFSKTKCDGSLTLSHILGGKGANLAEMCNIGVDVPPGFTVSTAVCNYYYQHSKLPDNIFSLVENAIEFLNNEVNLKFGDNDNPLLFSVRSGSVSSMPGMLDTILNVGLNDNTVIGLAKKSGEFFAYDSYRRLIQMYAHTVLQIESNLFEEVICKKKREAGIPVNSQISDPNILKEIIIEFKKIVSTHTNKDFPQDVHEQLYNSIDAVFRSWMNKRAVIYRKIHNIPDNLGTAVNVQSMVFGNMSQNSATGVVFTRNPSTGEKEIFGEFLVNAQGEDVVSGTHIPLPLNKMQELMPQPYSDLEKVCQKLELHYREMQDVEFTIENGKLWILQSRPGKRSIQSAVKIAVDMVEEKLISREEAILRIDYKSFSKLFHPILENNTNINIIARGLPASPGAATGYAAFTPNDAEQFRKDGKNAILIRQETNPEDINGMNSSVGIITLRGGMTSHAAVVARGMGKPCICSANGIFIDKSEQFFYTNTGLKVHKGDNITINGCNGEVILGTIKTVTPKLSESFYKLMQWVDEIRILKVMANADTPEDTDIAMNFQADGIGLCRTEHMFFSDKRISIVQEMIVSDTKEERIAALEKLEVMQKEDFKKIFKSTINKQVTIRLLDPPLHEFLPDNDNAINEVSVRTGKSLEKLRNKVLYLSEKNPMLGHRGCRLAISYPEIYEMQVRAIFLAIKELQEETDITGIVPEIMIPLVMNEKELVIIKELISNVAQQFNNPKYSIGTMIELPKAALIADKIAQHAQFFSFGTNDLTQTTLGVSRDDSASFIEIYKDLEIIKQDPFETLDIEGVGKLISIAVDLGRKSSPNIKIGICGEHGGNFDSIQFFAKLNLNYISCSPYRIPTARLIAAQAAIMNRV

SEQ ID NO: 45178 - protein, 438 aa, Cicer arietinum
QLFDKTIEHDKATGSFINVHIVKFPATQLGLPIGVENLFAASDNQTASKIVMAAHILKPEIEAFMKQNPPDVFIPDIMFTWSESTAKILQIPRLVFNPISIFDVCMIEAIKSHPEAFVSDSGPYHIPELPHPITLPIKPSPGFARLTEPLVEAEKGSHGVIVNSFAELDEGYTEYYENLTGRKVWHVGPTSLMIKTTLEKTDNISNGSSTKHKCLTWLDTKEPSSVVYISFGSLCSLSNDQLLELAKGIEASKHQFLWVVHRKGDDDDDDDENWLPKGFKERMKEENRGMLIKGWVPQPLILDHPSIGGFLTHCGWNATVEAISSGVPMITMPGFGDQYYNEKLVTEVHRIGVEVGAAEWSMSPYDAKKTVVSWERIEKGVKSLMDGDGGGNEIRKRAKDMKEKAWKAVQEGGSSQNCLTALVDYLQSVVGPRQSINN

SEQ ID NO: 45179 - protein, 521 aa, Moorella thermoacetica ATCC 39073
MATATEKLELRREVTVWGSYMWGYADVGADIYAALGLVMLWAKGATSLAFALAGLVYIMIGLAYTELAAAYPVAGGGQFFTLRGLGDFWGFVAGAALLLDYTIDIALFATASAGYINFFLPYLFGVNIDSLAVSIGPLHHVNLVWMAEALALVFFLIALNIRGMRESSLLNEVLGAIDILTESTIIVFGFLFAWRPELLAHQWVTQFPTFKEFAYGSSLAIISFVGLESISQAAQETKRPATVVPRTSVGLIFTVFIFATAFSTMSLGVLPWQDIAKAVGDPVATLAHAIPFIGIIAGPFAALLGATILLISANSGVMSASRLTFAMSQFNFISDWFNAVHPRYRTPYRTILVFSGIGILQLVLSFLTPNAMDTLGNMYAFGATTGYILVFIALIKLRFTDPYAPRPYKVPLNIKINYRGRVVEFPILGVIGTLGISTILFEVILTHAIGRIAGPAWIILCFLYYAYYRRSKGYPIFGNIPRDWEAQQIKVLEAAEEYDLLEEYKQALAERERLEAKAHVK

SEQ ID NO: 45180 - protein, 293 aa, Methanothermobacter thermautotrophicus str. Delta H
MLHGTEVLKKGFAKMTKGGVIMDVVNAEQAAIAEDSGAVAVMALEKVPADIRASGGVARMADPNKVQEIMDAVSIPVMAKVRIGHFVEAQVLEALGVDMIDESEVLTPADERFHIDKKKFTVPFVCGARNLGEALRRIDEGAAMIRTKGEPGTGNIVEAVRHMRIMMSEIREIQNKEEEELWEVSRKIEAPLELVRETAKLGKLPVVNFAAGGVATPADAALMMQLGADGVFVGSGIFKSDNPEGYARAIVEATAHYDDPEVIAEVSRGLGTAMRGLEISEIPEEGRMQDRGW

SEQ ID NO: 45181 - protein, 398 aa, Archaeoglobus fulgidus DSM 4304
MGDSEIQYLLEKLKKLEEDYYKLRELYRRLEDEKKFIESERIRYEREVRRLRSEVERLRSPPLLVGVVSDILEDGRVVVKSSTGPKFVVNTSQYINEEELKPGARVALNQQTLAIVNVLPTSKDPMVYGFEVEEKPEVSYEDIGGLDVQIEEIREAVELPLLKPELFAEVGIEPPKGVLLYGPPGTGKTLLAKAVANQTRATFIRVVGSEFVQKYIGEGARLVREVFQLAKEKAPSIIFIDELDAIAARRTNSDTSGDREVQRTMMQLLAELDGFDPRGDVKVIGATNRIDILDPAILRPGRFDRIIEVPLPTFEGRIQIFKIHTRKMKLAEDVDFKELARITEGASGADIKAICTEAGMFAIREERAKVTMLDFTKAIEKVLKKTTPIPDLKGVMFV

SEQ ID NO: 45182 - protein, 225 aa, Lactobacillus plantarum WCFS1
MTELVLVRHGESTANRDNTYTGWSDVPLTAVGIAQAHQAGKRLRATGLQFGAVHTSVLKRAIVTANIMLSEIDQLWLPEYKTWRLNERHYGALRGQNKDVTRQEYGKAQVQQWRRSFYTVPPLLTPAELDHDRRYTKYGAAVEPRGESLKMAYDRIMPYWIDEIAPRLLDGQNQLVVAHGSTLRAMIKYLEHISDTGIDGVEVANGVPICYHLDRQLHVIGKEEY

SEQ ID NO: 45183 - protein, 196 aa, Medicago truncatula
MAGVQIRDEHGNPIQLTDELGNPVKLTDEHGNPIHLTGVATTTTTHNNPPTAAGSGSAGFGTYGSVAYGGGATTHPTTTVADLLSTEPPPGQQLHHTDQVSRGLRRSSSSSSSSSSSEDDGQGGRRKKKKGVKDKIKEKIPGVGGGNKEHNSATSIPGAGHHPTATATHHPAEPTLEKKGILDKIKEKLPGHHHSH

SEQ ID NO: 45184 - protein, 1080 aa, Xanthomonas campestris pv. vesicatoria str. 85-10
MPKRTDLKTILIIGAGPIVIGQACEFDYSGAQACKALRDEGYRVVLVNSNPATIMTDPNMADAVYIEPINWQTVEKIIAKEKPDALLPTMGGQTALNCALDLADHGVLEKYNVELIGAKREAIRMAEDRELFRVAMGEIGLDCPTAAVAHTLEEALEIQTRVGYPTIIRPSFTLGGSGGGIAYNREELIEIVGRGLELSPTTEVLVEESVLGWKEFEMEVVRDTADNCIIVCAIENLDPMGVHTGDSITVAPAQTLTDKEYQRLRDASIAVLRKIGVDTGGSNVQFGISPTTGRVVVIEMNPRVSRSSALASKATGFPIAKVAAKLAVGYTLDELKNEITGGLTPASFEPSIDYVVTKIPRFAFEKFPQADARLTTQMKSVGEVMAMGRTFQESLQKALRGLETGKIGLDPTGLDLSSEDGIATLKRELKAPGPERLFYVADAFRAGMTVADVYALSFIDPWFLDQIEEIISHEQQLADDGMAALDAPRLRMLKRAGFSDARMAQLIGSNEESVRTLRRALKVRPVYKRVDSCAAEFATSTAYLYSTYEDECEALPTDRDKIMILGGGPNRIGQGIEFDYCCVHAALALRDDGFETIMVNCNPETVSTDYGTSDRLYFEPLTLEDVLEIVELEKPKGVIVQYGGQTPLKLARALEANGVPVIGTSPDSIDLAEDRERFQQLVDKLGLKQPPNRIARNAEEALVLAREIGYPLVVRPSYVLGGRAMEIVYGESDLARYVRDAVKVSNDSPVLLDRFLDNAVEVDVDIIADKDGNVLIGGVMEHIEEAGVHSGDSSCSLPPYSLSPQTQAELRRQVVMLAEGLNVVGLMNTQFAVQVNEAGDDIVYLLEVNPRASRTVPFVSKAIGMPLAKIAARCMAGKTLAEQGATKEIVPDYYSVKEAIFPFAKFQGVDPILGPEMRSTGEVMGVGRSFSAAFARAQEAGGIKAPPVGKAFVSVRDPDKQRVLPVAQALVERGFTLVATRGTGAWLQQNGLSCEIVNKVAEGRPHIVDSIKNGEIVYIVNTTEGRAAISDSFSIRREALQHRVTYSTTVAGAKALVQSLEFRGTGPVWSLQELHKELEA

SEQ ID NO: 45185 - protein, 206 aa, Chromobacterium violaceum ATCC 12472
MSIFQNARFYTTVNHMKDLPATRAEVAFVGRSNAGKSSAINTLANRTRLAYVSKTPGRTQHINFFELGDECFLVDLPGYGYAEVPEAVRAHWVELLGRYLQTRQSLIGLLLIMDARHPLKELDRRMLEFFRVAGRPVHILLSKADKLSRQEQNKVLAEVKRELADYPSVSVQMFSSLKKTGVDVVEQVVKGWFDALPPQDDGMAEL

SEQ ID NO: 45186 - protein, 418 aa, Sulfolobus solfataricus
MNSEELWAQAKQLFAGGVNSPVRAAVKPFPFYVERGKGAYIYTVDGKKFIDYVLGYGPLILGHSPESVKRRIVEQLERGWLFGTPSELEIELARKIRSHIPSAQKIRFVNSGTEATMAAIRLARGYTKRSKILKFSGNYHGAHDYALVEAGSAATEYNVATSDGVPMEIMKTVEICEFNDLDCVDKKLRNEDIATVILEPVMGNAGVILPEKDFLFGLRELTKTYNSLLIFDEVITGFRISIGGAQSYYQIYPDITTLGKIIGGGFPIGAVAGKAEIIDNFTPAGKVFNAGTFNANPISMIAGIATIEELEKEYPYIIANQAAKTLVEELERLLKTKHTINHVGSMFQIFFGIDEVRNYSDAKRADKEYYIKFHERLLKEGVFIPPSQYETIFTSAAHKDDVIADTIDKLMKVIGELN

SEQ ID NO: 45187 - protein, 394 aa, Coxiella burnetii RSA 493
MNDVLSVRAQQLEPSVTLAVSDLARELLNKGHDVISLSAGEPDFDTPDFIKQSAIKAIQEGFTKYTNVDGTPALKAAIVHKLKRDNHLNYEPSEILVSGGAKQSIYNVLMGTLNAGDEAIIPAPYWVSYPPMVQLAEAKPIIISATIDQNFKLTPGQLSQAITPQSRLLILNSPNNPSGVAYTESELKALADVLMEHPQILILSDEIYEYILWGQNRFVNILNVCPELRDRTIIINGASKAYAMTGWRIGYAAGPKSIIQAMKKIQSQSTSSPNSIAQVAATTALGAQRGDFAYMYEAYKTRHDLVLKALNQMKGVHCIPADGAFYLFPDVSAAIQQLGLEDDIKLGTYLLDKTKVAVVPGSAFGSPGHVRLSCATSTEKLQEALERLASVLDY

SEQ ID NO: 45188 - protein, 297 aa, Clostridium difficile 630
MKAEFLTPVVTIFDEEGNLDKEGNKKVYDHLIDGGVDGLVIMGSTGEFFNMSMDMQKELIDLVTSHVNKRVKVFIGTSRMCINESIELSNYAHNSGADGVMIISPYYFSLDDDSIELFYSEIAKNTEAEIYLYNYPDRTGYDLSPELTLRLARKHKNIVGYKDTVTLMGHTRDLINTMKIEFPEFKVYSGYDENFIHNLMSGGAGCIGGLSNLIPEVCSKWAEAYNNRDMEKVIEIQKYINKAMDFYLITNPFIPAMKKAMNIRGLQISDYMTAPFVKPNEKQVCEIKKLMNELNIC

SEQ ID NO: 45189 - protein, 365 aa, Sapria himalayana
TSFRLAAKAISRLQAISSGSISKLCNVLVKEVSHLTCYDRVMVYKFHEDEHGEVIAECIRPDLEPYLGLHYPATDIPQAARFLFMKNKVRMICNCMASPVKVLQAEGLDKPLSLCGSTLRSPHRCHEQYMANMNSIASLVLSVTINEEDGEMESTQSRPARLWGLVVCHHTSPKFVPFSLRYACEFLIQVFGIQINKEVELEAQRKEKHILQTQTLLCDMLVRDSPVGIITKSPNVMDLVKCDGAALFYRNKIWLLGLAPSEMQIRDIAEWLLECHGKSTGLSTDSLMESGYPGASLVGSSVCGMAAIRVTSKDFIFWFRSHIAKEFKWGGAKHGRHDKDDGRKMHPRSSFKAFLEVVKWRSLPW

SEQ ID NO: 45190 - protein, 53 aa, Malus x domestica
PQFRYTQTPSKVLHLRNLPWECAEEELIELCKPFGKIVNTKCNVGANRNQAFV

SEQ ID NO: 45191 - protein, 359 aa, Vitis sp. Qiu 94046
AGALKSYKLAAKAISRLQSLPSGNISLLCDVLVKEASELTGYDRVMVYKFHEDEHGEVIAECRRPDLEPYLGLHYPATDIPQASRFLFMKNKVRMICDCLAPPVKVIQNKRLAQPLSLCGSTLRSPHGCHAQYMANMGSVASLVMSVTINEEDDDTESEQQKGRKLWGLVVCHNTSPRFVPFPLRYACEFLVQVFGVQISKEMELAAQMKEKHILQTQTVLCDMLLRDAPVGIVTQSPNVMDLVRCDGAALYYQKKFWLLGVTPTEAQIRDIVEWLLEYHSGSTGLSTDSLMEAGYPAASLLGDAVCGIAAVKINSNDFLFWFRSHTAKEIKWGGAKHDPDDKDDGRKMHPRSSFKAFL

SEQ ID NO: 45192 - protein, 523 aa, Glycine max
RLREDDRCGTRVLSCDYPCNTHCLVGKIFHQQHTAMAGSNILSHSPSLPKTYSHSLNQNALSQKLFFLPLKFKATTKPRALRAVLSQNAVKTSVEDTKNAHFQHCFTKSEDGYLYCEGLKVHDIMESVERRPFYLYSKPQITRNVEAYKDALEGLNSIIGYAIKANNNLKILEHLRHLGCGAVLVSGNELRLALRAGFDPTRCIFNGNGKILEDLVLAAQEGVFVNIDSEFDLENITEAAKRAGKKVNVLLRINPDVDPQVHPYVATGNKNSKFGIRNEKLQWFLDAVKELPNELKLVGAHCHLGSTITKVDIFRDAATIMINYIDQIRDQGFEVDYLNIGGGLGIDYYHSGAILPTPRDLIDTVRDLVISRGLNLIIEPGRSLIANTCCLVNRVTGVKSNGSKNFIVIDGSMAELIRPSLYDAYQHIELVSPAPSNAETTTFDVVGPVCESADFLGKGRELPTPAKGTGLVVHDAGAYCMSMASTYNLKMRPPEYWVEDDGSVSKIRHGETFEDHIRFFEGL

SEQ ID NO: 45193 - protein, 319 aa, Rickettsia sibirica 246
MTNTNNYRIIAKRVISSEASALEKLSENIPEDFNRIIEFLLSFKGRIILTGIGKSGYIARKIAASFSSTGMPAFYLHPAEASHGDLGMVTRNDLVIMLSNSGETKELFNIIEYCKNSSIKIAAMTMNKNSTLAKRSDFLLIVPEYPEASVIGVPTISSLIMLSLGDALMTVIHEKRGFTKDDFKIYHPGGTIGANLTKIKNLMRSGDEIPLVYEDTSFAKTIIIMNKKRLGCTLVTDKNQNLVGIITDGDLRRHINDQIHLKTASSIMTKNPIHISSEIFAKEALNLMKAKNITNIPIVDDNIIIGIIHIHDLLRIGVS

SEQ ID NO: 45194 - protein, 265 aa, Zea mays
  misc_feature (65)..(65): Xaa can be any naturally occurring amino acid
MAPLGDGGAAAAAASNNLVVSFGEMLIDFVPDVAGLSLAESGGFVKAPGGAPANVACAIAKLGGXDLGLVRRARVFHYGSISLISEPCRSAHMAAMRAAKAAGVLCSYDPNVRLPLWPSPDAAREGILSIWKEADFIKVSDDEVAFLTRGDANDEKNVLSLWFDGLKLLVVTDGDKGCRYFTKDFKGSVSGFKVDTVDTTGAGDAFVGSLLVNVAKDDSIFHNEEKLREALKFSNACGAICTTKKGAIPALPTVATAQDLIAKAN

SEQ ID NO: 45195 - protein, 149 aa, Pseudomonas syringae pv. actinidiae
AETRDLLVALASEVGLKDAIKAQYDGELVNSSEGRPALHTALRRPVGDKLKVNGVDVIPDVHRVLNQMTELVGRIHDGLWRGYTEKPITDVVNIGIGGSFLGPELVSEALVAYAHKGVRCHYLANIDGSEFHELSMKIRAETTLFIVSS

SEQ ID NO: 45196 - protein, 149 aa, Pseudomonas syringae pv. aptata
TETRDLLVSLAGEVGLKEAIKAQYDGELVNSSEGRPALHTALRRPVGDKLKVNGVDVMPDVHRVLNQMTELVGRIHDGLWRGYTEKPITDVVNIGIGGSFLGPELVSEALVAYAHKGVRCHYLANIDGSEFHELSMKIRAETTLFIVSS

SEQ ID NO: 45197 - protein, 431 aa, marine gamma proteobacterium HTCC2207
MSNIVDIKAFEILDSRGNPTVQADVILENGVVGTANAPSGASTGSREALELRDGDSSRYLGKGVLTAVNNINTTIKTLLVGQDVADQRLLDKLMIDADGTENKATLGANAILAVSLAAAKAAAIDLGIPLYAHIANVNGTPGQYSMPVPMMNIINGGEHADNNVDIQEFMVQPVGAKSFSEALQVGTEIFHQLKKVLSNKGLNTAVGDEGGFAPDLASNAEALAVIKLATEAAGYELGKDVTLALDCAASEFYKDGHYNLSGEGVVFSSEGFSDYLAELCDVYPIISIEDGLDESDWDGWKYQTEKLGERVQLVGDDLFVTNTSILGRGIELGVANSILIKFNQIGTLSETLDAIAMAKDAGYTAVISHRSGETEDTTIADLAVATAAGQIKTGSLCRSDRVAKYNRLLRIEAELGEQAQYRGLAEFKAAQ

SEQ ID NO: 45198 - protein, 149 aa, Pseudomonas syringae pv. aptata
TETRDLLVSLAGEVGLKDAINAQYDGELVNSSEGRPALHTALRRPVGDKLKVNGVDVMPDVHRVLNQMTELVGRIHDGLWRGYTEKPITDVVNIGIGGSFLGPELVSEALVAYAHKGVRCHYLANIDGSEFHELSMKIRAETTLFIVSS

SEQ ID NO: 45199 - protein, 227 aa, Lactobacillus plantarum WCFS1
MNQDQLKQLVGQKAVEYIQDGMQVGLGTGSTVKFMVDALGERVKNEHLNIVGVSTSDRTAAQAKALGIPMKSVDEVDHLDLTIDGADEIADDFQGVKGGGAALLFEKIVAINSDKVMWIVDESKMVHQLGAFGLPVEVIPYGSQHVFEKMAARGYNPVFRKVNDELVRTDSNNIIIDLHIDPITDPHALAEDLIHMVGVVEHGLFLDMVNTVIVGHANGPEVIEARP

SEQ ID NO: 45200 - protein, 598 aa, Blastopirellula marina DSM 3645
MADFSTVSDLHKGIAVSPGVAVGTAYCILEIFVNPEKTKLEPHEITQELARYETARDQTSSDLSALQSKVESQVGKDEAAIFAAHRTILRDPAFTNKIRHWIVDERMTAQGALHRLLDEYTLLFSRMGDPYLQERLNDIRDVIIRLSAYLTDVLNDPDGGDGCLKGPLIVVADELLPSQAVALGDADVHGIVTERGSQTSHAAIIARSRGIPAVSGVPGIAARVKTGDTIVVNGREGIVVINPEAEELSAYRKLEREFFDLKDQLAANRDLPACTACGQDIELMANINNVQDAAAASAMGAGGVGLYRTEYLYLTHENVPDEAEQIGIYRQVINASPNRTVTIRTLDIGGDKTVAYLGHNHNEANPFMGWRSVRLSFEHPEFFMSQIRAILQSGVGIEGSEVRMMFPMITTVEELRKIRSFVRRAQRRLIEEKKPFADVKVGMMLEVPAAAVVIRSMLDLVDFVSIGSNDLVQYLMAADRDNPKVSNLCQPLAPAVVHTLNDVIRACNMARVPVTLCGEMAGQPRAFILLLGMGLRSFSMSPAFVPTIKQLASQITIERAESLLARALQMKTTNQVKRFLRMELEEISPDIAKLDTDG

SEQ ID NO: 45201 - protein, 560 aa, Xanthomonas campestris pv. vesicatoria str. 85-10
MNQARPWLQSYPAGVAAEIDLEQFRTVAEVFATSVKRFADRPAYHSFGKTITYREADQLVEQFAAYLLGELQLKKGDRVALMMPNCLQYPIATFGVLRAGLTVVNVNPLYTPRELKHQLIDSGASVLVVIDNFGTTVQQVIADTPVRQVITTGLGDMLGFPKAALLNFVVKYVKKLVPDYRINGAIRFREALALGRKHRVPTLQIEPDDIAFLQYTGGTTGVAKGAMLTHRNLVANMQQAHQWLAGTGKLEEGHEVVITALPLYHIFALTTNGLVFMKIGGCNHLISNPRDMPGFVKELKKTRFTAFTGVNTLFNGLLNTPGFDQVDFSSLKMTLGGGMAVQRSVAERWKKVTGLTLVEAYGLTETSPAACINPMDLKDYNGSIGLPIPSTDACIKDDAGAELPVGEIGELCIRGPQVMKGYWKKPDETAKVMDAQGWLHTGDIARMDAQGFVYIVDRKKDMILVSGFNVYPNEIEDVIAEMPGVLEVAAVGVPDDKSGEIVKAVIVKKDPALTADDVKAHCRANLTGYKQPRVIEFRKELPKTNVGKILRRELRDAPKT

SEQ ID NO: 45202 - protein, 975 aa, Oryza sativa (japonica cultivar-group)
MLQPRESDVPVLFVVFIVLPVIAYFLLGRWHDAVSKKARVSVLAQRAAEETFKVETMATPDVILPGPSLRPMPYMRSAPSARPEYHECATCHGPAKTRCSRCKSVRYCSGKCQIIHWRQGHKQTCQQWNGFGTSSSGGLPPTENTEQMPFLSNLNSPLRGSDVHLHDMDFDTMSEPSFVTTDSYNLDTSPFLSDRSNMNKPNQFLHTSENGAAIGSYEKNDYSIDGEVPSSEILSGNKGLNNSSGSGENCGNRDVIYPLNSVVHQPNNYAPEIRKRPKASITVYESDKGVYLTSDMISSGEGPYASAAESLQRSNSSGNVTGKGNMIHKKPPYPSGKVSSSQKSQEKVLTSHQYDGHEKNPHNKNEQRSTKTAVSTNSSLQGCNGISKAGASKVEALKKPSKFLKTSLVGLINDNKRSKVLFPYEDLVKFFQYEVRGISPRGLFNCGNSCYANAVLQCLMCTKPLMIYLLLRLHSKDCCSKNWCLMCELEQYASTLRESGGPVSPSRILSNLRNIGCRLGGGSQEDAHEFLRHLVMSMQGACLDGLGGEKQVEASLQETTLIQQMFGGRLKSKVKCLRCYHESERYENIMDLTLEIHGWVESLQDALTQFTAPEDLDGENMYKCGRCSAYVKARKQLSVHEVPNILTVVLKRFQTGKYGKINKCVTFPDMLDMVPFVTGAGDNPPLYFLYAVVVHVDTENASFSGHYISYVKDMQGTWLRIDDSEVQAVSLNQVMSEGAYMLFYMRSFPRPPKIYIEKGLSSVPTCSKRHSSKSSKGSKQDLNHTESLFASSDQTYGIYDFRPDNGYIQDQHAALRTRNFYHTDDAFADSISTDFSDATSSEWSLFTSSDESSFTTESTRDSFSVVDYGDNAGLDPISSIFGPYYAQDHPPGSFASCTRLSPSNPQTRYFQENTGFVSDSSMPAHLPGNVHRGRYPDRACSSSAEPPASANPRSVYGRYGLSREGFVQTSGFCQM

SEQ ID NO: 45203 - protein, 202 aa, Sinorhizobium meliloti 1021
MADVMPSRTGQVSRKTNETAISVSVNVDGTGVSKIATGVGFFDHMLDQLSRHSLIDMEIKAEGDLHVDDHHTVEDTGIAIGQALAKALGDRRGITRYASIDLAMDETMTRAAVDVSGRPFLVWNVTFTSPKIGTFDTELVREFFQALAQHAGITLHVQNIYGANNHHVAETCFKSVARVLRTATEIDPRQAGRVPSTKGTLA

SEQ ID NO: 45204 - protein, 297 aa, Ehrlichia chaffeensis str. Arkansas
MYSLMGVFTALITPFKDDFSIDENAFCHLIEEQISNNIHGLVPCGTTAECPTLSFEEYCKVIELCVKITNKRVPIIAGSSSNSTQEAIKRTLYVQSLNVDAALVVVPYYNRPSDEGIYQHFKAVHDATNLPIIAYNIPNRSAIDASDALLARILSLPRIIGLKDSTGDVSRPLNLKLLLNKEVVLFSGDDSTCLGFYAQSGSGGRTGCISVVSNVIPKIHADMHNAFLANNMKEAMNANLSVFKLAKALFCQSSPAPTKYAMSLIKNISPAVRLPLVELTQENKLKVEKTLKELKLI

SEQ ID NO: 45205 - protein, 149 aa, Pseudomonas syringae pv. broussonetiae
TETRDLLVSLAGEVNLKDAIKAQYDGELVNSSEGRPALHTALRRPVGDKLKVNGVDVMPDVHRVLNQMTELVGRIHDGLWRGYTEKPITDVVNIGIGGSFLGPELVSEALVAYAHKGVRCHYLANIDGSEFHELSMKIRAETTLFIVSS

SEQ ID NO: 45206 - protein, 553 aa, Coccidioides immitis RS
MSAFDQATSLGAWKALEEHHSSAGKDISLKEEFQKDPQRFSKFSRTFNNPADGSEILFDFSKNLITDETLKLLVNLAKEAGVEKLRDEMFNGDPINFTENRAVYHVALRNVSNGPMQVNGKSVVEEVNSVLQHMKEFSEQVRSGEWKGYTGKKIKTIINVGIGGSDLGPVMVAEALKPYADRSLTVHFVSNIDGTHIAEALKESDPETTLFLIASKTFTTAETITNAQTAKAWFLATARDEAHIARHFVALSTNEAEVTKFGIDKRNMFGFESWVGGRYSVWSAIGLSVALYIGFDNFHQFLAGAHAMDKHFRETPLEQNIPVLGGLLSVWYSDFFGAQTHLVSPFDQYLHRFPAYLQQLSMESNGKAITRSGDFVKYTTGAILFGEPATNAQHSFFQLLHQGTKLIPADFIMAAESHNPVENGKHQRMLASNFLAQAEALMVGKSPDQVRAEGAPENLVPHKTFTGNRPTTSILAQKITPAALGALIAYYEHVTFTEGAVWNINSFDQWGVELGKVLAKKIQSELETKGAGSGHDASTSGLIAAYKKKAGLL

SEQ ID NO: 45207 - protein, 148 aa, Malus x domestica
HFLELESHALHYLDSSDKIPPVYPVGPLLNLKSSDEDKVSDVLRWLDDQPPFSVVFLCFGSMGSFGEAQVKEIACALEHSGHRFLWSLRRPPPKGKRAMPSDYEDLPTILPEGFLDRTATVGKVIGWAPPPPILGHPATGGFVSHGGV

SEQ ID NO: 45208 - protein, 149 aa, Pseudomonas syringae pv. coronafaciens
TETRDLLVSLAGEVGLKDAIKAQYDGELVNSSEGRPALHTALRRPVGDKLKVNGVDVMPDVHRVLNQMTELVGRIHDGLWRGYTEKPITDVVNIGIGGSFLGPELVSEALVAYAHKGVRCHYLANIDGSEFHELSMRIRAETTLFIVSS

SEQ ID NO: 45209 - protein, 211 aa, Zea mays
MGDADAYAKRVLLTAAGDTVSRGIASTLTKHGCRLVLLGDEGALAATEEEARRCGVGGGCVELVGLDFKACGEAAADAAVDRAWRCFAGLDAFVNCYSYEGEVQDCLSISEDEYMKTIKLCAMELGKHKIRVNAACRGLHLQDKFPVSVGKEKAEKATAEVMPLRRWLDPEKDLASTVLYLVGDESRYMTGTTIFVDGAQSIVRPRLRSFM

SEQ ID NO: 45210 - protein, 227 aa, Pyrococcus furiosus
MVEVKKHKFPGVYVVIDDDGSEKIATKNLVPGQRVYGERVIKWEGEEYRIWNPHRSKLGAAIVNGLKNFPIKPGKSVLYLGIASGTTASHVSDIVGWEGKIYGIEFSPRVLRELVPIVEERRNIIPILGDATKPEEYRALVTKVDVIFEDVAQPTQAKILIDNAKAYLKRGGYGMIAVKSRSIDVTKEPEQVFKEVERLLSEYFEVIERLNLEPYEKDHALFVVRKP

SEQ ID NO: 45211 - protein, 468 aa, Glycine max
  misc_feature (61)..(61): Xaa can be any naturally occurring amino acid
CLILCIGVLLQTYPNPLQDNPAYSVVKQYFVHVDDSVPQKVVVHKDGARGVHFRRAGPRQXDEVQAAIVTCGGLCPGLNTVIRELVCGLHHMYGVKKVLGINGGYRGFYARNTITLTPKSVNDIHKRGGTVLGTSRGGHDTKKIVDSIQDRGINQVYIIGGDGTQKGASAIFEEVRKRGLKVSVVGIPKTIDNDIPVIDKSFGFDTAVEEAQRAINAAHVEAESVENGIGVVKLMGRNSGFIAMYATLASRDVDCCLIPESPFYLEGPGGLYEYIEKRLKENGHMVIVIAEGAGQELVSESVQSMSKQDASGNKLFQDVGLWISQKIRDHFAAQKTLPITLKYIDPTYMIRAIPSNASDNVYCTLLAQSAVHGAMAGYTGYTSGLVNGRQTYIPFYRITERQNHVVITDRMWARLLSSTNQPSFLDAKGDNEEKEEEEALNQLPDGHCAKDTSLASKEINSSIYPTAC

SEQ ID NO: 45212 - protein, 125 aa, Geobacter metallireducens GS-15
MIQIDFQKMGGLIPAIIQDHESGEVLMVAFMDEKTLNLTLESGKTWFFSRTRNKYWMKGEESGNTQEVIEVLTDCDADSVVIKVKQNGPAACHTGNRSCFYVRWEGGQWVEHSNPLFDPKEVYKK

SEQ ID NO: 45213 - protein, 1539 aa, Pichia pastoris
KVSILRNDSIHVGYNMSSHIVDEILTKKASSTYVLITDSNIVKMGHLQTFVDEFNRLIPSKRPGSRILTYVVPPGEANKNRATKAAIEDYLLEKGCTRDTFILAIGGGVIGDMIGYVAATFMRGVRFVQIPTSLLAMVDSSIGGKTAIDTPLGKNFIGAFWQPDYVFVDVAFLETLPEREFINGMAEVVKTAAIWNEQEFSRLETYSKRFLKVIRDRRVDDSVDLTSLKEHIIKLVLESIKVKAEVVTLDEREGGLRNLLNFGHSIGHAIEAILTPQALHGECVSIGAVLEAELSRYLGILSPVAVSRLYKCFAAYGLPVSIADKLVQKRTNGKKCPVDVLLQKMAIDKKNDGSKKKVVLLSKIGKCYEPKASYVNDEDLRFVLTDEVLVKDFNSAPSTAVVVPPGSKSISNRALILAALGKGECKIKNLLHSDDTEHMLNAVAALKGADISFDDNGETVVVTGNGGNFTATDAEIYLGNAGTASRFLTSVASIVKPDSNTTHVILTGNARMQERPIGPLVDALRTNGSDIEYLNREGSLPLKIKSGNGLKGGRIELAATISSQYVSSVLMCAPYASEPVTLSLVGGKPISLLYVDMTIAMMKSFGIEVTKSTTEPYTYHVPQGHYVNPAEYVIESDASSATYPLAFAAMNGTQVTIPNIGSSSLQGDARFAVDVLKPMGCKVEQTATSTTVQGPTKGTLKPLPLVDMEPMTDAFLTASVVAAIANDTNQSTSIVGISNQRVKECNRIEAMITQLAKFGVRAKELEDGIEVFGIDYHHLKTPSDGVYTYDDHRVAMSLSLLAGLAESPVLIQERHCTGKTWPGWWDILHTTFNVELDGHEAVVETTTAKANEDKSIIVIGMRAAGKSTLSHVIAQTLKGFKVVDLDDVFVEKYGDIREFIKENSWELFREKEAMIAKEAFKNYSKNTVISTGGGIVETEASRKLLKQQMKDGHIVLHLHRDIEETVVFLSQDKTRPAYVDEINQVWERRKNLYKECSNYFFFSPHCQTEREFFTLKKTFSKFINRITGGAVPSIPNGRSAFVCLTYEDLAPVSSKLTRVTNGCDAVELRVDLLKQHDSHFISNQIGILRNQTSVPILFTIRTKSQGGRFPDDSYEDIERLLNLAIKLGVEYVDLELSLPESLLDSVASKRQFTKIIGSHHDFSGTVKWNNVEWENKYLLALKLNVDIIKFVGTATSLNDNWELEHFRSLHTDKPFIGINMGPLGKVSRVFNTILTPVTHKDLPSSAAPGQLTLKEINEYFGQFGGSSRKKFYIVGKPISHSKSPELHKTFYDEFGLSHTFDKFETDDAAKVFNDLVKGNDELGGCAVTIPLKIDMLKYVNELTDSAKSIGALNTIIPIGDGRFIGDNTDWIGIRDSLHQAGCEIAPESSVGLVVGGGGTSRAAVYALHQMGCSKIYMLNRTPSKLSEIKNHFPSNYNIHIVDSLDAIDEDDKLDAAVSTVPGDKPLDDQLISLLKKLLEKKRGHAVLLEAAYKPRETPIMALAFSRGWKVVPGSKMLVNQGIEQFYKWTGYQFSSHIDL

SEQ ID NO: 45214 - protein, 332 aa, Ralstonia eutropha JMP134
MTIKIGINGFGRIGRMVFRAAAANFKDIEVVAINDLLEPDYLAYMLKYDSVHGRFDGEVSVDGNTLVVNGKKIRLTAVKDPAELKWGEVGADVVIESTGIFLTKEGAQKHIDAGAKKVIMSAPSKDDTPMFVYGVNHETYKGEAIISNASCTTNCLAPVAKVLNDKWGIKRGLMTTVHAATATQKTVDGPSNKDWRGGRGILENIIPSSTGAAKAVGVVIPQLNKKLTGMSFRVPTSDVSVVDLTVELEKSASYEEICAEMKAQSQGALKGVLGYTEDKVVATDFRGDARTSIFDAEAGIALDGTFIKVVSWYDNEWGYSNKCLEMARVVAK

SEQ ID NO: 45215 - protein, 524 aa, Oryza sativa (indica cultivar-group)
MREYWTSLASLMGAVAFLQGVVHAVFPAELRAAVARLLGRATRAFSPYCYFDVTETEGMGTNEIYDAVQLYLSSSAAPAAGARLTLSRPHNASSFTFGLAASDRVLDAFRGAAVTWEHVVAPRQAQGFSWRPLPEEKRRFTLRIRRGDRGVLLPAYLDHILAAAADIRRRSQDRLLYTNARGGAMDARGLPWDPVPFKHPSTFDTLAMDPERKAAIMADLRDFADGSAFYERTGRAWKRGYLLYGPPGTGKSSMIAAMANHLGYDVYDLELTEVGSNAELRKLLMKTTSKSIIVIEDIDCSVDLTNRATAAAAAQPPKPRASIDGGAIDQDAAAAPAGAAARSITLSGLLNFTDGLWSCCGSERIFVFTTNHIEKLDPALLRSGRMDMHIFMSYCTFPALKILLRNYLDDDSSASSSSAAAAATMAGLETWIDAAEITPADVSEVLIKNRRNGREQAMEQLLEVLKARAEKRPPSAAAGNATGGGDNEEEEEEEEEKRALESPKEGGGEDGQDEETEAKKQLSE

SEQ ID NO: 45216 - protein, 677 aa, Ralstonia eutropha JMP134
MSALAHPATSPFASQPAKLMADAIRVLAMDAVQQANSGHPGAPMGMADIAVALWGRHLKHNPANPHWADRDRFVLSNGHGSMLIYALLHLTGYDLPIEELKNFRQLHSKTAGHPEYGITPGVETTTGPLGQGITNAVGMALAERLLGEEFNRPGFNIVNHYTYVFLGDGCLMEGISHEACSLAGTLKLNKLIALWDDNGISIDGDVVHWFNDDTPKRFEAYGWNVIRGIDGHDVTAVDLAISQAKASDKPTLICCRTKIGKGAPNKEGGHDVHGAPLGGAEVLATREALGWAHAPFEVPADVYDAWDAKATGLALEKAWNALFEGYADRHPYEAGEFQRRMRGELPGSFDAAVDAFIAKCEEKAETIATRKASQNTIEAFGPVLPEFLGGSADLTGSNLTNWSGSQAVRVDAWGNHINYGVREFGMSAILNGITLHGGYIPYGATFLTFSDYSRNALRMAALMKIRSLFVFTHDSIGLGEDGPTHQSIEHVASLRLIPNMDVWRTADTTETAVAWAEAIRRENGPSCLIFSRQNLPFQQRDDATRANIARGGYVLRDGTNANTGRPDAVILATGSEVGLAVGAADQLAAEGVHVRVVSIPATTVFDKQDSAYKASVLPAGVPRVAVEAGVTDFWWKYQVQAVVGIDTFGQSAPAGVLFKHFGFTVENVVRTVKDTLQ

SEQ ID NO: 45217 - protein, 173 aa, Triticum aestivum
AYLGDTIEQVCTKKQAGTGPEFPGYRRPTRPAKQMAESFNMSTFANREDLLGQSKKAADDMNRVAGLDNQGIVGLQRQIMKEQDEGLEKLEQTVLSTKHIALAVNEELDLHARLIDDLDDHVDGTNSRLQRVQKRLAVLNKRAKGGCSCMSLLLSTVGIVMLVVIVWLLIKYL

SEQ ID NO: 45218 - protein, 466 aa, Sinorhizobium meliloti 1021
MDTRPEPFEPPAPVPRTGIPSRLEIIRTVLRNPLELWGEPSYTLPWIETKFINQRTLIVNDPGLIRYILVENAANYEMSNVRRLILRPILRDGLLTAEGEVWKRSRKAMAPVFTPRHAQGFAGQMLRVCEAFVDRYAGASSEPFVTNVAVDMTELTFEILAETLFSGEIAVEKQGFAANVEELLHRMGRVDPMDLLVAPSWVPRLTRIGGRKVLDRFRGVVSETMSLRRRRTTEAPGDVPNDFLTLLLQLEGPDGLSTSEIEDNILTFIGAGHETTARALAWCFYCVANTPAYRETMEQEIDSVLASGADPVDWLGRMPHVLAAFEEALRLYPPAPSINRAAIEEDAWTSPEGERVPIRKGISVLVMPWTLHRHALYWQKPRAFMPERFLPENRDKINRFQYLPFGAGPRVCIGATFALQEAVIALAVLMHRFRFDLTDETHPWPVQRLTTQPRGGLPMKVSARVK

SEQ ID NO: 45219 - protein, 479 aa, Cryptococcus neoformans var. neoformans JEC21
MPPRIAPLLSRTVRTSTRSFASTSVSMSAPVRTAAQWSDFGREHVSHGLGRVKDHVIVKGEGLNLYTADGKKLLDFTAGIGVTNLGHCHPAVSKAAAEQINNLVHLQCSIAFHQPYLELIEKLLPVMPDPSLDQFFFWNSGSEAVEAAVKLTRKATGRQNLIVFQGAYHGRTMGSGSMTRSKPIYTQNTGPLMPGVIATPYPYWHSLGASPSTSEEELVNLAKYQLDLLFRQQTSPKDVAAIFIEPVQGEGGYVPCPPAFMKHLREVCDKHGILLVVDEVQTGFFRTGKYFAVNSIPDFRPDVLVFAKGIANGFPLSGIVSTKELMSTLDVGSLGGTYAGNPVACAAGIAAQEVYASGEIEKNVAARSEQLFTALNKLASSEKTKHLIADVRGVGLMTAIEFRSASDPLTHEGLPEGTKIPKDIGKRVQAYCLEKDLMVLTTSCFDTIRFIPALVINEEEMKRAMDIFTEAVEKVALEA

SEQ ID NO: 45220 - protein, 302 aa, Zea mays
FSRHVIRSVIYGEQPRNRLDLYIPKDNSKSSPVVAFVTGGAWIIGYKAWGALLGRRLAERGIIVACIDYRNFPQGTISDMVSDASEAISFICNNVVSFGGDPNKIYLMGQSAGAHIAACALLEQAIKESKGENTYWNVAQIKAYFGLSGGYNIQNLVDHFHERGLYRSIFLSIMEGEESLPHYSPEIVAKKLSAETISLLPQIVLLHGTADYSIPSSASETFADVLKQAGGKVELQLYKGKTHTDVFLQDPLRGGRDKLVEDVLSVIHVDDASARERDASAPTPERLVYEWQIKLARQISPF

SEQ ID NO: 45221 - protein, 393 aa, Rhodococcus sp. RHA1
MQRIVIVGAGLAGLRTAEELRRAGYEGDLVLLGGEPHLPYDRPPLSKEVMRGEKSDTTLKPREFFDEKNIQLRLGVEAVAVGSGSRILRLADGTELGYDELVIATGLVPRRIPGLPDLAGVHVLRSIDESLALRADLAEGKRALIVGAGFIGCELAASMRAGGLDVVLVEPQPTPLASVLGEKIGGLVARLHTGEGVDLRAGVGLTSLVGTDRVTGAVLGDGTEVDVDVVAIGVGSVPVTAWLDGSGVELDNGVVCDGVGRTAVPHVWAVGDVAAWQLRVGGRKRVEHWSNAGEQAKILAGALTGAGDENAAAQVPYFWSDQYDIKIQALGTVAATDEVHVIKDDGRKFLAYYERDGILAGVVGGGMAGGVMKMRGKIAAGTPIGEVLEAASA

SEQ ID NO: 45222 - protein, 499 aa, Oryza sativa (indica cultivar-group)
MALLAWLVFAYKVQYQAKSALASTGTTICPSHWWDFQWVLAVSTSVDTCGLTGAQALKASKKLSHLRSPAKPDAVLAVLSGVGLSRADLAAVVAAEPQLLCARADNIARRIASLRDRVGLSDPQIGSFLLVAGGAKGIHACDVAPRLEFWIPFLGSFETLLRILKGNNVLVLSDLEKVIKPNIALLQECGLTVCDIAKMARFAPRMFTSNPKQVEGFVRRADELGVPRTSGQFKYMVGIFANISEGSATARMEYLSRSLGCSMDKLRSAVQKLPQILGLSETNLGSKIEFLVGKVRLEPEYLLKTPKLFTYSLEKRLVARHYIVQVLAAKGLKGLKKDVPFCSYVQLGESCFVKNFIDQHENVVPGLSDAYAALRAGKVPPECPYSLTADAMTCFLNHYSPVQVSLYPFCSISHLFQDHITMIMIVLMIFLEKRLVPRHYVAEALAVKGLIRKGLDFYHCVCMRDEVFVAKYIDHYEDALPGLADAYAAVRAGKLPAQV

SEQ ID NO: 45223 - protein, 276 aa, Oryza sativa (indica cultivar-group)
MSAYTVLLKTVKRSYRILTSDIEEVIKPNFAQLQECGLTVCDIVKTNPRLLSFNPERIKRYVHRADMLGVPRCSPAFRMAVCSTNEGSVTARMEFLSRTLGCSMDNILIAVGKRPTILGLSMDNLRRKIEFLVTEVGLKLECIVECLGILRYSLEKRMVPRHSVMEILRARGLMKKGASLYGLIMQGEADFVARYIDTHKDMVHGLADAYNASCFGKMPVVPDSTVKKRHGRRDISCRGFAMFEIWNLLSYMLDNYTCRSALHLADTLLEFSELQQ

SEQ ID NO: 45224 - protein, 74 aa, Zea mays
  misc_feature (26)..(26): Xaa can be any naturally occurring amino acid
FTLLEKTVALFFFHLRSKCSDAPPPXEPLFPPEVEKLKGDQFNPPEQVTLDPSEGAPPFFLGGYRVPKKQKPPF

SEQ ID NO: 45225 - protein, 754 aa, Blastopirellula marina DSM 3645
MNQHSNEKVDLDNCDREPIHIPGSIQPHGVLLAFDPQSLVLRYWSQNAAMLLGRKVTLTETPESLFGARTAAAIRQISQESPAVVVPIDGGATIGREDENIRHTAAAHLHAGMLLLEIEIAPIDKIHSRAISKLPRLLKTATHRMQACQTMEELYSAIATQIKSLSGFDRVMIYRFLEGGHGAVVGEAAESHLESFLGLHYPASDIPQQARRLYELNAVRLIADIHAPPVPIAAADSDAQQPLDLTFSYFRSVSPIHIEYLQNMGVAASMSISILQGGDLWGMIACHHYEPRNLTLEVRDACELIGVAAGVYLGSRQLALENQIYRVRRDALHQTLRTAAAGESFRAGIEAALPIMPQIVDAEEALVCLDGKILTLRNESPTIQSLIPLIPQIAAATSGPLFYTDSLRTHFPSSAPIRAEVAGVLAIRIGESPLDIMLFVRPEYAHEVSWAGKPQKEEVATAHGIRLSPRKSFETWREIVRDHSRKWSTVDRDMALELHNGLAELLGRRAIELTRINEELSRINADLDSFAFAASHDLREQLRNLHQAITMFEAKLHRPLTSEEGIRFETIQRSRSRLDELLEGLLRMSRAGRGDLVLEPIQITAVAQEAAEMIWGSVSPHEVQLTIEEMPEANADFMCVREIYCNLFSNATKYNSNLPKIVHAGTMVAGAAAPAAYRGRNVFFVRDNGIGVAPQDQERIFEIFKRLHLPHEFGGGSGAGLTIVKKVVERHGGSIWVESPANQGTIFCFTLEAI

SEQ ID NO: 45226 - protein, 111 aa, Acidobacteria bacterium Ellin345
MQIDFDKMQGLVPAIVQDAANLEVLMVGFMNREAYEKTLATGYVTFYSRTRNTLWTKGETSGNRLRVIDAATDCDRDTVLVKVAVEGDGLVCHTGTRSCFTETLAVPGASR

SEQ ID NO: 45227 - protein, 1460 aa, Oryza sativa (japonica cultivar-group)
MAFLFPSLLLPWLPWLLGSLLSVYLLDLLAHSRRRLPPGPRPLPFIGSLHLLGDQPHRSLAALAMAYGPLMSLRLGAVTTVVASSPAVAREILHRHDAAFASRSSPDSTGDHARSSVAWLPSSAPRWRALRRIMATELFAPHRLDAAAPRRLRREKVRELVAHVARLAAGEGGKPAVVDVGRVAFATSLNLLSRTIFSRDLTSLDDHGGSKGFQEAVARIMEAGGRPNVSDFFPVLAAADLQGWRRRLARLFARLHRVFDAEVDARLREHDAGEARKGDFLDVLLGIAARRDDAAELDRDTLRSLFTDLFCAGSDTSSSTVEWAMAELMQNPKSMSRVCDELSQVIGLGRNIKESEIGQLPYLQAVVKETFRLHPPAPLLLPRQAEMTMKIAGYTIPKGTRIFVNVWAMGRDKDIWPEPEKFIPERFLGSKIDFKGVHFELIPFGAGRRICPGMPLANRMAGLTGRSDRRPDSGPTNTSGWSDRAPSVGLTGASGRSDRWSTTGMTGLQRRFDRRVAKGDERASSSSNRVNRGHYLPPGTEPNPRWMPKDLMATQKRRLQRLRAQELREKKAEEQRDKRFNELRPPPVWRPKSIKKAKPIGVEEKEEQSVHKSESSPKEDMYINMFCAMDEAEVAQFSLGPKDAVFEIPDESNRHMKPLYLKGHVDGKPVSRMLVDGGAAVSLMPYSLFKKLGHEDDELKKTNMILNGFNGEPTEAKGIFLAELTVGNKTLPTAFFIVDVQEANLEWLQKRVQEYRSTKNDIGETIEDFDEVEKLGQGFTSADPLEEVDIGDGTKPVNKNMRADYKVKIIELLKEYVDCFAWEYHEMPGLSLKEEIDWLLKAGFIRPCRYAEWVSGIVPVEKKGSGKIRVCIDFRDLNKATTKDGYPMPIADMMINDASGHKVISFLDSNAGYNQIFLVEEDMYKTAFRCPGFVGLFEWVVMTFGLKNAGATYQRAMNLIFHDLLGIILEIYINDIVVKSDGMEGHIADLRLAFERMRRYGLKMNPLKCAFGVSAGKFLGFMVHERGVEIDPKKIEKIRDFKAPTCKKEVQKLLVMEMVGAKYMEAFGDSELVVQQVVGVYKCLDRSLNRHIASRDNSRVNDLAQQASGYNVKKGLFLIIEEPVLDIKSLCEIGKTGDQGWSDRHCTAGLTGDQGRSDRLHAAGLTGDPERSDRPCVAGLTGSGLDARGHVAINLEAELTVNSDICAQEAEEDWRIPLIRYLKDPTLKVDRKIRRQAFKYTLLDGNLYRRNIDGVLLKCLDEDQSKVAMGERMRGLSTVRQCSIGAHRRVEPHNQTMAVPRMGFGFHWSNLSFVIKRAYVRASCYGLLHQVGRSRAFEEYDSYGDYKTLMGDNLDEVIDKRLKALEEIEKEKKRVAKAYNKRVKAKLFQVEDLVWKTILPLGTRSKEFGKWSPSWEGPYRVCGIVRGNPYFLETLQGERFQRAINGKYLKKYFPSVWQDA

SEQ ID NO: 45228 - protein, 367 aa, Archaeoglobus fulgidus DSM 4304
MDIIEELRAYREKDIPYSRVLSSMCTVPHPVAVEAHRMFIETNLGDPGIFRGTVELEAKLMRLIGDILHCETPAGYICSGGTEANIQGIRAARNVQKKENPNIVIPKTAHFSFEKIGDILGVKIKRAGVDEEYKVDVGQVEDLMDENTVAIVGIAGTTELGQIDPIVELSKLAEERQVELHVDAAFGGLVIPFMDNPYPFDFQNRGVSSITIDPHKMGMATIPAGGIIFRNESYLRALEVETPYLTSKTQFTLTGTRPGTGVASAYAVLKSLGFEGMREVVKNCLKNTRILVEEMRDLGFEPVIEPVMNVVSFRTDEAERIKEELYRMRWVISTIREPKAIRFVVMPHVTEEVIKNFISDFRKVLRR

SEQ ID NO: 45229 - protein, 774 aa, Ralstonia eutropha JMP134
MTSPQQSPSQDDLKQQQREALRKAALEYHEFPTPGKISVTPTKPLSNQRDLALAYSPGVAAACEEIVADPANSFRYTARGNLVAVITNGTAVLGLGDIGAAASKPVMEGKAGLFKKFAGIDVFDIEIDEKDPEKLVQVIAALEPTFGGINLEDIKAPECFYVERKLREKMKIPVFHDDQHGTAIVVAAAVINGLKVVGKDIKSVKLVASGAGAAALACLDLLVDLGLPIENIWVTDLAGVVYEGRTELMDPEKARFCQKTDKRKLGEVIDGADIFLGLSAAGVLKQDMVQRMGEKPLVLALANPNPEIAPELVKEVRPDAIMATGRTDYPNQVNNVLCFPFIFRGALDCGATTITREMEIAAANAIAELARQEQSDIVATAYGIQDLAFGPEYLIPKPFDPRLIVWVAPAVAEAAMKSGVASRPIEDMDAYRLQLQQFVYHSGTLMKPIYAAARKVEMAKKRIVFAEGEEERVLRAVQVVVDEKLANPILIGRPAVLQHRIERFGLRLRPGVDFAVVNPEHDERFRDYSDAYYRMMAREGVTPQYAKLELRRRTTLIGAMLVKRGEADGMICGTVSNTAAHLRYIDQVLGGTSKVYAAMNGLVLPGRQIFLVDTHVNVDPTADELAEITLMAAEELKRFGIEPKVGLLSHSNFGSSEAPSARKMRDTLAILRERAPELEVDGEMHGDSALDEKLRNTLVPDGTLKGEANLLVCPNIDAANISYNLLKVAAGNNVAIGPILLGVKAPVHILTPSATVRRIVNMTSLVVVDAAAKR

SEQ ID NO: 45230 - protein, 426 aa, Helicobacter pylori J99 [sequence omitted]

SEQ ID NO: 45231 - protein, 1432 aa, Saccharophagus degradans 2-40
MNAIRNMLKVSTLILLAVGLYACGGGSTVESGKELLTCSVPQVPNSAGTECVDPEPIQCAIPTVPDEKNETCIVGANPDAPDPIVFPGPNQAILFFNKADGDYEGYRLHNWNSETCNAYAEGSLAASWSNGLVHSGVDPVYGAYWLLDLVEGHDDCGHFIIHVGTDDAGKEMGGGDWIMPLAQDDPKFTRMNFTFSGVGSVFEFPVPSLGPQKVAIAGAAAHWLDIDTLVWNLDTTDVADVKLHYSATAGITVDDDSNVSGSTADLTFATLSEELQQLVPHMASWPAFGNMLTASDVKPIVKGQLIAVAYNADGKAIAATKVQRARVLDALYTAGENDADEATLGVVYDGANINVSVWAPTATSVTLRVFDAAKTEVSSHTMNEDTSTGIWSFAGDSNLDRVFYQFELSVFHPLTQAIETVTTSDPYSVSLSTNGEYSQFVNLADDDLLPENWNGHTVPTIANFEDAVILEAHIRDFSIRDETVSEANRGKYLAFTETESNAVKYLQRMAESGVTHFHMLPANDIATVNEDESEQINLTSTVAELCAVKADAPVCGEESDSATLISVLESYQYEPLAAQALVESMRSLDGFNWGYDPHHFNAPEGSYASDPDGVARIKEMREMNKALHDLGLRVVLDVVYNHTSASGLWDNSVFDKVVPGYYHRYDENSGGIITSTCCDNTAPENRMMHKFVVDSLVLWAEAYKFDGFRFDIMGHIPKSTILEAREAVLAVDPNTYFYGEGWNWGEVENNRLFVQATQANMAGTEVGTFNDRPRDDIRSAALFNEDGSLDAQDHIRLGLAGTQADFILESNRGNMGTGSTYARASYGLDPADIINYVSKHDNETLWDQLQYGLPESMSLEDRVRAHNIAATIPVMSQGIPFFQLGVDMLRSKSMDRNGYDAGDWFNFVDYTMASNNWDVGLPLAQDNEVRWEEIDAISGRISAPGMFELDYSSQVFSEFLQIRKSSPLFRLTTSADIIDRVGFHNIGNRQQQGLIVMSIDDGTGLADLDPANDAIVVVINGTNESQSHTVATAAGFQLHSIQQSSVDSVVAGSTFTAGEGEGTFTVPALTTAVFVKPQGEAQGAGLSADVTQGAPDVVPFGDTVVYIRGDMNTWSTDNPLTYAGNGVYSTTIALTGGTTYGFKFADAEWGALGVNFGGAEGGDGVVTEGVDKNLFATNTNLSFTPAVDATYVITFDASDSAAPVANIVNEEPYPGSTILLRGDMNSWGETDAFTYEGGRIYTFETTLDAGTYGFKVATGDWNTVNFGAAAEDENVVSLGENVYLGSTNFNLSLTLAESTELVFIFDMTNLDEPKLRVMNKAFFGDTAVYIRGDMNSWGATDEVAYVGDGAYATTLTLAVGSYSFKVADADWADVNFGPTSAEAAPIVLGATNATLFNSPNNFSLTVETAGDFTFTVTGPDATNPSLTVTAAN

SEQ ID NO: 45232 - protein, 174 aa, Oryza sativa (indica cultivar-group)
MLPSRQRSIFHLGEEGGGAADAEHLGADHGDGHGDHGIISIHQQRLRVVGLQIVLAQTRHHHRQQHGHVVLKQMQMVSPPPAARHRRRRRPCGDFLSACSLCRRELGPDKDVYMYRGDQGFCSEECRWQQIMTDEARERDAMAKKERLGLHHRTPRPPPAAMRGGSPRRLLAVA

SEQ ID NO: 45233 - protein, 683 aa, Oryza sativa (japonica cultivar-group)
MGARWGPRRATVGPHLRDALRHLLFVFLVLLQAQAGRGGATLNGEGMALLELRERVEADPHGALRDWDPADATPCRWSGVHCFDGKVEILNLTGRELVGTLAPEIGRLQLLKSLILRNNNFRGKIPKEFGGLTALEVLDLSSNNLDGTIPEELMAMPLLKQLSLHDNQFQDDISSLHIQDISDEQAGCLSRKLGCWAGFKDWTSFSDLREKYSTNLASNRTFKSLGEPHIMQNLQSFASAVGRRLLGEVGNLPALSGNYAKSSGPVNSEEIQRAIDVLSLGSGSFSAFPNSEAEVLESAVNTDAAAMQSGAANQSTDEVSGSKHSKWAYFMIIPAAILLISLIVAPILVWRKRGRAAIGPWKTGLSGPLQKAFVTGVPKLNRPELEAACEDFSNIINTFPSCTVFKGTLSSGVEISVVSTAILSLKEWPKSSETCFRKQIDTLSRVNHKNFINLLGYCLENQPFMRMMVFEYAPNGTLSEHLHLKEFEHLDWAARMRIIMGVAYCLQYMHHDLNPPVAITDMRSDTIFMTDDYAAKIADVGIWKEVAIKAKTAKEDSSSRSECPPDIASNVYCFGTLLIEIISGKLPEADDQKSMCNWAAEYLKGKSYSKLVDASLKEHNANELEAVCEVIQECIDPDSDQRPTMRDATRKLRQALNISPEAATPRLSPLWWAELEILSAEAT

SEQ ID NO: 45234 - protein, 249 aa, Alteromonadales bacterium TW-7
MEIRKAMVAGNWKMNGSIELVKNMSDAINSIKSPEIDVILFPPFPLVSAMIASGVITGAQTVSENTPGAFTGEVDAQLLKDLGVNYALVGHSERRSIYNESSDVIADKFARAQSAGLIPVLCVGESEAEQESGQTEHVVAAQIDAVIKKLGVAALKDSVIAYEPVWAIGTGKTASPEQAQAVHKFIRDKIASLDSDLAQGLTILYGGSVNEKNSELLFAQPDIDGGLIGGASLKAASFVAICNSAKGTV

SEQ ID NO: 45235 - protein, 707 aa, Aspergillus oryzae
MLQDMGAIREDGSDKFFGMENVSLAVSTVIPVIAVVNYPTRTPIESLEAALANTLRYQNFAANLEAEALAEKQKAANAQRPGAPPNQPQKPEDKDSPEYKKKMALQTLPLLETKNNATSYGMSESLFTSLKDLFESVVASQSRIGIIRPQHFLDVLRREHEMFRTAMHQDAHEFLNLLLNEVVANVEAEASKQPEPERSLPPAESADSTELSGSSGSKTPNTTRWVHELFEGTLTSETQCLTCEKVSQRDEVFLDLSVDLEQHSSVTSCLRKFSAEEMLCERNKFHCDNCGGLQEAEKRMKIKRLPRILALHLKRFKYTEDLQRLQKLFHRVVYPYHLRLFNTTDDAEDPDRLYELYAVVVHIGGGPYHGHYVAIIKTQDRGWLLFDDEMVEPVDKNYVRNFFGDRPGLACAYVLFYQETTLEAVMKEQEQENMDLNTSVADINDSTLKQNGYPLSPGLAHVHSASQIPSPSEPARFSNLQRAPTAPPLFPHPEHADSESSPADPSTTASATPPVPPIPDIHSLPLSPKKSDSHFKKERAKEEKERKANEKEKEKQRRRDQEARIREQRREDAEIRAALEASKASKAEEDRRHSPDDTKKSSHGLSRLKRGSKSFSHRLGKDKENRVSSSSHSATPIAEHPPSRNGASESQQQLPNGQSPGSHGLHTRHTGLDEERDTLKDPKHDRSGHHGKWRSFSLKKKSFSILS

SEQ ID NO: 45236 - protein, 230 aa, Emericella nidulans
MSSGRVSEATNITQPPAYSKKFVVVGDGGCGKTCLLISYSQGYFPEKYVPTVFENYITQTLHRRSGKTVELALWDTAGQEEYDRLRPLSYPETDLLFVCFAIDCPASLENVMDKWYPEVLHFCPTTPIILVGLKSDLRNKRTCIELLKTQGLTPVTPEQGQAVAGRMNASYVECSSKEMRGVDSVFQLAVDTVVSLEEQNWDTRLPSSSGKPGGKPIGGKKIKKRSCKIL

SEQ ID NO: 45237 - protein, 633 aa, Oryza sativa
MAVAVPDHTFNNGYSSKNQIEGRSLSWKRVFVQTDKGSVLGIELERGENAHTVKKKLQLALNIPTEESSLTCGDQLLNNDLSYICNDSPLLLTRNHMHRSCSTPCLSPNGKDVQHCDDSRVIEIVGCTSPSARMKQLVDDIVRGIEKGIEPVAISSGMGGAYYFRDMWGEHAAIVKPTDEEPFGPNNPKGFVGKSLGLPGLKKSVRVGETGSREVAAYLLDHKNFANVPPTMLVKITHSVFHMNEGVDYKTKSSDNKTQAFSKLASLQEFIPHDYDASDHGTSSFPVSAVHRIGILDIRIFNTDRHAGNILVRKLYNDASRFETQTELIPIDHGLCLPESLEDPYFEWIHWPQASIPFSEEDLEYITNLDPIKDAEMLRMELHTIHEASLRVLVLSTTFLKEAAACGFCLSEIGEMMSRQFTRKEEEPSDLEVLCMEARNWVEEREWLLPQADFEGEDDNESTQFDLDSEDDSTTFEASFSNNIRPIKGNSRDPPSKLAEVNEYVDEDDNNEFNKDDVGTCTSPITTWTPSTSNLSISSNELSFSGRRKSHSGVAKNKVTSKINSNSYSGNHSAKEKLPHNSSFAKLSDLSANKWSPFLEKFQDLLQSMFQDRKQTAGRNPWLSQRLGTSCQF

SEQ ID NO: 45238 - protein, 376 aa, Listeria monocytogenes str. 4b F2365
MAKRDYYEVLGVSKSASADEIKKAYRKLSKQYHPDINKEAGADEKFKEISEAYEALSDPQKRAQYDQYGHVDPNQGFGGGAGGGFSGGGFSGFEDIFDTFFGGGGRQQDPNAPRQGSDLQYTMRLKFKEAIFGKDAEIEIPREENCDTCHGSGAKPGTTPEKCSHCGGKGSINVEQNTPFGRVVNKRTCQYCNGTGKEIKEKCPTCHGKGRVTKTKKIKVKVPAGVNDGQQMRVSGEGEAGINGGPNGDLYVVFVVIPDEFFEREADDIYVEVPITFVQATLGDEIDVPTVHGKVRLKIPSGTQTGTTFRLRGKGVPHLRGNGTGDQHVIVKVIVPKKLDDKQKEILREFASTTGDKVDEQTSGFFDKMKRAFKGD

SEQ ID NO: 45239 - protein, 149 aa, Pseudomonas syringae pv. japonica
TETRDLLVSLAGEVGLKDAIKAQYDGELVNSSEGRPALHTALRRPVGDKLKVNGVDVMPDVHRVLNQMTELVGRIHDGLWRGYTEKPITDVVNIGIGGSFLGPELVSEALVAYAHKGVRCHYLANIDGSEFHELSMKIRAETTLFIVSS

SEQ ID NO: 45240 - protein, 135 aa, Malus x domestica
MARTKQTARKSTGGKAPRKQLATKAARKSAPTTGGVKKPHRYRPGTVALREIRKYQKSTELLIRKLPFQRLVREIAQDFKIDLRFQSHAVLALQEAAEAYLVGLFEDTNLCATHAKRVTIMPKDIQLARRIRCER

SEQ ID NO: 45241 - protein, 195 aa, Acidobacteria bacterium Ellin345
MRKATLDRNTAETKIHLELHVDGKGKYEISTGIRFFDHMLELFTRHGAFDVTLRCEGDLDVDQHHTVEDVGIALGQAFTQALGSKMGILRAGYFVMPMDETLAVAAVDLSGRSAYAVDTKVKVRIVGDLQTELVDDFFEGFSRGALANVHIKVMYGRSNHHKIEASFKAFARALRFACAKDKRLAKVLPSTKGLL

SEQ ID NO: 45242 - protein, 272 aa, Gibberella zeae PH-1
MSHSHDGQSHSHDGFNAQEHGHSHEILDGPGSFLGREMPIVEGREWSERAFTIGIGGQDQSLSQLLTTALMLALSLALRKEYSLAAVTNDIFTREDAEFLTRNKALPPSRIRAIETGGCPHAAVREDISQNLAALEDLHREFDTDILLIESGGDNLAANYSRELADFIIYVIDVSGGDKIPRKGGPGITQSDLLIVNKTDLAELIGADLGVMERDARKIREGGPTIFAQVKKDVGVDHIISLIKSAWKASGAEDERRSKGGPRPTEGLEQLE

SEQ ID NO: 45243 - protein, 241 aa, Oryza sativa
MRGEEEPAVAAAAYTTASKAGFLFFSAALTRLPTREEEISRRLLMELSPPNHESSPPTAGGGGGGGGDGAGGSSSAGASSSAGGGASTPQTPSRYEAQKRRDWNTFGQYLRNHRPPLGLAQCSGAHVLEFLRYLDQFGKTKVHTAACPFFGHPNPPAPCPCPLRQAWGSLDALVGRLRAAFEENGGRPESNPFAVRAVRLYLREVREHQARARGVSYEKKKRKKPQPAAAVRRRGLLMASN

SEQ ID NO: 45244 - protein, 308 aa, Coccidioides immitis RS
MFGIIADLLSSVLTVLFPIFASYKALRTSDVSQIAPWLMYWVVLSIVLLVESWTFFIVGWFPFYSWIRLFALSYLVLPQTQGAKKLYLERVDPFLHQYERQIEEFIGETHERAKEAGLNYLYQAIDLIREKVLGLPPVLAAEAAPPPPASGPASYAQTLFSRFNLPAGTGTNLAGPASDLFSMLGSAVTAVTSTGKNRDTQAEELSATGLLPHNLASASKNEQASYIASQKEKLRILLSALDREHRNLGLEGREEDDLAYGTSYDSDSRGLKKNQSENSFENIDHEELGASSAFYKDGSGRRRPGRHD

SEQ ID NO: 45245 - protein, 294 aa, Ralstonia eutropha JMP134
MTSTESSQPADRYVVVGNPVAHSRSPFIHAAFARQTGEAVEYGRLEAPLDAFADTMRAFLAEGGYGFNVTVPFKLQAYDLADRLTPRAEAAGAVNTMWIEDGLIHGDNTDGIGLVRDIQDNLDTLLEDKRVLLLGAGGAAMGAMLPLIECRPSRIVVANRTASRASDMLEEFVEAADSFGVELWGGGLDALEQLSEDDVCDVVINASSSSLHGEVPPVPAFLLGDGVLAYDMMYGAEPTVFLQHAAQCGARTADGLGMLVEQAAEAFYIWRGVRPRTAPVLADLRAALQAERKG

SEQ ID NO: 45246 - protein, 314 aa, Geobacter metallireducens GS-15
MPFSEPGKTKFQVDLRRHLRNQGICDNLVHLICEIAEASKYVINAVRTGDLGVAGTSNLYGEEQLALDVLSDRIIKKRLIHSGVVCNIASEEMDEIFQAQADADGLYSVAYDPLDGSSLVDVNLAVGTIVSIYEGCNLLQKGRNQVAALYILYGPRVSMVYSVGRGVHEFTMNHLMEFTLSRENIVMQEEGNIYAPGGLRNKYQEGTEQFVRYLEEKGAKLRYSGGFVPDINQVIMKGKGIFMYPALNGSPNGKLRLLFELNAMAYLVENAGGAATDGKQPILDLEPHSLDQRAPVYIGCKADVVKAMEFVSRN

SEQ ID NO: 45247 - protein, 407 aa, Brassica oleracea var. botrytis
MESRVLLRATETVTGVPQLRRPIRAINRQFSTASSSFTAFAKPIGSIGEGGNLISGRQLRPLLLLDSLPEKREILKPVRAASAEGGDSAGETKVGFLGKYPWLVTGILLLMWYFLNVIFNILNKKIYNYFPYPYFVSVIHLFVGVVYCLVSWSVGLPKRAPVNSDILKVLIPVAVCHAIGHVTSNVSFAAVAVSFTHTIKALEPFFNASASQFLLGQPIPITLWLSLAPVVLGVAMASLTELSFNWLGFISAMISNISFTYRSIFSKKAMTDMDSTNVYAYISIIALFVCLPPAIIVEGPQLLKHGFNDAIAKVGMTKFISDLFWVGMFYHLYNQLATNTLERVAPLTHAVGNVLKRVFVIGFSIVIFGNKISTQTGIGTGIAIAGVALYSVIKAKIEEEKRQGKTA

SEQ ID NO: 45248 - protein, 183 aa, Shigella flexneri 2a str. 2457T
MTATAQQLEYLKNSIKSIQDYPKPGILFRDVTSLLEDPKAYALSIDLLVERYKNAGITKVVGTEARGFLFGAPVALGLGVGFVPVRKPGKLPRETISENYDLEYGTDQLEIHVDAIKPGDKVLVVDDLLATGGTIEATVKLIRRLGGEVADAAFIINLFDLGGEQRLEKQGITSYSLVPFPGH

SEQ ID NO: 45249 - protein, 488 aa, Oryza sativa (indica cultivar-group)
MAAAAATAAAHLLSTPPSASPVHPPPHARILCAHRTKGVATLSCRASLGPDGSLAGLAAAAAAAPRVEPRGRPYLREHSCLIFPPSPRGRRPLAVVKFLGGAFIGAVPEVTYSHFLKLLAQEGFLVVSVPYNVTFDHEAAAREVYERFHGCYGALLSSGLPAAGLSAMDIAELPLYSVGHSNGALLQLLVGSYFSEKIPKANAIVSFNNRPASEAVPYFEQLQGYNFENGEENKPFLVYASAFRSPKGDAWKALFDLAGGLIQVYDQEAMLSLSKFVDQLPSVMNQVTEGVSEFKPTPPENREFCKNSYNVPNTLLVKFSIDAIDDTEIVEDVLKPRVESICGQIKKVILSGTHLTPCIQALTKTILQDVKWQVGSEYTPADALAQGLKSLALNETRAVPKISDQDWGAWARVFPLGLLSQHLLYNAFNPWSKETYPVSAPSSIKVSVRYQLSSPKPTKPQRTGQAQDLLRLAPVKSDILGTNQDANQ

SEQ ID NO: 45250 - protein, 540 aa, Arabidopsis thaliana
MKSRKKVVVGVSGDRISGLPDALICHILSFLPTKEAASTTVLAKRWKPLLAFVPNLNFDDSIYFHPRARRNKYSKSYESFMSFVDSVLALQAKTKTPLKRFHVKCEDVVDQSWVLEWIPKVLKRGVLDIDLHITSSRNYCENSSFYSLPSKIFVSKTLVRLKIQFQDGVHIDVEGGVSLPKLKTLHLDYFKIETSMLNKLLSGCHALEELVLANLMWADSSEDEACHVSVSIPTLKRLNFCRSEDFYEGEFHFYEDYDEENINEGVSLSFDNPNLVYLEYSDVIVDKYKQVSFDSLVEANLRLRKTPDQDETDKVNVTKLLMGIHNVKILYLSDDTLEVLSCCRERIPVFDNLLELTIKTTPYVGWKSLPPLLKSCPSLETLVFEGLHHKYTKRCGDKDGCLCKYENHWGTKKKKNVRTCLSSSLVKVLKILKFGETFEDENEDGLDVDHDDYDDEDAVSCDEVGGVVEEQIEHVKHFLETMPVLKQVILYYNTPKDEDVMKVFKKLEKLPRVASANCNVQISSKNLSLSSTSTKRGTLL

SEQ ID NO: 45251 - protein, 149 aa, Pseudomonas syringae pv. maculicola
AETRDLLVALAGEVGLKDAIKAQYDGELVNSSEGRPALHTALRRPVGDKLKVNGVDVIPDVHRVLNQMTELVGRIHDGLWRGYTEKPITDVVNIGIGGSFLGPELVSEALVAYAHKGVRCHYLANIDGSEFHELSMKIRAETTLFIVSS

SEQ ID NO: 45252 - protein, 258 aa, Brassica napus
MSSQSCHGNESNSVNKEGNVDPSSVSENQLVLYDPKGNETEEEGAEPNQSQTSSHKTQCPSIGAFTVQCATCLKWRLMPSMEKYEEIREQILEKPFYCETACEWKANVTCDVAEDISQDGTRVWAIDRPSISRPPAGWQRQLRIRGEGGTKFADVYYVTPSGKKLRSNVEVQKYLNENPEYITQGVKLSQFSFQIPKPLRENYVRKRPARPMEPSDAPVAIEANPLALVSPDAQTPLQPTEPGLCTHLKKARRSEPSS

SEQ ID NO: 45253 - protein, 439 aa, Oryza sativa (indica cultivar-group)
MSPKQKSLRSKRMAEASEEDGIDVLPDALLQHILSFLPAEDAVKTCVLSRRWRHLWKLTPILCITNTERWRSPKDFIKLVNHLVLFRGSSPLHKFEIKINSCAHWMIMSGDSNPFHCAIMWVMYALMCQVQVLTIKNMHAYIEMDDGFSLFSRHLTELNLSGLDFRKFVLNFSSCPALEYIYFSASCCFNSVEKILSQSVKYLTFDFPEFSEHHRTHIYAPNLITLRLDDCWGRVPFLESMPSLIAAFVRPHRDSDDLCSNTYSGNCEDEYCHGCYGMVDNAGNDSAKCVLLGGLSEAKKLELIAGPEMRIFRSDLRWCPLFSKLKSLLLNEWCVANNFWALACILEHSPVLLKLTLQISKETKPMIGAVENYSALVKPAAISKHLKVVKVHCKEVDEGVCETVKFLSTLDVVVLIRRMDRSTNRLLENLRFSEGNLKA

SEQ ID NO: 45254 - protein, 874 aa, Mycobacterium avium subsp. paratuberculosis K-10
MAECHPVGFQWVEEARARGARVIHVDPRFTRTSAVSDRHIPIRAGSDVVLLGALINHVLTNDLWFSEYVVAYTNAATIINENFRDTEDLGGLFSGFDPETGQYDTSSWAYEEEDDGRSGGEIESPGGGHTHGATATHSAAGDEHGSGGPPLAHARVRRDETLQHPRTVFQILKRHYARYTPEMVKDVCGISREDFDYLARSIVENSGRERTTCFAYAVGWTQHTLGAQFIRTATILQLLMGNVGRPGSGIMALRGHATIQGSTDIPTLFNLLPGYLPMPKAGVHDTLADYLAAVGSKKQKGFWANADAYTVSLLKAWWGEAATADNDWAYDYLPRLTGPHGTYQTVMGMLADEVEGYFLLGQNPAVGSAHGRMQRLGMSHLKWLVVRDFNLIESATWWKDGPEIASGELKTEEIETEVFFLPAATHVEKAGSFTQTQRLVQWRHQAVEPPGQCQSELQFFYELGKRIRQRLAGSTDERDRPLLDLTWDYPTDEHGDPDGEAVLAEINGYRVGEPADPLASYTELRADGSTAAGCWIYTGVYANAVNQAARRVPNGGASPSQSEWGWAWPADRRVLYNRASADPDGKPWSERKRYIWWDPDQRRWVGYDVPDFVVDRAPGARPDPELGGPDALAGDDPFIMQADGKGWLFAPKGVVDGPLPTHYEPQESPVANALYPQQRNPARITFARKDNLSAPSAGEPGSDVYPYVFTTYRLTEHHTAGGMSRWLPYLSELQPEMFCEVSPELAAERGLQPYGWATIISPRAAIEARVLVTKRVAPLVINGHTVHQIGLPYHWGVGGDAVVSGDAANDLLGVTLDPNVQIQESKAGSCDIRPGRRPRGEELLRLIADYQSRSGVTAETGNVRVDDAVWERGS

SEQ ID NO: 45255 - protein, 486 aa, Ostreococcus tauri
MRIVIPACGKGERFRAAGYDTIKPLIKVHGEPMIDCVMRALNVHDTLDEHVVIVNFDAKDINHAVVELDRETLGAAETVLLALQAREGEDVPMLLVDCDAIYHSDILGRFRALEAHTDVRAAVLSFHEDASALRSKPKYSYVAVDEKSDVMKIAEKVRVGPLANTGAYWFASSTEFVKLTQIVIEGRQFQHGEAYVSCVIDEYLRQNKTVRAVIINEDEYSNIGTPDCLEHYLSTQGRAFLFDLDGTLVDTTAAYVRAWHSLLAPKGALVDADFFNTHISGLADEQVREKFKIAISSEEKDEEFLKHLTCVEAIPGAVDFVRKCQEIGPVYVVTNSNKRAADALLDCIGLGDVPLLTASDVKHGKPNPEPYAKAMLTLGVSPRNCVVFEDSKSGTTSARAAGVGFVIAISNNVSGCDAFYENYADIEPNEIIQHLESVAQLSDELTEMFGQRSIVHPVRASGGYISEVLSASCGCQRAVGVAYDRV

SEQ ID NO: 45256 - protein, 149 aa, Pseudomonas syringae pv. maculicola
AETRDLLVSLAGEVGLKEAIKAQYDGELVNSSEGRPALHTALRRPVGDKLKVNGVDVMPDVHRVLNQMTELVGRIHDGLWRGYTEKPITDVVNIGIGGSFLGPELVSEALVAYAHKGVRCHYLANIDGSEFHELSMKIRAETTLFIVSS

SEQ ID NO: 45257 - protein, 1211 aa, Arabidopsis thaliana
MADGEDIQPLVCDNGTGMVKAGFAGDDAPRAVFPSIVGRPRHTGVMVGMGQKDAYVGDEAQSKRGILTLKYPIEHGIVNNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDHLMKILTERGYSFTTTAEREIVRDMKEKLSYIALDFEQELETSKTSSSVEKSFELPDGQVITIGAERFRCPEVLFQPSMIGMENPGIHETTYNSIMKCDVDIRKDLYGNIVLSGGTTMFGGIGDRMSKEITALAPSSMKIKVVAPPERKYSVWIGGSILASLSTFQQMWIAKAEYDESGPSIKQKLRRRIHFSRSSPLKSAISLLIGEDKSLIRMSDSVAGDFPPDPLLASGAFISSAGDGTLDSSAKRRPIQGGIGISGSGESVRIGMANGTDQVNHQTESKSRKRAAPGDNWLPPGWRVEDKIRTSGATAGSVDKYYYEPNTGRKFRSRTEVLYYLEHGTSKRGTKKAENTYFNPDHFEGQGSNRVTRTATVPPPPPPPLDFDFKNPPDKVSWSMANAGEEGWIPNIGDVKVQDSVRRDWSTAFTFITSRNPRKDLVLCETSVVIQELMLDMSHLLSFKMEKNQQKQEFLAETSEMKNTKNNDDCSVQQQQRFVWPWVGLVANIPTEVEPSGRRVGKSGSTLRDEFTMKGFNPTRVQPIWDFKGHSGFALVEFAKDFEGFESAMNFERSFNLDRHGKRDWEKGHRLRDNKLYGWVAREDDYNRSDTVGKNVKKKRDLKSISQIVEEDERKMVHLVENMSQTIEKKKQSKQELEQKVDETSRFLESLELHNVLLNKNYQEGFQKMQMKMEELYQQVLDGHEKSLAELEAKREKLDERARLIEQRAIINEEEMEKSRLEREMNQKAMCEQNEANEEAMKLAEKHQASSSLKEKEKLHKRIMEMEAKLNETQELELEIEKLKGTTNVMKHMVGSDGDKDIVEKIAKTQIQLDAQETALHEKMMTLARKERATNDEYQDVLKEMIQVWNANEELMKQEKIRVKRMGQLNPAPFLPAVMKKHKVTQSKAENKAMKLCSVWEANIGDVQWTPFRVDESDGTPKRVVDENDEKLRTLKNQYGEEVYNEVVRTKLEIEEHNASGSYVILELWNYEENRKATMEEATDVMLKIRSKLAAMKNKRKRLEV

SEQ ID NO: 45258 - protein, 273 aa, Listeria monocytogenes str. 4b F2365
MEKYVVIGNPIRHSLSPAMQNRIFQELGMNAEYNSVLIEEDAFETEIKKLMDSGVRGFNITTPFKERILPFLDELEDLAAASGAVNTVLKKEDKWYGFNTDGKGYLEGLEEIRSITEDDSILITGAGGASKAIYLALSTHTDAKITVTNRTTEKAIEMTKDNENHHAVTLEEAEKQLADFTVIIQTTSIGLEASKNKSPISLANVKKGTICSDIIYNPAETAFLKEAKKNGAITQNGLPMFVNQGALAFEIWTGIKPERSLMKEAVLEQLGGN

SEQ ID NO: 45259 - protein, 402 aa, Brassica oleracea var. botrytis
MQSSAVFSASPSLPLLKPGRLSLRHPVTASSNLSVSPPNVVSVPPLPRRSWRLASSDSPLRAWSGLPSVSSPSLDTNRFKTAATAVPEEGEGSGKMTKVLELGLLFAMWYLFNIYFNIYNKQVLKALHAPMTVTLVQFAVGSVLITFMWALNLYKRPKISAAQLAAILPLAVVHTLGNLFTNMSLGKVSVSFTHTIKAMEPFFSVVLSAMFLGEVPTPWVIGSIIPIVGGVALASVTEVSFNWAGFLSAMASNLTNQSRNVLSKKVMVKKDDSLDNITLFSIITLMSLFLMAPVTFFSEGIKFTPSYIQSAGVNVQQIYTKSLIAALCFHAYQQVSYMILARVSPVTHSVGNCVKRVVVIVSSVIFFKTPVSPVNAFGTGIALAGVFLYSRVKRIKPKPKTA

SEQ ID NO: 45260 - protein, 182 aa, Triticum aestivum
FIPASPCPTSAPSVLAAIQDSERNDTLLGNGVIGILAETVNMWERRAPLTPSHCARLVLGGGKRESGVNRIIVQPSTKRIHHDAQYEDAGCEISEDLSECGLIVGIKQPKLEMILPDRAYAFFSHTHKAQKENMPLLDKIMEERVSLFDYELIVDDDGKRMLAFGKFAGRAGLIDFLHGLGQ

SEQ ID NO: 45261 - protein, 435 aa, Sinorhizobium meliloti 1021
MTLDLSTFAREKGVKYFMISYTDLFGGQRAKLVPAEAIADMQKGGAGFAGFATWFDLTPAHPDLFALPDASAVIQLPWKKDVAWVAADCIMDDAPVEQAPRVVLKKLVAEAAQEGLRVKTGVEPEFFLISPDGSKISDTFDTAEKPCYDQQAIMRRYDVIAEICDYMLELGWKPYQNDHEDANGQFEMNWEYDDALRTADKHSFFKFMVKSIAEKHGLRATFMPKPFKGLTGNGCHCHISVWDLAGEVNAFADNKAEFGLSAEGRHFLGGIMKHASALAAVTNPTVNSYKRINAPRTISGATWAPNSVTWTGNNRTHMVRVPGPGRFELRLPDGAVNPYLLQAIIIAAGLSGVRSKADPGRHYDIDMYKDGHKVTDAPKLPLNLLDALREYNRDEELQEALGREFSAAYLKLKQGEWNTYCSQFTEWEHQTTLDV

SEQ ID NO: 45262 - protein, 303 aa, Actinobacillus pleuropneumoniae serovar 1 str. 4074
MKKLCVLGSVNADHVIRVPYFPKAGETLKGGHYHIAYGGKGANQAVAAARVRNTSLVEVDFIACIGADDIGRAMKQAFVQDGINPEHIVEVADQMTGIAMIQVADSGENSIVISAGANANLDESVVAQHQATIERADCLLVQLETPLQAVEKALKIAKANHTQVILNPAPAQPLSDEILANIDMITPNETETALLTGIQVVDEQTAQQAANVFHQKGIQTVLITLGAKGAFLSENGNGEIIAGFKVTPVDTTAAGDTFNGALAIALLEGKSMRDAVMFAHKASSISVTRMGAQSSIPTRAELV

SEQ ID NO: 45263 - protein, 259 aa, Vigna angularis
MAAAPTPREENVYMAKLAEQAERYEEMVEFMEKVSAAADNEELNVEERNLLSVAYKNVIGARRASWRIISSIEQKEESRGNEDHVTVIRDYRSKIESELSNICDGILKLLDSRLIPSASSGDSKVFYLKMKGDYHRYLAEFKTGAERKEAAESTLAAYKSAQDIANAELPPTHPIRLGLALNFSVFYYEILNSPDRACNLAKQAFDEAIAELDTLGEESYKDSTLIMQLLRDNLTLWTSDMQDDGADEIKEAAPKQDDQ

SEQ ID NO: 45264 - protein, 382 aa, Helicobacter hepaticus ATCC 51449
MGETIKNTKVGGLAGITAGQSAICTVGTGHGLNYRGYDIYDLARECEFEEVAYLLLKEKLPNANELAAFKKELIAARDLPKALKDTLKLLPKNAHPMDIMRTTCSMLGCLEPETYDIVKMSFPMQNQIAIRLLGIFPSALTFWHHYHHNGKEISTQSNQDSIAGHFLELLHQKPPKELWIKAMHASLILYAEHEFNASTFTARVITATMSDVYSGVTGAIGALRGPLHGGANEAAMELIAEYKTPQEAEKGILDKLARKDKIMGFGHRVYVKADPRNVVIKEWSKKLSEDVGDTKGLYPISEAIEKVMWEQKKLFPNLDFYSASAYHFMGIPTPYFTPIFIFSRTAGWLAHIFEQRANNKLIRPSSEYIGPDKKAFVPLHNR

SEQ ID NO: 45265 - protein, 162 aa, Actinobacillus pleuropneumoniae serovar 1 str. 4074
MGVSSTGKTTIGSEVARRLGIKLIDGDDLHPRANILKMSQGQPLNDQDRFPWLERINDAAFSLEQKNEVGIIVCSALKKKYRDQIRQGNRNVKFIHLHGSFELILERMKKRKGHFMKTEMLKSQFDTLEIPQEDEPDVISIDISGSFEDVVQLCVQAIKAYL

SEQ ID NO: 45266 - protein, 324 aa, Coccidioides immitis RS
MCIALISTAHPDYPLILIDNRDEFLRRPTAAAAWWPEPHSYVLGSRDMARAAHGTWLGVTRQGRIAVLTNYKEASSQAVGQLSRGEIINSFLELPPDGSVSTEEYVERLIAGGEAQLAGGFSLACGSIQGPLAVVSNRVCAKDGVAWIAKEKGETVVLSNTAFGDCSWAKIRNGERLMKEALHTSYKMGESEDQLVQRLLGLLSTDTLPRLKEGADVETYIDLLCESIFIPVIGEEEEDTREEAEICASNIHEKAEVMGNASENHMRYMKGLYGTQKQTVVLVHHSGRVKFFERTLYDDDARPVPIGKGDRTFEFIAEEYGAQS

SEQ ID NO: 45267 - protein, 201 aa, Shewanella oneidensis MR-1
MKLLKPLFDNNLRWAGRISQEHPDFFEQLAKQQNPEYLWIGCSDSRVPSNQIIDLMPGEVFVHRNIANMVIHTDLNCLSVLQYAIDVLKVKHIMVVGHYGCGGVRAAMGNQRLGLIDNWLGHLRDVYRLHHDELMQMDEAKRFDRLCELNVIEQVSNVTSSTIVQEAWARGQELAVHGWIYGIDNGLLTDLDVTVDRAQVV

SEQ ID NO: 45268 - protein, 572 aa, Gibberella zeae PH-1
MASPPHIGSLSRLPANLRGSIESVKRGGHNVSWPLLNLDLLRNVLLFLFFWRWSRRAFWQLRGRGIIGSVVELYTNIRRILYGYFLRAPGVRGKVQQQVNESLVKLSDKLVPKDQIRYLTLPKEGFSHDVVRSELENLANMDHTRWEDGYVSGAVYHGEDELLALQTEAYGKFTVANPIHPDVFPGVRKMEAEVVSMVLSMFHAPPGAAGTSTSGGTDSILMACLAARQKAYAERGVTEPEMILPETGHTAFRKAAEYFKIKLHLVACPAPEYQVDVNAVRRLINPNTVILVGSAPNFPHGIIDDISALSKLALRKNIWLHVDCCLGSFLVPFLERAGFETLLFDFRLKGVSSISCDTHKYGFAPKGNSTVLYRTAEHRKFQYFVSPDWSGGVYASPGMAGSRPGALIAGCWASLMTMGESGYIDSCTKIVGTAKKIAEAIQTTPALGGELEIMGKPLVSVVAFTARNLNVYDIADGMGTKGWHLNALQSPPAIHVAVTLPITKVWEKLITDLEAVVEEEREKERVRLVEGKGTHGKAMGDASALYGVAGSLPNKSVVVDLASGFLDLLYKA

SEQ ID NO: 45269 - protein, 479 aa, Bacillus cereus E33L
MTTSNTYKFYLNGEWRESSSGETIEIPSPYLHEVIGQVQAITRGEVDEAIASAKEAQKSWAEASLQDRAKYLYKWADELVNMQDEIADIIMKEVGKGYKDAKKEVVRTADFIRYTIEEALHMHGESMMGDSFPGGTKSKLAIIQRAPLGVVLAIAPFNYPVNLSAAKLAPALIMGNAVIFKPATQGAISGIKMVEALHKAGLPKGLVNVATGRGSVIGDYLVEHEGINMVSFTGGTNTGKHLAKKASMIPLVLELGGKDPGIVREDADLQDAANHIVSGAFSYSGQRCTAIKRVLVHENVADELVGLLKEQVAKLSVGSPEQDSTIVPLIDDKSADFVQGLVDDAVEKGATIVIGNKRERNLIYPTLIDHVTEEMKVAWEEPFGPILPIIRVSSDEQAIEIANKSEFGLQASVFTKDINKAFAIANKIETGSVQINGRTERGPDHFPFIGVKGSGMGAQGIRKSLESMTREKVTVLNLV

SEQ ID NO: 45270 - protein, 327 aa, Oryza sativa (indica cultivar-group)
MTLIPISWSALIFLFLSHRTSTGDITGLRVITAVKTPYLPDGRFDLEAYDSLINMQIEGGAEGVIVGGTTGEGHLMSWDEHIMLIGHTVNCFGTKIKVVGNTGSNSTREAIHATEQGFAVGMHAALHINPYYGKTSVEGLISHFEAVLPMGPTIIYNVPSRTGQDIPPAVIEAVSSFSNMAGVKECVGHERVKCYTDKGITIWSGNDDECHDSRWKYGATGVISVASNLIPGLMRKLMYEGENTALNDKLLPLMKWLFCQPNPIALNTALAQLGVARPVFRLPYVPLPLEKRVEFVRIVESIGRENFVGQKEARVLDDDDFVLISRY

SEQ ID NO: 45271 - protein, 391 aa, Staphylococcus aureus subsp. aureus MRSA252
MVTQNKKILIITGSFGNGHMQVTQSIVNQLNDMNLDHLSVIEHDLFMEAHPILTSICKKWYINSFKYFRNMYKGFYYSRPDKLNKCFYKYYGLNKLINLLIKEKPDLILLTFPTPVMSVLTEQFNINIPVATVMTDYRLHKNWITPYSTRYYVATKETKQDFIDVGIDPSTVKVTGIPIDNKFETPINQKQWLIDNNLDPDKQTILMSAGAFGVSKGFDTMITDILAKSANAQVVMICGKSKELKRSLTAKFKSNENVLILGYTKHMNEWMASSQLMITKPGGITITEGFARCIPMIFLNPAPGQELENALYFEEKGFGKIADTPEEAIKIVASLTNGNEQLTNMISTMEQDKIKYATQTICQDLLDLIGHSSQPQEIYGKVPLYARFFVK

SEQ ID NO: 45272 - protein, 209 aa, Brassica napus
RVWNAPRRTFSENSYMRHVDKIDSSLLNGHDDESGTRKHNNAQHGGRELKIVVFVHGFQGHHLDLRLIRNQWLLIDPKIECLMSEANEDKTHGDFREMGQRLAQEVVSFFKRKMDKHSRYGRLKKVKLSFVGHSIGNVIIRTALADSLMDPYRKYLHTYISLSGPHLGYLYSSNSLFNSGLWLLKKLKRTQVIHQLTLTDDPDLQNTFF

SEQ ID NO: 45273 - protein, 224 aa, Glycine max
  misc_feature (216)..(216): Xaa can be any naturally occurring amino acid
MVLKGLCERIVSSKCSSKSSTETVDNTQVPVYSKAGSSDSSEKKAVPSRSSGWAAAVRKVVTGGSMRRFQERVLGSSRTDISSSDGDIWLLGVCHKISQQESTGGVDTSNGLASFEQDFSSKILVTYRKGFDAIGDTKYTSDVNWGCMLRSSQMLVAQALLFHKLGRSWRKPIDKPLDKEYIDVLQLFGDSEASAFSIHNLLQAGKGYGLAVGSWXGPYAMCRT

SEQ ID NO: 45274 - protein, 334 aa, Medicago truncatula
MKATLRYLAGIAGPSGFGSNSTAEQVTQNCSSFLPSGLTALITGGTSGIGAETARVLAKRGVRIVIGARDLKKAMKVRDNIQKESPNAEVILLEIDLSSFCSVQRFCSDFLALDLPLNILINNAGVFSQDLEFSAEKIEMTFATNYLGHFLLTEMLLDKMIETSKKTDIQGRIINVSSVIHSWVKRHGFCFKDILNGKKYNYNGTRAYAQSKLANILHAKEIARQLKARKARVTMNAVHPGIVKTGIIKSHKGLITDSLFFIASKLLKSTSQGAATTCYVALSPKTEGVSGKYFTDCNESKCSRLANEESEAQKLWNNTHALIHKRLHQATNNM

SEQ ID NO: 45275 - protein, 355 aa, Arabidopsis thaliana
MGTYLSSPKTEKLSEDGENDKLRFGLSSMQGWRATMEDAHAAILDLDDKTSFFGVYDGHGGKVVAKFCAKYLHQQVISNEAYKTGDVETSLRRAFFRMDDMMQGQRGWRELAVLGDKMNKFSGMIEGFIWSPRSGDTNNQPDSWPLEDGPHSDFTGPTSGCTACVALIKDKKLFVANAGDSRCVISRKSQAYNLSKDHKPDLEVEKERILKAGGFIHAGRINGSLNLTRAIGDMEFKQNKFLPSEKQMVTADPDINTIDLCDDDDFLVVACDGIWDCMSSQELVDFIHEQLKSETKLSTVCEKVVDRCLAPDTATGEGCDNMTIILVQFKKPNPSETEPEDSKPEPSEDEPSSSS

SEQ ID NO: 45276 - protein, 194 aa, Methanothermobacter thermautotrophicus str. Delta H
MITMRRSMKTRETLETHVKVDLEIDGSGKSSVNTGLGFLDHMLESVARHGLLDLEVEARGDLEVDDHHTVEDVALTLGEALREALGDKSGIRRMAHAMVPMDDALATVALDLSGRPYTVLELEFDDAVIGDVKSQNIGHFIESLAVSAAMNIHASVRGRNDHHKAEALFKALALAIRDAVRVEHGEIPSTKGKL

SEQ ID NO: 45277 - protein, 211 aa, Nicotiana tabacum
MGKLSTLLFALVLYVIAAGANAQQCGRQRGGALCSGNLCCIQFGWCGSTQEYCSPSQGCQSQCSGGGGGGGGGGGGGGAAQNVRATYHIYNPQNVGWDLYAVSAYCSTWDGNKPLAWRRKYGWTAFCGPVGPRGRDSCGKCLRVTNTGTGAQTTVRIVDQCSNGGLDLDVNVFRQLDTDGRGNQRGHLIVNYEFVNCGDNMNVLVSPVDKE

SEQ ID NO: 45278 - protein, 1188 aa, Neotyphodium lolii
MISSSFLPNRFRGEPDRSQTSAAPSRIGKKLSPLLQFLAKVACSHPIHTVVTIAVLASTSYVGLIQDSLFEGPARLGKADWSSLVDGSRDLIASADTKWQWSKVEQDSASVKNSTHLALLTFVFPDTLSSESASSAPRSHVVPTPQNLSITPIPATENSFTTYTQDSILAYSIPYTQAPEFISAAQEIPDEDAEEITTQHGREKKKWIMKAAKVNSRSSITHWLSNAWVGFIDLLKNAETLDIVIMVLGYLSMHLTFVSLFLSMRRMGSNFWLGTSTLFSSVFAFLFGLAVTTKLGVPISVILLSEGLPFLVVTIGFEKNIVLTRAVLSHAVEHRRTQGGREVQPGNKSGGDKSQNIISYAIQAAIKDKGYEILRDYAIEILILSLGAASGVQGGLQQFCFLAAWILFFDCILLFTFYTAILSIKLEINRIKRHYEMRMALEADGVSRRVAEKVAKSNDDWTQSSGSESKNTTLFGRMRSSSVPKFKVLMISGFVLINVINICTIPFRSASSLSTLRSWAGGLGGVVSAPPVDPVKVAGKGLDAILTAAKASGKATLVTVLTPIKYELEYPSVHYALSSSLRDGAAGAVSSAVQFDNYGVGGRMVGSLLKSLEDPVLSKWIVIALALSVGLNGYLFNVARWSIKDPNVPDHGIDRKELARAQRFNETESATLPLGEYVPPTPSCTEPATPALTDDEGDGLSMSKLRSSQSRSQFEHRSIEELEKLIVEKRTHELNDEEVVTMSMRGKVPGYALEKALKDFTRAVKIRRTIISRTKATSEITNGLDRSKLPFENYNWERVFGACCENVIGYLPLPVGVAGPLVIDGQSYFIPMATTEGVLVASTSRGCKAINSGGGAITVLTSDGMTRGPCVSFETLERAGAAKLWLDSEAGQNTMKKAFNSTSRFARLQHMKTALAGTNLYIRFKTTTGDAMGMNMISKGVEHALNVMATDGGFDDMNIITVSGNFCIDKKPAAMNWIDGRGKGIVAEAIIPADVVKSVLKSDVDALVELNIAKNLIGSAMAGSIGGFNAHAANIVAAIFLATGQDPAQVVESCNCITTMKNLHGSLQIAVSMPSLEVGTLGGGTILEPQSAMLDMLGVRGSHPTNPGDNARRLARIIGASVLAGELSLCSALQAGHLVKAHMQHNRSAAPSRSTTPAPPPMTPVSLAMTIAQDKSSKSAAAQQRSKR

SEQ ID NO: 45279 - protein, 223 aa, Candida albicans
MSREALINRITNETKIQIALNLDGGKLELKESIFPNQSIIIDEHHAKQVSGSQYINVQTGIGFLDHMIHALAKHSGWSLIVECIGDLHIDDHHTAEDVGISLGMAFKQALGQIKGVKRFGHGFAPLDEALSRAVVDLSNRPFAVIELGLKREKIGDLSTEMIPHVLESFAGAVGITIHVDCLRGFNDHHRAESAFKALAIAIKEAISKTGKNDIPSTKGVLSK

SEQ ID NO: 45280 - protein, 465 aa, Medicago truncatula
MEAKEYSVSLKRHRKEPYFVAHHTKRQHHIASKQACTHNHSLILSTSQNTPPMLPVFVSLLLLLLTSTTPALSHHSIVSDSIHPSKTNQTYKAGSELLKLRRIRTHLMKINKPAVKTIQSPDGDLIDCILSHHQPAFDHPKLKGHKPLDPPERPNGYYNNGEKVSERLQLWTDSGEECPEGTVPIRRTTEDDILRASSIKRFGRKPKPVRRDSTSSDHEHAILFVNGNQYFGAKANINVWAPHVTDGYEFSLSQIWVIAGSFGNDLNTLEAGWQVSPELYGDNYPRFFTYWTTDAYQTTGCYNLLCSGFIQTNNKIAIGATISPTSAYNSGQFDIGIMIWKDPKHGHWWLEYGGQLVGYWPANMFSHLRSHASMVQFGGEIVNARSKGYHTDTQMGSGHFAEEGFKKAAYFRNLQVIDWDNNLLPLANIQHLADHSSCYNIKQGNNNVWGTYFYYGGPGRNVKCP

SEQ ID NO: 45281 - protein, 591 aa, Arabidopsis thaliana
MTMMSDLSLDLVEEILCRVPITSLKAVRSSCKLWNVLSKNRILCKTEARNQFLGFTIMNHRLYSMRFNLHGIGLNENSEEFIDPSIKPIGNLLNQVEISKVFYCEGLLLCVTRNHSSKLVVWNPYLGEIRWIKTRNDYHIGVTYALGYDNNKNHMILRFFSEQGYYEIYDMNSSDSWDCFYGIPNKGLKCYQPGASLNGNAYFLTEGREVMEGYDCLLGFDFTTKKFGPLLSLSFSHDFIETGRLSCVKGEKLAVLYQRCYTYEMEVWVTTKIEPNAVSWSKFLAVEMEPLTSLKFNDDSGSFFIDEEKKIVVVFDIDESERNNTAYIIGDYGCLKEVDLDEVVNPQESVEVGDRIYSFSPFVCSCSYVPSLVKFKEDAEHERKDKKRKSKRKRTNKDGYDFILCFDFTTERFGQILPLPFKHSFRDTWTLSSVKEEKLAVAVLYWKNTCVMIEIWMTIKIDPNVESWSKFLRVDRKPCIDLRFDDRNDSFFIDEEKKVVVFFSSDKVKTSTAYVIGDNRYLRTVDLEKAANSQESVEVGERVYCFSPLVCSCSYYVPSLVKINHNAGRKRKEKKTKRKSKDKQMKLSNKV

SEQ ID NO: 45282 - protein, 224 aa, Pichia pastoris
MTGEHKRSSLIKRITNETKIQIALSLDGGPVSLAQSLFKDKDYSAEHAAQATSSQFISVNTGIGFLDHMLHALAKHGGWSVIIECVGDLHIDDHHSAEDTGIALGMAFKEALGHVRGIKRFGSGFAPLDEALSRAVIDMSNRPYAVVDLGLKREKIGDLSCEMIPHVLESFAQGAHVTMHVDCLRGFNDHHRAESAFKALAIAIKEAISSNGTDDIPSTKGVLF

SEQ ID NO: 45283 - protein, 401 aa, Triticum aestivum
MGCSPFFCYKSGATRQQISTHTEDLPGDINTIRYTYKELARATENFNPSNKIGEGGFGSVYKGRLRNGKLIAVKVLSVESRQGLKEFLNELMSISNISHGNLVSLYGYCVEGNQRILVYNYLENNSLAQTLLGSGRSNIQFNWRSRVNICLGIARGLAYLHDDVNPHIVHRDIKASNILLDKDLTPKISDFGLAKLLPPNASHISTRVAGTLGYLAPEYAIRGQVTRKSDVYSFGVLLLEIVSGRSNTSSRLPYEDQILLEKFPEVTNGVLLLQTWMYYEQGDLAKIIDSSAGDDLDIEQACRFLKVGLLCTQDVTRHRPTMSTVVSMLTGEKDVDSEKISKPATISDFMDLKIRSMRRENNIAFASSSTLLSTIMAHSSPLLSQETTQASITFTAISERE

SEQ ID NO: 45284 - protein, 215 aa, Mycobacterium avium subsp. paratuberculosis K-10
MDGSLVDSNYLHVHTWQRAFDDEDIAVASWQIHRCIGMDGSRLVRTLSGDAPDDVGERLRDKHSRYYRELTPMLKPLPGARALLRRVADLGLQVVLASSAPEDELEILRKVLDCDDVIAATTSSRDVDTAKPEPGIVRVALDRAGVRAEEAIFVGDAVWDAHAARGAGLACIGLCSGGIARDELRAAGADPVFADPQDLLDHLESTRIAALARGG

SEQ ID NO: 45285 - protein, 178 aa, Oryza sativa (japonica cultivar-group)
MELIWKWIIDFHSILLPVVLWAKAQNIFFQLAFSDNLTGKGLVTTKGFKGSFADAASSAKIFAVLAGVQSLVACTLRQLRGKDDVLNAGIAGCCTGLALSFPGAPQTMIQSCLTFGTFSYIIEMLNKQEPALARPSITGTKDLKAGHRVLPPFTLPLPQEAMEGFSSFQNFLSKFQGK

SEQ ID NO: 45286 - protein, 509 aa, Oryza sativa
MGALLERWISREGRTDGGDTSVQGERSVGTTSHRMGALLDVGSAVDDPAKQRSAMGNSLPVESKFTDEKENDRIKYVVSSMQGWGEKMEDAHAAILNLDDTMTSFFGVYDGHGGAEVASYCAKRFHIELCNHEDYDSNLSNAMRSAFYSMDEDLQLSDAWRELVIPRNNGWMYFLKAAACTSICKATYTEPAYEGSTACVVVIRGNQLIVGHAGDSRCVLSRNGQASALSVDHKPDSESARGSQNAGGVAVGYSYRKIMGRWVTKKQWGFTDFKGRVSISRSIGDFACKKNERLPPEDQMLTCNPDILTMDITDDMEFLVIATEGLWCNMTNQNVVDHTHDRLLEGAEARVICEELVQFGLPSGDNTTVILVLFKPGAYPAVPPVDTDTDTDSHTGDDVDNNDPANEVDPTANAGSDDSNTSDEVKVDATATAVGSSSTTAVAADEATVVSLSTATITIVDNYFFINTSEEVDPTANAGSDDSNTGDEVKVDATASSGLSDWELIYSEF

SEQ ID NO: 45287 - protein, 421 aa, Burkholderia xenovorans LB400
MDTPARLNDLQRTTLAIVLAGGRGTRLGPLTNKRVKPAVHFGGKYRIIDFALSNCLNSGIRRIAVVTQYKAHSLLRHLQRGWSFLRGEFGEFIDLWPAQQRVEGAHWYRGTADAVFQNLDIIRSIRPKYVVVLAGDHIYKMDYTRMIADHAESGADCTVGCIEVPRMDAVAFGVMHVDENRRVTGFVEKPADPPAIPGRPDTALASMGIYVFSADYLYSLLEENISSVDTDHDFGKDILPRVVTQGTAIAHPFSMSCVSSDPNVEPYWRDVGTIDAYWAANLDLASTIPTLDLYDRSWPIWTYQEQLPPAKFVRDMKGLQGSGNNLIVCGGCVISGSQISRSVLSSNVKVSSFCNINEAVLLPQVTVGASCRLQKVVIDRGCAIPDGTVIGEDPVSDAERFYRTDDGVVLVTPEALRQMPK

SEQ ID NO: 45288 - protein, 390 aa, Oryza sativa (indica cultivar-group)
MATAGKVIKCKAAVAWEAGKPLSIEEVEVAPPQAMEVRVKILYTALCHTDVYFWEAKGQTPVFPRILGHEPEVLYYFLSFDVLSIVESVGEGVTELAPGDHVLPVFTGECKECDHCKSEESNMCDLLRINVDRGVMIGDGKSRFTIKGKPIFHFVGTSTFSEYTVIHVGCLAKINPEAPLDKVCILSCGFSTGFGATVNVAKPKKGQTVAIFGLGAVGLAAMEGARLSGASRIIGVDLNPAKFEQAKKFGCTDFVNPKDHSKPVHEVLIEMTNGGLDRAVECTGNINAMISCFECVHDGWGVAVLVGVPTKDDVFKTHPMNFLNEKTLKGTFFGNYKPRTDLPNVVELYMKKELELEKFITHSVPFSEINTAFDLMLKGESLRCVMRMDE

SEQ ID NO: 45289 - protein, 873 aa, Arabidopsis thaliana
MIRHALLIFSILVSTPIVGEGATSTYEPTDVFLFNCGDTSNNVDVSGRNWTAENQKILSSNLVNASFTAQASYQESGVSQIPYMTARIFRSEFTYSFPVTPGSNFLRLYFYPTRYGSQFNAVKSFFSVKVNGFTLLNNFSADLTVKASKPQTEFIIKEFIIPVYQTLNLTFTPSLDSLAFVNGIEIVSIPNRFYSKGGFDDVITNVGSSVDFHIENSTAFETVYRLNVGGKTVGDSGMFRRWVSDDEIILSESSGISPIVPDIKINYTEKTPSYVAPDDVYATSRSMGNADHPEQNLNFNLTWLFTVDAGFSYLVRLHFCETLSEVNKEGQRVFSIFIENQTATLEMDVFRMSGGSWIPMYLDYTVIAGSGSGRRHDLRLDLHPLVSINPKYYDAILNGVEILKMNDPDGNLAGPNPDPLVSPDLIPNRATPRIRKNKSHILPITLAVVGSLVVLAMFVVGVLVIMKKKKKSKPSTNSSWCPLPHGTDSTNTKPAKSLPADLCRRFSIFEIKSATNDFEDKLIIGVGGFGSVYKGQIDGGATLVAVKRLEITSNQGAKEFETELEMLSKLRHVHLVSLIGYCDEDNEMVLVYEYMPHGTLKDHLFRRDKTSDPPLSWKRRLEICIGAARGLQYLHTGAKYTIIHRDIKTTNILLDENFVTKVSDFGLSRVGPTSASQTHVSTVVKGTFGYLDPEYYRRQVLTEKSDVYSFGVVLLEVLCCRPIRMQSVPPEQADLIRWVKSNYRRGTVDQIIDSDLSADITSTSLEKFCEIAVRCVQDRGMERPPMNDVVWALEFALQLHETAKKKNDNVESLDLMPSGEVGTTTDGEDDLFSRTTGHVGKSTTTDDSVLVVGDERSGSSWGVFSEINEPKAR

SEQ ID NO: 45290 - protein, 774 aa, Gibberella zeae PH-1
MTVPSDLTHRGANGQHLSLEDRFEVLKEIGDGSFGSVVLGRVRTAGANVARRGTVVAIKTMKKTFESLQPCLELREVVFLRTLPHHPHLVPALDIFLDPYSKKLHIAMEYMEGNLYQLMKARDHKCLDNGSVKSILYQIMQGLEHIHSHHFFHRDIKPENILVTTSGHNDAGNTFRRYSSLVTPPSTPPTYTVKIADFGLARETHSKLPYTTYVSTRWYRAPEVLLRAGEYSAPVDIWAVGAMAVEIATLKPLFPGGNEVDQVWRVCEIMGSPGNWYNKSGNRVGGGDWRDGTRLAGKLGFSFPKMAPHAMDTILQTPQWPASLAQFVTWCLMWDPKNRPTSSQAIAHEYFVDAVDPTRPKSSASRILGRKQSDLSRSSKEASTTPTSVKQSWFRKSLIGRSESTDLATMQTQTKEPAGPRPAPEPVAAKARPAAGKRATWTNGPSNVAPMPILPTARPISPIPDAVNARANNAYDDAYANGHGQGKTKKLGRQLSVASSTNNYTEMHRQQAERALNGNSGLASPPSGQKESFFSHLRKRARRFSGRHQTPVSPSYDDDDLEAQVGCGPWGSNRSSMVIDQSQQPAPVPKSEVYESLDKALRDVQTNLDSRPPVPPAHQVSPTSTLKRHHSLPQQQARSVDNLIGAARGGPISSRTRRAQATHGVHQYEAPDEEEELMDEAMTTTQRAMKRMEQNQNKPLRQSASNIGLMNPYPTPSPSANGNQVLFADGQAITPKPLDLNKRTDQYKWPTPPYEESEWAASASASIWAAGSRI

SEQ ID NO: 45291 - protein, 340 aa, Bacillus cereus E33L
MKAAVWYGEKDIRIEERETKELQPNDVKVKVAWAGICGSDLHAYLHPDSVPMNKNTVLGHEFSGEIVEVGSHVTKFKEGDRVCIYPMMLKDPSNAETERFITLDAVGAQIDGGFAEYVILPQKTIFKIPDNLSLEVAAMVEPAAVSFQSIKDSNVEEGDTVVVYGAGPIGLFAVLGAKAAGASNIIVVDLFDSRLGKATEVGATHTFNAKEVNPVEEIRKLFPDGADVTIEAAGVESTFNQAIQSTKVRGTMMVISFHTQDIQFNAPASLLFSGVKLMGSVGYSNETYNEVIQLLANGRLPAQSIITSKVDIDNIAEQGFEALIHDKAQAKILVKLSGAH

SEQ ID NO: 45292 - protein, 412 aa, Rhodococcus erythropolis
MTSDIVVIGGGVAGVSAVQSLRSEGYDGRLFLIGKERELPYDRTSLSKAVLAGDLADPPPLAPADWYDELQVETVLDRTVLQVDVTRKEVLLDGGRSLEVDRVLLATGASARVPSFSGADLPGVTTLRTVDDAQRLRQDWEPGQRLVVVGGGLIGCEVATTARKLGLEVSILEASDELLQRVLGRRIGGWCRARLEELGISVMVNTGVAEFDGVDRITAVIGTDGRRFPADSAIVCVGAEPETAIAEQAGLACSRGIIVNDSGGTAAEGVFAAGDAASWPLRTGGRRSLETYINSQKEATAVASAMLGKAVHAPQLPLSWTEIAGHRIQMIGDIEGSGEYVMRGAPDDGPALLFRLTDGKLTAALSVDAPREFAMATRLVESGAQVGRDVLADTSVELRELNRAARERTTAA

SEQ ID NO: 45293 - protein, 331 aa, Geobacter metallireducens GS-15
MALRVAINGFGRIGRSVLRAAIKEKGIEFVAINDLTDAKTLAHLLKYDSVHGPFPGKVEAGNGEIIVNGKPIKILAVRNPEELPWKKEKIDVVLESTGLFTSREKAELHLKAGAKKIIISAPATNEDITIVMGVNSNLYDPKKHNIISNASCTTNCLAPVAKVLHETFGIEKGLVTTVHSYTNDQQILDLPHKDLRRARAAAMSMIPTSTGAAKAVALVLPELKGKLDGMAIRVPTPNVSVVDLVVTLSKKADADKVNAALKKASKGSLKGVLGFSEEPLVSIDFNGNPLSSIVDAGCTKVIEGNMVKVLSWYDNETGFSHRVVDLMKLIA

SEQ ID NO: 45294 - protein, 398 aa, Geobacter metallireducens GS-15
MAIRYIDEIESLKGKKVFIRVDFNVPLDEHQNITEDTRIRAVLPTINFALDAGAKVILASHLGRPKGERKPKYSMAPAAKRLSRLLNKEVQLAPDCIGDEVKKMIDAMKPGEVLLLENVRFYEGEEKNDADFAKALANDCEIYINDAFAVSHRAHASVEAITKFFPVVAAGFLMNNEINYFEKAMQKPIRPLVAILGGAKVSGKLEVLESLVNKVDKIIIGGGMAFTFLKALGYNVGKSLVEEELLEIALTTYTKAREKGVKFYLPVDCVAADRFNPEAETKVTTIQEIPEEWMALDIGPATVTLFTEALQNAKTIIWNGPMGVFEMDAFSRGTFAMVSAVANSYALTIVGGGDTDSAVHRAGEYAKISYISTGGGAFLELLEGKHLPGIKVLEENGK

SEQ ID NO: 45295 - protein, 348 aa, Oryza sativa
  misc_feature (156)..(156): Xaa can be any naturally occurring amino acid
MAAAAAAASSAKRALLPWARDAHHALARALQGCGGGGGLGLRGALPTAGGRWSLLQCRWRSSLPQLDSADRSDEESGGEIDWDNLGFGLTPTDYMYVMRCSLEDGVFSRGELSRYGNIELSPSSGVINYGQVCHVLQSTHMSMQRNVDPGDRTNKXTRVMAACVRTYVLDDQGLFEGLKAYRAANQQGSYMLFRPEENARRMQHGAERMCMPSPSVEQFVHAVKQTVLANRRWVPPQGKGALYIKPLLIGSGPILGLAPAPEYTFLIYAAPVGTYFKEGLAPINLVVEDSIHRAMPGGTGGVKTITNYAPVLKAQMDAKSRGFTDVLYLDAVHKTYLEEASSCNLFIV

SEQ ID NO: 45296 - protein, 251 aa, Geobacter metallireducens GS-15
MRTPIIAGNWKLFKKSSEAQDFVAELIPLVQKTTDVEIVIAPVFTVLSAVKRAIADCNIMLSAQDCFWEEEGAFTGEISPGMLVDAGCSHVIIGHSERRQYFGETDETVNRKIKAAITAGLTVLFCIGETLAEREADKTFEVLRTQIENGLAGLARGDLAKIVIAYEPVWAIGTGKTATDEQAQIAHAFIRKVVGELFTVQIAETIRILYGGSVKPENVRGLMNQPDIDGALVGGASLKADSFGAIVNYKA

SEQ ID NO: 45297 - protein, 281 aa, Pisum sativum
MELYAASHSLPNYPSSFLFKPKITTFHTTLFPTKFAPFKASFFSPNHLTLTTPMNPPTTSLSSAAFVEHNNGSTSTSLPFHPETRVGEVKRVTKETNVSVKINLDGSGVADSSTGIPFLDHMLDQLASHGLFDVHVKATGDVHIDDHHTNEDVALAIGTALLQALGDRKGINRFGDFSAPLDEALIHVSLDLSGRPHLSYNLDIPTQRVGTYDTQVVEHFLQSIVNTSGMTLHIRQLAGRNSHHIIEATFKAFARALRQATEYDPRRRGSVPSSKGVLSRS

SEQ ID NO: 45298 - protein, 313 aa, Bacillus cereus E33L
MKNRVNPALLPGLEMYPDQDLRPECLPVMREEASKVFPPTIVDETLSVTNEVIEGPDANPLRLKIYRPKSNNESLPALLWIHGGGYILGSINDNDDLAVKIAKEANCMVVSVDYRLAPEHPYPAPIEDCYAALKWIADNAETLNIDSNRIGVAGVSAGGGLTAALTLLARDRQYPSICFQMPLYPMIDDRNNTPSANEIKEGFVWNQKSNEAGWKMYLGELHGTDHIPAYAAAARAEDYRNLPRTYTCVGQLDPFRSETLTYVTKLAEAGVDVEFHLYPGAYHGFEMMHPDTDISIHAWNDYVRAVKTGFARK

SEQ ID NO: 45299 - protein, 464 aa, Oryza sativa (indica cultivar-group)
MVIAEVVEASAREYEEGMRACYDAAKTWMAIPAPKRGEIVRQIGDALRAKLHHLGRLVSLEMGKILPEGIGEVQEIIDMCDYAVGLSRQLNGSIIPSERPNHMMMEVWNPLGVVGVITAFNFPCAVLGWNACIALVCGNCVVWKGAPTTPLITIAMTKIVASVLERNNLPGSIFTAFCGGADIGQAISLDTRIPLVSFTGSTKVGLMVQQQVNARFGKCLLELSGNNAIIVMDDADIQLAVRSVLFAAVGTAGQRCTTCRRLLLHESIYRTFLDQLVEVYKQVRIGDPLENGTLLGPLHTPASRDAFLKGIQTIRSQGGKILYGGSAIESEGNFVQPTIVEISPSAPVVREELFGPVLYVMKVQNLKEAVEINNSVPQGLSSSIFTKRPDIIFKWIGPHGSDCGIVNVNIPTNGAEIGGAFGGEKATGGGREAGSDSWKQYMRRATCTINYGSELPLAQGINFG

SEQ ID NO: 45300 - protein, 137 aa, Helicobacter pylori J99
MKQRTLSIIKPDALKKKVVGKIIDRFESNGLEVVAMKRLHLSVKDAENFYAIHRERPFFKDLIEFMVSGPVVVMVLEGKDAVAKNRELMGATDPKLAQKGTIRADFAESIDANAVHGSDSLENAHNEIAFFFAAREF

SEQ ID NO: 45301 - protein, 101 aa, Malus x domestica
VGYMKKMIALGFEGSPKKIAVGVVTLDGTILSNPRHTYITPTGQGFLPRETAQHHFQHILPLVKSALETAQITPKEIDCLCYTKGPGMGAPLQVAAIVVRV

SEQ ID NO: 45302 - protein, 1341 aa, Oryza sativa
MEMRRRIFRPPHAAPLQPPADCRPSPAGPLPLSSAHRTPHAGPLRLPAAPLLPPAARRFSHAGVIEGEISREEVELVFVFREKFVSVFVPDHIRFLFVFEIIRIRFRIRAIHIRFRIRFARRASPRRLRRFPSISREVGAVVLLLPPPESKPERMELRFKAPDYATWKKEAAACDKNNGNDKDGSIPVRNKYPRHPPPRFELAEGLDYKKIDKFMDERAISIAKTIANDIIIPDPAPEWMCHTFLDKHDELEPIFVKDSPRCFLRYFKNCGCYGMSWNLTITAQTLTCMVSFNALRCAKVVLEGRAPELFGMHANPNCVTKYGYFPLHEAAERFSVEMIKLLLRFGASANVRTVGDDVIEDLLPLHIAIENTCLHKYLEDNLSPSQNHLDYIYKLIHLLCLPEMKIFLDTIRLLAGKTNNLLEELWYYIEDGKLIQSAILLLAAQEQIRGGCSSKINGSSKKDGFGIISKRILRLSFALRWEKGSNGMAQKLREEKRALIDCTGLLVDVISQAGEPLSAYVQAHSEAPHVEVLEHVSTILKEYGFYPTAEVIDTMNLQPYDCEMERESCSKGWEKGSRRRMGSHVYKEKFFPILEISFTNPVSCEVGRIPPFANNHQSKRSFSTCATGAFRLLKLLKSSVTDLAWGLRYPCPLDLEAQQLGKYIVKYSLLFCQFQQAKSCMERYRLYTFDFPAVLFLWVNNSSAEFVANLNDRNVEIVQHMEDNDHNIINATANVTSDWSIVKEEFTFPAGSAPFNSCHASTIVETEKDSFLVAYFGGSKEGAPDVKIWLQRYSPFLVEDGRLLCGSSVESWNSWGAWLEVTKDAGRTWRKYGPIYIEGETLGVIQPVPYMTANGTIRVLLRSFETIGRVCMADSADGGVTWSYVHETDLPNPNSGIDGVKMKDGRVLLAYNTFSRGTLKVAVSMDDGDSWNDVMTLEDTEGMEFSYPAVIQTMDDLIHITYTYNRTQIKFDLPTLSSQGSKDHGLILHIQEKCDKMTNKWSVLREEFTFSEGNVPFKTCHASTIVEVQKNMFLVAYFGGTQEGADDVKIWLQRYYNGSWHSPEVVDEVPNVPLWNPVLFQLPSGEILLFYKVGKTVESWSGCMKCSSDGGVIWSKREQLPPGILGPIKNKVTKDHGKTWKKYGPIYVRGKTMGVIQPVLYQTSSGTIRMLLRPSDEVGRICVAESKDSGVNWSYAQPTELPNPNSGIDGVKLKDGRVVLVYNSTSRGVLKVAVSQDDGDKWEDVLTLEETHGVEFSYPAVIQTSDGLVHVTYTYKRTQIKVVLPMLFGLLMVITSFIIFHVKNEFLLVTALCSMSFYNQARFDAVSNQTCGFVSGVKFEL

SEQ ID NO: 45303 - protein, 425 aa, Rhizobium sp. NGR234
MPSKLAGPLAKAESRSPTMARPHTAGHPSLAWETLALDGGLTIDPATKAIAPNISMSVNNLLVPGDGAFSADGVEDLTALPFLYARWTNPTVRQLELRMAALEGADDALATATGVAAIAATFLTCLKRGDHLIISDVCYAGANELARRMLPDYGIEVTAVNMSRLDEVAAAFRPNTRLVHCESPCNPILRLTDLSAVAALAHRHGALVSVDSTLATPVATRPLALGVDLVIHSLTKFINGHGDALGGIVCGRKELVEKIRSRAGVYLGASLSAQNAWLIMRGIDTLFPRLKAMSDSAMRIAHFLRDHPGVRSVTYPGLETHPQHALARRQMRIFGGIVTFQTDDPQKIALRLAERLRVVHYAFSLGHQRSIVVLLDTKEMMNSTYGLEGPQLDDYRAFAGDGVFRLSVGLESVDDIIADLDRALR

SEQ ID NO: 45304 - protein, 168 aa, Glycine max
MASSSSASGSGSASAVTERRGIPGAQFVEDVQTYLTQSGLDVGSALAFLQERLQQYKVVEMKLLAQQRDLQAKIPDIEKCLDVVATLKAKKGTGEELIADFEVSEGIYSQARIEETDSVCLWLGANVMLEYSLEEATGLLQKNLDNARASLEVLIADLQFLRDQVTIT

SEQ ID NO: 45305 - protein, 139 aa, Caulobacter crescentus CB15
MTERTFSIIKPDATRRNLTGAINAVIEAAGLRIVAQRRVKLTEAQAKKFYEVHAERPFYGELVGQMTAEPVVVQVLQGDNAVLKYREVMGATNPENADEGTIRKLFALSIGENSVHGSDSLENAGIEIAQFFTEDEIVG

SEQ ID NO: 45306 - protein, 379 aa, Magnaporthe grisea 70-15
MYASAMRGGRRPIVQRFDEYYRCYPMIMVPGAERPELNHGSKIILPPSALEKVSKLHVQWPLLMELINGENDKHTHSGVLEFVAEEGRAYLPQWMMQTLQLDVGDMIQIKSTSLELARMVKLQPQSAKFLDISDPRAVLEKAFRNFATLTKGDVFSFEYNDDVYEMAVLDVKPETTKMGVSMIETDVSVDFAAPVGYVEPERQAKGSGTSTPRSTRGGGLPAGGLLHSQGGMAQAINYDAIAPGSARSAATNFMGEGNKIGSKKGSKDGTPVKSSTPVAGVSTNPNTSGTSQDLIPRRRTNGPLPLRLPANKLFFGYEIKPVKTDAQKEEEKESAKRPHFAGQGQTLRGGAAKRKGDENEQLPTPEKRPGEGRRLDGKT

SEQ ID NO: 45307 - protein, 1039 aa, Magnetospirillum magnetotacticum MS-1
MIFTQPLPSPTAERLAIHQAAARDEADLVSGLAAAVPLEDEARRRAVNHAVNLVDGARQNRRSLGLDGFLNEYRLSTREGVVMMCLAEALLRIPDDHTADLLIKDKIGSGDWDDHLGHSPSLFVNASTWALVLGDRLLHLEEDGRATLGRMAGRLGEAVVRRALRQAMGLMGRQFVMGRSIAEALDHARAWEAKGYLHSFDMLGEAARCEATALDYVRAYTTAIEALGRHATGDGVIAGPGISVKLSALHPRFEMAQRGRVMAELVPRLRDLCLKARHAGIGLTIDAEEADRLEISLDVIEAALSDSGLDGWSGFGMAIQAYQKRARPVIAWAGALAARRQCRLMIRLVKGAYWDGEIKRAQERGLHGFPVFTAKEATDVSYLACAADLLARPDLFYPQFATHNAHTVAAIVEMTGGPGDWEFQRLHGMGEALYAQLVPQFACRIYAPVGSHQDLLPYLVRRLLENGANSSFVSRLADEDIPAHVVAADPLAILGRITPQMVAAPSALFEPQRRNSSGLDLSSPAVLAQLDLALAAAATPERAHPIIDGQMLDTDNATPVLDPADHRRIVGEVVDAHPAQVAAALASAHAAFPAWDDLGGEGRAAILDKAAEMLEDQRARFMALAIREAGKTLPDALGEVREAVDFLRFYAAEARTRFAHPLPLPGPVGESNHLMLGGRGVFACISPWNFPLAIFMGQVAAALAAGNTVVAKPAPQTPLMAAAAVRLLHAAGVPPKVLHLVPGGPSVGEALVSSPMLDGISFTGSTATARQINRIRAAMDGPLLPLIAETGGLNAMIVDSSALAEQVVADCQESAFRSAGQRCSALRIAFIQREAWTRIEPLLAGAMAELSLGDPALLSTDVGPVIDEAARQRLLAHGGKLRHAGRAIGQSPFPADCRFGTFFAPMAYELENLDLLRAEVFGPILHVITWESGHLDKVLDAVAATSYGLTLGIHSRIDATIAQVVARARIGNIYVNRAMIGAVVGSQPFGGLGLSGTGAKAGGPNTLIRYGVERCLSVNTAAAGGDAALMAGPQRGHAK

SEQ ID NO: 45308 - protein, 392 aa, Oceanicola granulosus HTCC2516
MPADAPITQDVLTIPRKIPDSGRTNLVGLTRPALAEALRAAGTPDKQVRMRVNQVWQWIYHWGVRDFEAMTNLAKPYRALLAENFEIALPEIVSRQVSNDGTRKYLVRIAGGHEVETVYIPEEDRGTLCISSQVGCTLTCSFCHTGTQKLVRNLTPAEIVGQIMLARDDLGEWPAPGTGTGESGPRLLSNIVLMGMGEPLYNFDAVRDAMKIAMDGEGIALSRRRITLSTSGVVAEIARCAEEIGCMLAVSFHATTDEVRDRLVPINKKWNIETLLESLKAYPKLSNSERITFEYVMLKDVNDSDDDARRLVKLIEGIPAKINLIPFNEWPGAPYERSSNNRIRAFADIIYKAGYASPIRTPRGEDIMAACGQLKSATERARKSRLEIEAEL

SEQ ID NO: 45309 - protein, 377 aa, Vibrio cholerae O1 biovar eltor str. N16961
MSAAKELGGAGLRGQSAGSTALCTVGKTGTGLTYRGYDITDLAHHAQFEEVAHLLLVGYLPTQAELDQYKTRLIGLRGLPEKLKQALELIPAEAHPMDVMRTGCSILGNLEPEHTFAEQQAATERMLALFPAIICYWYRFSHEGVRIDTADQSEDSIGGYFLKMLTGQAPSELFKKVMHCSLTLYAEHEFNASTFAARVCASTLSDIHSCVTGAIGTLRGPLHGGANEAAMAMIEQWHSADEAEAGIMRMLASKEKIMGFGHAIYRESDPRNALIKEWSKALSEAVGDSHLYAVSERVEAVMKREKDLFCNADFFHASAYHFMGIPTKLFTPIFVMSRLTGWAAHVYEQRANNRIIRPSADYVGPEHQTWLPIEQRG

SEQ ID NO: 45310 - protein, 512 aa, Rhodococcus erythropolis
MHIPFTVTDFLERGAAGFPDSVAVIDEPEQPGESVGQVTFRELAHRVCAWQAGFDRLGIRVGERVAVVSHNSARLLELLYAVPASGRICVPINFRLSPAEVDYIVGDCGASVLLVDPELEEALSGIKVRHRFVLGKHTDADLMRFDTEPAPWASPTEESTATINYTSGTTARPKGVEMTHRNLWVNAVTLAMHTRAWERDVYMHTLPMFHCNGWGMPFGMAGLGAKQIVLRKVDGTEILRRVEEHGVTLMCGAPAVWNAVLDAARSWHGEIPGRDRVRVVCAGAPPPSRTIARLSSELGWELQQIYGLTETSPLLTFNRSLPADDGLDLEERAHRLTRAGLPALGARLHISNSGEVLARSNVVMNGYWNNPEATDEALRDGWFHTGDGGMIDGEGQLTISDRKKDVIVTGGENVSSIEVEECIFSHPGVTQVAVIGVPDEKWGETVKALVVTTGPSTVSEAEIIAHCKQRLAGYKAPTSVEFRDSIPHTATGKIQKFKLRAPYWEGSTRGVN

SEQ ID NO: 45311 - protein, 161 aa, Zea mays
GEDVPILIADTSDPASFAALATCARVVLSCAGLFRFHGHAVAAACATVGADCLDISEEPGFMERVEAELHEPTARSGSLIVSACGFGFVPAEFGFLFHSRQWEWEPPFAPATVEAYVSLQSTKRIVGNIGTYESAVLGVANAGQLQALRRSRPRRPRPNVN

SEQ ID NO: 45312 - protein, 213 aa, Gibberella zeae PH-1
MYHLAKGLYLYATSKEEYSVILLGLDNAGKTTFHEQVKSMFLPNRPDPKLKTVPTVGQNVSTIPLQDMYLKLWDVGGQHSLRKLWESYYTSCHAIVFIIDSTDIGDGNIEHDENLGRLEECRLVLEDVLQHTETEGVPLLILANKQDREDCVETIRIKEGLVKKVMEGDKGSAVRDSRVLALSALTGDGVREAIEWVRTRVQWNKESRPPVMR

SEQ ID NO: 45313 - protein, 71 aa, Brassica napus
GKGGVNRHKNVLRRNIEGFIMPANRMQARQGGVKRISGLIDDDIPGVLRILLENVIRNAVTYTEHPMMKTV

SEQ ID NO: 45314 - protein, 528 aa, Thermobifida fusca YX
MVDTTPAQPAEQKERLPLPPRIARFVVLFAVFVCAACGLVYELALVALGSYLLGDTITQASVVLAVMVFAMGVGSLASKQLTHRPAFWFAVVEGLLSLLGGLSVLILYAAFAWFSLYQPALVSLSFLIGVLIGAEIPLLMTLIQRIRRQEAASAVADLFAADYVGGLIGGLAFPFLLLPVFGLLEGVLLVGILNAVTGIAIVLWLFRHSLTRGGRIGLAAGLALVMAVSGSALALSERFEVDARQALYRDPVVYAERSDYQEIVLTENLARTDLRLFLNGDLQFSSLDEYRYHESLVHPVMNGPRRTVLVLGGGDGLALREILEYADVARVVLVDLDPAVVDLARTHPRITALNRDAFADERVTVVHDDAFTWLRTTTEQFDAIVVDLPDPDDVNTAKLYSVEFYGLVRQAMAEEARVVVQAGSPYFASRAYWSVGQSMEEAGLHTTPYHVDVPSFGDWGFFLAATDRAPALTLPDDLPDTDFLDAAVLHAAQVFPKDRRPGAQGESQPSTLLNPRIIDYHRTAWEGY

SEQ ID NO: 45315 - protein, 450 aa, Pseudomonas putida GB-1
MQPDHRATGNGQLRKTLRLWHVIIIGLAYLTPMTVFDTFGIVSGITAGHVPSAYILALAGILFTAVSYGTLVKRFPQSGSAYTYTQKAINPHVGFLVGWSSLLDYLLLPMVNALLAKLYLSAMFPEVPEWMWVAGFVTLISLINMRSVNLVAHFNLLFVGVQVAIIAVFIYLCVRGLDHGEGLGTAWSLMPFADSQTQFSALAAGATILCFSFLGFDAVTCLSEETRDPAKTIPRAIFLTALIGGVVFITVSYFIQAYFPTMARFHDQEAALPEIALYVGGKLFQSIFIACTVINTIASGLASQTSVSRLLYVMGRDNVIPASVFARLHSRYKTPVLNIAVVGIISLSAIFFDLVTATSIINFGALVAFSFVNLSVINHCYLREGNRKGLANQLKYLVLPTIGFCIIVSLWLDLNAHSLMFGGIWAALGLIYLGWLTKAFRAAPPNYIAE

SEQ ID NO: 45316 - protein, 533 aa, Oryza sativa (indica cultivar-group)
MSLPAISLYTSPPPGAVYSSEFDPSSRGSSPPCSTAPPSTSHRPPAAAGGLSCLFSSPAAAASPPRAPPHDELGALWQDRSDEPAFAGGGGGYSSSPLKWRDLHHHHHHSPVSVFQGPSSSPAASRSPPASWLAGRDRDRERLFAGFVRNALGSCVDYAPALSPRSEVGGGELAFELDENLAEASPACEPCARELLAGAQARHRIFLEELVVKAFFEAEKAHRGQTRASGDPYLQHCVETAVLLANIGANSTVVSAGLLHDTIDDSFIDYDHIFHMFGAGVADLVEGVSKLSHLSKLARDNNTASRIVEADRLHTMLLAMADARAVLIKLADRVHNMKTLEALPLGKQQRFAKETMEIFVPLANRLGISSWKDQLENLCFKHLNPEEHKDLSSKLTKSFDEVLITSAVDKLDRGLRDAGLSYHNLSGRHKSLYSIHNKMLKKNLTMDEIHDIHGLRLVFEKEEDCYRALDVVHELWPQVPGRFKDYISRPKLNGYRSLHTVVMSENVHPFEVQIRTKEMHLQAEYGFAAHWSS

SEQ ID NO: 45317 - protein, 192 aa, Triticum aestivum
  misc_feature (64)..(64): Xaa can be any naturally occurring amino acid
  misc_feature (88)..(88): Xaa can be any naturally occurring amino acid
  misc_feature (94)..(94): Xaa can be any naturally occurring amino acid
  misc_feature (102)..(102): Xaa can be any naturally occurring amino acid
  misc_feature (137)..(137): Xaa can be any naturally occurring amino acid
  misc_feature (147)..(147): Xaa can be any naturally occurring amino acid
  misc_feature (178)..(178): Xaa can be any naturally occurring amino acid
MLGVARRRLGSGCVLAQLAQALRPAAAPARTYSAAAKEITVREALNTALDEEMSADPSVFLMGXEEVGEYQGAYKISKGLLDKYGPRXGLDTPXTEAGFTGXIGVGAAYNGLRPIVEFMTFNFSMQAIDHIINQAAXSNYMSAGQIXVPNVFKGPNGLLLEWCQHSHAINLDQCPGLXSPHPRMPVTHRIVV

SEQ ID NO: 45318 - protein, 414 aa, Gordonia westfalica
MREVMASARPRLARARSGSLLLGPAFVAAIAYVDPGNVASNISAGAQFGYLLVWVIVVANVMAGLVQFLSAKLGVVTGRSLPETVRLRASRTARLSYWVQAEIVAMATDLAEVVGGAIALNLLFDLPLLIGGVITGSVSMVLLLVQDRRGQQPFERVIIGLLAVIAIGFLTSTVVAPPPPGAVVGGLLPRFDGTESVLIAAAMLGATVMPHAVYLHSGLVRDRHGHQPEGPIRSRLLRVTKIDVGLAMLLAGAVNLSMLLVAATTLRGREGVDSIDGAHAAVADTLGQVVALLFALGLLASGLASTSVGAYAGAMIMDGLLQRRIPLILRRLITLIPAITVLAIGIDPSRALIVSQVVLSFGIPFALVPLVRFTSDRMLMGEDVNNRLTTSLAWLTAAVIIVLNVALIYLTVTG

SEQ ID NO: 45319 - protein, 338 aa, Oryza sativa
  misc_feature (27)..(27): Xaa can be any naturally occurring amino acid
MGSPPPHRLLLLLAVAAVLHRSAAAAXEGVIRLPRGRACAAPTDPAAYDRPVIGIVSHPGDGAGGRVSNGTAASYIAASYVKFVESAGARVVPLIYNKPEERLLEKLSLVNGVLFTGGSVKSGPYFETIKKVFQYVLDKNDAGIPFPLFAQCLGFELVSMIVSKDNNILESFSATNQASTLQFPNYSSLEGSVFERFDPDLIKKLSTSCLVMQNHKYGISPKTLRENVALSSFFKILTTSPDENGEVYVSTVQANKYPITCTQWHPEKAIFEFGKQMIPHSEEAVQVTQNFANYFISQARKSQNRPPADKVLDNLIYNYSPTFIGKKSKSFDVVYIFS

SEQ ID NO: 45320 - protein, 141 aa, Alkalilimnicola ehrlichei MLHE-1
MAVERTLSIIKPDAVAKNIIGEIYNRFEKAGLKIVAARMVHLSREQAEGFYAVHKERPFFNDLVGFMISGPVMVQVLEGENAIVKNREIMGATNPAEAAAGTLRHDYAETIDANAVHGSDAPETAKQEIEFFFKADELCSR

SEQ ID NO: 45321 - protein, 457 aa, Rhizobium sp. NGR234
MTLHGHKIGFGLPPILRSATADLLTRHGPLLLDWVTCYGSPLNLVWPDALQKNLAALKGVLTERRVGHAVYYGVKVNKSLGLMRAALSAGAGLDVSSLCELRDARRLGAEGVRLVATGPAKTSAFHKELIDCSALISVDSPEELEDLIDGLPADAGPQPILLRLRPRDQSKSRFGMPGDAVVHCLARLTAENRLRFDGLHFHLSGYRWETRVAALSEAADLITKARRMGFSPRMIDIGGGLPIQYVDQVKYRAHLAAQAPEDYRTGKIPDSFYPYGGTLSPADWLHRLLEAEMSQGQSVAGYLAREGLTLAMEPGRALTDQAAITVFRISRVKALGPDSHVIFVEGSSFSACETWFASEFLVDPILVPVTRPAAQSPPIRAYLAGHSCLDEDVISNRWLTFPIAPQAGDLLVYANTGGYQMDLLENEFHRHPMPARLCVIDDAEGRATLVPDTIGEV

SEQ ID NO: 45322 - protein, 227 aa, Streptococcus pyogenes M49 591
MEALKKIAGVTAAQYVTDGMTIGLGTGSTAYYFVEEIGRRVKQEGLQVVGVTTSSVTSKQAEGLGIPLKSIDDIDSIDLTVDGADEVDKDFNGIKGGGAALLMEKIVATPTKEYIWVVDASKMVEHLGAFKLPVEVVQYGADRLFRVFEKAGYKPSFRMKGDSRLVTDMQNYIIDLDLGCIKDPVAFGHLLDGTVGVVEHGLFNGMVDKVIVASKDGVTVLEAPKAG

SEQ ID NO: 45323 - protein, 322 aa, Arabidopsis thaliana; identical to SEQ ID NO: 934

SEQ ID NO: 45324 - protein, 653 aa, Medicago truncatula
MACISIHNFMLLLLFLFHFTPTSAQVPIFLYSFCQNSTEKSLTASYKSNVNKLLLWINSDSAAGTEFNNNKIGSNNTTSDDVYGNYDCRADVTGSFCQFCINTAVKEIAQRCLNSDTAVIFYDVCIIRYSNKNFFGNVSITPSWNVTGSKKIKDSTELTKVEDYIGILIRKVTVETNQSWGASEFNSNETGKRYGFLQCARELDKEGCRQCLEAVLDLVPKCCGTKVAWEVVVPSCGIKFDDQKFFQLNDQSGSSSLKPNQAKQEGASNKKTLIIILVSVLMAVALLCCCVYYYWRKNGLCKGGFLLRKTLNIDDTLNGDLPTIPFSVIQHATNYFSSSSKLGEGGFGPVFKGTLPDGTEIAVKRLAETSGQGSEEFKNEVIFIAKLQHRNLVRLLGCCIEGNEKILVYEYMPNSSLDFHLFDEEQHKKLDWTLRLSIINGIARGLLYLHQDSRLRVIHRDLKASNVLLDDEMNPKISDFGLARKFEKGQSQTKTKRVIGTYGYMAPEYAMAGLFSVKSDVFSFGVLVLEIVYGKRNGEFILSEHRQSLLLYTWKLWCEGKSLELIDPIHKKSYIESEVMKCIHIGLLCVQQDAADRPTMSTVVAMLGSDTMPIPKPKQPAFSVGRMTEDDPTLKSYKDNYVDEVPITIVSPR

SEQ ID NO: 45325 - protein, 173 aa, Listeria monocytogenes str. 4b F2365
MEIKDLQDYVAIVNDWPKKGIVFKDITPLMNDGEAYRFATDKIVEYAKELKIDIIVGPEARGFIIGCPVAYALGIGFAPVRKPGKLPRETIEMEYDLEYGTNKLSMHSDAIKPGQRVLITDDLLATGGTIEATIKLVEELGGIVAGCAFLIELKELEGHKKLNGYDRLILMQL

SEQ ID NO: 45326 - protein, 512 aa, Arabidopsis thaliana
MFPLISFSPTSLDFTFFAIIISGFVFIITRWNSNSKKRLNLPPGPPGWPVVGNLFQFARSGKPFFEYAEDLKKTYGPIFTLRMGTRTMIILSDATLVHEALIQRGALFASRPAENPTRTIFSCNKFTVNAAKYGPVWRSLRRNMVQNMLSSTRLKEFGKLRQSAMDKLIERIKSEARDNDGLIWVLKNARFAAFCILLEMCFGIEMDEETIEKMDEILKTVLMTVDPRIDDYLPILAPFFSKERKRALEVRREQVDYVVGVIERRRRAIQNPGSDKTASSFSYLDTLFDLKIEGRKTTPSNEELVTLCSEFLNGGTDTTGTAIEWGIAQLIANPEIQSRLYDEIKSTVGDDRRVDEKDVDKMVFLQAFVKELLRKHPPTYFSLTHAVMETTTLAGYDIPAGVNVEVYLPGISEDPRIWNNPKKFDPDRFMLGKEDADITGISGVKMIPFGVGRRICPGLAMATIHVHLMLARMVQEFEWCAHPPGSEIDFAGKLEFTVVMKNPLRAMVKPRI

SEQ ID NO: 45327 - protein, 178 aa, Brassica napus
MNSVVRRNQVDSAHHIKKHDGEDHRHQLAKKLTAVDLVAIGVGTTIGAGVYILVGTVARQHTGPALAVSFFIAGVAAALSACCYAGLASRCPSAGSAYHYAYICLGEGIAWLVGWALVLDYTIGGSAIARGISPNLASFFGGSDKLPVFLARQTIPGLGIVVDPCAALLIMIVTILLC

SEQ ID NO: 45328 - protein, 807 aa, Oryza sativa
MEPASQVGTGAWKMLTCTRSKGRNRYFQHGEASPFLSPVRGGGGVAISVCEEEAAAAAAPGLGRGHLLDGMSRRTTTARWVPRDRPEPAGRSGTGAPGRASHALGQMPRRRTTTTTARWVPRQGQKGEPGGSGHAAAPVDRLSALPDTLLHHVMSFLKAWEVVRTCVLSRRWRDLWASAPCVDIRLRGSGRDGAPPEDFGRFVYRLLLAREVSAPVDTLRLRSSNGEEYAETYDNDDVNIWICSAIKRNVRVIHLNGHRKDELVLEHTAFVSHHLKILKLSHIKLDGKILKQLSSQCTSLEDLELNNCPVNGGEILSVSLKKLTMVKCSITMDLSICAPNLELLCCITPYYHVPLFENLSSLVAATIMLDDSFLRRDEFLYEVEEETSDDEDDNKTTSDHCDSKMDADSDAYDDDDNDDILYDEYLNSRHGNLVDDYNYGSDIDSDDDLHEYSQIAHECRGGRYGYCHDSKRREAAGGGGMEVGRGPAGWRPVAGGLTLPSPRSGRRGSGGMGGWPAAGWEAGHFGKRVSEKLIGEVENIEYRTQKGAVYFLVEGNAHPPEEASLGLRSQLKASDHSAAAPAISSGHPLDGMSRRNTTGWPVPRGGAEPTGKPGPSAPVRAAHAFGQMPRRRTTTTARWVRRHQVHKGKPRGAATVDRLSALPDALLHHVMSFLKAWEVVRTCVLSRRWRHTWASAPCVDIRAPSSRRERGPGRDSDPPEDFGRFVYRLLLAREVSAPVDTLRLRSSNGEEYAEMYDNDDVNMWISSAIKRNARVIHLNGHREDDDLVLEHTAFVSQRLKILKLSNS

SEQ ID NO: 45329 - protein, 152 aa, Nicotiana attenuata
MAEVEYRCFVGGLAWATTDQTLGDAFSQFGEILDSKIINDRETGRSRGFGFVTFKDEKAMRDAIEGMKGQDLDGRNITVNEAQSRGSGGGGGGGGYRGGGGGGYGGGGRREGGYGGGGGYGGGRREGGYGGGGGGGYGGGRREGGYGGGSEG

SEQ ID NO: 45330 - protein, 156 aa, Zea mays
PPPLSYAAFVGSIFGYGQGLITKKGFKGSFSNAGSSAKTFAILSGVQSLVLCLLRRLRGKDDIVNAGIAGCCTGLALGFPGAPQALLQSCATFAAFSCIMEGLNKQQAAMARTLGGTAAMAVHEKCGVLPPFTLPPILDASDALASCCLALVKPKP

SEQ ID NO: 45331 - protein, 273 aa, Ostreococcus tauri
MGKRASAPTRDATPPTTTKKPLGVKDLSKFKGRRFGVDESKCTMFIRQWRWKREMKSDRERFEEAYEYPSNAMTTQISLKQRKYSTKTSVHGFASTVWDSSIVLAKYVERTLGGASSSSVKTALELGSGCGLVSCVLSRICQIPTVVATDLEHNLDLLRENLERNAPSASCAALEWGKDAALGNVKFDLVVASDVVYVEEAMPALVETLKRFCTPKHTRVVFAYGRNRQALETFLKLSRDAGFSSPRSISKTTECDELWTCTDVDLIELELER

SEQ ID NO: 45332 - protein, 500 aa, Gibberella zeae PH-1
MLQHGDNKVANHQTDNSSTDKVDYEKAVSLHEDASQEVFDEPATKRLLRKMDIKLLPFLALLYLLSFLDRTNIGNAKLAGLEEALGMTGKWDYNIAVAVFFPFYVAAEIPSNMAMKRFRPSIWIPSIMVAWAICTTLMGITHNFGGFLASRMALGLAEGGLFPGITYYITLWYKRHECGLRMAIFFSAATAAGAFGGLFARGVMEMDGVGGLDGWAWIFIIEGLLTFIFAVMAFFVMHDYPDTAKFLDDSERKEVIRRLEEDRSVLSDSFDLKFAKDALKDWKIWVHMLITIGIYTPLYSISIFLPTIVKGLGYTNEVAQLMSVPPYVVACLFTIGGGFAADKHGQRGIYMIGFCIVAIVGFIILATVEAHGAKYFGAFLITCGIYPNVPQGVAWNGNNIGGSLKRGVGIAMHVGFGNLGGAISGFVYRKDDAPNYRSGHWTLVATTTMSCILSIFMTIYLRRENARRDQTHKAPHEYTRAEKELEQDKGDNATFFRYTV

SEQ ID NO: 45333 - protein, 508 aa, Arabidopsis thaliana
MSYSNSNPENYSAATSSPELKLYQAFIFSVPICFTFIILFLFYLIYLRRSSSDLSSLGMRTTFIPGNSLSTIELGLSKELREMLPIVVFKESFTVMDSQCSVCLGDYQPNDKLQQIPVCKHTFHMDCIDLWLTSHTTCPLCRLALIPSRSRQSQDDPVPSLVSPDEEVSSQPESEPVNHRVVSTQPESEPVNHSGVSSQPESQPVVNHRGVSSQPESQPVNHINDGHEQQCDQDVEGFKEMEEDERNNIGTSSACCSCRTVHYCCVSRDNQIMYAYNNAGDHRNNESLAALCLEKTPPFHKWYFETRGKKTFGFLMKDDFVYFAIVDDVFKKSSVLDFLEKLRDELKEANKKNSRGSFSGSISFSNVQDQIVRRLIASLEFDHTCLPLSSPSIDGAEQSYASNSKAPLLGRSNKQDKKKGRDHAHSLRGIEIEEHRKSNDRGNVTECSNASSESATYVPRRGRSGGSQSIERKWRRQVKIVLAIDIAICLTLLGVWLAICHGIECTRS

SEQ ID NO: 45334 - protein, 295 aa, Pseudomonas putida GB-1
MIAGSMVALVTPMDAQGRLDWGSLDKLVDFHLENGTHAIVAVGTTGESATLDVEEHILVIKHVVERVKHSKKPIPVIAGTGANSTAEAVHLTQNAKNAGADACLLVVPYYNKPTQEGLYQHFKHIAEAVDIPQILYNVPGRTSCDMQAETVIRLSTVPNIIGIKEATGDLVRAKAILDGVSKDFIVMSGDDPTAVELILMGGKGNISVTANVAPREMADLCEAALEGNAEKARAINEKLMPLHKDLFCEANPIPVKWALVEMGLMHKGIRLPLTWLSEGCHEKVRTALRQSGVLV

SEQ ID NO: 45335 - protein, 258 aa, Alkalilimnicola ehrlichei MLHE-1
MCLLLVAWQQHPRWPLVVAANRDEFHSRPTRAAHWWHEPPILAGRDERAGGTWMGVAAQGHWAALTNYREPSRPRRGLRSRGQLVLDALQTPPASLRVDLEPAALEHDYDGFNLLFGDRERLYYVSNRDQPLRQVPPGYHGLSNGLLNDPWPKVRRGRERLAACLSGTWGERADTPPLEPLFDLLHDDRCPPDHELVDTGVSLAWERRLAPMFIRSPEYGTRCSTLLLLDEGGEIHFAERRFDPAGRVLDTRRFAFRP

SEQ ID NO: 45336 - protein, 661 aa, Medicago truncatula
MSIMRFLLSFMLLLLFLFTPTNSQTPISLNTFCNNSTKKPLTTSYKTNVNKVLQWMNTISSTGQESNLTSIGSNKNDHNDTVYGNYDCRGDIPAHFCNFCVNSAVKEISQTCTNGTSAIIFYDMCILRYSNKNFFGKINLSPSFNLTGPKKIKDSRDFAKAEGLMKDLIRKTTDANRMWATSVFDWSDTEKRYGLVQCAGDLDNNGCKECLKELIDRVAECCGTSVMWGIVAPSCGVRFDDKMFFQVSSEQPGSSSSPNPAKQEGSSNKKTLTIILVSVLMAVALLICCVFYSWRRNNRLSQGESTLSTTPLAFHGHVLRDDSLNGDLPIIPLIVLQQSTDYFSESTKLGQGGFGSVYKGTLPDGTEIAAKRLSETSGQGLEEFKNEVIFIAKLQHRNLVKLLGCCFEQNEKILVYEYMQNSSLDFHLFNSGNHDKLDWSVRLNIINGIARGLLYLHEDSRLRVIHRDMKASNVLLDDEMNPKISDFGLARRFEKGQSQTETKRVMGTYGYMAPEYAMAGLFSVKSDVFSFGVLILEIVYGKRNGEFFLSEHRQTLLLYTWKLWGEGKSWEFVDPIQRKSYIESEVMKCVHIGLLCVQEDAADRPTMSTIVLMLGSDTMVLPKPKKPAFSVGRMFNDEDSTSKSYTDNSVNELTITSFIPR

SEQ ID NO: 45337 - protein, 652 aa, Medicago truncatula
MTCTRLVSFMALFLLLFVLITSISAQTPIYMYNFCNSTQKSLSTSYQSNVNNLLLWFNSDSATGKESNHTTLGNNDDAVYGSYDCRGDIADQFCRFCINSAINEISQRCPNGVSAVIWYDICIIRYSNQNYFGKVVVTPSWNITGSNSVKDSTEIGKAVDLMRSLMRKMTEANQSWATSELNWSDTEKRYGLVQCSGDLNNDGCTECLETLFDKIHLCCGTKVTWALVAPSCGIRFDDQLFYQLTENTGSSSPVPNPAKNEGASKSKTLIITLSSVLVAVALVCFCVFVRLRKGGLIFKNIPNAIHDHVQRDDSLDGDLPIIPLTVIHQSTNYFSESSKLGEGGFGPVYKGTLPDGTEIAVKRLAEASNQGLEEFKNEVIFIAKLQHRNLVKLLGCCIEENEKILVYEYMPNSSLDFHLFNEEKHKQLDWKLQLSIVNGIARGLQYLHEDSRLRVIHRDLKASNVLLDSEMNPKISDFGLARKFESGRIETKTKRVVGTYGYMAPEYAMVGVFSVKSDVYSFGVLILEIIYGKRNGEFFLSDHRQSLLLHTWRLWCEGKCLEKIHPIHKESYIESEVMKCIHIGLLCVQEDAADRPTMSTVVVMLGSDTITLPNPKPPAFSVTRVSDEEGTTSKSSKDNYVNEVPITIVSPR

SEQ ID NO: 45338 - protein, 668 aa, Prochlorococcus marinus str. MIT 9301
MVAASVSLESLCVNSIRMLAVDAVNKSNSGHPGLPMGCAPMGYALWQNILNHNPNNPKWFNRDRFVLSAGHGCMLLYSLLHLTGYKSVSIDDIKEFRQWGSKTPGHPETFETEGVEVTAGPLGAGISNAVGLAIAETHLAAKFNKPDCKIVDHYTYVIMGDGCNQEGIASEACSLAGHLKLGKLIALYDDNQITIDGRTDVSFTEDVLKRYEAYGWHVQHVEDGNHDVKGITEAIEKAKLITDKPSIIKISTTIGYGSPNKSDTAGIHGAAVGEEEAALTREFLNWEYPPFEIPDEVYAHFRKSIDKGGSLEKEWDSKFEEYQSKYPSEGAELNRMLKGQLPENWDSDLPSYTPEDKGLATRKHSQICLGALGPNLPELIGGSADLTHSNYTDIKGESGSFQPHSPEKRYLHFGVREHAMAAVLNGIAYHNSGLIPYGGTFLVFADYMRGSMRLSALSELGVIYVLTHDSIGVGEDGPTHQPIETIPSLRAMPNMLVFRPGDGNETSGAYKLAIQNRKRPSALCLSRQGMPNQENTSIDKVALGGYVVSDCEGTPDLIFIGTGSELNLCIEASKEISSLGKKVRVVSMPCVELFEEQEDSYKESVLPSSVKKRVVVEAAHSFGWHKYTGFDGICITMDRFGASAPGGECMKNFGFTVENVVNKTKEIL

SEQ ID NO: 45339 - protein, 456 aa, Prochlorococcus marinus str. MIT 9301
MRSSWIKPRLGKDNVTQMNFARNGYITEEMDFVAKKENLPPSLIMEEVARGRLIIPANINHLNLEPMSIGVASRCKVNANIGASPNASDINEEVEKLKLAVKYGADTVMDLSTGGVNLDEVRQAIIQESPVPIGTVPVYQALESVHGSIDRLTEDDFLHIIEKHCQQGVDYQTIHAGLLIEHLPKVKGRITGIVSRGGGILAQWMLHHFKQNPLYTRFDDICEIFKKYDCTFSLGDSLRPGCLHDASDDAQLAELKTLGELTRRAWEHNVQVMVEGPGHVPMDQIEFNVRKQMEECSEAPFYVLGPLVTDISPGYDHISSAIGAAMAGWYGTSMLCYVTPKEHLGLPNAEDVREGLIAYKIAAHAADIARHRAGARDRDDELSHARYNFDWNKQFELSLDPERAKQYHDETLPEEIFKKAEFCSMCGPKHCPMNSKISDESLDQLKDKLEECSTSA

SEQ ID NO: 45340 - protein, 449 aa, Streptococcus agalactiae
MTITAEDIRREVKEKNVTFLRLMFTDILGVMKNVEIPATDEQLDKVLSNKAMFDGSSIEAFVRINESDMYLYPDLDTWIVFPWGDENGAVAGLICDIYNAEGEPFCRRFHVKFQRNMKRMNRVGYNSFNFRTRPDFLLFKLMKCNQHLIDCYCPRRPTLTLAPTDLANNNRREIVSLNTNWALKLKLVIMKLAVGQHEIDFKYDDVLKACDNIQLFKLVVKTIARKHGLYATFMAKPKFGINGSGMHCNMSLFDNEGNNAFFDPEDPRGMQLSEDAYYFLGGLMKHAYNYTAIINPTVNSYKRLVPGYEAPVYIAWAGRNRSPLIRVPASRGMGTRLELRSVDPTANPYLALSVLLGSGLEGIENKIEAPEPIETNIYAMTVEERRQAGIVDLPSTLHNALKALEEDEVVKAALGTHIYTNFLDAKRIEWASYATYVSQWEIDNYLDLY

SEQ ID NO: 45341 - protein, 354 aa, Triticum aestivum
MTMVTPRAPEPPPQDQDEEMLVPQQEVEVFEGPQPMEESMPAVDNESLPDASTSRFTWKIESISKHSGRKTHSDIFVVGGYSWRVLVFPTGNNVNHLSMYLDVADAKSLPIGWSRSAQFSLAVINQLDSKHSVRKEVTHTFNSRESDWGFTSFMPLIDLYDPSKGYIVNDQCIIEAEVAVRKIVDYWNYDSKKETGYVGLKNQGATCYMNSLLQTLYHIPYFRKAVYHMPTVDTPSGSIPLALQSLFYRLQHGDNSISTKELTKSFGWDSYESFMQHDVQELNRVLCEKLEDKMKGTIVEGTIQKLFEGHHMNYIECIGVDYKSTRKESFYDLALDVKGCSDVYASFDKYVAVE

SEQ ID NO: 45342 - protein, 248 aa, Bacteroides thetaiotaomicron VPI-5482
MKKIVLLRHGESAWNKENRFTGWTDVDLTEKGVAEAEKAGVTLREYGFNFDKAYTSYLKRAVKTLNCVLDKMNLDWIPVEKSWRLNEKHYGDLQGLNKAETAEKYGEEQVLIWRRSYDIAPNPLSESDLRNPRFDYRYHEVSDAELPRTESLKDTIDRIMPYWESDIFPALKDAHTLLVVAHGNSLRGIIKHLKHISDEDIIKLNLPTAVPYVFEFDENLNVANDYFLGNPEEIRKLMEAVANQGKKK

SEQ ID NO: 45343 - protein, 377 aa, Oryza sativa (indica cultivar-group)
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTQGNVLDSGDGVSHTVPIYEGYALPHAIPRLDLAGRDLTDYLMKILTERGYSFTTTAEREIVRDMKEKLSYIALDYDQEMETAKTSSSVEKSYELPDGQVITIGAERFRCPEVLFQPSFIGMEAAGIHETTYNSIMKCDVDIRKDLYGNIVLSGGTTMFPGIADRMSKEDHCLAPSSMKIKVVAPPERKYSVWIGGSILASLSTFQQMWIAKAEYDESDPSIVHRKCF

SEQ ID NO: 45344 - protein, 421 aa, Ostreococcus tauri
MVEQMARGEDGKFSADALEAGDDTFSALARMNSEQLNRQLSLSFLDSDEMNDMVRELRIEDDEAKKSTKNGASKRQKEAMRAMQARECATRRSGFGLSTGARGRRAVTRAVRAPELNTTRSNEIFTAAQDILPGGVNSPVRAFKSVGGGPIVFERVKDAYAFDVDGNKYVDYVGSWGPAICGHANERVNAKLKAQIDKGTSFGAPCELENILGQMVIDRVPSVEMVRFCNSGTEACLSALRVMRAYTGRDKIIKFEGCYHGHADPFLVKAGSGVITLGLPDSPGVPAAATATTLCATYNNLEEVKALFEANKGEIAGVILEPVEFLQGLRDVCTAEGAVLCFDEVMTGFRIAKGCAQEHWGVTPDLTTMGKVIGGGMPVGAYGGKREIMDVVAPAGPMYQAGTLSGNPLAMVAGIETLSIW

SEQ ID NO: 45345 - protein, 668 aa, Bacteroides thetaiotaomicron VPI-5482
MKMGTNYLAILGVTTVTTVMSCTTAKKEYMSYELYPVRTGSLIEMEYTPEATKFTLWSPTADEVRLMLYEAGEGGHAYETVKMQSGEEGTWTAVVSKDLIGKFYTFNVKIDDKWQGDTPGINARAVGVNGKRAAIIDWQSTNPDGWESDTRPPLKSPADMIIYEMHHRDFSVDSTSGVKNKGKYLALTEHGTMNSDKLLTGIDHLIELGVTHVHLLPSFDYASVDETRLNENSYNWGYDPQNYNVPDGSYATDPYQPATRVKEFKQMVQALHKAGIRVIMDVVYNHTFNTDESNFERTVPGYFYRQKEDKTLANGSGCGNETASERLMMRKFMVESVLYWIKEYHVDGFRFDLMGIHDIETMNEIRKAVNAVDPTICIYGEGWAAEAPQYPADSLAMKGNIAQIPGVAVFSDELRDGLCGPVGDKRKGAFLAGIPGGEMSVKFGIAGAIEHPQVQCDSVNYTQKPWAKQPVQMISYVSCHDGLCLVDRLKASMPDITPEQLIRLDKLAQTVVFTSQGIPFIYAGEEIMRDKQGVDNSYKSPDAVNAIDWRRKTTSADVFMYYKRLIDLRKSHPAFRMGDAGQVRKHLEFLPVEGSNLIAFRLKDHANGDHWEDIIVAFNSRPTPARLTIPVGKYTVVCKDGVIDVRGLGIQNGPEVIIPSQSALILYK

SEQ ID NO: 45346 - protein, 246 aa, Nicotiana attenuata
DLALASGKIYGGEGFKYVKGCFEKGTLHLIGLLSDGGVHSRLDQVQLLLKGAAEHGAKRIRVHALTDGRDVLDGSSVGFMEDLENSLAQLREKGIDAQVASGGGRMYVTMDRYENDWDVVKRGWDAQVLGEAPHKFKDPVEVVKKLRQEPNAHDQYLAPFVIVDDNGKPVGPILYGDAVVTFNFRADRMVMLAKALEYENFDKFDRVRVPKIRYAGMLQYDGELQLPSHYLVSPPEIDRTSGEYLV

SEQ ID NO: 45347 - protein, 426 aa, Caulobacter crescentus CB15 [sequence omitted]

SEQ ID NO: 45348 - protein, 188 aa, Debaryomyces hansenii CBS767
MTTTPNTVIVVGGPAGTGKTTIAELLATHFQCPFIEGDALHPPQNISKMSEGIPLTDEDRWDWLKELTRASVGQCIDSTNKSNIAIVSCSILKKIYREYIKQCSGESLAGEIQFKFVFLHTTLEHLFERVQNRPGHFMKSDMVSSQYSIMEIPCDDELLENGGEALPVDTTNKSPQEIYKEVVSSLKL

SEQ ID NO: 45349 - protein, 481 aa, Coccidioides immitis RS
MSSAPKSRWVEDDADTQAYLEQKKREKEKKKQAKAEKQRQLEEAQRRANPPTLASEAADANGAAESRVREGSAERPVKRRRLSIDRGDTQRVVAEDKPGALLQFPGSEWGPCRHVDNYERLNAIEEGSYGWVSRAKEVTSGEIVAIKKLKMDNTYDGFPITGLREIQTLQESRHPHIVRLREVVMGDTMDDVFLVMDFLEHDLKTLLDDMREPFLPSETKTLLLQIMSAAEFLHSHWIMHRDLKTSNLLMNNRGEIKLADFGMARYYGDPPPKLTQLVVTLWYRSPELLLGAEKYGPEIDMWSIGCIFGELLTKEPLLQGKNEVEQLSEIFKLTGPPNSQIWPGFRSLPNAKSLRLPPSSTTSSKRSTNVPLLPRSKFPYLTTAGLTLLSDLLALNPASRPTAKDCLSYPYFREDPKPKPKEMFPTFPSKAGMEKRRKRDTPEAPKRGEEAPSLDFANVFGGGGGAESGMEAGAGFTLRLG

SEQ ID NO: 45350 - protein, 763 aa, Rhodopirellula baltica SH 1
MRASRTVSPKACSIPVASCRGFVLKIVLRMSSRSRKARSKAKSQREGKTAFKNSDAGSFGDGILSGGKKNGAGPSKVGLENLNVPYPAGLPTDRPLDPEDYFEQLAIWLDLEAEAERARLAKLRQIRSQRDVESTGQAIVGLDMVDYHTGLAGRYLLDLAKPGGKDLPMNRLKVGSPVVLSMDDDPSDEGIAGVVSRRKNHSIQIATDSFPIRDQDDLKKKGVGKHGKSGQRPAVVSDRFRLDMSPDETTRLRQLAAMAKAQEIRGRSGKLRDVLLGIKTPRVDGNPIDTHDIDPESFQFELNDIDFRTELNPPQRDAVAFAMMADDVAIIHGPPGTGKTTTIAEIIAQSVERGERVLACAASNTAVDNLLERLVRLMPNVVRVGHPARVFESLQEHTLDALVESDPTSTVIKDLRRELDQILREANRPIREGGGRERKQRAELFNEAGRLRGMIRSQERSIVRAVIDRADVICTTTTIDEELLSDQSFDLVVVDESCQCTEPGMWQAILRADRLILAGDHCQLPPTVLSDDAARIGMRDSLMQRLVHRYGEKIYRRLTVQYRMNESIMRFSSDHFYDGTLIADASVKRHLLCDLPNVEENDFTSEPLLLIDTAGAGYEEELEPDGQSKLNHGEAKVILQLVKQLADLGVTGDQIAVIAPYAAQVRNLRMRLDLDGIEIDTVDGFQGREKEVVLITMTRSNPDGEIGFLSDQRRSNVALTRAKRKLIVVGDSATLCNHEFYSELFGYFEDAGAYHSVFTLDGH

SEQ ID NO: 45351 - protein, 336 aa, Debaryomyces hansenii CBS767
MTSFDPESISYFNPNVDRRVALITGGNSGVGWYTVLHLYLHGYIVYIAARSKTRVNTSINELKEEAMVIRLKYTSQQSSNERFLGELYFLDIDLLSLSSVLNAVKTFKSREKHLNILINNASVMALPYSITKDGFEIQMQTNYISPFLLTTKLLPLLESSSELFPKSGPPKIIYLSSIGHQLAFKYFNLNSTFNYRPNIVFTWFRYGLAKTCGIHFMKMLALRNPKILCMSVHPGFVMNTNLFSYWTRLPIIGILFWCLFQIFGFLFGVSSEQGSYATVRCCLDPKLSLEEDNGKYFATNGAEAEPSKIARNMNFAARTWIWTVQELSERKISIPN

SEQ ID NO: 45352 - protein, 663 aa, Desulfovibrio vulgaris subsp. vulgaris str. Hildenborough
MDRFYVTTPIYYVNAKPHLGHAYTTIVADSMRRFQRLLGKDTYFLTGTDEHGDKIVQAAEKAGVSPKDFVDGVSGQFRDLWPHLGVEYDQFIRTTDPEHKKVVQAFLQRVYDSGDIYFGEYGGHYCYGCERFYTEKELENGLCPQHQVKPEYIAEKNYFFRMSKYQGWLKQHILDNPDFIRPERYRNEVLSMLDSGALEDLCISRPKSRLTWGIELPFDTDYVCYVWFDALLNYVSALGWPDGDRFANYWPGVQHLVAKDILKPHAVFWPTMLKAAGLEPYNNLNVHGYWLVRDTKMSKSLGNVVSPLEMIDRYGLNAFRYFLLREMHFGSDASFSEEALVGRLNADLANDLGNLYSRVLSMTAKYFGGVVPAPGAYTEEDETLRALAAEAQRNFCNLFGRVRFSNALESLWELVRALNKYVDSAAPWTLFKQGDTKRLGTVMYTLLESMRKVAVHLLPVMPEAATSMLAQLGLEVNVDAVDLGNEAETWGGLQPGTTVAGASNLFPRVELVREKDEPAEVASSKGKSADGAGTAKNAKPAAVAPAPAASPAEDAGVIDFEDFQKVDIRMGTVVAVERHPNADKLLRVEVDLGEEKPRQIVAGLAAYFSPEQLQGRQVAVVANLAPRKLRGLESQGMILAVRQGEGMELVSVSGPVSPGSKVS

SEQ ID NO: 45353 - protein, 976 aa, Gibberella fujikuroi
MDHEGCQGQHPQQCCQWVSNAWSEFLDLLKNAETLDIVIMLLGYIAMHLTFVSLFLSMRKMGSKFWLGICTLFSSVFAFLFGLVVTTKLGVPISVILLSEGLPFLVVTIGFEKNIVLTRAVMSHAIEHRRIQAQNSKSGKRSPDGSTQNMIQYAVQAAIKEKGFEIIRDYAIEIVILVIGAASGVQGGLQQFCFLAAWTLFFDFILLFTFYTAILSIKLRSTVSSVMSICVWPLRMMASRRVAENVAKGDDELNRVRGDAPLFGRKSSSIPKFKVLMILGFIFVNIVNICSIPFRNPSSMSTIRTWASSLGGVIAPLSVDPFKVASNGLDAILPTAKSNNRPTLVTVLTPIKYELEYPSIHYALGSAASNPAYNDAFHHHFQGYGVGGRMVGGILKSLEDPVLSKWIVIALALSVALNGYLFNVARWGIKDPNVPEHNIDRNELARAREFNDTGSATLPLGEYVPPTPMRTQPSTPAITDDEAEGLHMTKARPANLPNRSNEELEKLLSENALREMTDEEVISLSMRGKIPGYALEKTLGDFTRAVKIRRSIIARNKAAADITHSLDRSKLPYENYNWERFFGACCENVIGYMPLPVGVAGPLVIDGQSYFIPMATTEGVLVASASRGCKAINSGGGAITVLTADGMTRGPCVAFETLERAGAAKLWLDSEAGQDMMKKAFNSTSRFARLQSMKTALAGTNLYIRFKTTTGDAMGMNMISKGVEHALSVMANDGGFDDMQIISVSGNYCTDKKAAALNWIDGRGKGVVAEAIIPGEVVRSVLKSDVDSLVELNVAKNLIGSAMAGSVGGFNAHAANIVAAIFLATGQDPAQVVESANCITIMKNLNGALQISVSMPSLEVGTLGGGTILEPQGAMLDILGVRGSHPTNPGDNARRLARIIGAAVLAGELSLCSALAAGHLVRAHMQHNRSAAPSRSTTPGSSHDARLTGHDQCPRALSVNNVDERRRYSEVKAIDE

SEQ ID NO: 45354 - protein, 444 aa, Desulfovibrio vulgaris subsp. vulgaris str. Hildenborough
MPGTRFEKDGLVIDTTIPHLGPAKIPSPLVYCHHTNDTGVPLYLDSEFIEELAGESTALNFEAAGPRRNLYFDPSKAKCAIVTCGGLCPGINDVIRAIVMEARHAYDVPAVLGIRYGLEGFIPKYRHDVVELTPDVVSDIHQFGGTILGSSRGPQSPEEIVDALERMNISALFMIGGDGTLKAASNIVQEVMRRNLKISVIGVPKTIDNDINFISQSFGFETAVYKATEAIQCAHTEAIGAMNGIGLVKLMGRESGFIAAHATLSLKEVNFVLIPEAPFTLHGEGGLLPTLERRLRARAHAVIVVAEGAGQNLLADTGKKDASGNPILGDIAQLLRAEIKAYCDERGLPHTLKYIDPSYIIRSVPANANDRVYCGFLGQHAVHAAMAGRTGMVVAKLMDRYVHLPLELVTLRRRKLNIRSDYWRAVLESTGQAELAGMVPGLDE

SEQ ID NO: 45355 - protein, 403 aa, Haloferax volcanii
MTDAASLADRVREGDLRLHELEAHADADTAAEARRLLVESQSGASLDAVGNYGFPAEAAESAIENMVGSIQVPMGVAGPVSVDGGSVAGEKYLPLATTEGALLASVNRGCSVINSAGGATARVLKSGMTRAPVFRVADVAEAEALVSWTRDNFAALKEAAEETTNHGELLDVTPYVVGNSVYLRFRYDTKDAMGMNMATIATEAVCGVVEAETAASLVALSGNLCSDKKPAAINAVEGRGRSVTADVRIPREVVEERLHTTPERGRELNTRKNLVGSAKAASLGFNAHVANVVAAMFLATGQDEAQVVEGANAITTAEVQDGDLYVSVSIASLEVGTVGGGTKLPTQSEGLDILGVSGGGDPAGSNADALAECIAVGSLAGELSLLSALASRHLSSAHAELGR

SEQ ID NO: 45356 - protein, 551 aa, Alkalilimnicola ehrlichei MLHE-1
MYQYTDEDYALVRERVDEFRDQTRRHLAGELSEDDYRPLRLMNGLYIQRLGPMLRIAIPYGTLSVRQLRALAEVARRYDRGLGHFTTRQNLQLHHLKLEDVPEVLADLAGVEMHAIQTSGNCIRNVTSDQMAGVAPDEVDDPRPWCELIRQWANLHPEFSYLPRKFKIAVSGARHDRAAVQVHDIGLRLVSGTGHAARFEVWVGGGLGRTPVIAQRLRTDLPGEQLLPYLEAILRIYNRLGRRDNKYKARIKILVRELGLARFRDLVETEYATMEKAPLRISESRYRAVAGHFDRPPVSAPAADEQGLEAQAAEEPAFGHWLRWNTELQRQPGVRAVTVCLKGGERQPGDITSDEMDAVADLAERFGQGEIRSTHHQNLVLPDIPAGDLREVWRTLAARGLAHPVVGTVSDVICCPGWKYCNLANAESIPVALAVQAELDELDYLHDLGEVRLNISGCMNACGHHHVGHIGILGVEKRGKPWYQIQLGGSSAGEVSLGKVLGPAVPQEQVAPVVGSLMARYVALREGDERFLDTVRRVGLAPFKEVLHAAA

SEQ ID NO: 45357 - protein, 212 aa, Nicotiana attenuata
SAAYYQQGARFAKWRTVVSIPNGPSALAVKEAAWGLARYAAISQDSGLVPIVEPEILLDGEHGIDRTFEVAQKVWAEVFFYLAENNVMFEGILLKPSMVTPGAECKDRATPQQVADYTLSLLKRRIPPPVPGIMFLSGGQSEVEATLNLNAMNQAPNPWHVSFSYARALQNTCLKTWGGQPENVKAAQDALLTRAKANSLAQLGKYTGEGES

SEQ ID NO: 45358 - protein, 238 aa, Bifidobacterium longum DJO10A
  misc_feature (221)..(237): Xaa can be any naturally occurring amino acid
MAINPPVDATQTPEWAALQKHYDELQVEGVSLKKWFAEDAERVEKLSFDAGDLHFDLSKNLIKPETLQLFANLAKAVKLDERTKAMYTGVHINNTEDRAVLHTALRRPVEDEGKYIVDGQDTVKDVRETLDKIYAFADDVRSGKWTGVTGRKIETVVNIGIGGSDLGPVMVYEALKPYADAGISARYISNIDPNDLAEKTKGLDPETTLFIIVSKTFTTLXXXXXXXXXXXXXXXXXP

SEQ ID NO: 45359 - protein, 450 aa, Caulobacter crescentus CB15
MTDILMPALSPTMEEGTLAKWLVKEGDTIKAGDVIAEIETDKATMEVEAVDEGVIEAILVPAGSENVKVNTLIARLKGDGEAAAPAVAAPVAEAATVVVAAPAAGGPISAASTFADPEIPTGTALKKITVRDALRDAMAEEMRRDDRVFLMGEEVAQYQGAYKVSRELLQEFGDRRVIDTPITEHGFAGMGVGAAMAGLKPIVEFMTWNFAMQAIDHIINSAAKTLYMSGGQIKSSIVFRGPNGAASRVGAQHSQDYAAWYGNVPGLKVIAPYDAADAKGLLKAAIRDPNPVVFLEHEMMYGHEFDIPDVEDWVVPIGKAKVRRQGSDVTLVAYSRMVGFALKAAEELEKEGIAAEVVDLRTIRPMDHATILESVKKTNRLVTVEEGWGPMGVGAEIVARITEFGFDYLDAPPLRVCQEDVPLPYAANLEALSLPSVEKIVKAAKAVCYK

SEQ ID NO: 45360 - protein, 300 aa, Nicotiana attenuata
GNTGYDEIRAAIKEAKAVTDKPTMIKVTTTIGFGSPNKANSYSVHGSALGAKEVEATRSNLGWPYEPFHVPEDVKSHWSRHVPEGAALEAGWNTKFAEYEKKYPEEAAELKSIITGELPAGWEKALPTYTPESPADATRNLSQQNLNALAKVLPGFLGGSADLASSNMTLLKMFGDFQKNTPEERNLRFGVREHGMGAICNGIALHSQGLIPYCATFFVFTDYMRGAMRISALSEAGVIYVMTHDSIGLGEDGPTHQPIEHLASFRAMPNILMFRPADGNETAGAYKVAVLKRKTPSILA

SEQ ID NO: 45361 - protein, 265 aa, Bifidobacterium longum DJO10A
MIFGPARFEEFLHGFHEIDEYFANTPFEKNVVVLLGMLNVWYRNFFKVASHAVLPYDQYLHRFPAYLQQLTMESNGKSVRWDGTPVTSETGEIFWGEPGTNGQHAFYQLIHQGTQLIPADFIAFVNTPNPTKDGDQDVHELFLGNYFAQTKALAFGKTADEVRAEGTPEEIVPARVFSGNRPTTSIFGVALTPFALGELIALYEHITFVEGTVWGLDSYDQWGVELGKQLAKQITPAISQDDDALAAQDASTQSLIKFYRANREF

SEQ ID NO: 45362 - protein, 332 aa, Prochlorococcus marinus str. MIT 9301
MKNKKVICIGEALIDRIRNKSNQGFTDFLGGAPANVACALRKLKIDSVFIGCLGSDDYGKKFITQFNKLDVNLDFLQLDNDSSTRVVNVDRDQFGERFFSGFEESSYSCFADEVLSKKLIAKQILNLEKSFLETKYLVTGTILLSSPISSETIFFLLEGAKAFDVKIVIDLNWRQVFWDHSSFSSEISQATRVNLIKKFLNHANVLKLAKEEATLFFEDENPFLISQQLSNRPDVIITDGKNPVTWYINGLQGITETPSSQEIVDTTGAGDAFLAGLISKLISSGYPSNEQEIEDCIKFAGACGLLTCLGEGAIEQQPYYENVNKFLGSLIS

SEQ ID NO: 45363 - protein, 474 aa, Actinobacillus pleuropneumoniae serovar 1 str. 4074
MSKEIKTQVVVLGAGPAGYSAAFRCADLGLETVIVERYSTLGGVCLNVGCIPSKALLHVAKVIEEAKHAEKNGITFGEPNIDLDKVRAGKEAVVSKLTGGLAGMAKARKVTVVEGLAAFTDPNTLVARDRDGNPTTIKFDNAIIAAGSRPIQLPFIPHEDPRVWDSTDALKLKEVPKKLLIMGGGIIGLEMGTVYNALGSEVEVVEMFDQVIPAADKDVVAIYTKQIEKKFKLMLETKVTAVEAKDDGIYVSMEGKACNDTKRYDAVLVAIGRVPNGKLIDAGKAGVNVDDRGFIAVDKQMRTNVPHIFAIGDIVGQPMLAHKGVHEGHVAAEVIAGQKHYFDPKVIPSIAYTEPEVAWVGKTEKECKQEGLNYEVAKFPWAASGRAIASECSEGMTKLIFDKDTHRLLGGAIVGSNGGELLGEIGLAIEMGCDAEDIALTIHAHPTLHESVGLAAEVFEGSITDLPNAKAKKR

SEQ ID NO: 45364 - protein, 428 aa, Caulobacter crescentus CB15
MSIDILMPALSPTMEEGTLAKWHVKVGDTVKAGDVIAEIETDKATMEVEAVDEGVVEAILVPAGTENVKVNALIAKLAGEGDSPAPAPKVEAPKAAAAAPVPAAAPAPAVPAPAAPVAADGSRVLASPLARRLASAAGLDLKALKGTGPHGRVVKSDVEAAKSGAPAAKAAPASAPAAVAPTAAAPRQIQSLEQMGIPAGSYDLVPLDGMRKTIARRMTESFRDVPHFPLTIDLEIDALLAARAKINSLLEKQGVKVSVNDIVIKAAAVALKQVPEANASYTPEGIAMHHHADIAVAVAVDGGLITPIIRKAETKGLAQISAEMKDLAQRAKDKKLKPEEFQGGTFSISNLGMFGIKSFASIINEPQGAIMSVGAGEQRPVVKNGEIKVATVMTVTLTCDHRVVDGSVGAKFLAAFRPLIEEPLTLIV

SEQ ID NO: 45365 - protein, 129 aa, Aegiceras corniculatum
LNLLGLLGGFVPDAKLGRFRTVAISGSIAALGVTLLTLATSLPSMTPPPCNSRKHETCIQATGSQLALLYAALYTLALGGGGIKSNVSRFGSDLFHPRDPKEEKAMIYFFNRFCFCISSGALLGVRAIF

SEQ ID NO: 45366 - protein, 419 aa, Bacteroides thetaiotaomicron VPI-5482
MQTIDKFNFAGKKAFVRVDFNVPLDENFNITDDTRMRAALPTLKKILADGGSIIIGSHLGRPKGVADKFSLKHIIKHLSELLGVEVQFANDCMGEEAAVKAAALQPGEVLLLENLRFYAEEEGKPRGLAEDATDEEKAAAKKAVKESQKEFTKKLASYADCYVNDAFGTAHRAHASTALIAKYFDTDNKMFGYLMEKEVKAVDKVLNDIQRPFTAIMGGSKVSSKIEIIENLLNKVDNLIIAGGMTYTFTKAMGGKIGISICEDDKLDLALDLIKKAKEKGVNLVLAVDAKIADAFSNDANTQFCAVDEIPDGWEGLDIGPKTEEIFANVIKESKTILWNGPTGVFEFENFTHGSRTVGEAIVEATKNGAFSLVGGGDSVACVNKFGLASGVSYVSTGGGALLEAIEGKVLPGIAAINE

SEQ ID NO: 45367 - protein, 685 aa, Rhodopirellula baltica SH 1
MLRELPVSRSHAACLSMQGAPQLAAPSVVDVPSAKRLVIVGGGMAAHGFCKRVIGSTQRSRFAISVYGEEPRPAYDRVNLSSLLSGRPESDLLLSPREWYEANDIDLHTGRRITRIDLQRQQIHDDQGGVQSYDHLVLATGSYPWVPPISGSDSPGVFVYRTIDDLEAIQRYVREHGAKTSAVIGGGLLGLEAAKVITDLGLATTILEVAPGLMPRQLDAQAAKVLREKVESLGVDVHVTRRTKAIEPRDGRLTLQFENAEPSQVDIVLVAAGIRPRDELARDAGLELGPRGGIAVNRRLETSDPHVFAIGECAAVDGHIHGLVAPCYRMADVLAARLAGEQTEFVDSEEAVELKLLGVPVITLGKAIGESTSGVVVTHDGKNGYRKLILEQGRVVGAASVGEWDDVNLIRMSVAQHKRLWPTQRVRFQRTGMPYAGGTGLQIHQWPGHATVCSCMGITRHQLGMAIADGHGTAAQLSAATGAGTACGTCTNLLCELVGEGPEQVNVRGSKVVLVTSVLAACLALALFLTPPLPFATSVQDSWRKIDLFWRDGFIKQVTGFSLLFLMLAALVFSLRKRVKRISFGEYGWWRAAHAAIGTAMLFGLIVHTGVRMGSNLNFVLSLTFMLLALVGGLAGIASSLESKLSGDSAMFMRAWRPKLTWIHIALFVPLPALLAGHVFSVYWY

SEQ ID NO: 45368 - protein, 466 aa, Caulobacter crescentus CB15
MSTEFDVVVIGAGPGGYVAAIRASQLGLNTAIIERENLGGICLNWGCIPTKALLKSGEVYEQLSHLGGYGLSVEKASFDFGKIIERSRGVAKNMSGGIAFLMKKHKIEVIEGEAKLEKGAPAPKVVVALKAGGSRTVQAKNVILASGARAREIPAIGAVSDGDKIWTYRDALAPKSMPKSLVVIGSGAIGIEFASFYRALGAEVTVVEAIDRIMPVEDEEVSKAAQKAFEKRGIKFRVGAKVSKIEKTKDGVAVTVEAGGKIEQLTAEKCIVAVGIAPNNDGLEALGVSLDRGHVVTDKHCRTNVPGLYAIGDIAGAPWLAHKASHEGIHAAEAIAGYKTPNVLSPIPGCTYANPQVASVGYTEAGAKAAGIEVKAGRFPFRVNGKAVASGETEGFVKTVFDAKTGALIGAHMIGHEVTEMIQGFVTAITLEATEEDLHGVVYAHPTMSEAMHEAALDAYGRVLHI

SEQ ID NO: 45369 - protein, 884 aa, Actinobacillus pleuropneumoniae serovar 1 str. 4074
MSEIERDVDPFETKEWLESLDSLIRVEGVERAQYIIDQLLDQARTEGVPVQSGVTTAYVNTIPVSAQPAYPGDHKIERRIRSAVRWNAIAMVLRSQKKDLDLGGHISTFQSAATMYEVCYNHFFKAATEKNGGDLVFFQGHAAPGMYARAYVEGRLTEEQLDNFRQEAFTDGLSSYPHPKLMPEFWQFSTVSMGLGPVNAIYQARFLKYLENRGLKDTADQKVYAFLGDGEMDEIESKGALTFAAREKLDNLIFTVSCNLQRLDGPVNGNGKIIQELEGLFTGAGWEVIKVLWGGNWDKLFAKDTSGKLAQLMMEVVDGDYLTFKSKDGAYIREHFFGRYPETAALVADMTDDEIWDLRRGAHDSEKLYAAYAKAQKSDKPVVILAHQVKGYKIPEAESKNTAHQSKKMSLESLKGFRDYFELPLTDEQVESLEYIKFAEGSEEYNYIHGHRKALNGYVPARRAKFDVEYKVPALDEFKALLAEQPRGISTTMAFTRALNILLKDKNIGKTIVPMIVDEARTFGMEGLFRQVGIYNPHGQNYTPSDRDLVAYYREAKDGQVLQEGINELGGAASWVAAATSYSVSNQPMIPFFIYYSMFGFQRVGDMMWLAGDQLARGFMVGGTSGRTTLNGEGLQHEDGHSHIQAGIIPNCVTYDPSFAFEVAVIMQDGINRMYGEKQENVFYYMTTLNEVMEQPAMPEGAEEGIRKGLYKFETVKGKGKGNVQLLGSGSIMRHVREAAQILANDYGVTSDVFSAPSFNELAREGNDAVRWNLLHPTAEQRIPYVAQVLADLPTVASTDYVKQYADQIRAFVPSKHYHVLGTDGFGRSDSRANLREHFEVDARYVVVAALSQLAKEGTVETKVVADAIAKFGLNVDRINPLYA

SEQ ID NO: 45370 - protein, 210 aa, Aegiceras corniculatum
NGKYELGCILGHGTFAKVYLARNVPSGKNVAMKVVGKEKVIKVGMMEQVKREIAVMKRVKHPNIVELHEVMASKTKIYFAMELVRGGELFAKVAKGRLKEDVARHYFQQLISAVDFCHSRGVYHRDLKPENLMLDDDGNLKVADFGLSAFADHLRQDGLLHTTCGTPAYVAPEVLGKKGYDGAKADIWSCGVILYVLLAGFLPFQDENLV

SEQ ID NO: 45371 - protein, 409 aa, Debaryomyces hansenii CBS767
MSKIEVITENVNNGHTGELQTIQYTQSQMVGHGSFGVVFETQILPSNEIAAIKRVLQDKRFKNRELQIMKLVHHRNIVDLKYYFYTNNDKSELYLNLILEFVPETLYKASHYYVSKRLSMPLLEVKLYTYQMLRALNYIHSQGICHRDIKPQNLLINPETGELKLCDFGSAKILNPAEPNVSYICSRYYRAPELIFGATNYTTKIDVWSAGCVMAELILGQPLFPGELGIDQLVEIIKILGTPSKDQIKNMNPNYMEHKFPQIKPIPLQKIFKKMSNDCIQFLIKVLQYSPHERISCITALADPYFNELRNQTTKLPNYRKLFSKQYHQNSTGGNLNHHNNANYQLFNNQPDIRDLPQLFDFDDRELSVDPLLNHILIPEFALDSLKLSSGDLQSFRPLTSEELKVTLD

SEQ ID NO: 45372 - protein, 671 aa, Methanosarcina barkeri str. Fusaro
MEGLIFIAPSAGIISLAFATFFANNVLKEHTGSKRMQEIAGAIQEGSVAYLSRQYRTIAMVSTMLMVLILFLFDDGLKVAVSFLAGAISSTAAGYIGMSVSVRANVRTAYAASSGIEKALSVAFRGGAITGLAVVGLALLGTSGFYILYGDVNLVVGFGFGASLISLFARVGGGIFTKAADVGADLVGKIEVGVPEDDPRNPAVIADNVGDNVGDCVGMGADLFETYVVTSLAAMLLGSLIVNVYENAILYPLVLGSTAIFASIISMFFVKLGREGNVMKALYKGVAGSVIISLVSFYFVTNSLMGNPGLYYAAFIGIIIMVLMVVITEYYTSTRYRPVKSIASFSETGAATNIISGLSIGFESTLLPTVVIVVGILASYFIVGGTTNPEIGLYGIAISAVAMLSTTGMVVALDSYGPITDNAGGIVQMAKLPAHIRKVTDALDAVGNTTKAVTKGYAIGSAALGALALFADYRNKVNLGGQSLNLDDPVVLAGLLLGALLPFIFSAVTMRSVGRAAFEIVNEVRRQFREVPGIMDGTARPDYGRCVDIATKAALQKMTLPGFLAILAPLLVGFLLGPKALAGLLIGLIVVGFMVALLMDNGGGAWDNAKKLIEDGAHGGKGSEAHKAAIVGDTVGDPFKDTAGPALNALIKVVNMVAILFSSLIMGKGLF

SEQ ID NO: 45373 - protein, 303 aa, Arabidopsis thaliana
MVTKTEEKQLNQLEIQVDNGGGGTWEYLCLVRNLKVRRSEKVLKHGSSILNDQKKRSALGPDEWTLNEQVAIAAMDCQCLGVAQSCIKALQTKFPGSKRVGRLEALLLEAKGLWGEAEEAYASLLEDNPLDQAIHKRRVAISKALGKPSIAIELLNKYLELFMADHDAWRELAELYLSLQMYKQAAFCYEELILSQPTVPLYHLAYAEVLYTIGGVENIISARKYYAATVDLTGGKNTRALLGICLCASAIAQLSKGRNKEDKDATAAPELHSLAAAAVEKEYKQKAPDKLQLISSALRILKT

SEQ ID NO: 45374 - protein, 472 aa, Debaryomyces hansenii CBS767
MNSGYNPGNANHITSHSNRTKNGVPTIPQPALMALNAILTIGPYKHRKDLIRESVLTKYQIIGYIAAGTYGKVYKAKSKTNGNLNSNSALMNDNVISIGNGQKEAGLQKTNNELMEDKNQLFAIKKFKSDNHLNKNNHDINGNEVIHYTGISQSAIREMSLCRELSNKNITKVVDILLENKSIYMVFEYCEHDLLQIIQYHSHPDVKPIPDFTIKSITWQILNGVTFLHKNWIFHRDLKPANIMVSSSGVVKIGDLGLARKFNNPLQSLYTGDKVVVTIWYRAPELLLGARHYTPSIDLWAVGCILAELLSLRPIFKGEEAKIDMNNKKLVPFQKNQLQKIVEVLGTPTTKNWPTITKYPEYSAFQQHFSNTYPPNLISWYKLIGRTSKQCLNLLRCLLEYDPTIRITADDALTHAFFLELPKMSENSFEGLSQKYPKRRIYTHENDIVSNLQHVNNKRHGYDDNMTRKRQR

SEQ ID NO: 45375 - protein, 213 aa, Arabidopsis thaliana
  misc_feature (119)..(119): Xaa can be any naturally occurring amino acid
MMTSSKKFEPLIILQQLFASYDIHVCLCTSKSSGWLDINLNELWSELDRNICNQWKLKPHSGSLSQVLISALVMIIGEVISSDVETYGASAHSDYGMVTLLLTDGVPGLQVCRDKSKQXPHIWEDVPGIKGAFIVNIGDMMERWTNGLFRSTLHRVMPVGKERYSVVFFLDPNPDCNVKCLESCCSETCPPRFPPILAGDYIKERFRLTYATS

SEQ ID NO: 45376 - protein, 142 aa, Glycine max
  misc_feature (66)..(66): Xaa can be any naturally occurring amino acid
LKEMITQIFATPKDHRKAKPFHDHVFVFSIVDDHIWFRNYQISVPHNEIDKVDKGGLDKMTLVEVXPRFCLNPIKMFGGSFGGPTLFENPFYVSPNQIRALEKRKKAGKYAKKVKAKVRRKMHEMENTLEPDEFADLWKGED

SEQ ID NO: 45377 - protein, 487 aa, Marinobacter sp. ELB17
MVLTLKDAALLRQQAFINGEWCAAANGRSYTVTNPSTGDRVGDVPDMGAVETTRAIDAAAAAQPAWSALTAKARAKALRKWFELILAHQEDLAQLMTSEQGKPLAEARGEVAYGASFIEWFAEEAKRVYGDVIPSHGPDKRIIVLKQPIGVVAAITPWNFPIAMITRKVAPALAAGCTVVVKPGEDTPLSALALAELASRAGLPAGTFNVVTSQDAATVGQTLCNDSRVRKLSFTGSTPVGKLLMRQCADTVKKISLELGGNAPFIVFDDADLDAAVAGLMASKFRNAGQTCVCTNRILVQDSVYDTFVEKLASAVAQLKVGDGLTEGVTIGPLINAKAVAKVKGLVAEAVEQGAILHQADNAEGLGENFYAPVILTQVTTAMSIANAEIFGPVATVFRFSNEAEAVQTANDTPFGLAAYFYARDIGRIWRVAEALEYGMVGINEGIISTEVAPFGGVKESGIGREGSKYGIDDYVEIKYLCMGGLG

SEQ ID NO: 45378 - protein, 122 aa, Desulfovibrio vulgaris subsp. vulgaris str. Hildenborough
MSKHILIVDDSKTVRNLVAFIMKKEGFKVTTAEDGLDGLEKLYSSEGVDLIISDVNMPRMDGFTFIKTVREQDTYRNLPIVVLSTEGQEKDIQMGMSLGANLYMVKPAQPEKMVKNIKMLLG

SEQ ID NO: 45379 - protein, 307 aa, Helicobacter pylori J99
MQEKRLKAIQNKIASWIKEIESGFIDALFSKIGPSKMLRSKLMLALLDEKTDAILLDKALNLCAIVEMIQTASLLHDDVIDKATMRRKLPSINALFGNFNAVMLGDVFYSKAFFELSKMGESIAQALSNAVLRLSRGEIEDVFVGECFNSDKQKYWRILEDKTAHFIEASLKSMAILLNKDAKMYADFGLHFGMAFQIIDDLLDITQDANTLGKPNFSDFKEGKTTLPYLLLYEKLNQHEQGLLISYFKQDSHEIIEWTKEKFKQHGIIEETLKIAQVYSKKALEAIKGENNLILEKLAQDVIYRTF

SEQ ID NO: 45380 - protein, 443 aa, Azoarcus sp. EbN1
MHAPSLLERSLRSVWHPCTQMKQHEALPLVPIVRGEGPWLIDAEGRRLLDGISSWWVNLFGHCNPRINAALRAQLDTLEHVMLAGFTHEPVVELSERLAALTGHRLGHAFYASDGASATEIALKMSAHYWRNLGLAEKSRFVSLAGSYHGETVGALAVTDVAIFRDAYAPLVRAGTTVPTPDARLALPGESAADVARRAAAALEAHLAEHHAQTAALIVEPLVQGASGMVMYDPEYLRLARALCDRYRVHLIADEIAVGCGRTGTFFACEQAGIWPDFLCLSKGISGGYLPLSLVLATNTVYAAFYADSATRAFLHSHSYTGNPLACRAALATLDIFEQDGVLAANRVLARQLGDAVRARFGAHPAVRQLRQRGMILAFDVATERPDFARNFFRAGLDHGVLLRPIGNTVYFMPPYILDAAHVAHLVDGAAAALAEALEPAPG

SEQ ID NO: 45381 - protein, 356 aa, Glycine max
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEDDPVLLTEAPLNPKANREKMTQIMFETFNVPAMYVAIQAVLSLYASGRTTGIVLDSGDGVSHTVPIYEGYALPHAILRLDLAGRDLTDSLMKILTERGYMFTTSAEREIVRDMKEKLAYVALDYEQELETAKSSSSVEKNYELPDGQVITIGAERFRCPEVLFQPSMIGMEAAGIHETTYNSIMKCDVDIRKDLYGNIVLSGGSTMFPGIADRMSKEITALAPSSMKIKVVAPPERKYSVWTGGSILASLSTFQQ

SEQ ID NO: 45382 - protein, 423 aa, Aeropyrum pernix
MEVLALQPTDPLEEARAQLRRAVDLLGYDDYVYEVLANPDRVLQVRVTIKMDDGTVKTFLGWRSQHNSALGPYKGGVRYHPNVTMNEVIALSMWMTWKNSLAGLPYGGGKGGVRVNPKILSPRELELLSRKYFESISDIVGVDQDIPAPDVYTDPQVMSWFLDEYNRVKRGQFFGVVTGKPVELGGLNARIVSTGYGVAVSTRVAAEKFLGGLEGRTVAVQGYGNVGYYAAKFLAEMGAKIVAVSDSRGGIYDPEGIDPEEALKVKRSTGTVANYQRGKKISTMEILELPVDILVPAAIEEVITDENADRIKAKIISEGANGPTTTAAEKILVKKGVLVLPDILANAGGVIMSHIEWVNNRMGGWITDEEALKKLEQKMVENTKTVITYWEKNLKPEENSLRDAAYMIAVERVFRAMKLRGWI

SEQ ID NO: 45383 - protein, 429 aa, Listeria monocytogenes str. 4b F2365
MQNYSKSEKAFKEAKKVLPGGVNSPVRAFNSVDASPVFMDHGKGAYITDVDGNEYIDYVLSWGPLILGHADPAVVNAITKAALKGTSFGTPTEIETELAKLVIERVPSIEIVRMVSSGTEATMSAIRLARGYTKREKILKFEGSYHGHGDSLLIKAGSGVATLGLPDSPGVTKGLAADTITVPYNDIEGAELAFQKYGEEIAAVIVEPVAGNMGVVPPIDGFLEGLRELTTKFGSLLIFDEVMTGFRVDYYSAQGYYVVTPDLTCLGKVIGGGLPVGAYGGKKEIMEQIAPAGSIYQAGTLSGNPLAMNAGFETVRQLTPQHYDVFRTLIKRMEEGLTEISARRQVPLSINKAGSMFGFFFTDQKVINFDTAKTSNLEFFRNYYREMLGQGIFLPPSQFEGVFISTMHTEKEIDKTLEAFDTTCKILRG

SEQ ID NO: 45384 - protein, 245 aa, Aegiceras corniculatum
PTKVLPSVMFDKENGGFARCADVPRKLRRTKGILVNTFTELESYTIKCLSEDHRLPPIHTVGPVLNLDVNSGKDETDLSKYGTIMTWLDSQPPASVVFLCFGSMGSFEAEQVVEIACALEQSRHRFLWALRKSPTKNTLIYPSDYANLNEALPEGFLDRTKEIGKVIGWAPQVAVLSHPSVGGFVSHCGWNSIMESLWCGVPMATWPLDFEQQINAFTMVKELELVVEIKLDYHKNNPIALSAKE

SEQ ID NO: 45385 - protein, 110 aa, Zea mays
VDGSMAELIRPSLYGAYQHIELVSPPTPGAEVATFDIVGPVCESADFLGKDRELPTPDEGAGLVVHDAGAYCMSMASTYNLKLRPPEYWEKWKKPLQAREFQLLTWILLP

SEQ ID NO: 45386 - protein, 612 aa, Parvularcula bermudensis HTCC2503
MSVLRNIAIIAHVDHGKTTLVDALLRQSGAVRDNAEMAERAMDSNDIERERGITILAKATSVEWTSPKRGETRINIVDTPGHADFGGEVERILSMVDGCVLLVDADEGPMPQTKFVLSKALGLGLQPIVVLNKVDRPTADPDRVLDEAFDLFAALGADEEQLDFPSLYASGKEGWADLSLDGPKKDLSALFETILDRVPAPALDEDAATQPFRMLATTLEADPFLGRILTGRIVSGRPEVGQQMKALDIEGTLVEQARISKVLAFRGLKRQPVDTAEPGDIVSIAGFSKASVSNTLCAPEISTPLPARPIDPPTLSVTLAPNDSPLAGREGDKVQSRVIRERLFRQAEGDVAIRVTETADKDAFEVAGRGELQLGVLIENMRREGFELSVSRPRVLLREEDGQVLEPIEEIVIDVDEEYSGAVIDTLTQRKCELREMKPAGGGKTRLVLHGPARALIGYHGQFLTDTRGTGVINRSYLEHGPHRGALESRRTGTLIANGSGDAVAYALWNLEDRGTLFIDPGTKVYEGMIIGENAKPQDLEVNPLKGKQLTNVRAAGKDDAVRLTPPRKMSLEQAISYIMDDELVEVTPQSVRLRKRYLDPHERKRHAKSAG

SEQ ID NO: 45387 - protein, 379 aa, Debaryomyces hansenii CBS767
MDIVLEIFDYYLLDKTYSSLLPKSLNTTISDSIGKLGVNELTSSFYKNYNENHNSTLASASAASNLNVPLRALMNKLQTFQNTDEVYGEVPKLFPLNDYTNDSLLLRTNMFRQAFSIFIITAIFGWLLYFSVAYVSYLTVFDKKIFNHPRYLKNQIWLEIHRASTAIPVMVLLTVPFFLMELQGFSKLYMEVNASTGGWKAILLQVPLFILFTDCGIYFIHRWLHWPSVYKILHKPHHKWIVCTPFASHAFHPVDGWAQSLPYHIYPMIFPLHKVSYLLLFTFVNFWTVMIHDGQYLSNDPIVNGTACHTIHHLYFNYNYGQFTTLWDRLGRSYRRPDDNLFVRDNKKEEEVKVWNEQTQKMEEIRGKLEGKGDDRVYH

SEQ ID NO: 45388 - protein, 292 aa, Aegiceras corniculatum
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFEAFNAPAMYVAIQAVLSLYASGRTTGIVLDSGDGVSHTVPIYEGYALPHAILRLDLAGRDLTDALMKILTERGYSFTTTAEREIVRDMKEKLAYIALDYEQELETSKTSSAVEKSYELPDGQVITIGAERFRARKVLFQPSMIGMEAAGIHETTYNSIMKCDVDIK

SEQ ID NO: 45389 - protein, 194 aa, Listeria monocytogenes str. 4b F2365
MDVNNVELIISAVRPEQYPETDLPEYALAGRSNVGKSSFINTMIRRKSMARISQKPGKTQTLNFYKIEEALFFVDVPGYGFAKVSKTEREKWGVMIETYITSREQLRGVIQIVDLRHKPTEDDRMMYEFLKYYDIPVIVVATKADKIPRSKWQKNAKIVRETLDFDPDDKFVLFSSETKMGKDEAWQFIKEGME

SEQ ID NO: 45390 - protein, 467 aa, Zea mays
  misc_feature (264)..(264): Xaa can be any naturally occurring amino acid
MAFFRGLTAVSRLRSRMAQEATTLGGVRWLQMQSASDLDLKSQLRELIPEQQDRLKKLKSEHGKVQLGNITVDMVLGGMRGIIGMLWETSLVDPEEGIRFRGLSIPECRKVLPTAVEGGEPLPEGLLWLLLTGKVPTKDQVDALSKELLARSTVPAHVYKVIDALPVTAHPMTQFTAGIMALQVESEFQKAYGNGLPKSKLWEPTYEDCLNLIARLPPVASYVYRRIFKDGKSIEADNSLDYAANLSHMLGFDDPRMLELMRLXDHEGGNISSHTGHLVGSALSDPYLSFASSVNGLAGPLHGLANQEALLWLKSIIQETGSDVTTDQLKDYVWKTLKSGKVVHGFGHGVLRRTDPRYLCQREFALKYLPEDPLFQLLSKLYEVVPPILTELGKVKNPWPNVDAHSGLLLNHFGLSETRYHTVLFGVSRSMGVGSQLIWDRALGLPLERPKSVTMEWLENYCKNKAA

SEQ ID NO: 45391 - protein, 355 aa, male-killing Rickettsia from Adalia bipunctata
GFMSTASCRSTITYIDGDKGILRYRGYDIKDLAEKSDFLEVAYLLIYGELPSSEQYNNFTKKVAVHSLVNERLHYLFQTFCSSSHPMAIMLAAVGSLSAFYPDLLNFKEADYELTAIRMIAKIPTIAAMSYKYSIGQPFIYPDNALDFTENFLHMMFATPCEKYKVNPIIKNALNKIFILHADHEQNASTSTVRIAGSSGANPFACVSTGIASLWGPAHGGANEAVINMLKEIGSSENIPKYIAKAKDKNDPFRLMGFGHRVYKNYDLRAAVLKETCKEVLKELGQLDGNPLLQIAIELEAIALKDEYFIERKLYPNVDFYSGIIYKAMGIPSQMFTVLFAIARTVGWMAQWKEM

SEQ ID NO: 45392 - protein, 355 aa, male-killing Rickettsia from Adalia bipunctata
GFMSTASCRSTITYIDGDKGILRYRGYDIKDLAEKSDFLEVAYLLIYGELPSSEQYNNFTKKVAVHSLVNERLHYLFQTFCSSSHPMAIMLAAVGSLSAFYPDLLNFKEADYELTAIRMIAKIPTIAAMSYKYSIGQPFIYPDNALDFTENFLHMMFATPCEKYKVNPIIKNALNKIFILHADHEQNASTSTVRIAGSSGANPFACVSTGIASLWGPAHGGANEAVINMLKEIGSSENIPQYIAKAKDKNDPFRLMGFGHRVYKNYDLRAAVLKETCKDVLKELGQLDGNPLLQIAIELEAIALKDEYFIERKLYPNVDFYSGIIYKAMGIPSQMFTVLFAIARTVGWMAQWKEM

SEQ ID NO: 45393 - protein, 355 aa, male-killing Rickettsia from Adalia decempunctata
GFMSTASCRSTITYIDGDKGILRYRGYDIKDLAEKSDFLEVAYLLIYGELPSSEQYNNFTKKVAVHSLVNERLHYLFQTFCSSSHPMAIMLAAVGSLSAFYPDLLNFKEADYELTAIRMIAKIPTIAAMSYKYSIGQPFIYPDNSLDFTENFLHMMFATPCEKYKVNPIIKNALNKIFILHADHEQNASTSTVRIAGSSGANPFACVSTGIASLWGPAHGGANEAVINMLKEIGSSENIPKYIAKAKDKNDPFRLMGFGHRVYKNYDLRAAVLKETCKEVLKELGQLDGNPLLQIAIELEAIALKDEYFIERKLYPNVDFYSGIIYKAMGIPSQMFTVLFAIARTVGWMAQWKEM

SEQ ID NO: 45394 - protein, 178 aa, Brassica napus
MVSHEENTSIVEWFLGPNPFTYPPYGVEMIHDEEEAYHHHHHHQTGEYYREYEEDHRSSSDVDNDEIIARTLQDDFLQLQIAEENNNGYSQQQHQEGYTNNYNNNNNEYGWNEQPALEYSTEWVGNDNEQGCDSPNVFSCSSPSDTDEYVYSWESDQCEADGEFGRRLNQMVPIPYVP

SEQ ID NO: 45395 - protein, 962 aa, Alkalilimnicola ehrlichei MLHE-1
MKLEKRKGSSAATAVGGFLGRAVDRRTFLRGSGLAVGGTAAAAAMLEPRMMRKAKASERARFDPNADIKEVKTVCTHCSVGCGVIAEVQNGVWVGQEPNFDSPINLGAHCAKGASLRNHGHSGRRTKYPMKLVNGRWERIGWEQAIEEIGDKLLQIREESGPDALWFAGSSKASNEGAYLQRKFAAFWGSNNCDHQARICHSTTVAGVANTWGYGAMTNSYNDITKSNCIVMCGSNAAEAHPVAMQMILRGKENGAKLIVMDPRFTRTAAHSDIFVRPRSGTDVALIYGILWHIFENGWEDSTYIRQRVWGMDRVREEVAHWTPEEVERVAGVGEEALRDVAKTIVDNSPMTFIWCMGGTQHTIGNNYVRAYNHLLLATGNVGVSGGGANIFRGHDNVQGATDVGPNAHILPGYFPHSEGGWRHWARVWDVDYEYLQGRFDPAEYDDGSGGQAKPMHMPGIPVSRWIDGVLEDADNLSQKDNIRAVMFWGHAPNSQTRLPEMKEAMEKLDLLVIADPYPTVSAVLHDRQNDTYLLPACTQFETRGSATASNRSLQWRDKVIEPLFEGKPDHEIAYLLARKLGFADEMFKNIRIEGTEPVVEDVLREINRGTWTIGYTGQSPERLKKHMENQATFDVVSLKAEGGPCDGEYYGLPWPCWGTAEMGHPGTPNLYDTSKHVAEGGLTFRARFGTEYEGENLLAEGSYSKGSAIRDGYPEITADMIKQLGWWDDLTDEEKAQAEGRDWKTDLSGGLQRVAIKHGLAPFGNAKARCYVWNFPDPVPVHREPLYTPRYDLVSDYPTYEDRKAFYRLPTRWASVQAQDYSGDYPLIHTSGRLVEYEGGGEETRSNPWLAELKQEMFVEINPRDANNAGVRNNEWVWLEGPEGGRIRIKALVTRRVAAGTVFTPFHFGGHFQGEDLLAKYPEGASPYVRGESNNTATTYGYDSVTMMQETKTTLCRVVPA

SEQ ID NO: 45396 - protein, 691 aa, Arabidopsis thaliana
MKIEEDLGFINILKRATKLLCGNINLVLFLFLCSLPLFCFLIFFELSLQTTVSLASQYLVRQLTNWDYYYVPQDASVLENLIPLLIQTFLLYLFPYGLIDLFTTTTIVSASWTVHTSEEEPLRFGQLVRRTVEICQNRLEGCLITSLYVLLLSTPVFFGFLFVATNYFHIISLTGSGENSYYYSINIEEDAEGYYRSSSVNSPVKMLFDAVLAMFHGAIFLGLLAMFSKWSAGWNMGLVVSVLEEEENGQSIYGTDALTLSSNYGKGHEKRGLQVMLVFLVFAIAMRMPCFCFKCTESSNGNRVLYTSFYVGLICVGNMIKWVACVVFYEDCRTSVLEKKGDVEIGSKERDQQMETKSEEKLSVIELLKRALKLLFGNINLALFLFLCSLPLFCFLIFFELSLQTTVSLASTYISKLVNSEEDLSENDLLPWLIQTTLLYFFPYTILDLLTTTTIVAASSIAYTSEEEPLGLLYLVGRSFKLCQNKVGGCLITSLYVLLLSTSVFLGLFSGSTIYLYFASLTLEQQIFFNQAVVQDQRFLEQAVVLLDVVVVLIHGTVFIVLAAKFSKWSAGWNISMVVSVLEEEEDSKGIYGSSALSLSAWYLRGQEKRDFWMMLVFLVGALVTRMPCLYYKCSESLSGNGVLYTGLYVSLICVGNVVKWVSCVVWYHDCNTRVLRKKGDVEIGSKAFAT

SEQ ID NO: 45397 - protein, 497 aa, Oryza sativa
MGKAARWFRNMWGGGRKEQKGEAPASGGKRWSFGKSSRDSAEAAAAAAAAAAEASGGNAAIARAAEAAWLRSVYADTEREQSKHAIAVAAATAAAADAAVAAAQAAVAVVRLTSKGRSAPVLAATVAGDTRSLAAAAVRIQTAFRGFLAKKALRALKALVKLQALVRGYLVRRQAAATLQSMQALVRAQATVRAHRSGAGAAANLPHLHHAPFWPRRSLVRRWLNLADDIAMYMFDVDVVCWRWMQQERCAGDDTRSEHGVAAYSRRLSASIESSSYGYDRSPKIVEVDTGRPKSRSSSSRRASSPLLLDAAGCASGGEDWCANSMSSPLPCYLPGGAPTTRIAVPTSRHFPDYDWCALEKARPATAQSTPRYAHAPPTPTKSVCGGGGGGGIHSSPLNCPNYMSNTQSFEAKVRSQSAPKQRPETGGAGAGGGRKRVPLSEVVVVESRASLSGVGMQRSCNRVQEAFNFKTAVVGRLDRSSESGENDRHAFLQRRW

SEQ ID NO: 45398 - protein, 203 aa, Triticum aestivum
HYRTSLYKKAGWYRSGIPGISSTHASEEIEDKKTELEPKVVETIEASPPEIKGLMKDKKTSKIKKNSVAVTKFLDDLAKIDFPGAKLVSDAVAKSGTTPLSPAIVFILDKVAPFVPAPKEEPKAEPEDAAPAEETTTREVAVEEKKEEAEPSAAPAEAAALEYPSRGPSLRVPSFLVQSGPYSESYYKLGTGRRFTRRDWENC

SEQ ID NO: 45399 - protein, 216 aa, Rhodopseudomonas palustris CGA009
MTDAIDPDLIERGRKMFAGDWHFIWASPSIETLPPMGSVEIAFAGRSNVGKSSLINALTGRNALARTSHTPGRTQELIFFEGPPNAGLRLVDMPGYGYAAASKAKVASWTSLIHHFLQGRATLARVYVLIDGRHGLKDVDLDILKTLDKAAVSYQIVLTKADQVKAAELAERVTATVAALAKHPAAFPEVLTTSSRTGAGMPELRAAMIRLLDERR

SEQ ID NO: 45400 - protein, 140 aa, Parvularcula bermudensis HTCC2503
MALERTFSIIKPDATRRNLTGQIIAKLEDGGLRVVAQKRIRLSEDQAKSFYAVHKERPFYSDLVSFMTSGPVVVQVLEGENAISRNREIMGATNPSEAAPGTIRAEFAENIEANSVHGSDGPDTAAEEIKFFFTDDEIVG

SEQ ID NO: 45401 - protein, 178 aa, Glycine max
MASSMISSPAVTTVNRAGAGMVAPFTGLKSMAGFPTRKTNNDTISIASNGGRVQCMQVWPPVGKKKFETLSYLPDLDDAQLAKEVEYLLRKGWIPCLEFELEHGFVYREHNRSPGYYDGRYWTMWKLPMFGCTDASQVLKELQEAKTAYPNGFIRIIGFDNVRQVQCISFIAYKPPGF

SEQ ID NO: 45402 - protein, 281 aa, Triticum aestivum
  misc_feature (166)..(166): Xaa can be any naturally occurring amino acid
  misc_feature (177)..(177): Xaa can be any naturally occurring amino acid
  misc_feature (183)..(183): Xaa can be any naturally occurring amino acid
MFRRKHTSHFNSDDAEQRQAKINELRAALGPASARGDKYCSEACLARYLEARNWNVDKSRKMLEESLKWRAASKPEDIRWPDVSVEAETGKMYRATFTDREGRTVVIMRPAKQNTSSHEGQLRYLIYTLENAVLSLPQGLDKMVWLIDFTGWTLANATPIKTARDXPNILQNHYPEXAFSYKXYSIKVFLDPKSIQKVNFVYKDNEESMKTMYKHIDPEVLPVEFGGKNIVVYNHEDYSKLMTKDDTKTTSFWAADGSHAVNGGSVPQVIPQSSPIVAKAS

SEQ ID NO: 45403 - protein, 178 aa, Glycine max
  misc_feature (178)..(178): Xaa can be any naturally occurring amino acid
MASSMISSPAVTTVNRAGAGMVAPFTGLKSMAGFPTRKTNNDITSIASNGGRVQCMQVWPPVGKKKFETLSYLPDLDDAQLAKEVEYLLRKGWIPCLEFELEHGFVYREHNRSPGYYDGRYWTMWKLPMFGCTDASQVLKELQEAKTAYPNGFIRIIGFDNVRQVQCISFIAYKPPGX

SEQ ID NO: 45404 - protein, 373 aa, Listeria monocytogenes str. 4b F2365
MTLSKGLENVYVAETSISSIIDDMLTYVGYGIDDLMENNASFEEVIYLLWHLRLPNKDEFKKFKREIQENMAVSETIITSLRMQNHQKLHPMSVLRTTVSMLGVFDTEAELDDGEAVYRKGLRLQAKMPTIVAAFSRIRRGLDPIPPREDLNMAANFLYMITGEEADALSVEAMNKALVLHADHEFNASTFTARVCVATLSDVYSGVTAAIGALKGPLHGGANERVFDMLEEIDQAGDVRNYIQEKIDTKQKIMGFGHRVYRGGDPRAQHLREMSRKLTAEKGEEKWFDISLQVEESVWELKHLKPNVDFYSASVYHALGIDRDLFTLVFSVSRVSGWLAHIFEQYRDNRLIRPRAIYVGPENRSYLPVEERI

SEQ ID NO: 45405 - protein, 318 aa, Synechocystis sp. PCC 6803
MLNPLNIEYLYLSKLFDNSLIVFNKRQLFRFFVRFFFMTAALPNDSKPKLTPAWTVIFFFTSIHLVALLAFLPQFFSWKAVGMAFLLYVITGGIGITLGFHRCISHRSFNVPKWLEYIFVICGTLACQGGVFEWVGLHRMHHKFSDTTPDPHDSNKGFWWSHIGWMMFEIPAKADIPRYTKDIQDDKFYQFCQNNLILIQVALGLILFALGGWPFVIWGIFVRLVFVFHFTWFVNSATHKFGYVSHESNDYSRNCWWVALLTFGEGWHNNHHAYQYSARHGLQWWEVDLTWMTIKFLSLLGLAKDIKLPPETAMANKA

SEQ ID NO: 45406 - protein, 861 aa, Debaryomyces hansenii CBS767
MTFPILPIISSSNKEAIAEFSVVGQILLPLESVSISKHFLHQFPNYIDVNVDTTSSKVDIDQIVELLNSGIKQVFIKESQIEEFILSGGLPSSRFAIKFDSSKVSDTALETDSAFVFNCELAKDDAKKYSQSGNRGLYYENPSITQELANKLATEDIYPIIASESLTTASSESGKISISSLFTAGLTTDRPDGLFTTLITTPAPSYTALGIVYSSVESIHASIAEKQGVYQSRKRRDELWYKGKTSGATQKLVKLEKDCDSDVVKFIVEPREGYGFCHLDKNFTCFHDGELKQKGESFGKGLARLDNTLQDRFQSAPEGSYTKRLFNDEPLLIAKLKEELDELIEAGQSSSKDTNEVAWECADLFYFAMVWCIKNGVRLADVERNLDIKSGKVTRRKGDAKPAYLKTDNEKSEQSNEEYKMETIYVNDKTTDPKDIAKALNRPVQKTADIMKLVLPIIDKVKKDGDKALLELTSKFDGVKLKSPVLSAPFPADLMDISEEMKEAIDLSMTNIEKFHAAQLPKEKIMTVETAPGVYCSRFAKAIENVGLYVPGGTAVLPSTAMMLGVPAKVAGCSNIIVATPPSRSTGKLTPEVVYVAHKLGAKCIVMAGGAQAVTAMAYGTESVLKCDKILGPGNQFVTAAKMHVQNDTQALCSIDMPAGPSEVLVIADSEADADFVASDLLSQAEHGVDSQVILVGVGLTKEKLNEFESAVKKQAQVLPRKDIVAKCLSHSYTLLVDTYDEAFKLSNKYAPEHLILQVENARSFVPDYIENAGSVFVGGLSPESCGDYSSGTNHTLPTYGYARQYSGVNTATFQKFITSQDVTEEGLKSIGKAVMTLAEVEGLEAHRNAVHVRMEKLGLL

SEQ ID NO: 45407 - protein, 1177 aa, Marinobacter sp. ELB17
MIAGAQLSPSESKAISARASDLVRGVRKSAKPTIMEKFLAEYGLTTKEGVALMCLAEAMLRVPDATTINDLIEDKITSGCWGDHVGRASSSLINTATIALLMTSNLLKDSERKNVGETLRKLLKRLGEPVIRTVASQAMKEMGRQFVLGRDIKEAQKASEGYMKKGYTYSYDMLGEAARTDHDAQRYYNAYSDGIDSIAKHCSGDVRKNPGISVKLSALLARYEYGNKERVMKELVPRAMRLVKKAAAANMGFNIDAEEQDRLELSMDVIEALLSDPELAGWNGFGVCVQAYGKRAPFMLDWLYGIAEKYDRRIMVRLVKGAYWDAEIKRAQVMGLDGFPVFTRKACSDVSFLSCSTKLLNMTDRIYPQFATHNAHSVSAILELARVRGEANYEFQRLHGMGESLHGQVMGDSGVPCRIYAPVGPHHELLAYLVRRLLENGANSSFVNQIVDEDIPPEMIAKDPIDLVKEMGDDISSKAIVRPAKIFGEHRRNSKGWDLTDSATIEAIDQGRDAYKEHHWKGGPLIAGKVSGTEAQVVRNPANPEDLVGHVTQANEADIETAISAAQKGFKSWSATPVEERAACLRKVADLYEENTLELFALATREAGKSLSDAVAEIREAVDFAHYYANEGVRYENSGEAIGPVVCISPWNFPLAIFTGQILANLVAGNVVLAKPAEQTSLLAVRAVELMHKAGIPKDAIQLVPGTGATVGAGLTSDSRIAGVCFTGSTNTAKVIDKAMAENMAPDAVLVAETGGLNAMIVDSTALPEQVVRDVLASSFQSAGQRCSALRMLYVQKDIADSLLKMLYGAMEELGIGDPWLLSTDVGPVIDEPSAKKIIDHCKKFENKNQLLKKLSVPHKGNFVSPAVIKVNGIGDLEEEIFGPVLHVATFDAKDIDKVVDDINAKGYGLTFGVHSRVDSRIDRISRRIKVGNIYVNRNQIGAVVGSQPFGGEGLSGTGPKAGGPQYVRRFMKGETVQRPAESGGKKVDARALESLIGKLGRMNTQVPKARVEAMQSVFDSVPEPLDAHEEVMPGPTGESNVLTNHARGTVLCLGPDKDTAIEQMIMALAQGNKAVVVAPGVSDTVDRAAKAGLPVVGVEGQLEPDALETVKGFEAVVSCGEHSVLKPYRQALRKRDGALLPLITEHKLDQRYVIERHLCIDTTAAGGNASLIAASE

SEQ ID NO: 45408 - protein, 250 aa, Mycoplasma penetrans HF-2
MKKLIIANWKMFKTLNDIKTFKEEFDKNIKNVKVNADYSVGVPSIYLNQAKEILKGIKVIAQDAHFKNEGAYTGNISWSQLKDCGIDGSIIGHSERRQMFNETDETVNLKTISLVENNMQAVVCVGETLEEYEANKSFDVVWNQTKKALANVSEAQLKNVVIAYEPVWAIGTGKVPTGKEVDDLIQKVRDELSKLYSKQAVESLVVLYGGSVNDKNAEEFFKQKNINGALVGSFCLKAENFVKLIELGGN

SEQ ID NO: 45409 - protein, 425 aa, Alkalilimnicola ehrlichei MLHE-1
MEHVIVGAGPAGVVAAERLRKLDPQADIRLLTGEPEPPYSRMAIPYYLVDQIPESGTWLRKQQDHFERQRIEVRQAMVTGLDPDQRRLSLADGQSLGFDRLLLATGSSPVIPPLPGMEREGVHTCWTLADARAILQRARQDARVVLIGAGFIGSIILEALVKRGTQLTVVEQGDRMVPRMMDAEAGDLIRRWCEQRGVSVRTSTTVTGVDDGPGDHPLAVVLDGGEQLPADLVIVSAGVRSNTAFLEGSGLEIDQGIRVDHRLCTNRAGIYAAGDVAQGPDFSTGGWSVHAVQPTSVDHGQVAASNMAGRDRRYHGSLLMNVLDTLGLISTSFGQWEGVDGGDSVALLDRERYRYLRLQFQDDLLVGANSLGLTEHVGVLRGLIEGQVRLGPWKKRLQTDPTRLMEAYLGSTQAIGRPNPRRAPA

SEQ ID NO: 45410 - protein, 506 aa, Mycoplasma penetrans HF-2
METKMKKGPVLLAVLDGYGFSKDTKGNAILNAKTPFMDNLVKEYDHCYIEASGEYVGLPDGQIGNSEVGHLTIGAGRIVYTGLSLINQDIKTKKFDSNKTLLEAINHAKKNNSNIHIMGLLSPGGVHSNEQHIFEMIRIVSENGLKPVIHVFGDGRDVAPQSIISSLERLNDVLKKYPGTIATISGRFYSMDRDKRWERTKQAYDNLLGISNNYFDNPIDYVNKQYSENIFDEFLVPARINDSNVVIKDNDAVIHANFRPDRARQISHLFCGSTVYEEKNDHPLKNLYYAIMMTYEGITPTSILFPTVVVKNTFGEVVANSGLTQLRIAETEKYAHVTFFFDGGVEVDLKNESKILVDSKKVKTYDEVPAMSAVEITDKLIENLDKFDVIVLNFANADMVGHTGKYNEAVLAIEALDSQLARIDQKIKELNGTMFITADHGNAEVMLDDDNNPVTKHTTNPVIFISNNKDVKFNKPGSLGNVAPTILDFMGLEIPADMDKKSLLKK

SEQ ID NO: 45411 - protein, 865 aa, Oryza sativa (japonica cultivar-group)
MVPPSAAAAVARARTLLCVPATARAPREMAAEFAAAAALGADVAELRLDRLAGFAPRRDLPVLLAQPRPLPALVTYRPKWEGGEYEGDDEPRFEALLLAMEMGAEYVDIELKVADKFMKLISGKKPETCKLIVSSHNFENTPSTEELENLVAQIQATGADIVKIATTATEIVDVAKMFQILVHCQEKQVPIIGLVMNDRGFISRVLCPKFGGYLTFGSLEKGKESAPAQPTVTDLINVYNIKQIGPDTKVYGIIGKPVGHSKSPILHNEAFRSVGLNAVYVPFLVDDLANFLNTYSSPEFAGFSCTIPHKEAAVRCCDEVDPIAKDILEPFNKSRVTFVSNNFVQDIGAVNTIIRKPNGKLVGYNTDYVGAISAIEDGIRASQPTDTTTSPLAGRLFVVIGAGGAGKALAYGAKEKGARVVIANRTFARAQELGNLLGAPALTLAELENYHPEEEMILANTTAIGMHPNVNETPLSKQALKSYAVVFDAVYTPKETRLLREAAECGATVVSGLEMFIRQAMGQFEHFTGMPVVDCKFRALANSLDNPDAMKAAGITAHKARLWLHERSGDLIEFHPRSGRGMQPGHGGALYHFGTSGAAVAAATAVTHPLALGSVRYSSSSVGLGNGSKEIGLQNWGADDSGLVSSIRYVIKVRLQMQLAGQRGNLVGMGTIFTQMVQVEGPRSLYLGLAPALTRSVIYGGLRLGLYEPCKYVCNYAFGSTNFAFKFASGVIAGALATALTNPTEVLKVRSQMSPSRTSTIGVLKKIVAEEGVKALWKGVGPAMARAGCLTASQMATYDEAKQRECKGARVYRNGFHCGYQVVVTEGVTSLYKGGFATFARLGPQTAITFVVCEKLRELAGMTAI

SEQ ID NO: 45412 - protein, 450 aa, Mycoplasma penetrans HF-2 [sequence omitted]

SEQ ID NO: 45413 - protein, 300 aa, Prochlorococcus marinus str. MIT 9301
MITDKTECNNPLFGRILTAMVTPFTENGDVDYELAIKLSNYLFENGSDGIVLCGTTGESPTLSWAEQHELFIAVKGSLDASCKVIVGTGSNCTSEAVEATKKAYDSGADGALVVVPYYNKPPQEGLYKHFSSIAKSAKDLPLMLYNIPGRTGCNLLPDTVKKLMDFSNILSIKAASGRIEEVTELRAICGSELSVYSGDDSLLLPMLSVGAVGVVSVASHLVGLQLKEMIYSFQSGKVSNALAIHEKLQPLFKALFMTTNPIPIKAALELSGWDVGNPRSPLSPLTNDMKKQLSFILKSL

SEQ ID NO: 45414 - protein, 485 aa, Arabidopsis thaliana
MAMASLYRRSLPSPPAIDFSSAEGKLIFNEALQKGTMEGFFRLISYFQTQSEPAYCGLASLSVVLNALSIDPGRKWKGPWRWFDESMLDCCEPLEVVKEKGISFGKVVCLAHCSGAKVEAFRTSQSTIDDFRKFVVKCTSSENCHMISTYHRSVFKQTGNGHFSPIGGYNAERDMALILDVARFKYPPHWVPLKLLWEAMDSIDQSTGKRRGFMLISRPHREPGLLYTLSCKDESWIEIAKYLKEDVPRLVSSQHVDSVEKIISVVFKSLPSNFNQFIRWVAEIRITEDSNQNLSAEEKSRLKLKQLVLKEVHETELFKHINKFLSTVGYEDSLTYAAAKACCQGAEILSGSPSKEFCCRETCVKCIKGPDDSEGTVVTGVVVRDGNEQKVDLLVPSTQTECECGPEATYPAGNDVFTALLLALPPQTWSGIKDQALMHEMKQLISMASLPTLLQEEVLHLRRQLQLLKRCQENKEEDDLAAPAY

SEQ ID NO: 45415 - protein, 251 aa, Bifidobacterium longum DJO10A
MTKKIAVLTGAGISTSAGIPDFRGPDGVWTKHPDQMSVYDIDLFLRNKEDREYSWRWQKESPVWNAQPGTAHKALVKLEQAGMLTLLATQNFDALHEKAGNSDNVIVNLHGTIGTSHCMKCHQEYATADIMARLDEEPDPHCHRKLKYRGDMPCNGIIKTDVVYFGEALPDGAMEKSYSLATKADELWVIGSTLEVYPAASIVPVAAQAGVPITIMNMGHTQYDHLASRLIHEDIAVALPKLVDETIAENK

SEQ ID NO: 45416 - protein, 406 aa, Escherichia coli B
MAIEQTAITRATFDEVILPIYAPAEFIPVKGQGSRIWDQQGKEYVDFAGGIAVTALGHCHPALVNALKTQGETLWHISNVFTNEPALRLGRKLIEATFAERVVFMNSGTEANETAFKLARHYACVRHSPFKTKIIAFHNAFHGRSLFTVSVGGQPKYSDGFGPKPADIIHVPFNDLHAVKAVMDDHTCAVVVEPIQGEGGVTAATPEFLQGLRELCDQHQALLVFDEVQCGMGRTGDLFAYMHYGVTPDILTSAKALGGGFPISAMLTTAEIASAFHPGSHGSTYGGNPLACAVAGAAFDIINTPEVLEGIQAKRQRFVDHLQKIDQQYDVFSDIRGMGLLIGAELKPQYKGQARDFLYAGAEAGVMVLNAGPDVMRFAPSLVVEDADIDEGMQRFAHAVAKVVGA

SEQ ID NO: 45417 - protein, 119 aa, Oceanicola granulosus HTCC2516
MEAYDPDNIFAKLLRGEIPCDKVMETEHSLAFRDIRPQAPTHVLVIPKGAYASLDVFCQTASEAEIVDFMRTVGEVCRQQGVEEGFRLIANARTHGVQEVPHLHVHILAGRRLGPMLSL

SEQ ID NO: 45418 - protein, 292 aa, Zea mays
  misc_feature (201)..(201): Xaa can be any naturally occurring amino acid
  misc_feature (268)..(268): Xaa can be any naturally occurring amino acid
  misc_feature (270)..(270): Xaa can be any naturally occurring amino acid
  misc_feature (276)..(276): Xaa can be any naturally occurring amino acid
TQRVREEPSRWFQGTADSIRKFIWVLEDYYSHKSIDNIVILSGDQLYRMNYMELVQKHVEDDADITISCAPVDESRASKNGLVKIDHTGRVLQFFEKPKGADLNSMRVETNFLSYAIDDAQKYPYLASMGIYVFKKDALLDLLKAVLDHSVQACIFTGYWEDVGTIKSFFDANLALTEQPSKFDFYDPKTPFFTAPRCLPXTQLDKCKMKYAFISDGCLLRECNIEHSVIGVCSRVSSGCELKDSVMMGADTYETEEEASKLLLAGKXPXGIGRTXKDKDCIIDMNARIGKN

SEQ ID NO: 45419 - protein, 644 aa, Solibacter usitatus Ellin6076
MCGIAGFVTVQPSDSPSIIERMTDTIRHRGPDDFGFYRDPWASLGFRRLAIIDVSGGHQPMPNEDQSKFIIFNGEIFNHASLRPALEQAGHRYSNRSDTETILHSYEQYGADCVLRLRGMFAFAIWDKNTRKLFCARDRLGKKPLYYFWDGRTFAFASEIKALFEHPSISPQFEESLLPEYLAFGYVSEDRTLFRGIRKLMPGHHLTLHLGAPNPQPVIRQYWEIPDPQPEQRDDASWISECRDRMEQTVQMRLMSDVPLGMFLSGGVDSSAIAALMKRNFSGPVKTFAVGYQEAEFSELSYARHVAGAIGTDHHEVVVGMEDFFNALPRLIWHEDEPITWPSSVSLYFVSKLAREHVTVVLTGEGSDEMFGGYARYRFYAMNERWMRFYRILPRAVRTAIRSQVATTSLLSSTLRRKLQHTFVGRAEDLESLYLDNFYSAFSQSQQRDLFPALAATSPYANFRRYWDSKPGLNPLPRMLFADQKTYLIELLMKQDQMSMATSIESRVPFLDHEFVEFSTRVPEHMKLRNGEGKYIVKKAIEGLVPHEIIYRKKMGFPTPLRQWLLDPRAAHLFDMMRAKDGLLASCIDPARLDDLLLRQTSGREDVTDRIWRLLTLQLWGDMFFTGKREERWDGLMAAARPAV

SEQ ID NO: 45420 - protein, 347 aa, Triticum aestivum
LLISLRALFKQRPLHDVADITKGEERVRIPIVNEFGSDSCPPLFYYIRKNLIFQSAYVNTSLARIGDEDCCADCSGNCLLESHPCACARSTGGEIAYTPEGLVRAELIDECIAVNHFPEKDNKFYCKACPLEIYKTKPSPDPCKGHLARKFIKECWGKCGCGKQCGNRVIQRGITCNLQVFFTNEGKGWGLRTLDGLPKGAFICELVGEVLTSSELYERKAKNSKHVDQVLLDASWGSEGVLRDEEALCLDLTFYGNVGRFVNHRCYDANLVIIPVEVETPDRHYYHLALFTAKKIEAFEELTRDYGIDFDGTDDLNKAFDCMCGSKYCRGGPKNSRKRTRASASRN

SEQ ID NO: 45421 - protein, 608 aa, Triticum aestivum
  misc_feature (167)..(167): Xaa can be any naturally occurring amino acid
  misc_feature (426)..(426): Xaa can be any naturally occurring amino acid
MDDKTGVEVKDKGSDGMSQDEDGGTGDNDSSGNVEYIENEKADLIDELMVDDLKDAENLPPIPSLDEFMLGLDSEPPFENLSAGTPQKDLSDSDEPSSTLESEKLPETEDKQSAQKKARSARGGPALQGKSESKSESPKQKSESPKQKVGSELVPDVPRDGELIKSXSPEKVESKEPAAASANMSNPVSTVNHKTTAGPMIRESIWEGAIQLTLSSLTNVVAIFKSGEKPSGKEWSSLIEIKGRVKLSAFQDFLEQLPKSRSRAIMVTELCWKEGSSESGRQQLSQTIDSYIADERVGLAEPADGLELYLCPPQGKTVEILSQHLPKEHLGGLAVAETSIIGIVVWRRPSVPRVSSHQRHDGSKRQSAPRKPQVTGSTSAHRPSAPQNSHGVPPGFPNQRHHQHQEEDVTDDDVPPGFGPGVVARXDEDDLPEFNFVNPAANVTTHAFKGQRHVCSSDLEVCLLGSVAPCVLYGSNVERLAAAPGTFANSCLPYTGLYMLGNSLFGWNCLAPWFSHPTRRAIRRRYNLEGSFEAFTRQCGCCGGLAEDEERREHLEVACDLATHYFCHPCALCQEGRELRRRVPHPGFYGRSVVVMMPPTEQTMGRAM

SEQ ID NO: 45422 - protein, 518 aa, Arabidopsis thaliana
MADSTRPLLSDFNSSESNLPPPRSLEETIERCIGDFGWAQFLQAALVSFAWFFDAQQTFITVFTDSQPMWHCDNSDRVDSVCNTSSSNLCTLPNQTWSWDLNPHVSIISEWGLQCAGSFLKGFPASSFFLGCLIGGLALSTLADSSLGRKNMLLLSCLIMSLSSMLTAFSTSIWVYAFLRFLNGCGRATIGTCALVLSTELVGKKWRGQVGAMGFFCFTLGFLSLPMLGYINEGNSWRNLYVWTSIPTLIYCCLVRSFVRESPRWLIVKGRKEEAVSILQSIASNAITMSFTNLCFEVENDQSKSNPDVYDALKILVRKSWSFRRLLAAMVVGFGIGMVYYGMPLALTNLNFNLYLGVVFNALSEFPAFLITFFFIDKINRRDALIGFTALSGISSALIAVLGQQLGSLQIVLELVSFFSACTAFNMTLIYTIEMFPTCVRNSAISMVRQALVFGGVFSPVMVAAGRENQFWSYGLFGLIIGLCGLFVFGLPETRGSVLCDTMDEEEYKTLAKRQFIG

SEQ ID NO: 45423 - protein, 471 aa, Zea mays
MGDGRTGGANRPAWLQQYELIGKIGEGTYGLVFLARLKPPHPAPGRRGPPIAIKKFKQSKEGDGVSPTAIREIMLLREINHENVVKLVNVHINHADMSLYLAFDYAEHDLYEIIRHHREKLSSSINPYTVKSLLWQLLNGLNYLHSNWIIHRDLKPSNILVMGEGDEHGIIKIADFGLARIYQAPLKPLCDNGVVVTIWYRAPELLLGGKHYTSAVDMWAVGCIFAELLTLKPLFQGVEAKNPPNPFQLDQLDKIFKVLGHPTVEKWPTLANLPWWQNDHQHIQGHKYENPGFHNIVHLPPKSPAFDLLSKMLEYDPRKRITAAQALEHEYFRMDPLPGRNALLPSQPGEKIVQYPIRPVDTTTDFEGTTSLQPTQPPSGNAPPGGQSVARPMPRQMPQQPMVGGIPRVAGGVTMAAFNAASQAGMAGLNPGNMPMQRGAGGQSHPHQLRRKADQGMGMQNPGYPQQKRRF

SEQ ID NO: 45424 - protein, 104 aa, Xanthomonas oryzae pv. oryzae KACC10331
MSMQFSSPYGSVADSYKARPTYPTELFDWLAGQVSQCVLAWDCGCGSGQGSQDLARYFDGVVATDVSHEQISRASSNSKVEFRATPAHISGLDDASVDLVLLCY

SEQ ID NO: 45425 - protein, 356 aa, Triticum aestivum
  misc_feature (123)..(123): Xaa can be any naturally occurring amino acid
  misc_feature (167)..(167): Xaa can be any naturally occurring amino acid
  misc_feature (263)..(263): Xaa can be any naturally occurring amino acid
  misc_feature (317)..(317): Xaa can be any naturally occurring amino acid
MHPTRWELSHMVDLQAAALVISVVAAEVGKMFGFVHLYNGQEAVSTGFIKQLNQPDCVVSTYRDHVHALSKGVPARAVMAELFGKATGCCRGQGGSMHMFSEPHNLLGGFAFIGEGIPVATGXAAFAAKYRHEVLKQSSPDGLDVTLAFFGDGTCNNGQFFECLNMXAQLWKLPIIFVVENNLWAIGMSHLRSTSDPEIWKKGPAFGMPGVHVDGMDVLKVREVAKEAIDRARRGEGPTLVECETYRFRGHSLADPDELRRPXDEKSHYAARDPITSLKKYIIEQNLASEAELKSIEKKIDDVVEEAVEFADASPLXPPRSQLLENVFADPKGFGIGPDGKYRCEDPKFTQGTAQV

SEQ ID NO: 45426 - protein, 462 aa, Escherichia coli B
MTANSPLQRIGQEKGIAMGSQELQRKLGFWAVLAIAVGTTVGSGIFVSVGEVAKAAGTPWLTVLAFVIGGLIVIPQMCVYAELSTAYPENGADYVYLKNAGSRPLAFLSGWASFWANDAPSLSIMALAIVSNLGFLTPIDPLLGKFIAAGLIIAFMLLHLRSVEGGAAFQTLITIAKIIPFTIVIGLGIFWFKAENFAAPTTTAIGATGSFMALLAGISATSWSYTGMASICYMTGEIKNPGKTMPRALIGSCLLVLVLYTLLALVISGLMPFDKLANSETPISDALTWIPALGSTAGIFVAITAMIVILGSLSSCVMYQPRLEYAMAKDNLFFKCFGHVHPKYNTPDVSIILQGALGIFFIFVSDLTSLLGYFTLVMCFKNTLTFGSIIWCRKRDDYKPLWRTPAFGLMTTLAIASSLILVASTFVWAPIPGLICAVIVIATGLPAYAFWAKRCRQLNALS

SEQ ID NO: 45427 - protein, 890 aa, Rhodopirellula baltica SH 1
MTATMAKKDKMVYYFGKTKTEGKGGSKAILGGKGLNLAEMTSIGLPVPPGFTITTEVCDGYYKAGKKLPKGLMDEIQDAVKILEKELGKNFGDNENPLLVSVRSGAAVSMPGMMNTILNLGLNDEATEGLAKATKNERFAYDAYRRLINMYGDVVMGLHHEQFEAAFDKVKKKHNVTEDTEVPAEGLRELCEAYKAVYKKGTGEDFPQDPIKQLQLAIEAVFGSWNADRAISYRRIESAKGNTEINNLIGTAVNVQAMVYGNMGDDSGTGVGFTRDPNTGQNKFYGEFLINAQGEDVVAGIRTPQPVAQMAKWDKAAHKELMEIKKKLEDHYTDMQDIEFTIERGKLFMLQTRNGKRNGIAAVKIACDMVKEGLITEKEAVLRVPASDLTHCLLPSFKPTARNAADVLCRGLNASPGAAVGKLAFTAPEARERFEAGEDVILVRRETSPEDVEGMSAAVGILTSTGGATSHAAVVARGWGKCCVAGASEVEINEKGKTITVGGRKFTAKDTISLDGTTGEVMAGEVETQEPKLSGDFAKLMEWADQYRRLSIRTNADSPADSKRARDFGAEGIGLCRTEHMFFEADRIIHMRAMILAEDEDARRAALKKLLPFQRKDFEGIFKAMKGCPVTIRLLDPPLHEFLPHEAAAQKQMAEELGVKPAEIKKRGEALHESNPMLGHRGCRLSVTYPEILEMQVQAIVEAAISCAKKKIDAQPEIMIPLVGTAAELRILREKVEETIEATKTAKKFEGELNILIGTMIEIPRACLTADEVAEYADFFSFGTNDLTQMTFGYSRDDVGGFLPDYIEAKIVPVDPFQSLDTSGVGQLVEMGVTKGRSIKKKLKVGICGEHGGDPASIEFCNSVGLDYVSCSPFRVPIARLAAAQAALKA

SEQ ID NO: 45428 - protein, 250 aa, Zea mays
MAGAAAAAAAVASGISIRTVAAPKISRAPRSRSVVRAAVSLGEKAYTVQKSEEIFNAAKELMPGGVNSPVRAFKSVGGQPIVFDSVKGSHMWDVDGNEYIDYVGSWGPAIIGHADDEVNAALIETLKKGTSFGAPCALENVLAQMVISAVPSIEMVRFVNSGTEACMGALRLVRAFTGREKILKFEGCYHGHADSFLVKAGSGVATLGLPDSPGVPKGATVGTLTAPYNDAEAVKKLFEDTKGEIAAVFP

SEQ ID NO: 45429 - protein, 1108 aa, Oryza sativa (japonica cultivar-group)
MVTPRAPELLQQDQDEEMLVPDQDVVVEGPQPMEDSGSTVENEQVPETSTSRFTWTIEDFSNHRKLYSDVFVVGGHKWRVLVFPTGNSVQSLSMYLDIADANEQPHGWSKYAQFSLAVINQLDSKYSLRKEAAHHFSTRESDWGFTSFMHLGDLYDPTKGYIVNDKCIIEAEVAVRKIVDFWNYDSKKETGYVGLKNQGATCYMNSLLQTLYHIPYFRKAVYHMPTTENDTPCGSIPLALQSLFCKLQHSDNSVSTKELTKSFGWDTVDSFLQHDVQELNRVLCEKLENKMKGTTVEGTIQQLFEGHHMNYIECINVDYKSTRKESFYDLALDVKGCSDVYASFDKYVEVERLEGDNKYQSEKHGLQDAKKGMLFIDFPPVLQVQLKRFEYDFVRDTMVKINDRYEFPLQLDLDKDDGKYLSPEADRRVRNLYTLHSVLVHSGGGHGGHYYAFIRPALSDIWYKFDDERVTKEDMKRALEEQYGGEEELPHTNPGLNTTPLRFTKHSNAYMLVYIRESDREKIICNLDENDIPEHLKIRLRKENEEREYKKKEKAEAHMFTALKVARDSDFAEQIGKHIYFDLVDYDNIQSLRAPKHLTINQAKVDLSKEFGIPVQSQRFWLWAKRQNHTFRPVRPLTLQEEASSIGHLTDPSNKSLNSELKLFLEVALGQENHPISVPPKTKDDILIFFKLYDPEKEELRYVGKLLVKASGKPADIVQKLQEMAGFQSDEDIELYEEVMFEPSVMCEPININDSFLSSQLEDGDIICYQKRCSPEKLDHYRCADVPSFFEYIQNRQVVHFRLLENPKDDDFTLELSKRFTYDDVVEKVANQLGLDDPSKLRLTQHLPYSQMPKSHYIKYRGLDHLSDMLRNGNQMSDILYYEILDIPLPVLQDLITLRVAFYHATNNEVSSHFIRLPKGSTMSDLIEDMKSKVELSYSDAEFRLFEVYKNKIRKVYQPSEKISVNEFNGLLCVEEVPEEEKNAGVRDRLVHVCHFIIEKQHIDYYGEPFFFLIRDGETLSDIKVRIQKKLLVSDEQFAKWKFAYIAHNRLAGEYFQDSDIVLSRFQKDVYGPWEQCLGLEHSDVTPKRSCLSNQNRNSFDKAVKIFN

SEQ ID NO: 45430 - protein, 60 aa, Glycine max
SATSDISSKLLDICNAFSSELSRLNQANLPLKCALHNLDSASSQQYLRACSLLDHWRQHV

SEQ ID NO: 45431 - protein, 630 aa, Alkalilimnicola ehrlichei MLHE-1
MGLNSNDNVQDATRALNADATRPFPASRRIYLQGERPDVRVPMREISLSPTVGSEGTEANPPFPVYDTSGPYGDPEVEIDLVRGLPAHREAWIEERGDTETLAGPSSEYGRARAEDPATAALRFQRPRKPRQARAGQCVTQMHYARRGIITPEMEFVALRENQALDQLAAQGLLKGRHPGQAFGATIPERYTPEFVRDEVAAGRAIIPNNINHPESEPMIIGRNFRVKINANFGNSAVTSSIAEEVEKLIWSTRWGADTVMDLSTGDHIHETREWIVRNSPVPVGTVPLYQALEKVNGVPEDLTWEVFRDTLIEQAEQGVDYFTIHAGVRLPFIPLTTERTTGIVSRGGSIMAAWCLAHHRESFLYEHFEDICEIMKAYDVAFSLGDGLRPGSIADANDEAQFAELKTLGELTKIAWAHDVQVMIEGPGHVPMQLIKENMDKELEACFDAPFYTLGPLTTDIAPGYDHITSAIGAAQIAWYGTAMLCYVTPKEHLGLPDRDDVREGIVTYRLAAHAADLAKGHPAAQARDNALSKARFEFRWEDQFNLGLDPERAREYHDATLPKEGHKRAHFCSMCGPKFCSMKISQDVREFARRKGLDDAEALEAGMREQAEAFRARGSRVYLDEEGE

SEQ ID NO: 45432 - protein, 661 aa, Oryza sativa (japonica cultivar-group)
MATGMLLRGLRSAASRTSPVFPTSASSPAPYVSPLLRRLYSAAAASAAASPALGPGGALDPSRIRNVAVIAHVDHGKTTLMDRLLRQCGADIPHERAMDSISLERERGITIASKVTSVSWKENELNMVDTPGHADFGGEVERVVGMVEGAVLVVDAGEGPLAQTKFVLSKALKYGLRPILLLNKVDRPSVSEETCNEVESLVFDLFANLGATEEQLDFPVLYASAKEGWASLEFTKSPPDNAKNMSALLDSILQHVPSPKADLEAPFQMLVSMMERDFYLGRILTGRVRSGVVRVGDKVHGLRSTDDGVQKIEDGKVVKLMKKKGTSMVIVEAAGAGDIISMAGLAAPAIGHTVSNSDILTALPTIELDPPTISMTFGVNDSPLSGRDGTHLTGAKIGNRLMAEAETNLAINVLPGPLSESYEVQGRGELQLGILIENMRREGFELSVSPPKVMYRTDRGERLEPIEEVTVEVDEEHVGFVMETLTHRKGEVMDMGPVPGTTGRTRIFLTCPSRGLVGFKGIFSSFTRGTGFMHRAFQAYAKYRGQLGNVRKGVLVSVGKGLITSHALMSLEARGILFVSPGMEAYEGMIVGEHSRDSDLDINPVRTKELTNIRAPGKDENVRLSPPRLMSLEEAIGYVAADELIEASFLYLLLMILLVLV

SEQ ID NO: 45433 - protein, 1693 aa, Gibberella zeae PH-1
MASADFCDDSEDITRKRTMLLPDFATCPNPQGLCKQTTAQRGATFNNKFPFAKKTRTHRPQDYPEEAIGPTDRNDPNNMYHLDTNLNDMEGILTKPPPLTPMDTTFVNPVEPERHDSIISTAPKGRWDAPDSWAVRRNTEDNSYNGGPELDEIGSPPRPEEKASPYCIRIFRSDGTFSTHSMSLDSSVTDVISQVIKKTYVMDGLENYHIIMKKHDLIRVLTPPERPLLMQKRLLQQVGYEEKDRIEDLGREDNSYLCRFMFLSARESDFHAKTTDMGLARAQKLNYVDLSGRNLVTIPISLYSKAMEIISLNLSRNLSLDVPRDFVQSCKHLRDIKFNNNEARKLPPSLSRANKLTYLDVANNRIEQLEHAELNALTGMIKMNLANNRLKHLPSYFGAYQSLRTLNISSNFIDKFPTFLCGLPSLVDLDLSFNAIATIPQEIGSLRNLEKLLITNNRLTHAVPATFGQLVSLRELDIKYNGISSIDIISELPKLEILSADHNCVSAFVGQFESLRKLKLNSNPLNKFEIVAPVPTLKTLNLSNAQLASIDSSFANMVNLERLILDKNYFVSLPQEIGTLSKLEHFSIANNSVGELPSQIGCLTELRVLNVRGNNISKLPMELWWANRLETFNASSNVLEHFPKPASRAPRIPGEESQPAPPPVNGRAAPLGTLSATASSEELSDDRRPSQNSSTLLSVGPSPLNAGDRKSSVVSVYGKGGRKTSVVSRSATPSAPTQSVNPRKDSGLSSRLNNTFAGSLRNLHLADNRLDDDVFDQITLLTELRVLNLSYNDEISDMPQRSIKSWPQLVELYLSGNALTTLPADDLEESSLLQALYINGNRFTNLPADISRAKNLAVLDCGSNYLKYNISNVPYDWNWNLNPNLRYLNLSGNKRLEIKQTATGPLGPGAVNREEYTDFSRLLNLRILGLMDVTLTQPSIPDQSEDRRVRTSGSLAGHLPYGMADTLGKHEHLSTVDLVVPRFNASETEMLLGLFDGQALSSGGSKIAKYLHENFGHIFALELKALKTRLNETPVDALRRAFLALNKDLVTIAIQQSEERPIQTHRNSGQPIILTKEDLNSGGVATVVYLQSTELYVANVGDAQAMVIQTDGTHKMLTRKHDPAEPTERSRIREAGGWVSRNGRLNDLLQVSRAFGYVDLMPAVQAAPYVSNMTIREQDDIILIATGELWEYLSPGLVTDVARAERQDLMRAAQKLRDLAIAYGASGKIMVMMISVADLKRRVERSRLHRGASMSLYPSGIPDDAQVLNIRRGRRTKGDVLDSSLNRLEAEIPAPTGNVSIVFTDIKNSTTLWEMYPSAMRSAIKLHNEVMRRQLRRIGGYEVKTEGDAFMVSFPTATSALLWTFAVQMQLLDVNWPSEVLNSVSCQPIFDKDNSLIFKGLSVRMGIHFGDCVSETDPVTRRMDYFGPMVNKAARISAVADGGQITVSTDFISEIQRCLENYQDTDRGNASGSEDTFGDEETYASAIRKDLRSLTSQGFEVKEMGEKKLKGLENPEVVYSLYPHALAGRIEFHSQHERKEEGGGDKPAVLAPGTELCIDPDSVWTLWRISLRLEMLCSSLEGNEPPGLQPPETELLERIKQRGGEVTDRFLLNFLEHQVARIEELEDLHGPMSAILDQFMAQNRELKRYRRKYGALPNPVNSLSSSEEEEEEDDDDDDDDPDTEEGSNTEQEL

SEQ ID NO: 45434 - protein, 232 aa, Alkalilimnicola ehrlichei MLHE-1
MKKLVLLRHGQSIWNQENRFTGWHDVDLTEKGREEAQAAGQLMKRHGLRFDYAYTSVLKRAIRTLWIGLDELDQMWIPVTKAWQLNERHYGALTGLNKAETAEEYGAEQVHIWRRSYDTPPPPLDETSPYHPRHDPRYASLKPEQLPATESLALTLERVLPYWNERIVPTLRDCDNVLIAAHGNSIRALIKHLDGLDDEAIMKVEIATGDPLVYELDDALAVVDKHYLRERD

SEQ ID NO: 45435 - protein, 559 aa, Prunus dulcis
  misc_feature (46)..(46): Xaa can be any naturally occurring amino acid
MGSLEEERSLLEDGLIQDETNGLYTGDGSVDITGKPVLKQSTGNWXACPFILGTECCERLAFYGISTNLVTYLTHKLHEGNVSAARNVTTWSGTCYLTPLIGAVLADAYWGRYWTIAIFSTIYFIGMCTLTISASVPALKPPQCVDSVCPSASPAQYGVFFFGLYLIALRTGGIKPCVSSFGADQFDDTDSRERVKKGSFFNWFYFSINIGALVSSTLIVWVQDNAGWGLGFGIPALFMGIAIVSFFSGTPLYRFQKPGGSPLTRMCQVLVASFRKWNLDVPRDSSLLYETQDKGSAIKGSRKLEHSDELNCLDKAAVISETETKTGDFSNPWRICTVTQVEELKILIRMFPIWATGIVFSAVYAQMATMFVEQGMMMDTSVGSFTIPPASLSSFDVISVIFWVPIYDRFIVPIARKFTGKERGFSELQRMGIGLFLSVLCMSAAAVVEMKRLQLATELGLVDKEVAVPLSIFWQIPQYFLLGAAEIFTFIGQLEFFYDQSSDAMRSLCSALSASDDFIGKLSELFDSDIVTYFTTQGGKAGWIPDNLNDGHLDYFSGS

SEQ ID NO: 45436 - protein, 224 aa, Parvularcula bermudensis HTCC2503
MPKFAAGVVRFQQHVFPEKQELFERLSKGQSPEALFITCSDSRIETAMITQTDPGELFICRNAGNIVPPHTDNTGGMTASIEFAVAALRIPHIVICGHTQCGAMTGAMDPGGLEHLPHVRKWLGYAEAAVAIVKDQGDTLTPEAQMRMLLEQNVILQLRHLETHPSVAVRLARGDLRLHGWVYDIEKGTVDAYDAASGAFRTVTDIYAAEVAQYATTCEHGDHR

SEQ ID NO: 45437 - protein, 335 aa, Saccharomyces cerevisiae
MSEPAQKKQKVANNSLEQLKASGTVVVADTGDFGSIAKFQPQDSTTNPSLILAAAKQPTYAKLIDVAVEYGKKHGKTTEEQVENAVDRLLVEFGKEILKIVPGRVSTEVDARLSFDTQATIEKARHIIKLFEQEGVSKERVLIKIASTWEGIQAAKELEEKDGIHCNLTLLFSFVQAVACAEAQVTLISPFVGRILDWYKSSTGKDYKGEADPGVISVKKMYNYYKKYGYKTIVMGASFRSTDEIKNLAGVDYLTISPALLDKLMNSTEPFPRVLDPVSAKKEAGDKISYISDESKFRFDLNEDAMATEKLSEGIRKFSADIVTLFDLIEKKVTA

SEQ ID NO: 45438 - protein, 731 aa, Debaryomyces hansenii CBS767
MSDMEELDVKAKQYTPQLFLESEDKTDEARSTFNELQECTYSSKSTGSSGQHEHMTCDCYEDWDSDKQQNMACGEDSDCINRVTSVECSNKFCTCGNDCQNQRFQKKQYANVTVIQTELKGYGLRANEDISESSFIYEYIGEVIDEESFRKRMIDYDTKKLIHFYFMMLKKDSFIDATMKGSLARFCNHSCNPNAYVDKWVVGEKLRMGIFSKRNIQKGEEITFDYNVDRYGAQSQPCYCGEPNCIKWMGGKTQTDAALLLPDGISEALGVTHKQERQWLKENKHLRSKQQSDESIINEAFVKSIEVSALTESDVSKVMGALMRVQDLNITQKLIERIYLTSDDSINSSIIRVHGYKTLSQTIKAFKDEDKELISKILIILAKWPKVTRNKISSSQIEDVVKDINTNSNDDNLKKLSSDLLAEWGKLQMAYRIPKNIGNDKESNSPALYGRNARSRSRSRSPDRGKSAEPQHVETDEALPDGWQTAFDPNTQTNYYYHAELGISKWERPIKEVPKGPKGPKALPVSEPIQRPNLNSNGRSYNEEELTRREEERLKREKEEQFKEIQQKERLLQELILQSQKELEEKKSFEEKMKLEKLEKEKERQALKRKKLKKSKSSIPPAPPVPIDGQWTKTFAKHVPNFLKKYEAEIGRDNIKGCAKELVKTLVAKEMKKNPDTKPPKELDNAKLKKIKEYSKMFMDKFLIKYRSKHDKKRSHNEENGGTKRVKPDVE

SEQ ID NO: 45439 - protein, 291 aa, Magnetospirillum magnetotacticum MS-1
AYKVSQGLLDEFGAERVIDTPITEMGFAGLACGAGYAGLKPIVEFMTMNFSMQAIDHVINSAAKTLYMSGGQLTCPIVFRGPNGAASRVGAQHSQDYASWYAHCPGLKVVAPWSAADAKGLLKASIRDPNPVVFLENELLYGQSFDVPDDPDFVLPIGKAKIERAGAHVTITAYSRMVQIALDAAEILKGEGIEAEVINLRTIRPLDTATIVASVQKTNRIVSLEEGWAYAGIGSEIAAVMMEQAFDWLDAPVVRVCGADVPMPYAANLEKLALPQIEHVVAAARSVCYRA

SEQ ID NO: 45440 - protein, 235 aa, Parvularcula bermudensis HTCC2503
MPRICLVRHGQSRWNLENRFTGWVDVDLTEKGEAEARRAGELMKAETFKPVRAFTSVQTRAIRTLNIALHALDRLWVPVTKDYRLNERHYGGLTGLDKAETAVKHGEDQVKIWRRSYDTPPPPLDDPSPFPSLTDERYAGIEVPKTESLKLTLDRVAPYWQSTIVPAISEGDLLIAAHGNSLRALVKLLFAVGDDEITSVEIPTGNPLLVELNNQMRASSAKYLDDSRAQALPKI

SEQ ID NO: 45441 - protein, 462 aa, Magnetospirillum magnetotacticum MS-1
MAENSFDIIVIGGGPGGYVAAIRAAQLGMNTALVEREHLGGICLNWGCIPTKALLRSAEIYRNMQHAESYGLSAPGASFDLAKIVARSRGVSAQLQGGIKHLLKKNKVTVIEGTAKLAGGGKVAIEGKPTISAPHIILATGARARILPGFEPDGKFIWTYKEALVPDTMPKRLLVIGSGAIGIEFASFFNALGAQVTVAEAMDRVLPVEDAEISAMAQKSFEKQGMKILTSANIKGLKKNAADVTVTIEAGGKTQDITVDRIITAIGIVGNVENIGLEGTKIRVERTHVITDPYCRTDEPGIYAIGDIAGAPWLAHKASHEAMICVEKIKGLADVHPLDMRKIPGCTYCHPQVASVGLSEAKAKDKGYTVKVGRFPFMANGKAIALGETEGMIKTVFDAKTGELLGAHMIGAEVTEMIQGYVVAKTLETTEAELMHTVFAHPTLSEMMHESVLDAYGRAVHF

SEQ ID NO: 45442 - protein, 377 aa, Trifolium pratense
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNAPAMYVAIQAVLSLYASGRTTGIVLDSGDGVSHTVPIYEGYALPHAILRLDLAGRDLTESLMKILTERGYMFTTSAEREIVRDIKEKLAYVAVDYEQELETAKSSSSIEKNYELPDGQVITIGAERFRCPEVLFQPSMIGMEAAGIHETTYNSIMKCDVDIRKDLYGNIVLSGGSTMFPGIADRMSKEITALAPSSMKIKVVAPPERKYSVWIGGSILASLSTFQQMWISKGEYDESGPSIVHRKCF

SEQ ID NO: 45443 - protein, 296 aa, Solibacter usitatus Ellin6076
MFSFSNEWWSINVGLAEMLKGGVIMDVTTAEQARIAEAAGASAVMALERVPSDIRKEGGVARMANIAIMEEIQKTVTIPVMAKARIGHFVEAQVLEMLKVDFIDESEVLTPADEENHIDKNLFKTPFVCGARNLGEALRRIAEGATMIRTKGEAGSGNIVEAVRHIRTIVKEMKQLTVMGKDELAHQAKILQAPLELVKWVADHGKLPVPNFSAGGIATPADAALVMQLGAEAVFVGSGIFKSSDPAARAVAIVKAAKNYQNPAKLLEASRQLGEAMPGLEISKLPESELMQTRGW

SEQ ID NO: 45444 - protein, 345 aa, Oligotropha carboxidovorans
MAQGQTLHQHLTGFAATDPAHGPVADVVAAFAIAATEISELISGGLLSGITGEGQTRNSDGDVQKDLDIKADQIIRAALAGTSVAALASEEAEEIEICDPAGAVSVAFDPLDGSSNINTNMSVGTIFSIVRTPSHARAAFTQPGSAQLAAGFVVYGPQTSLVLTLGDGVDVFTLDRKAKVFQKVRSRVQIPAQTPEYAINASNRRFWDPLIVAFIEDCLAGKDGVMQADFNMRWIGSMVAEAYRILVRGGIFLYPGDTREGYGEGRLRLLYEAHPIAFIMEQAGGGATTGRQRILDITANTPHQRVPLIMGSIDSVRRIERMHGSPDIKFERNPPLFATRGLFRI

SEQ ID NO: 45445 - protein, 384 aa, Medicago truncatula
MATPMGSDTWKAHLAMAMVQLFNGGYHVITKVALNVGVNQLVFCLYRDLLALSILAPIAYIREKRTRPPITKNLLTSFFFLGLTGIFGNQLLFLIGLSYTNPTYAAATQPAIPVFTFLFAVIMGTERVNLLRSEGLAKVLGTLICVSGAVLMVLFRGPIVIGYSEIDHVARNEISARGQPEPSGWFVGGLLDLGLDHFHLGVLCLIGNCMCMAAFLAIQAPVLKKYPANLSVTAYSYFFGAALMVAVSFLMTNESTDWSLTSSEILAVIYAGIIASALNYGLITWCNKILGPALVALYNPLQPAFSALLSRMFLGSPIYLGSIIGGSFIIAGLYTVTWGSYRERHATVGVIPHGWEAEPLIHDKIGQIFSGSSSLSASPKSAAD

SEQ ID NO: 45446 - protein, 582 aa, Oligotropha carboxidovorans
MTIDEIKSFRQWGSKTPGHPEYGHTQGVETTTGPLGQGIATAVGMALSERMTNARLGNDLFEHYTYVICGDGCLMEGVSQEAISLAGHLKLGRLIVLFDDNGISIDGSTSLSCSDDPLARAAASGWSVRRVDGHDPKAVEKAIAEERETDRPSLIACKTRIGYGSPGREGSEKAHGAPLGAEEIVSTRAALDWPHAPFEIPRDVLAAWRTVGEHGQTEHSKWVDRLAQLDREEREHINSVLSGKLSSQYDAAMRKLCAGFATEQPKIATRQASQQVIEMLASVLPNLAGGSADLTHSNLTHAKSQKPIKPGDYAGNYIHYGIREHGMAAAMNGIALHGGFIPYGGTFLTFADYSRPAIRMAALMGLRVIHVMTHDSIGLGEDGPTHQPVEHLASLRAIPNLLVFRPADAVETAEAWDCALRAESRPSILCLSRQALPTFRSGSSAINKVAQGAYLVLDPQDRCDVTLIATGSEVAIALDAARLLEKDDIRAAVVSAPCLELFAEQPEEYRRAVLGQRPRVAIEAAIEGAWARLIGDDGEFVGMTGFGASAPANVLYREFGITPEGVVLAAKRSIARSSSKGV

SEQ ID NO: 45447 - protein, 444 aa, Lactobacillus sakei subsp. sakei 23K
MKVAVIGCTHAGTFATQATLTAHPDWDVTVYETHDNLSFLSCGIALWVGGHVSDPKKMFYSSPEMLAQLGAHMKMQHTVLKADLKEKVLHVKNLVTSEETIEKFDKIIVTTGSSPVIPPIEGIDNPNVKLCKNWEHANELKKSAPDVKSVIVIGSGYIGAELAEAYATTDKKVTLIDALPHALGKNFDPNISEIVEQDYRDHGVQLALSEKVVSFSGTDQVTVKTDKNEYTADLAILCVGFRPNTGLFKDQVEMLGNGAITTDEYMQTSVKGVYAAGDSAAVYYNPTQKADYIPLATNAVRQGLLIGRNIETPTEKYMGTQATSAVELFGRTYSGSGLTVEGAKVRGMAVATTTLTEDYRPDFMPSTTPVLMNLTWNPKTRQVLGGSFTSQYDIAQAANVISMAIQTKMTIDQLAMVDMFFQPNYDQPLNYVNAIAMKAVAESH

SEQ ID NO: 45448 - protein, 335 aa, Oligotropha carboxidovorans
MSVKVAINGFGRIGRNVLRAIVESGRDDIEVVAINDLGSVQANAHLLRYDSIHGRFPHEVKISGDTIDVGRGPIRVTAEKDPAALPHAAMGVDVALECTGIFTTREKAAAHLKAGARRVIVSAPADGADMTVVYGVNHQKLNKDHVVISNASCTTNCLAPVAKVLNDAVGIERGFMTTIHSYTGDQPTLDTMHKDLYRARAASMSMIPTSTGAAKAVGLVLPELNGKLDGVAIRVPTPNVSVVDFKFIAKKNTSVEEINEAISKASGGALKGILGATHEQNVSSDFNHDPHSSIFHMDQTKVIDGNFVRILTWYDNEWGFSSRMSDTAVALGRVM

SEQ ID NO: 45449 - protein, 333 aa, Oligotropha carboxidovorans
MPDYSLAPLRPALEKSLKRSVRFVETDWRNGAPRAEVAKAIPGDILLMENTRFHPGEEENDPEFSRTLADLGDIFVNDAFSVSHRAHASTEGVARLLPSFAGRGMEAELTALDRALGKPMRSVGAVVGGAKVSTKITVLENLVTRVDELIIGGGMANTFLYAKGINVGRSLCEPDFKETVERILQRAADHHCNIVLPRDVVIAKEFAPNAPHEVVDVHAVPADSMILDVGPESVADIMEQFGDLKTLLWNGPVGAFETEPFGRGTFALARCAARLTKAGKLVTVAGGGDTVAALSAAGIQDDFSYVSTAGGAFLEWLEGRGLPGVDVLKISHA

SEQ ID NO: 45450 - protein, 306 aa, Prunus dulcis
MGKEHALVISNHRSDIDWLVGWVLAQRSGCLGSSLAVMKKSSKFLPVIGWSMWFSEYLFLERSWAKDEGTLKSGVQRLKDFPQPFWLALFVEGTRFTQAKLLAAQEYAAATGLPVPRNVLIPRTKGFVTAVSQMRSFAPAIYDVTVAIPKSSPAPTMLRLFEGRPSVVHVHIKRHVMRDLPETDEAVAQWCKDIFVAKDALLDKHTVEQTFGDQQLKVTGRPLKSLLVVTAWACLLILGALKFLYWSSLLSSWKGIAFSALGLGVVTVLMQILIRFSQSERSTPAPVAPTNNKNKGESSGKPEKQQ

SEQ ID NO: 45451 - protein, 417 aa, Oryza sativa
MPALGTLSGGAAGVAGLLRLRRATPSPAVATPFPAAAAARCAAAAAAVVPDGGQLVWGRQLRPALLLPAAGGLLQPPTSPSSSQAGRRQALRPPAAATSGEAKPAGFLEKYPALITGFFFFMWYFLNVIFNILNKKIYNYFPYPYFVSVIHLLVGVVYCLLSWAVGLPKRAPINATLLKLLFPVALCHALGHATSNVSFATVAVSFAHTIKALEPLFNAAATQFVLGQTVPLSLWLSLAPVVLGVSMASLTELSFSWKGFINAMIPNISFTYRSIYSKKAMTDMDSTNVYAYISIIALVVCIPPALIIEGPQLVQYGLNDAIAKVGMTKFVSDLFLVGLFYHLYNQIATNTLERVAPLTHAVGNVLKRVFVIGFSIIIFGNKITTQTGIGTCIAIAGVALYSYIKAKIEEEKRAKAA

SEQ ID NO: 45452 - protein, 232 aa, Triticum aestivum
RLGYPVPGKFPGGFCLTPRASAGCGAPGDPYPGRKGFEKTPGGPPPLPGYIPYIVPPWPPPVLAWSATSFGPFQGVKSTAGLPVSPRSNGVSLGRVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 45453 - protein, 250 aa, Gibberella zeae PH-1
MVTYMKEVAKLGGELTVDERNLLSVAYKNVVGTRRASWRIISSIEQKEESKGSDKHVSTIKDYRNKIETELEKVCQDVLDVLDDFLIPNAATGESKVFYHKMKGDYHRYLAEFASGEKRKGAATAAHDAYKSATDVAQTELTPTHPIRLGLALNFSVFYYEILNSPDRACHLAKQAFDDAIAELDSLSEESYRDSTLIMQLLRDNLTLWTSSDSAEGEAAGAADAPKKEEGEAAKPAEEAAEEPAPAPAS

SEQ ID NO: 45454 - protein, 204 aa, Glycine max
MEESKFGQTDKRKRVRDESDSVLNSPDSLKHPRAESNSFESLRVDSDEFELARLDPVLLNMLNDAENVAEREPTVLDSVIKSFEEEILSPVPNPNLASEADVFKPNLGYLLEASDDELGLPPTVAPSEDVLKPETVDSDRVGPEGMDLTGFLGFEDDIRSYEGFGFVGYDVGDNGGGYVTIDGLFDYAEPGADILWRSESLQAL

SEQ ID NO: 45455 - protein, 656 aa, Burkholderia pseudomallei K96243
MCGITGFVGPVACAPQTARATLARMTDSLAHRGPDDTGLWIDHDAGVALGHRRLSIVDLSEHGHQPMLSACGRYAMTFNGEIYNFRALRSELEREHRAPEWRGHSDSEVLLAAFCAWGVDRALQKAVGMFALALWNRESRVLTLARDRIGEKPLYYGRIGGSFVFGSELKALRRFPGFDAHPIDRDALCLYLRHASVPAPYTIYEGIRKLPPGTYAQFEDLAEAPAPRRYWSLERAIAAGRANPFDGDANAAVAQLDHVLRDAIAEQSVADVPLGAFLSGGVDSSVIVALMQTQTAQPVQTFTIGFHEAGYDEAGYAKAVARHLGTSHTELYVKPADVLATVPRMPCVYDEPFADSSQIPTLLVSELTRRHVKVSLSGDGGDELFGGYTRYFLTPRLWGRLRRVPAAVRMRIAAALHALRPDHADQIASLVQGAWSASAQRDASPRVGDRLHKLANVMTADSRASLYRLLMSSVHHPERFTLAGHEPQTLIDTPGAWPPGLSFAEQAMAVDTLTYLPTDILTKVDRAAMAVSLETRMPFLDYRVVEFAWRLPEALRIPDGQDKWLLRKLLYRYVPRPLIDRPKQGFCAPVGAWLRGELSDWAAELLRPARLRDEGYLDAARVERLWRQHQSGRMNWQHPLWTVLMFQAWLERQRAE

SEQ ID NO: 45456 - protein, 146 aa, Bartonella quintana str. Toulouse
MNIIAQLEAEQCAKIEAKRQLPKFQAGDTVRVMVRVTEGTRTRVQAYEGVCIARSGGGLNETFTVRKISYGEGVERVFPVYSPLIEGVELVRRGKVRRAKLYYLRGLRGKAARIAEKRVYRKKDEKVAERVQATAVTVDVAEQAAE

SEQ ID NO: 45457 - protein, 178 aa, Arabidopsis thaliana
MSENEVKDPRIDGIKTKIRVVPDFPKKGIMFQDITTLLLDPKAFKDTIDLFVERYRDMNISVVAGIEARGFIFGSPIALAIGAKFVPLRKPKKLPGQIIFEEYELEYGSDRLEMHVEAVDSGDRALVVDDLIATGGTLCAAMNLLSKFFSFFNNISLVPKLLLSFKWLPIDSNHLPLQ

SEQ ID NO: 45458 - protein, 456 aa, Securigera parviflora
MCGILAVLGCSDDSQAKRVRVLELSRRLKHRGPDWSGLHQHGDCFLAHQRLAIVDPASGDQPLFNEDQSIIVTVNGEIYNHEELRKQMPNHKFRTGSDCDVIAHLYEEHGENFVDMLDGIFSFGLLDTRDNSFIVARDAIGVTSLYIGWGLDGSVWIASELKGLNDDCEHFETFPPGHLYSSKEREFRRWYNPPWFSESIPSAPYDPLALRQAFEKAVVKRLMTDVPFGVLLSGGLDSSLVASITARHLADTKAAKQWGAKLHSFCVGLEGSPDLKAGKEVADYLGTVHHEFQYTVQDGIDALEDVIYHIETYDVTTIRASTPMFLMSRKIKSLGVKWVISGEGSDEIFGGYLYFHKAPNKEELHKETCRKIKALHKYDCLRANKSTFAWGLEARVPFLDKEFINVAMNIDPENKMIKLDEGRIEKWILRKAFDDEENPYLPKHILYRQKEQFSDG

SEQ ID NO: 45459 - protein, 338 aa, Methanosarcina barkeri str. Fusaro
MRLAVIEGDGIGREIIPAAVKVLDAFGLEFEKVPLELGYTRWERTGTAISNNDLETIKGCDAVLFGAITTVPDPNYKSVLLTIRKELDLYANVRPVKPLPGITGVTGRNDFDFIIVRENTEGLYSGIEEIGPELSWTKRVVTRKGSERIAEYACKLAKKRKNKLTIVHKSNVLKSDKLFLDVCRQTASANGVEYEDMLVDSMAYNLIMRPERYDIVVTTNLFGDILSDMCAALVGSLGLVPSANIGEKYAFFEPVHGSAPDIAGKGIANPLAAILCVKMLLEWMGEPRSQIIDEAIAYVLQKKIITPDLGGTASTMEVGNAVAEYVLSNIQDRRSPPW

SEQ ID NO: 45460 - protein, 335 aa, Vitis vinifera
MDMERVQAIAFSFMTEGRIPPEFIRSEKEQPAITTLHGYDPQIPTTDFSDPDEDSLTRLIAEASRDWGMFQIVNHGIPTHVINNLQKVGEDFFALPQVEKELYAKPPDSKSIEGYGTRLQKEEEGKRAWVDHLFHKIWPPSAINYQFWPKNPPSYRDANEAYAKCLRGVADKLLSRLSVGLGLGEKELRESVGRDELTYLLKINYYPPCPRPDLALGVVSHTDMSAITILVPNHVQGLQLFRDDHCFDVKYIPNALVIHIGDQLEILSNGKYKSVLHRTTVKKDMTRMSWPVFLEPPPELAIGPLPKPTSEDNPPKYKKKRYCDYVYCELNKIPQ

SEQ ID NO: 45461 - protein, 335 aa, Vitis vinifera
MAVERVQTIAFSSILVDTIPPEFIRSEKEQPALTTCLGCIPQVPTIDFSDPDEGNLTRLIAEASSEWGMFQIVNHGIPSEVITNLKKAGKEFFELPQEEKELYAKPPDSKSIEGYGSKLQKEVEGKKAWVDHLFHNIWPPSAINYQYWPKNPPSYRAVNEEYCKWVQPVGHRLLSLLSLGLGLEKNELKENVGGDELKYLLKINYYPPCPRPDLALGVVAHTDMSSITILVPNEVQGLQVFRDDHWFDVKYIPDALVIHIGDQLEILSNGKYKSVLHRTTVTKEITRMSWPVFLEPPSELAIGPLPKLINEKNPPKYQKKKYCDYVYCKLNKIAQ

SEQ ID NO: 45462 - protein, 335 aa, Vitis vinifera
MEIERVQAIAFSSLSEGTIPPEFIRSEKEQPAITTFHGYVPQVPTIDFSDPDEANLTRLIAEASMEWGIFQIVNHGIPFHVITSLQKVGREFFELSPEEKELYAKPPDSKSIEGYGTKLQKEVEGKKAWVDHLFHKVWPPSAINYHFWPKTPPSYRDANEEYTKCLRGVADRLFSRLSLGLGLDEDELKKSVGGDELTYLLKINYYPPCPRPDLALGVVAHTDMSSITMLVPNEVQGLQVFRDDHWFDVKYIPNALVIHIGDQLEILSNGKYKSVLHRTTVNKEMTRMSWPVFLEPPPELAIGPLSKLINEENPPKYKEKKYCDYVYCKLNKIPQ

SEQ ID NO: 45463 - protein, 462 aa, Zea mays
SCGRRSGGAGEMIRMAAASQPPSSALRMHGCGGAASASSAPVRLFTESRGRVVASIGRGRRRRRAISCCSSPDADGPRPAAPPTSAAPSDGSIQLYSQIERVITEAAKQSREGWGSTGDWTEVEGSWVLRPKSLEPSFVVHFVGGIFVGAAPQITYRFFLECLANRGALVIATPYASGFDHFFIADEVQFKFDRCLRNLDEPVNDLPTFGVGHSLGSVIHMLIGSRYAVQRSGNVLMSFNNKEASSAIPLFSPVIVPMAQSFGPIFSQLASYPTIRFGAEAAIKQLENLSPPVVKQFLPLLQQLPPLYMDLIKGREDFIPKPEETRRLIKSYYGISRNLLIKFKDDQIDETSTLAQVLSSEAAISSLLDMSIRSLPGDHGLPLQQVLPDVPPAMADAVNRGGELLTNLTTGTPWEAVAKEVGTTLGTDSGILRAQISKDVETLVDVIASWTSSNSGPRLLRP

SEQ ID NO: 45464 - protein, 136 aa, Nicotiana tabacum
GGHGIVGAQVPLGVGLAFAQKYSKEEHVTFAMYGDGAANQGQLFEALNMAALWDLPAILVCENNHYGMGTAEWRAAKSPAYYKRGDYVPGLKVDGMDALAVKQACKFAKEHALKNGPIILEMDTYRYHGHSMSDPA

SEQ ID NO: 45465 - protein, 392 aa, Triticum aestivum
  misc_feature (22)..(22): Xaa can be any naturally occurring amino acid
  misc_feature (47)..(47): Xaa can be any naturally occurring amino acid
  misc_feature (87)..(87): Xaa can be any naturally occurring amino acid
  misc_feature (134)..(134): Xaa can be any naturally occurring amino acid
  misc_feature (325)..(325): Xaa can be any naturally occurring amino acid
SVSSSPTPATDAGAAAMAVDDXSETDQLDSMSTEDIVRATHLVDNEXCVLKDELQRNNLELENVKDKIKENQEKIKLNKQLPYLVGXIVLRASPAPGISPIWTRMRKLWVSVPSSFMPDSRFPDPVLVRANQIXPRVACDFTCSSFALHFVLIDEGSVTVRPSLVCWKCLTSQKHIVATGPEFPGYRRPTRPIVLPMTHKEQFQKLGIRPPKGVLLYGPPGTGKTLMARACAAQTNATFLKLAGPQLVQMFIGDGAKLVRDAFELAKEKAPCIIFIDEIDAIGTKRFDSEVSGDREAQRTMMELLNQLDGFSRDERTTALSASHXADNYSPPLCLRSRPDRSLTRPSPSTPPALNRHNFNIHPITPSPTMINHTLTSRPHPFLTIRNNVSSQ

SEQ ID NO: 45466 - protein, 151 aa, Brassica napus
  misc_feature (147)..(147): Xaa can be any naturally occurring amino acid
LRPVVETGYENLLLVRLLVEIQIHSVRKSSVADGLSIQEILENWSKLKPTLMDEWQEDRESLVDLFGRVRDDWIENDFSGWIGANRFYPGTADALKLSSSEAYIVTTKQSRFAEALLKELAGIDFPSERIYGLGTGPKVKVLQQLQXMLQH

SEQ ID NO: 45467 - protein, 425 aa, Colwellia psychrerythraea 34H
MNRKQNIIKTAINEHVIDHNLTAIGVMDLDGLKKTVNDAYAAFPANFFHTFAVKANALVKVLEPLREYGMGAEVASPGELLIAVTAGFTAENIIFDSPAKTLQDLRTCIKKGIALNIDNLQELERIDALMLEFPESTSIIGFRVNPQIGGGKIGSTSTATATSKFGYALVDGDNRNELISIYKKRPWLKSIHTHSGSQGCELSLMAKGIKIITELAEEINSLVGLQQITRLDIGGGLPVNFSSEIIKPSFKDYADILKAEVPLLFTDKYQVKTEFGRAIVAKNGVIITRVEYTKNSGGRHIATTHAGAQIITRTAFLPKSWPIRVTGYTTKGEERTAQTSEVVTTDVAGPCCFAGDLICSNQPLPKLESNDYVMVHDTGGYYFTNHFDYNSLPRVAIYTVAGHDDDLTIECIRQGESLEDVLNKM

SEQ ID NO: 45468 - protein, 510 aa, Zea mays
  misc_feature (208)..(208): Xaa can be any naturally occurring amino acid
MMIARRLLRPNAPAQATSLLKHVMTGTASLQGNADSLLDGTVRHFGSAPSAQPEENGFKGHGMLAPFTAGWQSNDLHPLIIERSEGSYVYDINGNKYLDSLAGLWCTALGGSEPRLVKAATEQLNKLPFYHSFWNRTTKPSLDLAQEILSMFTAREMGKVFFTNSGSEANDSQVKLVWYYNNALGRPNKKKFIARSKAYHGSTLISAXLTGLPALHQKFDLPAPFVLHTDCPHYWRYHLPGETEEDFATRLATNLENLILKEGPETIAAFIAEPVMGAGGVIPPPKTYFDKVQAIVKKYDILFIADEVITAFGRLGTMFGCDYYNIKPDLVSLAKALSNAYVPIGATLVSPEISDVIHSQSNKLGSFAHGFTYSGHPVACAVAIEALKLYRERDIPGHVKQIAPKFQDGIRALADSPIIGEIRGLGMIMGTEFTNNKSPTDLFPAEWGVGAIFGEECQKRGMLVRVAGDAIMMSPTLIMTPGEVDELVRIYGEALKATEERVAALQSKKN

SEQ ID NO: 45469 - protein, 349 aa, Gibberella zeae PH-1
MTRDNLEIVLAERPTTDIIPGRTFTQKTGKAPTPADLQDGQILVETLYLSLDPAMRGWLRDMRSYLPPVQIGETMRGSCACRVIASKSKLAKEGDIVAATPGWTEFAIVPEGRFEPASYYPGVQDPKDMLSALGMTSLTAWVGMAKIADPQPGELVVVSGAAGATGSVAGQIAKLKGATVVGIAGGEDKCKWLTEELGFDVALNYKADDFKEKFNEATKNYIDVYYDNVGGDILDMCLMRAKEHARFIECGLVSQYNAAKPQGPRAFSQIVTMRIKMQGFIVLDHAKDFATARADLAKWMSEGKLKKTETVIRGGLKVAEQALVDLYKGINTGKLIVEIKNHNDTPSKL

SEQ ID NO: 45470 - protein, 332 aa, Vitis vinifera
MEVERVQALASGADLNELPAKFIRPAHERPENTKPLEGVSVPVISLAESHDVLVKEIYKACSEWGFFLLKDHGISPGLIEKLQEVGIEFFKQPQEEKEKYANDPSTGKFEGYGTKMTKNLDEKVEWVDYFFHLMSPPSNVNHQIWPQTPSSYREVTEVYNKELLKVTDTLLELLSEGLGLEGKVLKSHVGGDEIELEMKINMYPPCPQPQLALGVEPHTDMSALTLLVPNDVPGLQVWKDDYWVAVDYLPNALFVHVGDQIEVLSNGKYKSVLHRSTVNKERTRMSWAVFCAPPHKAMIGPLPELVDEPNPAKYSTKTFAEYRYRKFNKLPQ

SEQ ID NO: 45471 - protein, 294 aa, Xylella fastidiosa Ann-1
LGESKLSLPVPMMNIINGGAHADNNVDFQEFMVLPVGFASFSEALRAGAEIFHALKSVLKGRGLSTAVGDEGGFAPDFRSNVEALDAILEAIGRAGYIAGEDVLLGLDVASSEFRDNGKYNLVGENKRLTSEQFVDFLDDLVAQYPIISIEDGLAEDDWVGWKQLTERIGHKVQLVGDDLFVTNPKVFQEGITSGIANAILIKLNQIGTLTETLESIAMAHRAQYAAIVSHRSGETEDTSIADIAVATTATQIKTGSLCRSDRVAKYNQLLRIEQALGVGVRYAGRDAFVSLKS

SEQ ID NO: 45472 - protein, 188 aa, Arabidopsis thaliana
  misc_feature (132)..(132): Xaa can be any naturally occurring amino acid
MASSMLSSAAVVTSPAQATMVAPFTGLKSSAAFPVTRKTNKDITSIASNGGRVSCMKVWPPIGKKKFETLSYLPDLSDVELAKEVDYLLRNKWIPCAEFQLQHGFVYREHGNTPGYYHGRDWDMWKLPLFGXCTHSPPVLYEAPQCQKEFPGALLKDHRDLKTPPTFQCSSFLGLQTPSFSRKPIFSF

SEQ ID NO: 45473 - protein, 89 aa, Arabidopsis thaliana
WLSLFSPSTVGVTSRVKATLVGQLTAWNYSVFFRATGRANTDFLSIKGNGGRVTCLKVWPPIGKKKLETLFNLLDFRDVNWLKEVTSLF

SEQ ID NO: 45474 - protein, 224 aa, Helianthus annuus
NDFFDYVLEELKQNDTMLTEATALDLMFALLFANFETTSQAITVAIKFLTHNPRALKELTEEHQKILRKRENPKLDLHGKNIVDEIYLQVINETLRLASIVPVLFRKAKKDIKFKGYTIPSGWAVMVCPPAVHLDPVNYKDPLDFNPWRWEDMDLKSASKTFMAFGGGQRFCVGADFAKLQIAIFLHCLVTKYQWQPIKGGDIVRTPGLQFPNGFHVRIFEKET

SEQ ID NO: 45475 - protein, 116 aa, Gibberella zeae PH-1
MSRQLISSEKFPPKPHNCPATKVPGLVFCAGQTATGEIKQATRTVLQNLKEVLELAGSSLEQVVKYNVYLADMKDFAAMNEVYIEFLPKPMPSRSCLQALPPGDGTVIEIECIAQA

SEQ ID NO: 45476 - protein, 282 aa, Arabidopsis thaliana
MTSIMNPCDKKFVWVIKNFSSLQLQDCYVSDPVLIHDVNWRLFAYPEGSNGDHLLFKKNNGDHLSLYLEVDFESLPCGWRQYTQFRFTVVNQISEHSSVKREGRKWFDKKAPEWGWEEMISLTKLNDINSGFVVNGELMIVAEVETFEAVSTSQVAAVRDDSEWTLLGYYSSSEEDKDDVTVVVKGFHVLDSQVNQVKEIFEKHPDLATNLVLKNQNLKNVYMGFLLDLIKTLSKLPKELTEEDLNFADSTLSDLTNAGFMLDWLRLKLNRALEKQIACDAG

SEQ ID NO: 45477 - protein, 447 aa, Bartonella quintana str. Toulouse
MAEKNVPGLTVRQVCVRLLGAVLDKHTSLAGLTDNEHGHPQYLGLSHRDRLLCRAILGAALRHRGQITAALSRFLTRPLPLQAFSLQHLLHISVAQILYLDIPDHAAIDLAVRVAKIDPRMRRFSGLVNVLLRNVAREAVFLCRKVPTIEEIPGWFGQLLVSTYGKEKADQILAIQSLEPPLDLTVKSDSVGWAERLGGIILPNGSVRLSRLNCSVSELPGYADGDWWIQDFAAALPACLLGNIYGKQVVDLCASPGGKTAQLALQGADVTAVDLSAHRLKRLKENMKRLHFSVRYHEGDVKNFHPKRLFDAALLDAPCSSTGTIRRHPDILWTKSMHDVIKLAALQYDLLVAAIALVKKGGRIVFSNCSLAREEGEDLIEKILSTCNDVVLEPICAEEMGALAHLLSAKGILRTTPADFCHENFDAEKKMFLGMDGFFTARFRKVN

SEQ ID NO: 45478 - protein, 409 aa, Staphylococcus epidermidis RP62A
MSLRDDALEMHRENQGKLEITPNVKVTNKQQLSLAYSPGVAEPCKEIHEDSRKVYEYTIKGNTVAVVTDGTAVLGLGNIGAEASIPVMEGKAALFKSFAGINGVPIALDTTDTQEIIKTVKLIAPNYGGINLEDISAPRCFEIEETLKKETNIPIFHDDQHGTAIVTMAGLINALKIVDKELTDIKVVLNGAGAAGIAIVKLLHAYGVNNMIMCDSKGAIYSGRNFGMNDTKTYVAKWTNKDKVEGSLEEVIKDADVFIGVSVVDILTQDMVKTMADDPIIFAMANPNPEINPNEAKQAGAKVVGTGRSDFPNQINNVLAFPGIFRGALDVEATHINEDMKKAAVEAIVHLIDENELHPDYCIPGPFDKRVAPSVAKNVAKAAMESGVARIKIDTQEIFDKTMKLTDLK

SEQ ID NO: 45479 - protein, 162 aa, Triticum aestivum
  misc_feature (69)..(69): Xaa can be any naturally occurring amino acid
  misc_feature (92)..(92): Xaa can be any naturally occurring amino acid
  misc_feature (96)..(96): Xaa can be any naturally occurring amino acid
  misc_feature (99)..(99): Xaa can be any naturally occurring amino acid
  misc_feature (101)..(102): Xaa can be any naturally occurring amino acid
  misc_feature (129)..(129): Xaa can be any naturally occurring amino acid
  misc_feature (133)..(133): Xaa can be any naturally occurring amino acid
  misc_feature (141)..(141): Xaa can be any naturally occurring amino acid
MAPTVMASSATSVAPFQGLKSTAGLPVSRRSNGASLGSVSNGGRIRCMQVWPIEGIKNSETLSYLPPLXSTEASSKQVRLPDPSKWVPCLRXSKLXHLXRXXNAPLGYYDGRYWTMWNCLFPGHRRHTXINKXEEVKKDTXRVFRTVIAAMLSSLQPQDPEA

SEQ ID NO: 45480 - protein, 205 aa, Eucalyptus globulus subsp. globulus
MVRGKTQMKRIENDTSRQVTFSKRRNGLLKKAFELSVLCDAEVALIIFSPRGKLYEFSSSSLCKTIEKYQTRAKDMEAKTAEISMQPSKGNTLDMEKKIEHFEISRRRLLGEGLDSCSVEELQQTENQLERSLTKIRARKNHLIREHIERLKAEERKLLEEKRKLLQEIECGKGLTPVSSERPREEIRAESMDVETELFIGPPKR

SEQ ID NO: 45481 - protein, 487 aa, Burkholderia pseudomallei K96243
MGIKHWIGGREVDSPETFTTFNPATGEPIAEVASGGAQEIDAAVRAAKDAFPKWAGTPAKERAKLMRRLGELIERNVPALADLETRDTGLPISQTRKQLIPRASENFHFFAEVCTRMNGRSYPVDDQMLNYTLYQPVGVCALVSPWNVPFMTATWKTAPCLALGNTAVLKMSELSPLTADQLGRLALEAGIPAGVLNVVQGYGATAGDALVRHPDVRAVSFTGGTVTGKRIMERAGLKKYSMELGGKSPVLIFDDADFDRALDASLFTIFSINGERCTAGSRIFVQRTIYDRFVAEFARRANNLIVGDPADESTQVGSMITRAHWEKVTGYVRLGVEEGARLVAGGPDKPANLPAHLANGNFVRPSVFADVDNRMRIAQEEIFGPVVCLIPFDGEEHGLRLANDTAYGLASYLWTRDVGRAHRLARGIEAGMVFVNSQNVRDLRQPFGGVKESGTGREGGEYSFEVFAEIKNVCLSMGSHHIPRWGV

SEQ ID NO: 45482 - protein, 659 aa, Yarrowia lipolytica CLIB122
MVFGREKDDSEGIEHVPSPQDNPSDQTSDIIALNEKASNEHDDLPTIPKPEGDAPVNSELDPDNPLIRYSRAELLEIATQFAVDNDLADKAEAFRKGALVAQDPSGFENIDILDDDDRYWLNREITNKWDHPMKVYYLVVCCSLAAAVQGMDETVINGANIIFPAQFGIKEDSGVVSRKSWLLGLVNSAPYLCCACISCWMTDPINKVLGRKWTVFWTCFWAGATCFWSGFVNTWWHLFIARFFLGFGIGPKSATVPVYAAECAPPRIRGAMVMMWQMWTAFGIMMGYVMDLAFYYVKDRGTIVGLNWRLMLGSALIPALLVCIFIVKCPESPRWHLARGEIRKSFECMREIRHTDIQAARDTFYAHVLLIEENEMKKGKNRFVELFTVPRNRRAAWASFIVMFMQQFCGINVIAYYSSNIFMESGFGAIQALLASFGFGAINFVFALPAVYTIDTFGRRALLLATFPLMAIFLLFAGFCFYIGQNDPTHSHARVGLIALGIYLFSAVYSCGEGPVPFTYSAEAFPLYVRDLGMSFATAVCWLFNFVLAVTWPSLLAAFTPQGAFGWYAAWNVVGFFLVLCFLPETKNLTLEELDKVFSVPTRVHMKYQFNAFKINIQRTILRKDVPKPPPLYAHEAGIGGTSHWSSKPQPNANTAEFV

SEQ ID NO: 45483 - protein, 259 aa, Haloarcula marismortui ATCC 43049
MLTFVGLGLYDERSVTVAGRDAIRDADRVFAEFYTSRLIGTDIETLEDTLETSIERRDRAGIEQDPEPILEAAESEHVVFCTAGDTMVSTTHADLRLRAADRGIETRIVHGTTAQTAAGSLTGLQNYRFGKATTLPFEDAHGGDGVPDSVVATIEDNRDRDLHTLVYLDIKVDDPHWEESDDTYMTASQAATMLSEPFPDTLGVVVARAGSPDPLVAADTLDELATQTFGDPLHLLVIPGSLHPLEADTLESVAGAALE

SEQ ID NO: 45484 - protein, 336 aa, Pichia minuta
MAYNVGINGFGRIGRLVLRIALSRKDINVVAVNDPFIAAEYAAYMFKYDSTHGRYQGEVTFEGKYLVIDGQKIEVFQERDPADIPWGKEGVDFVIDSTGVFTTTAGAQKHIDAGAKKVIITAPSADAPMFVMGVNHKEYTKDLSIVSNASCTTNCLAPLAKVVNDVFGIESGLMTTVHSITATQKTVDGPSHKDWRGGRTASGNIIPSSTGAAKAVGKVLPALAGKLTGMSLRVPTTDVSVVDLTVNLKTPTTYAEISAAIKKASEGELAGILGYTEDAVVSTDFLTDNRSSIFDASAGILLTPTFVKLISWYDNEYGYSTRVVDLLEHVAKVSSA

SEQ ID NO: 45485 - protein, 357 aa, Glycine max
MGIDSEYVISHKAYARVGLLGNPSDVYYGKTIALSVANFFATVTLRPSDQLILQPHPLHDLLHFSSLPQLVNRLSSQGYYGGVRLLMAICNVFYAYCRENAIDLGDDNFTLSYDTNIPRQAGLSGSSGIVCAALNCLLDFYNVRHLVKVEVRPNLILAAEKELGIVAGLQDRVAQVYGGLVYMDFSKENMNELGHGVYVPVDLSLLPPLYLIYAENPSDSGKVHSKVRQRWLDGDEFIVSSMLEIANIAQEGKTALEEKDYSKFAALMNRNFDLRRLMFGDDALGDLNLKMVEVARKVGAASKFTGSGGAVVAFCPEGTSQVKLLEDECQKEGFVILPIEPLPSRLNEIDLKTLQIK

SEQ ID NO: 45486 - protein, 185 aa, Wolinella succinogenes DSM 1740
MMQKVVLVPLAKGFEELEAVTIIDVLRRAGARVVVAGLDSTDLVQSQGGIFIRPDSKMELIEPQNIDMIVLPGGWGGTVALASHPLVRSMVEALHKRQKPIGAICAAPYALSEIGVIEGQYTCYPGIQEKIQRGEFVESLVVESDHIFTSQGPATALPFALALVEKLFGKAQRDEVARAMLVSDS

SEQ ID NO: 45487 - protein, 365 aa, Pichia pastoris
MLPFQAVAKAGLKPQLTRMSVNSLRAASSSAGPTKLSVRDALNSAMAEELDRDPEVFLIGEEVAQYNGAYKVSRGLLDKYGPKRIVDTPITEMGFTGLAVGASLAGLKPICEFMTFNFAMQSIDHIINSAAKTLYMSGGKQPCNITFRGPNGAAAGVAAQHSQDYSAWYGSIPGLKVISPYSAEDYKGLFKSAIRDPNPTIFLENELLYNEEFEVSPEVLSPDFTVPIGKAKIEREGTDITIVSHSRNLQFCLEAATILKEKYGVSSEVLNLRSIKPLDVPAIVESVKKTNHLITVEAGFPAFGVGSEICAQVMESEAFDYLDAPVERVTGCEVPTPYAKELEDFAFPDTPTIIRAVEKVLSLKE

SEQ ID NO: 45488 - protein, 428 aa, Oryza sativa
MGFLAMTTFKRILKAKSTERFDGLPYLFSLLNCLICLWYGLPWVANGRLLVTTVNGTGAVFQLAYICLFIFYADSKKTSFCLMAICHQERKRMVELCALPPPLSPPSAAPGWAVSRVGLRPRCPSLLALAAIPRVGRRGRRGEEEGRTDMWAPHVGEGGRARSNLGPDNGCDLNVIGDSFRRYGSRRAMFASYEAKGNVLFLSRNLKKIPPIHIPSSAIPAKITSNRLLSTCRFPRTPSLHGGGGGGGDHRTTDDDDGSNGRDQAATLSDVDRFLFDNFRSLYIHDGDNHQQRRQPPPSPGKFTQPAAAETSSSRSESVAEDARGTSSGDEDDNNSSTAIMLFSVDPYTDFRRSMQNIIEMHHGEEPQPLDWDFLEELLFYYLQLNEQSVHKYILKAFADLTAGAHVSCPARGKPQWADKSVRSRKHY

SEQ ID NO: 45489 - protein, 379 aa, Citrullus lanatus var. lanatus
MAMKCMMSTGESKEMKSKLHRVEFGCSEESMVPENFVWPDEFKAKDGAPELHVPHIDLHKFLNGNESDIEEATRLVDEACRKHGFFVLVNHGVDMELIKGVHECMDEFFTLPFDVKQKSQRKFGENYGYANSFIGRFSNNLPWKETLSLPYVANHNSTSVQDFVSKCVGPELSHQGKVYQECGKALSDLSLKIVELLGLSLGVPKEKFKKFYEDNDSIIRLNYYPPCEKPELTLGTGPHCDPTSITILHQDHVSGLQVYVDDEWHSIPPTKDSFVINIGDTFMALTNGVYKSCFHRAVVNCKEVRKSMAFFLCPAADKVVRAPDEVVEKNPPRKFPDYTWPMLLELTQKFYRADSNTFQAFIPWLEKQKSANTIAPPAL

SEQ ID NO: 45490 - protein, 473 aa, Pichia pastoris
MSALTALRVTRPLLRFPAARVSLNLFARGYASKSWPEHTVIDMPALSPTMTQGNIVKWHKAVGDQLEPGESIAEVETDKASMDFEFQEDGYLAKILLGDGTQEIPVGKPIAVYVEDKADVEAFESFTIEDAGAPAAAAALAKEEPKEEPKEAATPAPSSEESKSEAKPSSSKQPRPAGSRIIASPLAKTIALEKGISLKEITGTGPNGRIVAKDVESYKPKSTAAPAAPVSSPAPSTATAAYQDIPLTNMRKVISKRLTESKQSAPNYIISSSISVSKLLKLRASLNASSNDRYKISVNDLLIKAIAVACKRVPEANAYYLEQEGVIRQFENVDVSVAVATPTGLITPIVFNADSKGLETISKTVKDLGKRAKENKLKPEEFQGGTITISNLGMNPSVSFFTSILNPPQSAIIAIGTTEKKAVPDKGSPHGFVFDDVIQITGTFDHRTVDGAKGGEWVRALKQIVENPLELLL

SEQ ID NO: 45491 - protein, 499 aa, Nicotiana tabacum
MANKVVCPKLLKNLGFHVRRLNSAPSPLSAVPPLSFTGDFNATTVTTPNLVDTVPQINTVPDKNNIINFDDVKELFYGVPTSKLIRSTLTLQMAAIDPMVDMGMWVMNSKLMEMPIFREVMLGFVKNTFYEHFCAGKDLTEVRRTVSKLSDGGLKAMLDYGVEHATNNESCEQSMKAFIQTIESTKSLPQSSTSFVVVKITAICTPRLLKRMSDLLRWEHKDPSFNLPWKQKTLPLFAESSPLYHTSKKPEPLTVEEERDLQLARERLTKICEKCLEHDVPLLIDAEDTTIQPGIDYMAYSAAIKYHKDDDPLIFGTIQAYLKDAKERMAIAKKAAEKMGVPMGFKLVRGAYMCSERELASRLGFQSPIHDSIEQTHACFNSCAEFMIEEIANGSGAVVLATHNIESGKLAATKAIDMGIKDSQKLQFAQLYGMAEGLTFGLRNAGFQVSKYLPFGPVDQIMHYLMRRAEENRGMLSTSAFDRQLMRKELSRRLKVATS

SEQ ID NO: 45492 - protein, 499 aa, Nicotiana tabacum
MANKVVCPKLLKNLGFHVRRLNSAPSPLSVVPPLSFTGDFNATTVTTPNLVDTVPQINTVPDKNNIINFDDVKELFYGVPTSKLIRSSLTLQMAAIEPMVDMGMWVMNSKLMEMPIFREVMLGFVKNTFYEHFCAGKDLTEVRRTVSKLSDGGLKAMLDYGVEHATHNESCEQSMKAFIQTIESTKSLPQSSTSFVVVKITAICTPRLLKRMSDLLRWEHKDPSFNLPWKQKTLPLFAESSPLYHTSKKPEPLTVEEERDLQLAHKRLTKICEKCLEHDVPLLIDAEDTTIQPGIDYMAYSAAIKYHKDDGPLIFGTIQAYLKDAKERMAIAKKAAEKMGVPMGFKLVRGAYMCSERELASRLGFQSPIHDSIEQTHACFNSCAEFMIEEIANGSGAVVLATHNIESGKLAATKAIDLGIKDSQKLQFAQLYGMAEGLSFGLRNAGFQVSKYLPFGPVDQIMHYLMRRAEENRGMLSTSAFDRQLMRKELSRRLKVATS

SEQ ID NO: 45493 - protein, 522 aa, Oryza sativa
RAAADACVGGGRGRGARVVRRAGDGVGVVEAAAPGAGAPCPGPPRHAVPLPGGRRAAQRAAQRRGEGADHAARLPTTSCRARCRCSTRPCKEHGKVSITWFGPVPRVTITKPELVREVLSNKFGHFEKLKFGRFQRLLHNGLGSHEGEKWAKHRRIINPAFHLEKLKRMLPAFAACCTELVDKWEGLAKGGDEPYEVDVWPEMQSLTGDVISRAAFGSSYLEGKRIFQLQGEQIELIVATMNKIHIPGYIHLPTKSNRRMKQIAAEIEGMLKRIIAKRESALKAGEASSDDDLLGLLLESNLDHSKGNGGAASSGISIDDVIGECKLFYFAGMETTSVLLTWTMVVLSMHPEWQDRAREEVLHVFGSRAPDYDGLSRLRIVTMVLYEVLRLYTPLTALQRKTYKPMELGGVRYPAGVVLTLPLLCVHHDKDVWGADADEFRPERFAEGISKASREAPAFFPFGWGPRICIGQNFALLEAKMGLSMILQRFSFDLSPSYTHAPFPVGLLQPEHGAQVRLTRLN

SEQ ID NO: 45494 - protein, 370 aa, Oryza sativa
  misc_feature (103)..(103): Xaa can be any naturally occurring amino acid
  misc_feature (150)..(150): Xaa can be any naturally occurring amino acid
  misc_feature (203)..(203): Xaa can be any naturally occurring amino acid
MGAVSMSTTTRLPLVAALLSAAACVAAAQPATAEAAPETPGVGIKVSFRPSVAIVVGIFTMIFSLTFLLLMYAKFCHPSSPVAAPAPTVVPAAAADDGVAKPXGLECAVCLARFDDADLLRLLPRCRHAFHLDCVDRWLESKASCPLCRXARVDAEDAALGLKYASSARFVPAGGASESERFDGDQDIVGIFVERVPSSRMEXPAAAAHCPDLDRYKHRIVVSDTVFKSRWSEINSSDLIALDTELLRSMETMEVEMEMELYKETEEEETDHDHQRKTLLAASGGRSSVDAAARARMISSSSSSGSVRSMSEMVSLPRLRAAMRERLAHEDRWVPIARRTARWFAGRESRHDEAAPVVDSPPASHSNSLV

SEQ ID NO: 45495 - protein, 142 aa, Zea mays
  misc_feature (114)..(114): Xaa can be any naturally occurring amino acid
MASLAAVSVKPVAIKGFAGRSISGRKLAVARPLGRSIRRPRATAVVAKFGDKRVYFDLDDIGNTPGQWDLYGFEGPLPYNPVQSKFFETFAGPFPKKGLLVKFLLVGGGSLLAXVRGLGSPDLLPIKKGPQEPPQPGPRGKI

SEQ ID NO: 45496 - protein, 429 aa, Vibrio vulnificus YJ016
MTRIIVVGGGAGGLELATKLGRTLGRKRRAQITLVDRKASHLWKPLLHEVATGSLDEGVDALSYRAHAKNHCFDFQMGSLENIDRERKVVILSELKDEHGELLMPSRELEYDLLVLAIGSTSNDFNTPGVREHCIFLDSPEQAHRFRHEMNNQFLKLHAKNGHGTVDIAIVGAGATGVELSAELHNAIKELRTYGFGDLDSSKLNVNLVEAGERILPALPPRISSAAHSELVKLGVNVRTATMVTKAEADGLTTKDGEKIPAQIMVWAAGIKAPDFMKDIAGLETNRINQLVVKNTLQTTRDDDIFVIGDLAQCTQADGKFVPPRAQAAHQMASHAFSNIIAKLNGRELKDYVYKDHGSLVSLSRFSTVGSLMGNLTKGSMMVEGRIARVVYISLYRMHQMALHGIFKTGLMMLVGRINRVLRPNLKLH

SEQ ID NO: 45497 - protein, 298 aa, Arabidopsis thaliana
MGKQLAKKITWAIENFSSLHSKKIYSDPFIVGGCKWRFLVYPKGNNVDYLFLYLEVADYESLSPEWRRHARYLLNVVNQNSVKRSKQNEEQKWFDVQSPRWGRLSMFPLNEINAKDSGFLVNGELKIVAEIEVLEVIGKLDVSEETSTIMESMDFNGFQLLPSQVDFVRHMFEKHPEIASEFRLKNPNLRAGYMSLLLSLIETLRQSPQELNKVDLAEGYVALRSITDAGFKVDWLEKKLVEISEKKNKEEAGETRMQEINEELESLKQKCLDLEAQLEKEKAEVFAAKSPLSFNDVF

SEQ ID NO: 45498 - protein, 307 aa, Arabidopsis thaliana
MEKEVDKKFVWVIKDLNVFYPKQSHSDPFLIAGSRWRLLALPKGTNYEFFYQYMGVADSCQSLTSSWRRHVKLRLTIVNGISHKRSIVTDSDLYFDENLPACSYPTVPPPFNLLARDAGFLICREITIVIEVVSLEVIGTSNNDGANSIDLLKQTQQIIDVNGFQVLPSQVESVKRIFEIYPNIASEVPSMKPCLKTLYMNVLLGIIETLCQLPAELSDTDLDEASIAVLFVSQGGFKVDWLEKKLKEVKEKKKNVDNGKARLQQIEEDLQKLNQKRLDLKDILDKEKANDLTANVPLSFNDVLKMF

SEQ ID NO: 45499 - protein, 424 aa, Bartonella quintana str. Toulouse
MRFFSYNQGVLHAEGLSLSALAQDVGTPFYCYSANALVTRFKDYQNAFRDMPSLIAYAVKANSNQAVLQLLAANGAGADVVSEGELRRALAAGIPAHCIVYSGVGKTVKEIDFALAHDICCFNVESEPELEQLSARAVAFSKTARISLRINPDVDAKTHKKITTGKYENKFGIPLSLAWDVYKKAAQLPGIHVCGVDMHIGSQICDLKPFEDAFLIVADFVRHLSSSGYALTHVDIGGGLGIAYGHEQHSVPSLFDYAALVKRHIAPLGLKIIVEPGRSIIGEAGVLVTSVIYLKRGEGRNFVVVDAAMNDLIRPTLYDAWQNVLLVKQAPEDASFIRADIVGSVCETGDYLALDRRVPILAAGDLLAITGAGAYSAVMASTYNSRLLVPEVLVQDTRYAIIRPRLDYAQLIGCDHIPDWIEHR

SEQ ID NO: 45500 - protein, 365 aa, Bradyrhizobium japonicum USDA 110
MIAPALQFWGNVMQLIVLPGDGIGPEITTATSGVLRAASERFQLNLRLEEHAVGHASLKQFGTTVRPELLDIVRGADGLILGPTATFDFKDEAHGEINPSRHFRKNLDLYANVRPARTYAGRPGRLGDFDLVVVRENTEGFYADRNMEQGNGEMLVTPDVAISLRRITRACCERIAHAACRLAMKRRRHLTIVHKANVLKIGDGMFLDICRAAAKGYAGLEVDDILVDAMMAHVVRNPDRFDVIVATNMFGDILSDLTAELSGSLGLGGSLNVGDRYAMAQAAHGSAPDIAGQDVANPVSLILSTALLLAWHGERSGAVRYEEAARAIEAAVAKAIGEGRATRDVGGRLGTIAAGAAIAEILQGA

SEQ ID NO: 45501 - protein, 127 aa, Triticum aestivum
PHQPPPPQLLHLHLSQLQGRKRSAISGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 45502 - protein, 638 aa, Magnaporthe grisea 70-15
MSDADKEIQPQVHRKQNPRTYKQANSDSSSGSDKDGVPRNGKPSTEPGLDAKHIDHADLEALNRNAEARIKNPLAGIPYDRLMADVEAFTQQKGLTEYTAVFKQGALIAQDPDSYDNLPGEHALAAEDKEALRLEGWDQTGINGANVYMQEEYKIGDDSTGSRLILGLVNAGPYLGSALLGCWLSDPVNNWIGRRGVIFVSAHFCLWPVIGSAFCHTWEQQLICRLLMGVGMGIKASTVPIYAAENSPASIRGALVMSWQMWTAFGIFLGTAFNVAVFSVDNRINWRLMLGAPFIPAVPLLLLIYLCPESPRWYMKKDRYADAWKSIQRLRFTKVQGARDIYYIHSQLVLENEVMGKSTYATRFVELFTIPRVRRATLAAFTVMLAQQMCGINIIAFYSTTVFEDAGFGRYEALLGSLGFGLVNWLFAFPAFWTIDTFGRRSLLLFTFPQMTWTLLAAGLCTLIDNDGPQAKLRLGLVALFVFLFGAFYSPGEGPVPFTYSAEVFPLSHREVGMGFAVATCLFWAAILGITFPFLLDRFKVVGVFGFYAGLNVLALIMIFLWVPETKQRTLEELDYVFGSPTAKFINYQCTKALPWWFKRWVLFDRNAKLEPFYKEDRHAEHVQTTTSGGAVDEKRAI

SEQ ID NO: 45503 - protein, 210 aa, Synechocystis sp. PCC 6803
MPESSTPSLLIPNFPPRAAAVHRVTKETDVRVSLNLMGSGLCHVATGVPFLDHMLHQIASHGLIDLEVNATGDIEIDDHHTNEDVGITLGQALAEALGDRRGINRFGHFIAPLDEALVQVTLDFSGRPHLSYGLQIPTERVGTYDTQLVREFFVAVVNHSQMTLHIRQLDGINSHHIIEATFKAFARAMRMAIEVDPRRADTIPSSKGVL

SEQ ID NO: 45504 - protein, 356 aa, Aspergillus oryzae
MNSVDIGRCRKRIVQYIWDPEPRNDEEPDASIWCLGVEYAPQPQKITANTTPDNDEANHPMTLTVRIRTQLMDPQGFTSDTGWGCMIRSGQSLLANAMLTLCLGRDWRRGDKAEEEARLLSLFADHPDAPLSIHRFVKYGAESCGKHPGEWFGPSATARCIEALSAQCGNIAPRVYVTNDTSDVYEDSFLRVARSGSGSIQPTLILLGTRLGIDNVTPVYWDGLKAVLQLPQSVGIAGGRPSASHYFIGTQGPHFFYLDPHTTRPAVPYSIDGRLLSKTEISTYHTRRLRRIHIQDMDPSMLIGFLVRNEDDWEDWKGRVGSVVGKQIIHVFKGEEATYNQGRRGALDEVEALDDA

SEQ ID NO: 45505 - protein, 444 aa, Gibberella zeae PH-1
MARQSMLTRTNLATAPACALCRQLTVSRGPTRIHSASLHTSPRRDSAWGAAVQVASNVVSNVVKRASKDAMHIDPLRSVAKEMKFLTGNIRKLLGSGHPSLDRAAKYYTQAEGKHVRPLIVLLMSRATYLCPKTPATVPTVTHRGVDTSLSPAQILADVNPAAHPLSSPEQEIADANSDILPSQRRLAEIAELIHTASLLHDDVIDHSVSRRGSPSANLEFGNKMAVLAGDFLLGRASVALARLRNPEVVELLATVIANLVEGEFMQLKNTERDERNPKWSEETVTYYLQKTYLKTASLISKSCRAAALLGNTDAVTVDAAYSYGRNLGLAFQLVDDLLDYTQSGSDLGKPAGADLELGLATAPLLFAWKQMPELGALVGRKFAQEGDVQRARELVLQSDGIEQTRALAQDYVDKAIASIADFPESEAKDGLIEMAHKSLKRQK

SEQ ID NO: 45506 - protein, 86 aa, Brassica napus
  misc_feature (13)..(13): Xaa can be any naturally occurring amino acid
  misc_feature (50)..(50): Xaa can be any naturally occurring amino acid
  misc_feature (56)..(56): Xaa can be any naturally occurring amino acid
MSCSSSSGSKRAXQCFDSYRQGGYHAVMIRDTFSAGRYIAQTKHGWGEFXTVRVAXNTLPCNQVALNIQKSSQEVLQVSISEIDFH

SEQ ID NO: 45507 - protein, 523 aa, Amylomyces rouxii
MPPNTAADRLLSSTSTRSSNIVTEEKFQELIKQGDSVFIYEQKVYRVNNFMAKHPGGEAALRSALGRDVTDEIRTMHPPQVYEKMINLYCIGDYMPDVIRPASMKQQHTFTKPKEDKPVLTATWEGGFTVQAYDDAIQDLHKHHSHDLIKDAVLQKDLNGDQIRNAYRKLEAELYAKGLFKCNYWKYAREGCRYTLLIFLSLWFTLKGTETWHYMAGAAFMAMFWHQLVFTAHDAGHNEITGKSEIDHVIGVIIANFIGGLSLGWWKDNHNVHHIVTNHPEHDPDIQHVPFMAITTKFFNNIYSTYYKRVLPFDAASRFFVRHQHYLYYLILSFGRFNLHRLSFAYLLTCKNVRTRTLELVGITFFFVWFGSLLSTLPTWNIRIAYIMVSYMLTFPLHVQITLSHFGMSTEDRGPDEPFPAKMLRTTMDVDCPEWLDWFHGGLQYQAVHHLFPRLPRHNLRQCVPLVKKFCDEVGLHYYMYNFSTGNGVVLGTLKSVADQVGFMNEVAKSNAEIWANDKEHAH

SEQ ID NO: 45508 - protein, 261 aa, Pisum sativum
MAGLFVNQGKEYAIARPSYPPQLFQFIASKLLLTTLFGMSPPEGQAAKSLANLYKNVIATDVSEKQLEFATKLPNVQYQHTPSTMSIPEVEQIVAQQGTIDLVTIAQGLHWFNLPNFYEQVKFVLKKPHGVIAAWCYFLPRISDEVDIVLDQFYYSDANPYWDSARKLVEDNIRSIDFPFEAVDGVDHTGPFEFVTETLMSFDGLLTYIRSWSAYQTAKEKGVELLREDVVEKFKVAWGEDHAPKTAKFPIYLRIGKVRNV

SEQ ID NO: 45509 - protein, 323 aa, Triticum aestivum
MAAATPHSPPPQQLSSPFLEYITAPGGLDKVVLRGRRSCSVEIRLFGGQVTSWKNDHGEELLFVSSKAIKPPKPFRGGIPICFPQFGTQGNLKQHGFARNRLWAIDDNPPPLPVNPAIKAFVDLILKPSEDDLKMWPHSFEFRLRIALGAGGDLSLTSRIRNTNTDGRPFSYTFAYHTYFSVSDISEVRVEGLETMDYLDNMKGKERFTEQGDAIVFESEVDKVYLAAPSKVAIIDHDMRRTFVVTKEGLPDAVVWNPWDKKAKAMQDFGDLEYKHMLCVEPAAVEKPITLKPGEEWKGRLGLSAVPSSYCSGQLDPLKVLHG

SEQ ID NO: 45510 - protein, 197 aa, Arabidopsis thaliana
  misc_feature (47)..(47): Xaa can be any naturally occurring amino acid
  misc_feature (62)..(62): Xaa can be any naturally occurring amino acid
  misc_feature (76)..(76): Xaa can be any naturally occurring amino acid
  misc_feature (120)..(120): Xaa can be any naturally occurring amino acid
  misc_feature (129)..(129): Xaa can be any naturally occurring amino acid
  misc_feature (165)..(165): Xaa can be any naturally occurring amino acid
PCECTPPPLPLHTRPSALVHLTLAPPDDHLRIRPTNCQVRVTIRLGXTERQLTLTSRIRKTXNSDAQAITFTLAYXHTYFSVSNIMEVRREPWYTLDDLDNLNDLQRYTAHRYPMTFESXCDEIYLSTXPTQTAILNRYKKRTFVILSDGLADAEARNPCDKNSXTISDLRDEDDEHMLCVQSACIDRPITLEPVEQ

SEQ ID NO: 45511 - protein, 146 aa, Triticum aestivum
  misc_feature (73)..(73): Xaa can be any naturally occurring amino acid
  misc_feature (83)..(83): Xaa can be any naturally occurring amino acid
  misc_feature (92)..(92): Xaa can be any naturally occurring amino acid
  misc_feature (105)..(105): Xaa can be any naturally occurring amino acid
  misc_feature (111)..(111): Xaa can be any naturally occurring amino acid
  misc_feature (128)..(128): Xaa can be any naturally occurring amino acid
  misc_feature (141)..(141): Xaa can be any naturally occurring amino acid
  misc_feature (144)..(144): Xaa can be any naturally occurring amino acid
LGPDVDAMKAVADAYSKRSLKYFETALRDYKAQLEEDPIVHRHLSSLYDTLLEQNLCRLIEPYSRVEIAHIAXIIELPMNHVXKKLSQMILXDKKFAGTLDQGAXCLIIFXEDSKTEEIFPATLETIXNVCKVVDSLYMRXGKXMA

SEQ ID NO: 45512 - protein, 321 aa, Methanosarcina acetivorans C2A
MNQTKDSLEPATRIFVEKINRESDTPVYKLSPKDACKVLYDLQAAEVAKLPADIENLTIPVGSEGQVSIRIIRSAGNKEILPVVMYFHGAGWILGDKDTHDRLVREIAKGANAAVVFVNLTLSPEAKYSVQIEEAYAATKYIAENGKEFNLDTSRLAVAGDSVGGNVAAAVSLLAKERGGPKIVYQVLFYPVTDTNFGAPSYRKYSTDIWLTREAMKCFWDNYFSEKEARRQPTAFPLKASDDQLKGQPPALLIIDENDVSRNAVEAYTHKLMQAGVDVVTVRYLGTIHDFVMLNLLGGTPAACSAIGLANENLRNIFSRS

SEQ ID NO: 45513 - protein, 474 aa, Oceanobacter sp. RED65
MSGFHILVVEDDSQLREAIVDTLRLQKINVSEAPSGEQAIQFLKRQVVDMVLTDISMGEISGFDLLNHIKAQYPAIPVVLMTAYGQVEKAVQAMQQGATDYLVKPFEVDVLIDVISQFRNQASAPFGLKGPVAEDPSSKALLKLAAQVATSDATVLISGESGTGKEELARYIHQNSERKSGPFVAINCAAIPENMLESTLFGYEKGAFTGAYNSMPGKFEQAEGGTLLLDEISEMDMGLQAKLLRVLQEREVERLGGRKTIKLNVRILATTNRDLLSYVNEKQFREDLYYRLSVFPLRWKALRERPLDILPIAQRLLSKHGKKQGKPNLIFDESAQTALNQYPWPGNVRELDNVIQRALIIQSGACITASDIVFTMDGDQVAIEPNSQVAQTDFQKSVTQMDDIESNALFIKEESDALGDNLKQQEYSLILDALRQEKNKKQAAEKLGISPRTLRYKLAKMREQGIDLPRKHAV

SEQ ID NO: 45514 - protein, 339 aa, Arthrobacter sp. KW
MSSLTTLPVLDLSRLGAGPEAASQFRDDLRNVMHEVGFFYLAGHGIPQEMTDAILDISRRFFDLPDELKLAVENVHSPQFRGYTRVGGELTDGAIDWREQIDIGVERDTVAAGPGVADYWRLEGPNLWPDALPEMRETVTEWTERLSAISLSLLRALAVSLGAPEDTFDAAFAAQAFPLLKIVRYPGESDPDPKQGVGSHRDGGVLTLLLVEPGKGGLQVEYEGKWIDAPQVPGTFVVNIGEMLELATNGYLKATLHRVISPLRGTERISLPFFYNPALDATMPQLAVDPTFQAKARGLSVDPTNSPILETYGDNALRYRLRAHPNVAEVHHADLIQVH

SEQ ID NO: 45515 - protein, 207 aa, Lactobacillus sakei subsp. sakei 23K
MDGLLVDSEKVYYQANQLAAQKMGFEVTAEDHQAILGTTDTYLRQYFLQKLGSPELVKQFIDLSYRTVDEIIQDQGVAIKPGLVELLDYCDNHGINRVIASSNFRTMVEDFMQSTGLKPRFNQIVSGDEVTHGKPHPEIFLKALDKLAIPAPSALVLEDSPNGILAASKADIPVIMVPDLIAPTAITNQQTLATVDNLAAVIPFLEK

SEQ ID NO: 45516 - protein, 464 aa, Escherichia coli CFT073
MVRSQLSRADAPCLLTSLRRQLMAMFGFPHWQLKSTSTESGVVAPDERLPFAQTAVMGVQHAVAMFGATVLMPILMGLDPNLSIFMSGIGTLLFFFITGGRVPSYLGSSAAFVGVVIAATGFNGQGINPNISIALGGIIACGLVYTVIGLVVMKIGTRWIERLMPPVVTGAVVMAIGLNLAPIAVKNVSASAFDSWMAVMTVLCIGLVAVFTRGMIQRLLILVGLIVACLLYGVMTNVLGLGKAVDFTLVSHAAWFGLPHFSTPAFNGQAMMLIAPVAVILVAENLGHLKAVAGMTGRNMDPYMGRAFVGDGLATMLSGSVGGSGVTTYAENIGVMAVTKVYSTLVFVAAAVIAMLLGFSPKFGALIHTIPAAVIGGASIVVFGLIAVAGARIWVQNRVDLSQNGNLIMVAVTLVLGAGDFALTLGGFTLGGIGTATFGAILLNALLSRRLVDVPPPEVVHQEP

SEQ ID NO: 45517 - protein, 552 aa, Oryza sativa (indica cultivar-group)
MGNQCQNGTLGSDYHNRFPREHAVGYVQGDSYLDLKKFDDTWPEVNNFKPTAASILRRGLDPTSINVLGRKTADLREHYIIGRKLGQGQFGTTYLCTEINTGCEYACKTIPKRKLITKEDVEDVRREIQIMHHLSGHKNVVAIKDVYEDGQAVHIVMELCAGGELFDRIQEKGHYSERKAAELIRIIVSIVAMCHSLGVMHRDLKPENFLLLDKDDDLSIKAIDFGLSVFFKPGQVFTELVGSPYYVAPEVLHKRYGPESDVWSAGVILYVLLSGVPPFWAETQQGIFDAVLKGHIDFQSDPWPKISDSAKDLIRKMLSHCPSERLKAHEVLRHPWICENGVATDQALDPSVISRLKQFSAMNKLKKLALRVIAERLSEEEIAGLREMFKAVDTKNRGVITFGELREGLRRFGAEFKDTEIGDIMEAAHNDNNVTIHYEEFIAATLPLNKIEREEHLLAAFTYFDKDGSGYITIDKLQRACGEHNMEDSLLEEIISEVDQNNDGQIDYAEFVAMMQGSNVGLGWQTMESSLNVALRDAPQCQAAEATDEPVH

SEQ ID NO: 45518 - protein, 714 aa, Oryza sativa (indica cultivar-group)
MGYAAADLGAWKNTRQQYSPSSPISLGSSVFSESSLELSTTTADGSTANAVLAAIVASIGNLLQGWDNAAIAGAIMYIKNEFNLQNDPMMEGLILAMSLIGATIITALSGMITNSIGKRPLLSVAAILYSISALIMFQVSNEYMLLLARLIYGFGSGLVVTYAPLYISETAPTNMRGLLNTLPQFNGSLGMLLSYIMVFLMSLTLNPNWRIMLGSLSIPSFVFLLLCIFYLPESPVFLVSKGKIEEAKNVMKRLRGTNEVSSEIAFLIQGLTVDQDNYIEDYMIGHNNDEFDDQSISNTETTKLYGHEEGVTWFARPFKGKNVVESDHSPIPNLLDPIVTLFDSIHGNILNTPEFTSSGNMSNDIEQPKTDLESQEDLDTDYEDDLGHPLLFHQGSYMEGIDDACVNGGWHMAWKFVQRENEFGQTQDDFQQIFLQGDILQAGRVSHATALVSTPSFHHSIGPAMVHPSKFNLSTEGQSWSDLLQPGVKQGLIVGVTIQILQQLAGISGILYYTPQILEQAGAGILLKWFNVSSSSSSILTSALTTFMMLPSIGIAMKCMDRYGRRSLLLYTIPMLIVSLIILIVVNVMNLEAIFGAILSTFGVIIYVCCFVMGFGPIPNVLCSELFPPSCRNRCMSICTLTFWIVSIIVTYAFPVMLSSIGLIGVCGIYAVVCIVSFIFVLIKVPETKGMPLAVIANSLAVGARLSVKRNENI

SEQ ID NO: 45519 - protein, 583 aa, Securigera parviflora
MCGILAVLCAENSQAKRVRVLELSRRLKHRGPDWSGLHQHGDCYLAHQRLAIVDPASGDQPLFNEDKSLIVTVNGEIYNHEELRKQLPNHKFRTGSDCDVIAHLYEEHGENFVDMLDGIFSFVLLDTRDNTFIVARDAIGVTSLYIGWGLDGSVWISSEMKGLNDDCEHFECFPPGHLYSSKDRAFRRWYNPPWFSETIPSAPYDPLALRHAFEKAVIKRLMTDVPFGVLLSGGLDSSLVASITSRYLATTKAAEQWGSKLHSFCVGLEGSPDLKAAKEVADYLGTVHHEFTFTVQDGIDAIEDVIYHVETYDVTTIRASTPMFLMSRKIKSLGVKWVISGEGSDEIFGGYLYFHKAPNKEEFHRETCRKIKALYQYDCLRANKSTFAWGLEARVPFLDKEFINVAMNIDPENKMIKRDEGRMEKYILRRAFDDEEHPYLPKHILYRQKEQFSDGVGYSWIDGLKEHAAKHVTDKMIFNAANIFPHNTPTTKEAYYYRMIFERFFPQNSARLTVPGGASVACSTAKAVEWDAAWSNNLDPSGRAALGVHLSAYDNQNNLANKPVEFEKIIPMEAPSLGVAIQS

SEQ ID NO: 45520 - protein, 118 aa, Triticum aestivum
  misc_feature (48)..(48): Xaa can be any naturally occurring amino acid
  misc_feature (57)..(57): Xaa can be any naturally occurring amino acid
  misc_feature (60)..(60): Xaa can be any naturally occurring amino acid
  misc_feature (67)..(67): Xaa can be any naturally occurring amino acid
  misc_feature (69)..(69): Xaa can be any naturally occurring amino acid
  misc_feature (74)..(74): Xaa can be any naturally occurring amino acid
  misc_feature (87)..(87): Xaa can be any naturally occurring amino acid
  misc_feature (90)..(90): Xaa can be any naturally occurring amino acid
  misc_feature (94)..(94): Xaa can be any naturally occurring amino acid
  misc_feature (105)..(105): Xaa can be any naturally occurring amino acid
  misc_feature (107)..(107): Xaa can be any naturally occurring amino acid
  misc_feature (111)..(111): Xaa can be any naturally occurring amino acid
VAIASPPSNLRTPPWPQAVMASSATTVAPFQGLKSTAGLPVSCRSGKXTASASVSNXGRXRCMQVWXIXGNKKXETLSYLPPLSTGXLLXQGHXFFRSNGVPCLXFXKGGXSFRGKPG

SEQ ID NO: 45521 - protein, 2272 aa, Cryptococcus neoformans var. neoformans B-3501A
MPMFRRSASSHSTSDAAAPPTLTNVTEGSPVASGTLTRQKRSRSHGGGGSPASTFSSRFGIPRYLPHQHQQSHEQEQGEAPRPDKPATKEIPVSSEPEVYGSEAGEESNFGQEPADEQLVPETGSWSPQSRHSSRKLSVQTVEPSSDDEVRSPEERRVSPLIKRLGEEPPFMLPHPSRADSTYQEYPGVVIGSFAGGGPDTLFGNGMQLEGTMDDILDPNAARQEDRGNQAPAGANIAPWLMDDSPPSPSENPSPASPATQERPVKGPAAALREKDLRKASTVLNHFSSVPSLPKIRRHGRAQTTTPDQTPRGSTHSQSNLASSSSSLNNESRESRAGSDDSIQTTLTQKGRRQSPGEWGQASAVPPPSKGTRPGRFGSTASIISGTGSVGEKKKGLFGGLLKRKTNPNLSLNPISHDFTTSEHRGSAGSIPLSASSSKLSSCSLSSLPTKSPSFTSPPEAFSRQFLPANYVHEGAVSPLQEISESPFHLDMNLDDMEGIIDPTKTGLPSTVAYRPSASSEVTTDSSASESMRLEEALNQTSSFGTSVSGASRGSDGTKMPSRIVLGEAERLPAPFTGMDPFQQHRESASTTGSDGKPFSPPSPHTLSPKHHIPPASANQPRRPSALRNVETGQVDETSQLSASEGSIQPISPSWARDSGMITVFNDPFSTSRQKQEQPPNSASLSHSTTAYPSAVTLPGPSTARFPTTTGSTTPSAAWAAPESWGVEADEAPAEETTSSDEDDWTGAGVDEVASASPTSDTLPSPSTSPRASSLSSPKRAPPFGFKSQQRAKPGTSGTTDSTTTATGRRKGKRVGSSGRPATGRPGTSGSAYSPSSLHWIRIYRADKSYMLYNLPLNTSTGELLALLAAQAEQGMVRGKNVAINMKLYICERGQDRMLLPSEKPLTIQHRRLLQLGHTEADHLDELGKNDMAVLCRFIYQAPILPIMDPEEESSYDSFEFIDIANRDLQTIPIFLHLHAHDIIILNISKNPMTDIPLDFIQACTSLKELRMSNMALKRVPISIRASTTLARLDVSCNRIADLESVALHEVETLVSLKVQNNKLTSMPSYFAQMKSLKYLNISNNKFETFPSVVCEMSNLVDLDVSFNNIAELPAKMSDLKSLEKLGLYSNDISNFPESFSTLANLRILDVRRNKITDLSAVYALPNLATLQADNNNIVTLDAQLGANVRQFSVPHNSVTRFTLAPPPNMAVVTYMLTNLDLSHGKISTLADEAFSGLTNLITLNLNFNQFTKLPATLDRLTSLEVFSCTDNMLNLVPAGFGKLRRLRVINLHNNNLKSLPEDLWACGALEIFNASSNLLDSFVPPPADIESVVGRVGSGTSQTSNGRKKHSVPPIGLSIRKLFLADNRLNDDIFHWISLMPSLRIINLSFNDIYEVPPFTLCKCERLEALYLSGNKLTSLPSEDLEKLQSLKVLHLNGNKLQTLPSELGAIKTLQHLDVGSNVLKYNIANWPYDWNWNWNTSLRYLNLSGNKRLEIKPTSAHEMNHASSFRKELSDFTALTQLRVLGLMDVTLRIPSLPDESDEKRVRTSFSDINNMAYGISDMLGSIDNLAMFDLVVPHFRGKENECLFGMFGRATTTLQGGKIAKHVQEIFAETLTAHLHKLEPGEEPSEALRRTFLWGDRKAFEFFSGKLQLEKERKPSWTSFASFDSMFRGWTPGVNSVLRTGASGAVVYLVDKVLHVGSIGDTLVVLSRKGDAELLSKRHDPTDREESARIRKAEAWVSTKGFVNDDKDLDISRAFGYWHECPAVNAAPEIRTRRLQESDEFVIIGNHALWQFCSYQTAVDIARTERDDPMIAAQKLRDFAISYGAEGNVMVMVVNVSDLFLGKGGRARGPSEQTAADASTDVEGYTVAKRQVRRRYDEVGDRTLNRLQQEIEPPVGQVAIVFTDIVNSTHLWETNPAMPTAIKMHHNLMRRQLRLDGGYEVKTEGDSFMVSFQSVTAALLWCFNCQIGLLQQEWPRELLEAHDGKVVHDSNGTIVQRGLRVRMGVHWGAPECEKDPITRRMDYYGPMVNRAARINASADGGQLMASQDVLNEIAPLMEYLNSSDEQVLNDLQGDLKREVMELRRIGLEVRDMGDRKLKGLEVPERLHLLYPKTLAGRLEISNEIRAEVEVNDARKSAERQRSVDIDQVCQLSDIALRLEAVCSYNPTPSSPGDTPTAGVMRLHPPASYLGPSIREDMNDEELWTIIESLVGRIENAMSTLYLKNFGEFSTVLAALESATKIDQKLIVHALALMNEAMENAEENAI

SEQ ID NO: 45522 - protein, 120 aa, Wolinella succinogenes DSM 1740
MTLFERIVAGEIPCNKVHENSDFLAFHDINPKAPIHVLAIPKKCARSFQEVDPSWMGGMTSFIQEVARKLGLDEAGYRVITNIGYDGGQEVPHLHFHILGGTRLAWVDLRENENQAKKSL

SEQ ID NO: 45523 - protein, 328 aa, Arabidopsis thaliana
MNLLFFLQVLQFDQEESFTTSMTKQVGKKFAWVIKNFSSLQCKKFYSVPFQIGDCKWRLSIYPKGNNCDYLSLFLEVADFKSLPSGWRRYVKLRLYIVKQEMWGWGFLYMLPLTKLHDEKEGFLVNGELMIVAEVDALGFIDPLNESEESEDPTQPLKKIKLNDDGAVSSDLLEEASPRKESMEVNGFQVLPSQVESVRLIFERHPDIASEFRAKNQYLRKACMDFLLSLVETLCQSLQEFSNEDLVEADIALTYLKDAGFKVDWLEKKLDQVRDKKEKERSCLAKLQETEETLLKLKQKCTELDALMDTEKAELSAIRTPLSFEDVV

SEQ ID NO: 45524 - protein, 440 aa, Schizosaccharomyces pombe
MPPKEDWEKYQKPVDTEEENDKNPPPLDEGDIELLKSYATGPYARELAAIKEDTEAVLKRINDTVALGIKESDTGLAPISFWDVAADRQRMSEEQPLQVARCTKIIENEQSAEKNAYVINLKQIAKFVVSLGERVSPTDIEEGMRVGCDRNKYAIQLPLPPKIDPSVTMMQVEEKPDVTYGDVGGCKEQIERLREVVELPLLSPERFVKLGIDPPKGIMLYGPPGTGKTLCARAVANRTDATFIRVIGSELVQKYVGEGARMVRELFEMARTKKACIIFFDEIDAIGGARFDDGAGGDNEVQRTMLELITQLDGFDPRGNIKVLFATNRPNTLDEALMRPGRIDRKVEFGLPDLEGRAHILRIHAKSMAIDKDIRWELIARLCPSQTGAELRSVCTEAGMFAIRARRRVATEKDFLDAVQKVVKGNQKFSSTADYMNMSS

SEQ ID NO: 45525 - protein, 384 aa, Thermoanaerobacter tengcongensis MB4
MPKKDLYEILGVDRNASQEEIKKAYRRLAKKYHPDLNPGDKEAEQKFKEINEAYEILSDPQKRAQYDQFGHAAFEQGGSQQGGFGDFGEGGFDFDFGGFGDIFGDIFSDFFGTGRRKAEKGPKKGADIRYDLTLTFEEAAFGTEKEIEVERFEVCDVCHGTGVKPGSRPETCPVCHGTGEIRQTQNTPFGRIVNIRTCPRCHGEGKIITDPCQKCGGTGKIRKRRKIKVTIPAGIDEGQMLTLRGEGEPGLRGGPNGDLYIVIHVKPHEIFKREGYDVYVKIPISFADAALGGEIKIPTLDGMVSFTIPEGTQTGTKFKLRGKGIPHIGGRGRGDQIVEVYVEVPKRLSEKQKELLREFKRLEGENTAEHKSFFQRMRDAFGGS

SEQ ID NO: 45526 - protein, 552 aa, Arabidopsis thaliana
MEKQAHKKFCWIIKNFSPQSERLYSVPVLIGDCKWRPIAYPIRDKYFSLCLQVVDFESLPCGWGRYVELRLTLRNQHNSLNLSIKADFYFRLLTLFGCNVAETDHCFDEKRTTWGIPIPERIPICKLQTELYQSEHVVKGDFKIIAEVDVFEAVGTLTESDISGKASELLTKKIRNDGNESGDLLKKTSPEKESNHVNESKPVRKLRNFVVLYKRHAAMCSVLQEPICLLGIFHYTNGEASWAEVRVGVFLLNMTLCLPDSQLFPSEVVKARLTIVNQLSEKLSISKESEHCFDEQNPTLGYTFPYELLVEDGGFLVNEDLMIIVEVIGASDVFEDSSTQGKVDVNGFQVLPSQVEYVRSIFERHPDIAVEFRAKNQHLRTSCMIFLLSLIETLCQSLEELSNEDLVEADIALTYVKDAGFKVDWLEKKLDQVKEKKEKELSDMVQLQEMEDHLLKLKQSCSDLDDLVVKKKDELSVTRSPLSFDDVDWLEKKLDQVKDKKEREQSGLARLHELEEYLLKLKQKCSNLDLLVEKENVELSATRTPMSFNDVV

SEQ ID NO: 45527 - protein, 232 aa, Magnetospirillum magnetotacticum MS-1
YPQRSTLCVSSQAGCGMACPFCATGQLGLTRNLSVAEIVEQVRSAARSLADGEIPGGPARLNNLVFMGMGEPLANYKAVMGTVRRLVAPAPDGLGMSARNITVSTVGLVPAMRKLADEGIPVTLALSLHAPDDDLRSELVPINTRWSVDETLDAARHYFEVTGRRVSIEYALIKDMNDHAWRADLLGEKLNARGRGWVHVNPIPLNPTPGSIWTGSDPAVEAEFVARLRGHG

SEQ ID NO: 45528 - protein, 553 aa, Burkholderia pseudomallei K96243
MTQKFEEGLGRREANYVPLTPIDFIARAAEVYGERLAVVHGEIRRTWSETYARARRLASALERAGVGRGDTVAALLPNIPAMIEAHFGVPMAGAVLNALNTRLDVASMLFMLRHGEAKVLIVDTEYAEFAHRAALEVPGLAIVSVADAMPADPARFPAALDYEAFLAGGDPAYAWTPPSDEWEAIALNYTSGTTGDPKGVVYHHRGAYLAAISNLLEWDMPKHAVYLWTLPMFHCNGWCFPWAVAARAGVNVCLRKFDAKRVLELIRRERVTHYSGAPIVQSAIANAPAEWRAGIAHEVHAFVAGAAPAPAVIAKMKEIGFDLTHVYGLTEVYGPATVCAKQAHWASLPDDELAQLNARQGVRYHLQAGATVLDPDTMAPVPADGETLGEIMFRGNLCMKGYLKNPHATDEAFAGGWFHTGDLGVLTPDGYIRIKDRRKDIIISGGENISSIEVEDALYRHPAVAVAAVVALPDPKWGEVPCAFVELRDGMSATEEEIIAHCRLLLAAYKIPKTVRFGELPKTSTGKIQKFQLRAQVGSSSAIDLVAAARKPG

SEQ ID NO: 45529 - protein, 403 aa, Ralstonia eutropha JMP134
MNSGTSQQFVIIGSGQAGGWAARTLREGGFEGRIVIVGEEAHPPYERPPLSKAVLTMQKPAESCYLWSMEKLGELNIDTIQGSRATAIHRDRREVELADGGRVPYDRLLIATGARPRRLNCPGADLTGVHYLRTIEDSERIRASLSKGGRLLVVGGGWIGLEVAASAISMGVPVTLVEATDRLCGRSLPESLGRFFMDLHVRHGVEIHLNASLTRLEGNGRVERAVFGNGDAIEVTTVVVGIGVVPNTELAADCGLPLENGIVVNESACTADPSIFAAGDVANQPSSWLNGRVRFESWKNAQDHGVLAASAMLGGDTTGRDIPWFWSDQYDVNFQLLGIPSAGNQVYQKGDASSGRFTQYFVQNNHLTAVAAVNSPRDLRDAKRSMQSQSQFDTTGLVPVPAP

SEQ ID NO: 45530 - protein, 342 aa, Aspergillus oryzae
MTQAPVYQYPLFKMRFRIRGPGGQSTVTLDDSATVNELRTQIVDKTGLTAYDVKYGYPDLKHFLLDELQPNQRISDIGFKLDGEQLLVTKREVPPSNEGLTPISQEPPEKPPTSHTSSGAISDDPPEIPSLEHAGTFVLRIMPDDNSCLFRAVGSALMGGMDAMNELRSVVAQTIQQNPGLYSEAVLEKKPDDYCRWIQNEDSWGGGIELSILSKHFGIEICSIDVQTLRIDRFNEGLPTRCILVYSGIHYDTVALSPSDPPHTHAYAPPEFDTKVFDAADPFVLEKALELCKVLQSKHYYTDTAGFRIRCNTCGGVFIGEKGATQHATQTGHYNFGEASQD

SEQ ID NO: 45531 - protein, 1342 aa, Escherichia coli CFT073
MQHHRYFTITLSCTFQNNRSNGMGTTTMGVKLDDATRERIKSAATRIDRTPHWLIKQAIFSYLEQLENSDTLPELPALLSGAANESDEAPTPAEEPHQPFLDFAEQILPQSVSRAAITAAYRRPETEAVSMLLEQARLPQPVAEQAHKLAYQLADKLRNQKNASGRAGMVQGLLQEFSLSSQEGVALMCLAEALLRIPDKATRDALIRDKISNGNWQSHIGRSPSLFVNAATWGLLFTGKLVSTHNEASLSRSLNRIIGKSGEPLIRKGVDMAMRLMGEQFVTGETIAEALANARKLEEKGFRYSYDMLGEAALTAADAQAYMVSYQQAIHAIGKASNGRGIYEGPGISIKLSALHPRYSRAQYDRVMEELYPRLKSLTLLARQYDIGINIDAEEADRLEISLDLLEKLCFEPELAGWNGIGFVIQAYQKRCPLVIDYLIDLATRSRRRLMIRLVKGAYWDSEIKRAQMDGLEGYPVYTRKVYTDVSYLACAKKLLAVPNLIYPQFATHNAHTLAAIYQLAGQNYYPGQYEFQCLHGMGEPLYEQVTGKVADGKLNRPCRIYAPVGTHETLLAYLVRRLLENGANTSFVNRIADTSLPLDELVADPVTAVEKLAQQEGQTGLPHPKIPLPRDLYGHGRDNSAGLDLANEHRLASLSSALLNSALQKWQSLPMLEQPVAAGEMSPVINPAEPKDIVGYVREATPREVEQALESAVNNAPIWFATPPAERAAILHRAAVLMESQMQQLIGILVREAGKTFSNAIAEVREAVDFLHYYAGQVRDDFANETHRPLGPVVCISPWNFPLAIFTGQIAAALAAGNSVLAKPAEQTPLIAAQGIAILLEAGVPPGVVQLLPGRGETVGAQLTGDDRVRGVMFTGSTEVATLLQRNIASRLDAQGRPIPLIAETGGMNAMIVDSSALTEQVVIDVLASAFDSAGQRCSALRVLCLQDEIADHTLKMLRGAMAECRMGNPGRLTTDIGPVIDSEAKANIERHIQTMRSKGRQVFQAVRENSEDAREWQSGTFVAPTLIELDDFAELQKEVFGPVLHVVRYNRNQLPELIEQINASGYGLTLGVHTRIDETIAQVTGSAQVGNLYVNRNMVGAVVGVQPFGGEGLSGTGPKAGGPLYLYRLLANRPESALAVTLARQDAEYPVDAQLKAALTQPLNALREWAANRPELQALCTQYGELAQAGTQRLLPGPTGERNTWTLLPRERVLCIADDEQDALTQLAAVLAVGSQMLWPDDALHRQLVKALPSAVSERIQLAKAENITAQPFDAVIFHGDSDQLRALCEAVAARDGAIVSVQGFARGESNILLERLYIERSLSVNTAAAGGNASLMTIG

SEQ ID NO: 45532 - protein, 340 aa, Solibacter usitatus Ellin6076
MSAVEATGAATHNASSAAGSLQAELAHKCLYYMLLMREVEDRIERKLYRQGKILGGVYVGRGQEAIPVGSALVAVPEDVMFPSHRDMAVFFIRGVSARRVLAQYMGRLGGLTRGRDGNMHMGDMSVNVVSIISALAATVPVATGAALAMRYKGIPGVAFSYFGDGSTSRGDWHEGVNFASVQKLPVVFICNNNQYAYSTPLHLQMACANVADRGPAYNMPAEIVDGNDVLAVYEATQRAVTHARGGLGPYLLECKTFRMTGHSAHDAATYVPKGLFEEWGKLDPIVRLEKRMLEERWSLQEEIDELHAAVIREVDDAVAWAEQSPYPDAASLLDDVYENQ

SEQ ID NO: 45533 - protein, 323 aa, Solibacter usitatus Ellin6076
MSTTYLEAIREGLWEEMERDPNVFCIGEDIGEYGGAFKVTAGFLEHFGARRIVDTPISEAAIAGASIGAGLMGLRPVAEMQFADFISCGFDQIVNFAAKCRYRWNASVPMVVRSPSGGGIHGGPFHSQNPEMWFVRTPGLKVVCPATAYDAKGLIKSAIRDNDPVLFFEHKALYRRIKEDLPAGDFTVPIGKARVIREGRDLSIITYGAMVWTALEAADKLAPEGISVEVVDLRTLVPLDRDTVCESVRKTSKVLLLHEDTRTGGMAGELAATITENVFEYLDGPIVRVTAPDTPVPYSPPLEEAFLPNADKVVEKARWLYRY

SEQ ID NO: 45534 - protein, 670 aa, Arabidopsis thaliana
MSDLPLDLVEEILSRVSATSLKRLRSTCKQWNTLFKKRSFSQKHFHIAPKESMVLMLKEYRVCSMNINLNVSPPSVEFQGTLGIKDDSHSNLGQVEIVEVYHCDGLLLCATRDNRLVVWNPCLGETRWIQLKDECRRYSTFALGYENNKFCRRNYKILRYWGWFHDHIPDDGGRFRFEIYDFRSDSWKVLDDVPDDRFPPVSVVSLKGNTYWFGSNKKDFLRSFDFTTERFNHIGLPPSRDHGFMALSVVGEEQLSVLQEIETSKMEIFVTNKVGTEEAALLWSKSFIVDLPIGGHCSEVFASLLINEEKKVALCCNLDFETDGNLIFTIGEDNKYYSEIPYATNKPWCRRYGAKLMETAVTHSHLLNPRVPLVTENIRVPAMGVVRVFSKMTFEKKKTTEEKGSSGGKADQGNKGEQLIVSYWGVKPMKITKEDGTEWKWSCFRPWETYKSDLTIDLKKHHVPSTLPDKLAYWTVKSLRWPTDLFFQRRYGCRAMMLETVAAVPGMVGGMLVHCKSLRRFEQSGGWIKALLEEAENERMHLMTFMEVAKPNWYERALVIAVQGIFFNAYFLGYLISPKFAHRMVGYLEEEAIHSYTEFLKELDNGNIENVPAPAIAIDYWRLEADATLRDVVMVVRADEAHHRDVNHYASDIHYQGRELKEAPAPIGYH

SEQ ID NO: 45535 - protein, 231 aa, Triticum aestivum
  misc_feature (211)..(211): Xaa can be any naturally occurring amino acid
MSREENVYMAKLAEQAERYEEMVEYMEKVAKTVDVEELTVEERNLLSVAYKNVIGARRASWRIVSSIEQKEESRKNEEHVNLIKEYRGKIEAELSNICDGILKLLDSHLVPSSTAAESKVFYLKMKGDYHRYLAEFKTGAERKESAESTMVAYKAAQDIALAELAPTHPIRLGLALNFSVFYYEILNSPDKACNLAKQAFDEAISELDTLXEESYKDSTLIMQLLRDNLTL

SEQ ID NO: 45536 - protein, 122 aa, Brassica napus
MAAGPGGGRSMLGSMLLFTVVLSLQEVYRGKLASSELFTILGGFTSSLLFLFSLTFIGNLQESSGTKSSWGAVVIAEIIALVAASTVHRVCITTCFLFSAGLLYEMHKISGYMLSESKSKRH

SEQ ID NO: 45537 - protein, 157 aa, Nostoc punctiforme PCC 73102
MTKKLHEPLLVVEDSNEDFRMLQRLMRLMSVQNPIHRCTNGDEVLEFLYQQGSDAHSKGENLPNSKVALRPSVILLDLNLPGIDGRDILDRLKQDKSFKEIPIVVFTTSSNPKDIELCYQKGANGYLVKPMDAQELKKTIQAFVDYWLDANMPPVLD

SEQ ID NO: 45538 - protein, 441 aa, Chlamydophila pneumoniae CWL029
MIENDFPEASNFESSHFYRDKVGVIILCGGEGKRLSPLTNCRCKPTVSFGGRYKLIDIPISHAISAGFSKIFVIGQYLTYTLQQHLFKTYFYHGVLQDQIHLLAPEARQGDQIWYQGTADAIRKNLLYFEDTEIEYFLILSGDQLYNMDFRSIVDTAIRTHVDMVLVAQPIPEKDAYRMGVLDIDSEGKLIDFYEKPQEKEVLKRFQLSSEDRRIHKLTEDSGDFLGSMGIYLFRRDSLFSLLREEEGNDFGKHLIQAQMKRGQVQTLLYNGYWADIGTIESYYEANIALTQKPHAEKRGLNCYDDNGMIYSKNHHLPGAIITDSMISSSLLCEGCVINTSHVSRSVLGIRSKIGENSVVDQSIIMGNARYGSPSMPSLGIGKDCEIRKAIIDENCCIGNGVKLQNLKGYIKYDSPDKKLFVRDNIIIVPQGTHIPDNYIF

SEQ ID NO: 45539 - protein, 108 aa, Nostoc punctiforme PCC 73102
MIKVILLGIAIFTFAFSSPAFAGDAVSGAKVFSANCASCHAGGKNLVQAAKNLKKEALEKYGLYSAEAIIAQVTNGKNAMPAFGKRLKADQIENVAAYVLSQADKGWK

SEQ ID NO: 45540 - protein, 261 aa, Triticum aestivum
NKFVQKSRLVPVRNSRHTGDPRVREVMTLVELDVLRNTMVGLPGFDGLSTEQRKRLTIAVELVSNPSIIFMDEPTSGLDARAAAIVMRVVRNTVNTGRTVVCTIHQPSIDIFESFDDLLLLKRGGQVIYAGELGRHSHKLVEYFEAIPGVAKITEGYNPATWMLEVSSPLAEARLGINFAEIYANSLLYMENQELIRELSVPLPSYEDLSFPTKYSQKFLQPVVLQPFWKPKQILYWKNSPLTMVIALFLNDGGSNGSWLF

SEQ ID NO: 45541 - protein, 506 aa, Oryza sativa (japonica cultivar-group)
MGDDIDARYEVPRTAEFIRARAYTRVALQFPDEMLRDAAAVAQALRRELGGGGVKLFVMADTAYNSCCVDEVGASHIDAQCVVHYGHACMSPTSNLPAFFVFGKTPLDTDACGRSLLECSRESDKRILVFYGLEYAHALDDLKAVVAELYKSHSRSVEVQYADVLCSVMSPSSAAEVEHGQSDGSTHSDDLSIQSDVATFVNNCCNVEGSTRKYSLGGLTWSTSIDDNMEDYLLYWIGQDNSAFANIVLTFNKCDIVRYDTVANQPSRDVSHLMKILRRRYYLVEKAKDANIVGILVGTLGVAGYLHIIEQMKDLIKAAGKKSYTLVMGRPNSAKLANFPECEVFVYVSCAQTALLDSKDFLAPVITPFEAVLAFSRGREWTGEYLLDFKDLITTDKPEISSTTEEARFSFIKGGYVEDNCLEDNEEQPETSLALAEVTEKALSIKNQNNDAVLYQGGAKSAIDYLKARSYRGLTGEYEGPAPDSVLTGRTGRAAGYNNEKKEITQ

SEQ ID NO: 45542 - protein, 519 aa, Triticum aestivum
HPTLVITMPILFSQELLISVVVVLLVPLYLYLRASCRSKNPAVLPTNWPILHMFPSLVANIHNIHDYGTLVFAGSGHNFRAHSPPGTGMRFFVTCDPRNVRHIFTTNYTNFPKGAEFAAIFDIMGGSLFTIDGEPCLRQRAKVKGVLSNPRLVARIAACCRDKVKNILLPLFTHMASTGTPFDMQEMMSRFMFDLAATALFSVDPGLLSPDMPPMDAAVAMDIVMEVGFLRHVMPASCWKLMKQLNIGPERKLRMAHRVLRVFVVEMMKRRKINTCHVGNDEEQDGVDFVSSFLHDPEYADDDLFHAMMIGYMVAARDTVGTTLTWFFYNLTQNPKIVPIIRNELSPIASNKVASRVGAMVIFEPDETKSLVYLRAALYETLRLYPPAPIERKTVSGDDIMPSGHQVQAGDTIFISLHSMGRMEGLWGKDCLDYNPDRWLSDDGNNLKYVPSHKFLAFNSGSRMCLGKDIAIMQMKTGVATMLWNFDVQAVEGQSIQPKPSCILEVKNGLMVKLKKREM

SEQ ID NO: 45543 - protein, 450 aa, Cryptococcus neoformans var. neoformans B-3501A
MAPKADWEKYDKKVTDEKEEKIVALDESDIQILKTYGQGPYSLHLKKIENQIKDIQKRVNEKIGVRESDTGLAPANLWDIPADKQRSGRPLQVARCQTIIKAANPPSGDQPLNPQDGAGAGNPEGDRYVISIKQVAKFVVGLGDEVSPTDVEEGMRVGVDQVTYKIMLPLPPKIDPSVTMMQVEERPSITYADVGGCKEQIEKLREVVELPLLEPERFVSLGIEPPKGVLLYGPPGTGKTLCARAVANRTDSTFIRVIGSELVQKYIGEGARMVRELFEMARSKKACIIFFDEVDAIGGARFDDGAGGDNEVQRTMLELINQLDGFDPRGNIKVIMATNRPDTLDPALLRPGRLDRKVEFSLPDNEGRTHILKIHGKSMSVERDIRYDLIARLCPNATGAELKAVATEAGMFAIRARRKVATERDFLDAVEKVIRQGSKFSSTALYAQYN

SEQ ID NO: 45544 - protein, 114 aa, Thermoanaerobacter tengcongensis MB4
MSECIFCKIVNKEVPSNIVYEDDLVVAFRDINPQAPVHILIVPKEHIPTLLDVTEENKHLISRAYMVAKEIAKKEGIDEKGYRIVTNCGKDGGQTVYHLHFHLLGGRFMTWPPG

SEQ ID NO: 45545 - protein, 123 aa, Oryza sativa (japonica cultivar-group)
MGKLYGLFWVMALVLATVAGTKSDEGCSRDLQDLIMECQKYVMNPANPKIEPSNACCSVIQKANVPCLCSKVTKEIEKIVCMEKVVYVADYCKKPLQPGSKCGRPKAIEKSLSMEKVNYVVDY

SEQ ID NO: 45546 - protein, 287 aa, Zea mays
RKASPAFISCFEPRPTDVFLASFPKSGTTWLKALAFATLKRSTHPPFDDDHPLRHCNPHDCVRFLELDFNQQKDELEALPSPRVLATHLPYSLLPGSITGDGERSGCRIVYVCREPKDVLVSSWLFTRKAAPACGVDARSFTIQEALELFCDGRCLGGPQWNHVLHYWKESVRRPDMVLFLRYEEVLIEPEAHVRKLANFMGCGFSEEEEERGVVSAIVELCSLGKLKDMEVNRNGSTMLGIKNESFFRKGVVGDWSKHMTQEMAQRLDKVVEDALQGTGFTFASTA

SEQ ID NO: 45547 - protein, 345 aa, Oryza sativa (japonica cultivar-group)
MGERRSGYRDRGGGEQGRYWRPPRSHVPRWGNGNFSVPLWEKKFCTDACAIPWGKLCETKKLMSLYKNVVDWDDSAALETFNDAKARFCAVYHGQPCDIPLPDPNMYIDMVNQDEHVDPELVADLEKSRRSYPKRDNTAPDGWDSFIFTNKPVPATGWGDGETSNTPGQQYPTNWNNHVKQPTEANCMQSSVNWDNYVSQPPQATVQQSSGNWDMYVKQQDQANNWEAPTMPGTWDMKGDSLDAWKRDSGWGSAAIDSWDNHRENCYVPDSQGWSYGHWKRRNNESSRRNSRGRDRVGPISSKAMKPKYHSEERNGANNGWRHCRVRNNMQYSYENPGCNQSLAM

SEQ ID NO: 45548 - protein, 300 aa, Brassica napus
MAGGFVSQTPGVRNYNYKLTPKVFVTCFIGAFGGLIFGYDLGISGGVTQMEPFLEEFFPYVYKKMKNAHENEYCRFDSQLLTLFTSSLYLAALVSSLFASTITRVFGRKWSMFLGGLTFFIGSAFNGFAQNIAMLLIGRILLGFGVGFANQSVPVYLSEMAPPNLRGAFNNGFQVAIIFGIVVATIINYFTAQLKGNIGWRISLGLACVPAMMIMIGALILPDTPNSLIERGFTEDAKKMLQSIRGTSEVDEEFQDLIDASEESKQVKHPWKNIMLPRYRPAVDNDWLHPFFQQLTEIYY

SEQ ID NO: 45549 - protein, 451 aa, Burkholderia pseudomallei K96243
MNAPTEPTAPDTTVRTDAEWLDAHWMPFTANRQFKRDPRIIVEGKGAYYTAADGRQIFDGLSGLWCCGLGHGRAEISDAVARQVARLDYSPAFQFGHPQSFELANRIKAMTPAGLDYVFFTGSGSEAADTSLKLARAYWRAKGKGTKTRLIGREKGYHGVNFGGISVGGIGPNRKLFGQGIDADFLPHTQLPENRFSRGLPERGAELAERLLDLIALHDASNIAAVIVEPFSGSAGVVVPPKGYLQRLREICTAHDILLIFDEVITGFGRTGAMTGAEAFGVVPDIMNVAKQVTNGAQPLGAVIASKDVYDAFMAAGGPDYMLEFPHGYTYSAHPVACAAGVAALDLLVKEDALGRVRELAPYFEAAVHGLKGVRHVADIRNCGLAAGLTIEHAPGEPARRPYEIAMHCWKNGFYVRYGGDTIQLAPPFIAEKREIDSLIGALNDALLATD

SEQ ID NO: 45550 - protein, 875 aa, Polaromonas sp. JS666
MSGPQAFGLDPLVTLALAVAFTLFVVLAWLALRRGRARRRAAEAPAAGDAGAAQPRKIVIFYSSIGHGHISAAQAIEQEIGQLEPGARVILQDIREFMHPLWRWVDERLYWFIAGNLPESFDALFHALQARGKRVPSLAWLSNDYPQDKVRAFLEAQAPDAILATHYGSAQVLGTLRERGLLAQVNIGWLHTDFFEGYFPRISKMIDRTFLAHPELEARWLAAGVAPDKVTTSGMPVRVAAADCGTREMALTALGLAPDAPTVLITSGKEGVGDYAVVVESLARHHQGPLQIIAVCGANARQQALLTALQKRLPAPATLKVCGLVPHADLLAWMRMADLLITKAGGMTPAEAFAMGTPTILLDVVSGHERENAALFVRLGVAELADTLAQAGELAAAVLADPQRQAAMRHAQHAFHDSADLGRIARFALDPALPAPGMTPDFGAEHGSAVTDIDAALARLQAEAPCDIELLLSYSTAQTPQRVVLENPFGHIAIRVDDTVYSANYVAVPGHDPNLLQHVTLADYLYGVQPPSQVHTNTYGMAYGRETLGLRVAGVAAERKAAMVAEAHRIEDEFGQGRLLWDRSEFNCADVVVRLLRAGGYDRSPPLGRRWLPVMPLDIFEEARQACEDDASLYMELVAYRQIPGANAAYRFSRFPLSLGQPLRSMARALREAPQEPLEAAASKQLTGYFGDQQLYFEDLRGHGAGALADDPAHFSRAQRRLADALATDLRRLLAAQARRPLREIGRLGELDGAQDIRRLLERSLALARIATERADEVLQDRGARRMRALFTELVDGYGRIDAWRLRRQEIETYLKRFQVFEAAVGREFPARHGARHARATTLQRSLRYGIRRLRRRVGGLHRPTGHGPDKGASQ

SEQ ID NO: 45551 - protein, 379 aa, Yersinia pestis biovar Microtus str. 91001
MEMIKTRAAVAWGPNQPLSVEEVDLMPPQKGEVLVRIVASGVCHTDAYTLSGADPEGVFPTILGHEGGGIVEAIGEGVTSVAVGDHVIPLYTPECGECKYCRSGKTNLCQAIRSTQGKGLMPDGTTRFSKNGQPIFHYMGTSTFSELTVVPEISLAKINKEAPLEEVCLLGCGVTTGMGAVMNTAKVKPGDTVAIFGLGGIGLSAVIGAQMAGASRIIGIDLNTSKFELARKLGATDLINPKDYDKPIQEVIVELTDGGVDFSFECIGNVNVMRSALECCHKGWGESVIIGVAGAGEEISTRPFQLVTGRVWRGSAFGGVKGRSELPGIVQQYLDGKFALNDFITHTMALDQINEAFDLMHEGKSIRSVIHFNHSSESK

SEQ ID NO: 45552 - protein, 729 aa, Candida glabrata CBS 138
MMRGFKQRLIKKTTGSSSSKKKDKEKEKEKESKHATPTRKSSSSSIKSGSEKSNKATGNSGVSSSHGSKSHTSSGLTSRSPTVSATTSSSSISSKTGNSQGADDTQTETPNQHQKVSHETPSITISDDNTAKSTPKAHPTLLGAATAISPSSPQSPGSASFGHGVSSGINDDNNSPSYGGSSPGIDIPRSSHSFEKLPTPTKLNPDSDVDLIRTPQRHYSSRFEPSRYTQLTKLPNFDEVSPEERIPLFLAKVDQCNTLFDFNDPSFDIQGKEIKRITLQELIEFIVTNRFTYTHEMYAHIVNMFSINLFRPIPPPVNPIGDIYDPDEDEPVNELAWPHMQLVYEFFLRFVESPDFNHQIAKQYIDQEFILKLLELFDSEDIRERDCLKTTLHRIYGKFLSLRSFIRRSINNIFLQFVYETERFNGIAELLEILGSIINGFALPLKEEHKIFLVRILIPLHKVRCLSLYHPQLAYCIVQFLEKEPLLTEEVVMGLLRYWPKINSTKEIMFLNEIEDIFEVIEPLEFIKIEVPLFVQLAKCISSPHFQVAEKVLSYWNNEYFLNLCIENAEVILPIIFPALYELTSQLELDGTNGEESISDPYMLVEQAINSGSWNRAIHAMAFKALKIFLETNPILYENCNSLYLSSVKETQQRKVEREENWSKLEEYVKNLKISESASGQNLDSASNEGSTEQMTIDVEQKDTHMSSLQSDDDYHETNAVLANDAAEK

SEQ ID NO: 45553 - protein, 560 aa, delta proteobacterium MLMS-1
MAGLATTFGSGAMTNSVNEIEAADVILLSGSNTTEAHPQVARRIISAQDRGARLIVIDPRRTEMAARADVHLGLKPGSDIPLLNAIQRIILDENLADELFIEMRTENFATLRDQLFRLELSATIASCGLEPAAVRQAALLYGRARKAVICYCLGVTQHVCGTANVEALANLAMLTGNVEKQECGVDPLRGQNNVQGACDMGGLPAMLPGYQPVADEECRRRFEQAWGVEIPTRPGKTLLEMTHGRLPPDHRRPAAGRQQPATPLRGLFIMGENPLLSDPDLTRVRKNLAGLELLAVSDIFLTETAARAHVVLPAACFAEKDGTFTNTERRVQLIRQAVAPPGQARPDGEIIAALARRLGYEMAGSPAHEIMEEIALLTPIYGGIYHDRLASGAGLQWPCWDRRHPGTPYLHKYYFTRGKGRFVVAAQEEPAEAPDADYPLLLNSGRLYHHYHTGAMSRKSPLLEREAGVARLQVNPADAESRGIRDGERVRLRSRRGQVELAAELTTMVPPGMVYGTFHFQEAPINRLTIAACDQRAKCPEYKICAVELSRADAQGRGNE

SEQ ID NO: 45554 - protein, 137 aa, Brassica napus
  misc_feature (10)..(10): Xaa can be any naturally occurring amino acid
  misc_feature (12)..(12): Xaa can be any naturally occurring amino acid
MRGPRPEDFXPXPSTPITGQPTPTYPAGARKKGVGVRTWLVLCARGQAQTTEVGKHAIMRRTGLPARDLRILDPLLSYPSTVLGRERAIVINLEHIKAIITAQEVLLLNSKDPSVAPFIDELQRRILCHYRATKPKE

SEQ ID NO: 45555 - protein, 461 aa, Crocosphaera watsonii WH 8501
MKTIPTPKTPTLVQQLQWVLNPTGYLQTNHHRYPDLFKAKIIGLGNDIILISNPEIMQYILTHDRQEFTAPSSLNTLLKPLLGDYSVVMLDGDGHRQRRQLVMPSFHGERLKVYGDLTCRITREAMEKLPENQPFLAREVMQDISLKVIMEAVFGVTEGERYEELQYRLKELLDLFDSPITSGFLFFPSLQKDLGNWSPWGYFLRQRQALDKLIYAEISDRRANPDPERTDILSLLMFAKDEQGESMKDQELRDELITLLMAGHETTASAMAWALYWLHHIPEIKDKLIEELNTLSPDAEGMDIFRLPYLTAVCNETLRLSPSAMLTFTRLAQQTVEVGGYTFKPGDIVAGCLYLTHLREDIYANPKQFNPQRFLDHKYSAYEFIPFGGGSRRCMGEALAKFEMKLVIAIIISEYCLKLADTQPEKQQRRGLTLSPKRGVKMILEGKRQPQKARELELSTR

SEQ ID NO: 45556 - protein, 164 aa, Triticum aestivum
  misc_feature (78)..(78): Xaa can be any naturally occurring amino acid
  misc_feature (92)..(92): Xaa can be any naturally occurring amino acid
  misc_feature (99)..(99): Xaa can be any naturally occurring amino acid
  misc_feature (108)..(108): Xaa can be any naturally occurring amino acid
  misc_feature (116)..(116): Xaa can be any naturally occurring amino acid
  misc_feature (128)..(128): Xaa can be any naturally occurring amino acid
  misc_feature (133)..(133): Xaa can be any naturally occurring amino acid
  misc_feature (137)..(137): Xaa can be any naturally occurring amino acid
  misc_feature (140)..(140): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVXDYLIRSKWVPCLRXNKLGHLXVEHNASPGXYYDGRYWXMWKLPISGCTDXQVINXVEEXKKXTLYFSRQMLQVGSHFNNRVQDPEG

SEQ ID NO: 45557 - protein, 85 aa, Arabidopsis thaliana
  misc_feature (12)..(12): Xaa can be any naturally occurring amino acid
  misc_feature (27)..(27): Xaa can be any naturally occurring amino acid
WLPPPLSYAAEXTWAGYDTMVAPFTGXKSYAEFPVTPKTNKDITSIASNGGRVSCLKAWPPIGKKKTETPIYLPDLSDPKTAKEA

SEQ ID NO: 45558 - protein, 144 aa, Chlamydophila pneumoniae CWL029
MEQTLSIIKPDSVSKAHIGEILSIFEQSGLRIAAMKMMHLSQTEAEGFYFVHRERPFFQELVDFMVSGPVVVLVLEGANAVSRNRELMGATNPAEAASGTIRAKFGESIGVNAVHGSDTLENAAVEIAYFFSKIEVVNASKPLV

SEQ ID NO: 45559 - protein, 160 aa, Nostoc punctiforme PCC 73102
MSQFRRFGLALMLPVALLGTFAFPTQLQTATAQTSKDNRPLTIRADVQEYDAKNQVITARGNVQMLYPSRQLQATSAQAQYFSKERRIDFSGNVYILQQGGNSIRAEKVTYLIDEGRFVALPQSNRQVESIYMIEESNNSGQTATPAPSVPQTPPLKPSN

SEQ ID NO: 45560 - protein, 468 aa, Propionibacterium acnes KPA171202
MAEVFENAALILLFILVGGVFSAAEMALVSLRDSQIKQLAATRGSRGRSIQKLQSNPNRFLSAVQIGVTLSGFLASAFGGATLASELAPVFESWGMSASVAATVALVTITVIISYFSIVLGELVAKRLAMQRAEGFSVALGPMVNGIATLFRPIIWFLGVSTDLVVKILGGDPTAAREEVTDEEIRSMVVSSATLGDEERTILDEVFAVGEKSLREVMVPRTEVDFLQGSMKAVQAAQVVRDGSHSRYPVIDGSADRVLGFVHVRDLLELNPQIRTSRVSQLVRAVVSLPDTVKALKALTEMRRTNAHLAIVLDEYGGTAGIVTLEDLVEEIVGDITDEYDTVEPSDLAHVRQRDIDGLTTLEEFSDKVGLVLPEGPYDTLAGYFMAQTGEVPTKGAQVDVHLDPVGYVPDENDEDVEPDPNIELTVTEVDGLRAAWLRIRRLDAPGASTVPAGTSTIPRPEREAASA

SEQ ID NO: 45561 - protein, 591 aa, Helianthus annuus
MCGILAVLGCSDDSQAKRVRVLELSRRLKHRGPDWSGLYQHGDNYLSHQRLAIIDPASGDQPLFNEDQTIVVTVNGEIYNHEELRKRLTAAGHKFRTGSDCDVIAHLYEEHGEDFVDMLDGMFSFVLLDTRNNTYIAARDAIGITSLYIGWGLDGSVWISSELKGLNDDCEHFEVFPPGHLYSSKTGGFKRWYNPLWFAETIPSTPYDPLVLRCAFENAVIKRLMTDVPFGVLLSGGLDSSLVASITARYLAGTKAAKQWGAQLHSFCVGLEGSPDLKAAREVADYLGTVHHEFHFTVQDGIDAIEDVIYHIETYDVTTIRASTPMFLMSRKIKSLGVKMVISGEGSDEIFGGYLYFHKALNREEFHQETCRKIKALHQYDCLRANKSTSAWGLEARVPFLDKEFINVAMSIDPEAKMINMDQKRIEKWVLRRAFEDEEHPYLPKHILYRQKEQFSDGVGYSWIDGLKAHAELHVTDKMMLHAEHIFPHNTPVTKEAYYYRMIFERLFPQNSAKLTVPGGASIACSTAKAIEWDASWSNNLDPSGRAALGAHNAAYKKNMGPVGQVKLGPNIIDNVPRMMDISASELVIQG

SEQ ID NO: 45562 - protein, 364 aa, Xylella fastidiosa Ann-1
MSKRDYYQVLGVPRTASEDDLKKAYRRCAMKYHPDRNPGDAAAEAAFKECKEAYEVLADTKKRKLYDTHGHAAFEHGVGSGNAPDMNDIFGNIFGGARASRRGADVGYMVELDLEEAVAGVERQIQIPTLVECTHCHGSGSEDGHVETCGTCRGSGQVRIQRGIFAMQQTCPHCGGRGVIIRNPCKVCNGAGRVEDHKTLSVKIPAGVDNGDRIRLSGEGEQGPDGVPPGDLYVEVRVREHPIFQRDGDDLHCEVPVRISQAALGDIVRVATLDGEAEIRIPAETQSGKLFRLRGKGVRSVRSRTEGDLYCRIVVETPVNLTAEQRNLLEQFEMTFAGEDARKHSPKSATFLDGVKSFWDRMTS

SEQ ID NO: 45563 - protein, 558 aa, Helianthus annuus
MCGILAVFGCVDCSQAKRARILELSSRLRHRGPDWSGLHSEEDCYLAHQRLAIVDPASGDQPLYNEDKSIIVTVNGEIYNHKEFREQLKSHKFNTGSDCEVIAHLYEEHGEDFVHMLDGMFSFVLLDTRNKSYIAARDAIGITPLYIGWGLDGSVWFASEMKALSDDCEQFMSFLPGHIYSSKNGGLRRWYNPPWWSELVPSTPYDPLVLRNAFEKAVIKRLMTDVPFGVLLSGGLDSSLVAAVASRHLVDSEAYCQWGSQLHTFCIGLKGSPDLVAAREVADYLGTRHHEFYFTVQEGIDALEEVIYHIETYDVTTIRASTPMFLMSRKIKSLGVKMVLSGEGSDEIFGGYLYFHKAPNKEEFHEETCRKIKALHLYDCLRANKSTSAWGLEARVPFLDKEFINVAMSIDPKWKMIDRDNGRIEKWVLRNAFDDDEKPYLPKHILYRQKEQFSDGVGYSWIDGLRDHANKQVTDSMLANANFVYPENTPATKEAYYYRKIFEKFFPKNAARLTVPGGPSVACSTAKAVEWDASWSKNLDPSGRAALGVHAAAYEDAK

SEQ ID NO: 45564 - protein, 1218 aa, Oryza sativa
MDDDGETPMPSLELHKLPTLAGAAIPNPIARHPLYHPSPSFFISPTDVVLRDILFDASPASAAGERRRRHVAAYHRAGPRREVAFDPATVRAAIFTCGGLCPGTNTVVRELVVGLSELYGVRGGVFGVRNGYRGFYSDEVVPLDPAAVEHWHKAGGAALGTSRGGFDLARIVDAIERHGFNQVYAVGGDGTMRGAARIHREVRRRGRLAVAVAGIPKTVDNDVGVVDRSFGFHTAVEAAQQAIAAGHVEAESAANGVGLVKLMGRSAGHIALHATLSSRDVDCCLIPEEDFYLRGAGGLFDFLYRRIKDNGHAVVVVAEGAGQRLIPRTTTTSASGACAGADESGNETFLDVGAWLKAEMRAWWEEEHAGEVFTVKYIDPTYMIRAVPANAGDNLYCTLLAHAAIHGAMAGYTGFVSGTINGNYAYIPMDEVAEAKNPVDTKDHKWAWSFVVYLGGHSHGRGGAALASSQERAKNSHHEFLGSFLGSKEKARDAIFYSYTKYITGSPATLEEEEAMEISKHPSVISVFPNRGHRLHTTRSWEFLGMEKDGRIRANSIWAKARFGEGVIIGNLDTGVWPEAGSFSDDGMGPAPVRWRGICQDQASDDAQVPCNRKLIGARYFNKGYLSTVGQAANPASTRDTDGHGTHTLSTAAGRFVPGANLFGYGNGTAKGGAPGAHVAAYKVCWRPVNGSECFDADIIAAFDAAIHDGVDVLSVSLGGAPAGYLRDGVAIGSFHAVRRGVTVVCSAGNSGPGAGTVSNTAPWLVTVGASTMDREFPAYLVLGNNKKIKGQSLSPVRLAGGKNYPLISSEQARAANATASQARLCMEGSLERGKVEGRIVVCMRGKNARVEKGEAVRRAGGAGLVLANDEATGNEMIADAHVLPATHVTYSDGVALLAYLNSTRSPSGFITVPDTALDTKPAPFMAAFSSQGPNTVTTQILKPDITAPGVSILAAFTGQAGPTGLAFDSRRVLFNAESGTSMSCPHVAGVAGLLKALHPDWSPAAIKSAIMTTARVKDNMRRPMSNSSFLRATPFSYGAGHVQPGRAADPGLVYDMNDTDYLGFLCALGYNSSVIATFMASGSGAQPPYACPPARRPEDLNYPSFALPHLSPSGAARTVTRRVRNVGAAPAAYVASVAEPRGVSVAVRPSRLEFTAAGEELEFAVTFRAKKGSFLAGEYEFGRLVWSDAAAGGRHRVRSPLVVRVVDKKGKNGLPIS

SEQ ID NO: 45565 - protein, 368 aa, Bradyrhizobium japonicum USDA 110
MTPENAGTPMSANNAFHIAVLAGDGIGPEVMAPAIEVLRKIEQKSDLRFRFTEAPAGANNYLATGKSMPERTIKLCEEADAILLGACGLPSVRYPDNTEIAPQIELRFIFDLYAGVRPARLIPGVPSPIVGADTRGIDLVVIRESTEGLFASMGKGVVTHEDARETMVITRRTSERLFEFSFRLAARRKARGKPGMLTCVDKANVFKAFAFFRGIFDEIAKKHPEVRTDRLYVDACSAMLVKRPWDFDVMVMENMFGDIVSDITASLIGGLGMAPSADIGDKYAVFQPCHGTAPDIMGQGKANPTGMILSAAMMLDWIADKHGVESAAEAGETIERAVDQVYAGGIKPMEFGGSNGTADITKAVLGAL

SEQ ID NO: 45566 - protein, 751 aa, Arabidopsis thaliana
MTRGAGGETVAWSYFCRDVVPFTAMVAVECVTVGSNTLFKAATLRGLSFYVFVFYTYVVATLVLLPLSLIFGRSKRLPSAKTPVFFNIFLLALVGFMSLIVGCKGIEYSSPTLASAISNLTPAFTFTLAVIFRMEQIVLRSSATQAKIIGTIVSISGALVVILYKGPKVLTDASLTPPSPTISLYQHLTSFDSSWIIGGLLLATQYLLVSVWYILQTRVMELYPEEITVVFLYNLCATLISAPVCLFAEKDLNSFILKPGVSLASVMYSGGLVSSFGSVIHTWGLHLKGPVYISLFKPLSIVIAVAMGVMFLGDALYLGSVIGSLILSLGFYTVIWGKAREDSIKTVAESLSSKSTIMTMRSSLPSSSSAYSLASTSLSNRLETIFKKASELCTLCDIEACVIYYGPDGELKTWPPEREKVRDIALRYSQLNEALRRKKSVNLHGFLNKKKKNKGLKNTDKKRKTSLKKVNVLKYPLADHYPPDQVSPLIQSLELHVSKFHERLEFLESRKQNETQPDHHSLASSSLNHQTQSLNPSQFSLFMYNHGDNTLSQIPVSASNFNQDYFSALLEQSELKNQLMKQEICGNDQNQNMWMGNITNNNFQLPCVSVQESVNNFGLMHKEFYGCDHNMSVGNINSNSCEHPCVSSTQHYSAVEESVNNPWLNQLMQNELYGYGRKVLDAASFTSFESSWIIGGLLITSQYLLVSVWYILQSQVMEIYPEEITVVFFYNLCGMLISPPVCRKRLDLLGA

SEQ ID NO: 45567 - protein, 491 aa, Zea mays
  misc_feature (147)..(147): Xaa can be any naturally occurring amino acid
MGARCSKLSVCWWPPRFKSPMLENGAAEDDGSGVPVFAEYSLAELRVATDGFATDRIVSEHGEKAPNVVYRGTLFSSGRTVAIKRFGRSAWPDSRQFLEEARAVGQLRSRRLANLIGCCYESGERLLVAEFMPHETLAKHLFHWETXPLSWAMRTRAAFYVAQALEYCSSKGRALYHDLHAYRVVFDAEGNPRLSCFGLMKNSRDGKSYSTNLAFTPPEYLKTGRVSPESVVYSFGTVLLDLLSGKHIPPSHALDLIRGKNFLVLMDSCLEGHVSSSDGTDLMRLASRCLQYEARDRPNLKTVVSGLECLQKDVSTPSHTLLGIQHDNKNSGRISLSAIGKAFARADLNEVHEILLHDGYDEDDTANAELSLQSWNDDVSESFVVKRHADNAFRSKDYSTAIECYSRFIDSGAGVAPTMLGRRCFAYVVAGNPQEGLEDAKRAEVIASDWPMGHYLQALALHNLGREAESQEALKNGTALEAAMNSRARTV

SEQ ID NO: 45568 - protein, 728 aa, Pseudomonas aeruginosa PAO1
MTSITPVTLANCEDEPIHVPGAIQPHGALVTLRADGMVLAASENIQALLGFVASPGSYLTQEQVGPEVLRMLEEGLTGNGPWSNSVETRIGEHLFDVIGHSYKEVFYLEFEIRTADTLSITSFTLNAQRIIAQVQLHNDTASLLSNVTDELRRMTGYDRVMAYRFRHDDSGEVVAESRREDLESYLGQRYPASDIPAQARRLYIQNPIRLIADVAYTPMRVFPALNPETNESFDLSYSVLRSVSPIHCEYLTNMGVRASMSISIVVGGKLWGLFSCHHMSPKLIPYPVRMSFQIFSQVCSAIVERLEQGRIAELLRVSTERRLALARRARDADDLFGALAHPDDGIAALIPCDGALVMLGGRTLSIRGDFERQAGNVLQRLQRDPERDIYHTDNWPQPSEDSPDGGDCCGVLAIRFHRQESGWIFWFRHEEVHRIRWGGKPEKLLTIGPSGPRLTPRGSFEAWEEVVRGHSTPWSETDLAIAEKLRLDLMELCLNHAAEVDRMRQRLIAVLGHDLRNPLQSISMAAALLSSSDTRTTELRQHISASSSRMERLVSQILDMSRLQSGIGLTVNPVDTDVSQLVRQIVCETDVAYPGLVIEIAIDPQVRAVVDPDRYAQVAANLLSNARHHGLPGRPVLVTLTRQGDEVCLSVLNETSGLSEAQLANLFEPFKRESADNQRNRNGLGIGLYISQAIAQAHQGRIDVDCRDDVITFCLRLPVRQAETGSSS

SEQ ID NO: 45569 - protein, 140 aa, Gibberella zeae PH-1
MTRTSVSTKNAPAVPSNLMNQAIIANGFVFTSGGVAMDPKTGKIIDGDIEAHTLTSLLQRQIIRNLGAILDEAGSSLNDVVEVNIYLSDMKYYDKMNEVYAEYWGDLKPARTCVAVKSLPMNANIEIKCVGVVARTKSKL

SEQ ID NO: 45570 - protein, 486 aa, Pseudomonas aeruginosa PAO1
MIKHWINGREVESKDVFENYNPATGELIGEVASGGAAEIDAAVAAAREAFPKWANTPAKERARLMRRLGELIDRNVPHLAELETLDTGLPIHQTKNVLIPRASHNFEFFAEVCTRMNGHSYPVDDQMLNYTLYQPVGVCGLVSPWNVPFMTATWKTAPCLALGNTAVLKMSELSPLTANELGRLVHEAGIPPGVFNVVQGYGASAGDALVRHRDVRAVSFTGGTATGRRIMEAAGIKKYSMELGGKSPVLVFEDADLERALDAALFTIFSLNGERCTAGSRIFVQESVYPQFVAEFAARARRLIVGDPQDPKTQVGSMITQAHYDKVTGYIRIGLEEGATLVAGGLERPAGLPAHLSKGQFIQPTVFADVDNRMRIAQEEIFGPVVCLIPFKDEAEALRLANDVEYGLASYIWTQDIGKAHRLARGIEAGMVFINSQNVRDLRQPFGGVKASGTGREGGEYSFEVFAEIKNVCISMGSHHIPRWGV

SEQ ID NO: 45571 - protein, 335 aa, Chlamydophila pneumoniae CWL029
MKVVINGFGRIGRLVLRQILKRNSSVEVLAINDLVPGDALTYLFKFDSTHGRFPEDVRCEADHLIVGKRKIQFLSERNVQNLPWKDLGVDLVIECTGLFTKKEDAEKHIQAGAKRVLISAPGKGDIPTFVMGVNHKTFNPEKDFVISNASCTTNCLAPIAKVLLDNFGITEGLMTTVHAATATQLVVDGPSKKDWRGGRGCLQNIIPASTGAAKAVTLCLPELKGKLTGMAFRVPIEDVSVVDLTVRLDKSTTYDDICKAMKQASETDLKGILDYTDEQVVSSDFIGSEYSSIFDALAGIALNDRFFKLVAWYDNETGYATRIVDLLEYVEKNSK

SEQ ID NO: 45572 - protein, 569 aa, Mycobacterium smegmatis str. MC2 155
MTSSEAPAKTAEKPAPKTRPAKRPRGEGQWALGYREPLNANEQAKKDDNPLNVRARIENIYAKNGFESIDKGDLRGRFRWWGLYTQRKPGYDGTWTGDENTDMLEDEYFMLRVRCDGGALTTAALRTLGGISTEFARDTADISDRENVQYHWIQVENMPEIWKRLDAVGLQTTEACGDCPRVVLGSPLAGESLDEVIDGTPAIDEIVRRYIGKPEYSNLPRKFKTAISGLQDVVHEVNDVAFIGVNHPEHGPGFDLWVGGGLSTNPMLAQRVGVWVPLDEVPDVWEGVVSIFRDYGYRRLRSKARLKFLIKDWGVEKFREVLETEYLKRPLIDGPAPEPVTRPIDHVGVQKLKNGLNAVGVAPIAGRVSGTILTKVADLAEAAGSDRIRFTPYQKLIILDVPDDKIDELRAGLDALGLPSTPSHWRRNLMACTGIEFCKLSFAETRKRAQVLVPELEKRLDDINAQLDVPITVNINGCPNSCARIQVADIGFKGQMVDDGNGPEEGFQVHLGGSLGLDSGFGRKLRQHKVLSSELGDYIERVVRNFVKQREDGERFAQWAVRADEADLR

SEQ ID NO: 45573 - protein, 256 aa, Mycobacterium sp. KMS
MRLANKVTLVTGGSAGLGLAIAQRFGSEGAHVYITGRRREALEAARASIEGRVTALTADATVPGDLDLLIETIRRESGHLDVVVANAGSIERMNFGDVTEEHFDRTFDLNARGTLFTVQKALLTVQKALPLLRTGGSIVLLGSVTALQGHPGAGTYSAAKAAVRSYARTWSAEFGDKGLRVNVLSPGPIDTPIIDGQADYFGQDPVALRAQMSTLVPMGRLGRPEEIANGALFLASDESSFMTGAELCIDGGMARV

SEQ ID NO: 45574 - protein, 875 aa, Thermoanaerobacter tengcongensis MB4
MTKKYVYFFNEGDASMRDLLGGKGANLAEMTRLGLPVPPGFTVTTEACTRYYEDGETIAPEIVEQIHEYMKKLEEVTGKKFGDPNNPLLVSVRSGARVSMPGMMDTILNLGLNDETVEGLARATNNERFAYDSYRRFIQMFSDVVMGIDKNKFEAILDEIKEKRGAKFDTDLTAEDLKEVVKRFKELYKQEKGVDFPQDPQEQLLEAVKAVFRSWNNPRAIVYRRLNDIPSDWGTAVNVQSMVFGNMGNDSGTGVAFTRNPATGEKALFGEFLMNAQGEDVVAGIRTPQPISTLKETMPEVYNQFVEIAEKLEKHYKDMQDIEFTIERGKLYMLQTRNGKRTAQAAIKIAVDLVREGLIDEKTAVLRVDPKQLDQLLHPTFEPEALKAAKPVAKGLPASPGAASGKVYFTADEAVAAAKSGEKVILVRTETSPDDIEGMASAEGILTTRGGMTSHAAVVARGMGTPCVVGCGDARIDEQAKVMRIGDIVVREGDYISIDGSTGNVYIGEIKTVTPEISGDFAILMGWADKYRRLRVKANADTPRDAKIALEFGAEGIGLARTEHMFFDEERIPAMREMIIAKTEEQRRKALEKILPMQRSDFEQLFEIMGEYPVTIRLLDPPLHEFLPHLDEEIRELAEDMGVPFEELKATVESLKEFNPMLGHRGCRLAVTYPEIAEMQTRAIIEAAINVKKRTGKDVKPQIMIPLVGELKEFKYLKDIIVKVADEIIKQSGIELKYLVGTMVEVPRAALTADKIAKEAEFFSFGTNDLTQMTFGFSRDDAGKFLETYYEKKIYEFDPFEKLDQEGVGKLVEMGTKLGKQTRPDLEVGICGEHGGDPSSIEFCHRVGLDYVSASPYRVPIARLAAAQAAIKYGN

SEQ ID NO: 45575 - protein, 157 aa, Glycine max
  misc_feature (134)..(134): Xaa can be any naturally occurring amino acid
VQRAIQMHDNLSQSAKSPAELLTGCFNGIKVLQEQYETGSIAQHGVELLYATLTKIFSSLQEAYKGQIVGIIYCHVATTQESGKKFDVIFTPHHPYARWLAETNAVNATLPEVVLVRRTLAWITGIILLVSTLXGICYLLNMPLTRDTLLYSNVKLD

SEQ ID NO: 45576 - protein, 412 aa, Methanosarcina acetivorans C2A
MSQKTAGKDYLTMDDVELDNKRILLRVDFNSPMDANGNILDDRKIKSHLYTLRSLENSRVVMMSHQGRPGDKDYTTLEAHAKLATELLGRKVTYEDDIFSACARNAIKSLEKGDILLLENTRFYAEENMNRAPEEQARTQMVRKLYPLFDVFINDAFSVSHRSQCSVVGFTEVLPSVAGILMDREITGLDKGLKCHEHPAVFALGGTKAKDIVKVISDILKRGGADRILTTGVVATVFMMAIGIEVGEVNRKFIEDHKYLDQVSIASRLLKEYSGKIIVPKDIALNNDGKREEVKVDKIKGDLPIADIGPETISDYSKFLKEAKLSVFHGPAGIFELESFRLGTEELLKAAAQSNYSIAGGGHTLAAIDQLGLESKYSHLSMGGGASITYLSGEHMPGIEALKNYASRCCKD

SEQ ID NO: 45577 - protein, 497 aa, Pseudomonas syringae pv. phaseolicola 1448A
MTTLTRADWEQRAQHLKIEGRAFIQGEYTAASSGETFDCISPVDGRMLAKVASCDTADAQRAVDSARSAFNSGAWSRLAPAKRKETMIRFAGLLKQNAEELALLETLDMGKPIGDSFGVDIPGAARALSWSGEAIDKLYDEVAATPHDQLGLVTREPVGVVAAIVPWNFPLMMACWKLGPALSTGNSVILKPSEKSPLTAIRIAQLAIEAGIPAGVLNVLPGYGHTVGKALALHMDVDTVVFTGSSKIAKQLMIYAGESNMKRVWLEAGGKSPNIVFADAPDLQAAAEAAASAIAFNQGEVCTAGSRLLVERSIKERFLPMVLEALATWKPGNPLDPATNVGALVDTQQMNTVLSYIEAGHAEGARLVAGGKRILQETGGTYVEPTIFDGVNNAMKIAQEEIFGPVLSVLTFDSDEEAIQIANDTPYGLAAAVWTANISRAHLTAKALRAGSVWVNQYDGGDMTAPFGGFKQSGNGRDKSLHAFDKYTELKSTWIKL

SEQ ID NO: 45578 - protein, 515 aa, Methanosarcina acetivorans C2A
MAQARRPLMLIILDGWGYREVEEGNAVLSAGTPNLDRLVKDYPWCLLEASGGAVGLPEGMMGNSEDGHLNIGAGRIVYQNLTRINISIRNGDFFKNPVFLNAISKVKANDSSLHLIGLVSCGGVHSYTPHLHALIKLAKEKGLKKVYIHAFLDGRDVPPKTALGDIKKLNEFCKEHGGAKIATVSGRYYAMDRDKRWDRTKLAYDVLTLGASQYKAPNAETAVSEAYGRGETDEFVKPTVITDHEEKPVATIRDKDSVIFFNFRADRARQLTWAFVKDDFDGFVREKRPKIYFVCMARYDEDLDLPVAFPHEELKNVLGEVLSKQGLTQLRIAETEKYAHVTFFLNGGEEKRYEGEDRCLIPSPKIATYDLKPEMSAYKITDEVVRRIQSGKYDVIVLNFANMDMVGHTGIFEAAVKAVEAVDKCIGRIVEALKEIGGVALITADHGNAEQMIDSKTGEPHTAHTSNPVRCIYFGNGEVKALKKGKLCDLAPTLLELIGIPKPQEMTGKSLLVKE

SEQ ID NO: 45579 - protein, 658 aa, Pseudomonas syringae pv. syringae B728a
MCGITGFFGVKNKNLDETTVIKNMLSMIEHRGPDQAGYYVNNSMGLGTMRLSIIDLAAGIQPLSDGTGQYWISYNGELYNYIELRRRLQVLGHHFSTESDTEVVLRSWMEWGDEALEKFNGAFAFAIYDTVKDEVFIARDRFGKRPLFYTQTDGGYLFASEMKCFFGFPGFEFKFDEMSLSSILAHWTPLPSQTPFQGIRQLPPGSIMTLRGAQCEIRPYYALDFRAVDFDGTENEAKEEIRNTLEQAVKLRLRSDVPMGLYLSGGVDSSVLTSIAARIIKQKPLRTFSVEFEDKNLDESSDQQLVSALFSTKHERLIINHKDIVDNFSATVFHAEMPLFRTAPVPMYMLSKHVRSTGIKAILSGEGADEVFLGYNIFKETLLRSQWDTTDHDEKKRLLAKLYPYMKSFSEDNDSNLMGFYNAYAKEKIPGLFSHEIRFQNGRFASRLLKTKNDPFAGIQAWVAKDPVYSALSPTQKAQWLEFNTLLSGYLLSSQGERMGLAHGIENRCPFLDINVQKLASSINLRFDDGFTEKYMLRMAYDGILPGRIIHKAKTPYRAPDSGPFVEHALDYLNHLCESNALDAIELINPVFAKALIKKVVERTLAGGEDITVRDNQAFVYLMSLIELDKWFVKRQGAAYINPCRVDKLLVQAVDARH

SEQ ID NO: 45580 - protein, 139 aa, Pasteurella multocida subsp. multocida str. Pm70
MAVERTLSLIKPDAVKRHLIGAILSRFEQAGFRVVAAKMLHLTQAQAEGFYAEHQDKAFFPELVAYMISAPVLALVLEKENAVKDYRTLIGATNPAVAAEGTIRRDFAIDGRHNSVHGSDSLDSAKREIAYFFVESEIF

SEQ ID NO: 45581 - protein, 147 aa, Desulfitobacterium hafniense DCB-2
MSVLSEILDNHILISAMIAWFIAQTLKLIINFSIHRTFDVAFLFSSGGFPSSHSATVSALAIGVGKYYGWSSPTFAIAAIFGMIVMYDAAGVRRAGGKQAEVINQLVEGLYQQMTHLSQERLKELIGHTPFEVFAGAIVGIIVGVLM

SEQ ID NO: 45582 - protein, 446 aa, Bordetella parapertussis 12822
MSTTHVLHRSLRHTPPVAVRGEGVWLYDQAGRAYLDGSGGAAVSCLGHNHPDVRAAMHAQIDALAYAHTGFFSTEIAERLADRLVADAPAGTSHAYFVSGGSEAIEAALKMARQYFVEIGQPQRRHLVARRQSYHGNTLGALAVGGNEWRRAQFAPLLIDVAHVAPCYAYRDQREDESAEQYGERLARELEDTFQRLGPDTVIAFVAEPVVGATAGALTAVPGYFRRIREICDRYGILMIADEVMCGMGRTGTLYAVEQEEIVPDLITIAKGLGGGYQPIGAVMAQGRIVDAMSKGSGFFQHGHTYLGHATACAASLAVQEVIRRDGLLARVRQQGDGLRQRLMQALGAHPHVGDIRGRGLFLGVELVRDRAAKATFDPELALHARIKREAMARGLMVYPMGGTIDGRHGDHVLVAPPFIIADDELDQLVERLAGAIDAAIAQTRA

SEQ ID NO: 45583 - protein, 523 aa, Aspergillus oryzae
MADQFKARTLKRKNVKGLALNAAPKPLSNPSDGDAQVPGAIGNTDSNRTDTLEIGLEFRLDLRSEDLITLKELGAGNGGTVSKVMHASTKVVMARKIIRVDAKENVRKQILRELQVGHDCNSPNIVTFYGAFQNEARDIVLCMEYMDCGSLDRISKDFGPVRVDVLGKITESVLAGLVYLYEAHRIMHRDIKPSNILVNSRGNIKLCDFGVATETVNSIADTFVGTSTYMAPERIQGGAYTVRSDVWSVGLTVMELAVGRFPFDASDSSAGDRASAGPMGILDLLQQIVHEPAPKLPKSDAFPPILHEFVAKCLLKKSEERPTPRELYDKDAFLQAAKRTPVDLQEWAISMMERHNRKSYLAPPPPKSLKDEKEESPRRSPAPKPALSKSSRTPHYTPTSGEIPVNMVNEMSSHSRHYHVPPNPSPRPSRSTRSPPTISLEHLSLETKDDDYRSGRRPSRAHLGDPVSALEPPSRQHIASRSASSHNMKSRMPLQTSAMPVRAAPPPSGPLPPASVPGTPWQR

SEQ ID NO: 45584 - protein, 434 aa, Moorella thermoacetica ATCC 39073
MAINEHGRLVIGGCEVVQLARDFGTPLYIFDEDCIRDNCRQFYRAFNAGSGQAEVIYAGKAFLTTAMCRIIASEGLGLDVVSGGELYTALAAGFPVERIYFHGNNKSYAELCQGLEAGIGRFMVDNFTELELLSRLAVERGQVAKVILRVTPGIEAHTHDYIRTGQVDSKFGFTLPGGQALAAARRAGELPGIEFMGLHCHIGSQIFELEPYNEAVAVMMELAAAVKEATGLVTAELDLGGGFGIYYTTGDEPRPIRAYAETILARVREEARRLNLPQPRVLVEPGRSIVGPAGSTAYTVGSIKEIPGVRKYVAVDGGMADNIRPALYGAKYEAILANKAGMPATEKVTVTGKCCESGDMLIWEAELPPVERGDILLMPCTGAYGYTMASNYNRLGRPAAVLVRDGVADLIIKREDYSDLIRNDVIPARLACPR

SEQ ID NO: 45585 - protein, 557 aa, Pseudomonas aeruginosa PAO1
MYQYDEYDQALVSERVAQFRDQIARRLDGELSEEEFLPLRLQNGLYLQKHAYMLRVAIPYGTLSAPQLRALAHVARHYDRGYGHFTTRQNIQFNWIELEQVGDILEHLAGAQMHAIQTSGNCVRNITTEAFAGVAADEWTDPRPLAEILRQWSTVNPEFLFLPRKFKIALSSAVEDRAAVQMHDIGLYLYRHPDAGELRLRVLVGGGLGRTPMLGQVIRDDLPWQHLLSYVEAILRVYNRYGRRDNKYKARIKILVKALGIEAFAREVEEEWQHLRDGPAQLTAEECQRVAERFVLPRYLPPADGELAYGSARAADPAFARWASRNVQAHKVPGYASVVLSTKPGASAPPGDVTAEQMERVADWAERYGFGEIRVAHEQNLVLPDVRLENLHALWREACAAGLGTPNQGLLSDIIACPGGDYCALANAKSIPIAQGIQQRFEDLDHLHDIGELSLNISGCMNACGHHHIGNIGILGVDKSGSEWYQVTLGGAQGKDSALGKVIGPSFSAAEVPAVIERIVETFTDLRVGPERFIDTFNRVGLEPFKARVYARMEEPA

SEQ ID NO: 45586 - protein, 253 aa, Moorella thermoacetica ATCC 39073
MSPDQLAARVQEYPELLLMCDYDGTLVPLAPRPEDAVPDPGLLKLLRQLVSRPGLHLAVISGRPLADLRDLLPIPGLLLAGLHGAQVAGPEGPVINLLPPPPGKNPWPEIFSLARQLAAGVPGLLVENKGEGVALHYRLAEPDAAAGILEEFRHALEPFLQDGLELIPGHKVLEVRRRGVNKGLAVTYFTRRWPRAFPVYLGDDRTDEDAFAALPGNGLAIGVGQRQSGYAHYFLASPAEVIEFLQLLNRSRT

SEQ ID NO: 45587 - protein, 429 aa, Pseudomonas putida KT2440
MAKIVDIKGREVLDSRGNPTVEADVLLDNGIIGSACAPSGASTGSREALELRDGDKSRYLGKGVLKAVANINGPIRDLLLGKDPSDQKALDRAMIELDGTENKAKLGANAILAVSLAAAKAAAQDQDLPLYAHIANLNGTPGQYSMPVPMMNIINGGEHADNNVDIQEFMVQPVGAKTFSDGLRMGTEIFHHLKAVLKARGLNTAVGDEGGFAPNLASNEDALGAIAEAVEKAGYKLGTDVTLALDCAASEFYEDGKYNLSGEGKSFDAEGFADYLKGLTERFPIISIEDGLDESDWAGWKILTDKIGEKVQLVGDDLFVTNTKILKEGIEKGIGNSILIKFNQIGSLTETLEAIQMAKAAGYTAVISHRSGETEDSTIADLAVGTAAGQIKTGSLCRSDRVSKYNQLLRIEEQLGAKAVYRGRAEFRG

SEQ ID NO: 45588 - protein, 371 aa, Pseudomonas putida KT2440
MMIKSRAAVAFEAKKPLEIVEVDVAMPKAGEVLLRVVASGVCHTDAYTLSGADPEGIFPSILGHEGGAIVEAVGEGVTSLAVGDHVIPLYTPECGKCKFCLSGKTNLCQAIRATQGKGLMPDGTTRFSYKGQQLFHYMGTSTFSEYTVLPEISVAKIQKEAPLEKVCLLGCGVTTGIGAVLNTAKVKPGDTVAIFGLGGIGLSAVIGAVKAKASRIIAIDINPAKFEIARQLGATDCVNPKDYDRPIQEVIVDLTDGGVDFSFECIGNVQLMRAALECCHKGWGESVIIGVAGAGQEISTRPFQLVTGRVWRGSAFGGVRGRSELPSYVEMSEKGEIPLDTFITHTMGLEDINKAFDLMHEGKSIRSVIHF

SEQ ID NO: 45589 - protein, 887 aa, Oryza sativa
RVRRDLRRPWQRHLQRRRRVVAQPEGEGPDAHGRRTVPRLRRAEQPRQGGEEPPAVARARGRHGSALRPARPVLEADLRRDLHPRLRRGHRVLVGRPAGETLRSSLAHRLETLFLRHIIPMSCWKLMYRLEVGTERKMAVARRTIDRFVAETIAKRRADMIRQGTSNSDDLLSSFISHDDDDTSNGNDVVDETDEFLRDTTVNLLLAGRDTTGAALSWFFYILSKNPRVEQKLLEELAPIAAQKGGDGGGMVIFDASELKNLVYLQAALSECLRLYPSVPFEHKAVAADDVLPSGHEMKAGDKVLVFSYSMGRMEGVWGKDCTEFLPERWITSEGKLRYEPSYKFFSFNAGPRTCLGKELAFVQLKTVAAAVMWNFAVEVVPGHAVEPKLSIILHMKNGLAVTVKRRAIVANMHRLLDGVTFLLATSQLNFQCRFWLAGFRFFVTCDPDNVRHIFTSNFDNYPKGDVFADMFDVLGGGIFNTDGERWRRQRNKAQMLMTTPRFRAFVARSSLDKVEKGLLPFLAHVADARKTCDLQDVFTRWSLDATCHLVFGVDPGCLDIGLPEVPFARAMDDVLRTIFLRHTMPVSFWKTMRWLGIGHEKRNAAARRTVESFVASAIAKHRADDESKSRQGGGGGGDKQSVADLLSSFLCDDEIAGSADADVYIRDMAMNLLVAGRDTTSSALSWFFYLLSTNPRVEQKLLQELAPIASRKPQLQQGRLFPGNGGMVTFDASEVRNLLYLHAALCEAMRLYPPVPLEHKAAVADDVLPSGHEVMAGDKVLVFYYSMGRMKRVWGKDCREFRPERWITEDGKLRYVPSNKFVAFNSGPRTCLGKEMALVQMKVTAAAMAWNFAVEVVPGHVVEPRLSVILHMKNGLLVRVKRREPV

SEQ ID NO: 45590 - protein, 210 aa, Triticum aestivum
  misc_feature (175)..(175): Xaa can be any naturally occurring amino acid
MARHHLLLFLPLLALAFSFVIAAPERQGDAAAFIDGASHRYLRDQPEDQLNKLLLPNPFDRPRSVFLMQLDGSHDYVNGFISDAGSIYKTKIDGAKSAAIELSDKDELIVIRSDESSGLDVLDNELANLATWLAGSYQKADSKLNIPLKSGNSLTLFLTKEADVEFASSLISLLXTIERGIQVHEDFSGGMVSPAELLVCHFTGIKALED

SEQ ID NO: 45591 - protein, 1021 aa, Oryza sativa (japonica cultivar-group)
MSLVYRLPLIHECGLVMFCRTLKIDVLGQVRIGVLQMTRVIHDSGEGMQKEALAMVSSDVNFPKGHFPDYKIGPNNQIIDPEEIHEAVPLKEIVAKETAQLLEQRRRLSVRDLKEKFEKGLSGASKLSEEAKRREAASLDRQVLLKKLRDVLDTLKGRVAGRNRDDADEAISLVEALAVQLTQREGELIYEKAEVKKLASFLKQATEDARKVAEEERALALAEIEKARTAIAIVEKGLQEHDAASSSREKEEIEGLRKEVREARRIKMLHQPSKVMDMEFELKALRTLIAEKNQLCNQLMKELAMIKRLEEDSSDLYDLEGSDILGSQFCIIPRFDDAPDISSCPTQWYRVISGGNRNLILGATKPTYAPEPFDVGRLLQAEIVLNAEKVTIQTMGPINPAAGLEHYVESLMKRADVEFNVVVTQMNGNDYSSNSVHAFHIGKMRIKLRKGWSTKARESYSTTMKLCGSRGGGNAAATAVFWQARKGLSYTLAFETDRDRNAAIMLARKFASNCNITLTGPGDEVHAELAGAAVAAALDGGEEGSRAARLHSFFASVISGIFGQGEEEEEGEMATRSQNVAAAPQPPQNRGNVAALGKQKAVVAGRPDAKNRRALGEIGNVMNVRLPEGKPLQQAPAGRTANFGAQLLKNAQANAAANKQNAVAPAAVARPAQRQARKAPVKPAPPPPEHVIEISSDSDQSMRQQSEGSASSVRKCSRKKVINTLTSVLTARSKVACGITDKPREVIEDIDKLDGDNELAVVDYIEDIYKFYKVAENECRPCDYIDTQVEINSKMRAILADWIIEVHHKFELMPETLYLSMYVIDRYLSMQQVQRRELQLVGVSAMLIACKYEEIWAPEVNDFILISDSAYTREQILAMEKGILNKLQWNLTVPTAYVFIMRYLKAGASADNKSDKEMEHMAFFFAELALMQYGLVASLPSKVAASAVYAARLTLKKSPLWTDTLKHHTGFTESQLLDSAKLLVTSHSTAPESKLRVVYKKYSSEQLGGVALRSPAVELCK

SEQ ID NO: 45592 - protein, 113 aa, Zea mays
NGLNLARMFGDKFLKEQDSRFSSEPYLSQAVRITKACTAFAVIASDGLWDVISTKRAVQLVVEGTERYSGDSASAAKVANRVLDEARSLRTKDNTSLIFVDFDILRTDPCIAK

SEQ ID NO: 45593 - protein, 371 aa, Debaryomyces hansenii CBS767
MAPILHSSECETLPVSNPCLIVTPDHKLIAGNAPIPQCQPNQVKIHIKCTGICGSDIHLWKEGGIGDLVVTENLVLGHETAGQVIEVGREVTNDIKVGDRVAIEPQAPCMKCYLCLDGHYNLCEDVAFLGVPPTNGSMQRYLCTDPNFVHKLPDNMSYEQGALSEIVSVAFHGIRKAGGLNPGEPCMIAGCGPIGLATLLLADVSGAYPIVVSDISDERLEFAKTLVPSVMTYKNDTSISPKKNAKNIRKMFGTTEYVMPPVVLECTGFASSINSCCYVVRRNGVLTILGVSGKNELDGFPFMPLSLGEVDVRFINRYTDTWPAVINLISSGKINVDKFVTHVFQLEEAAKALECVVDRNVPTIKVMIKDD

SEQ ID NO: 45594 - protein, 454 aa, Arabidopsis thaliana
MNPTQKPDPVYDIVILGASGFTGKYVVREALKFLQTPSSSPLKSLALAGRNPTRLTQSLEWAARPNPPPSSVAILTADTSDPDSLRRLCTQTKLILNCVGPFRIHGDPVVSACADSGCDYLDISGEPEFMERMEANYHDRAEETGSLIVSACGFDSIPAELGLLFNAKQWVSPSVPNQIEAYLSLESDKKIAGNFGTYESAVLGVANAEKLKELRRSRPRRPRPTICGPPAKGPTLENQKTIGLWALKLPSADAVVVRRTLTTLTEKPHGLPGINESPEQIQKREAFWSSIKPAHFGVKITSKSLFGIFRYVTLGVSLGLLSKFSFGRWLLLKFPSVFSLGWFQKKGPSEEEVESATFKMWFIGRGYSEESLASQGETKPDLEIITRISGPEIGYITTPITLVQCGLIVLGQRESLVKGGVYTPGIVFGSTDIQQRLEDNGISFELISKIKTQG

SEQ ID NO: 45595 - protein, 312 aa, Aspergillus oryzae
MVQQPKQEKVWASLITNLSYLPGILTLSHSLQTTETAYPFIALYTSTFPAEGLAALHARGIRTQAVPSVQPGQSRVFLQDPRFNETWNKLIVFSLVEYDRIVLLDGDMLVRKNMDELMDVPLDGPGSGLSSEENKQERVFAASHVCACNPLNKPHYPKTWIPKNCAYTSQHSDPVRAQTSGAPAATGVAMLNSGLLVVRPTISAWAEIQARLHMPDRTDKYTFPDQELLSDVFRGRWVVLPYVYNALKTLRWEGVHDDIWRDDEVKNVHYIFANKPWHEDPDDGMDEPSRWWWEVNRQRQQLEVKKGITDGH

SEQ ID NO: 45596 - protein, 664 aa, Aspergillus oryzae
MAAPTQLAFRTVKGIGILDAAPVYEPLSGFERPEGNLRCSAYSPCGRYFAWASPEKVTVIDPSVGHIITNIPAENVFELGFSPLGTYLITWQRPSKDANGDAVKNLKVWKIVETAPDSNGDEHTIVGSYVQKSQTGWNLQYTSDERYCARVVTNEVQFYQSDNLSKVWNKLRVEGVIDFAVSPGKSQSVAVFVPERKGQPAAVKVFMVPQFGAPVSQKTFFKGDKVQLKWNASGTTLLVLAQTDVDRSGKSYYGETTLYLLGATGGFDSRVDLDKEGPIHDVTWSPNSREFGVVYGYMPAKTTIFNFRGVPQHSFALAPRNTISFSPHGRFVLVAGFGNLAGQMDIYDLEKNYFKIATVEASNASVCEWSPDGKYILTATTSPRLRVDNGVRLWHVSGALVYNEEMHELYDVFWRPQSTTQHPLGDPFHPLPTPHPSAVAYLSTRKAPVKPAGAYRPPGARGQLTPLAFKREDQGGATFIRDGANGGALNGLGKPRRREIPGADPVEEYLPPGAAPGGGVVLPPGADQPEKLSKSAARNKKKREAKKLKDGEDGQPARSPESHGDKGHHERSRSKANNSERKNANQANGASPASTKPNNNAAVEAAGTPTAQEKKIRGLLKKIRAIDELKMRLAGGEKLEDTQLKKIQTEESVRKELESLGFNG

SEQ ID NO: 45597 - protein, 595 aa, Candida glabrata CBS 138
MPTVSVNKQQLFDLLGKNYTNDEFDELCFEFGIELDEDTTEEALKTGEEPELKIEIGANRYDLLCIEGIAQSLNEYLGRSSTPTYKLTAPTTKLYIEKSTEQVRPYATAAILRNFKFTEKNYASFIALQDKLHSNLCRNRSLVAIGTHNLDSIQGPFYYKGLAPKEINFIPLNQTKKFNGEELIEFYKTPEQKNNIGRFVHIIENSPVYPVILDSNDVVCSLPPLINSEHSKINLETKNIFIEITANDKTKAEIVLNQMVAMFSRYCDEPFTVEPVEIVSEHNGESRMAPDFSERKMDVSIPYINSALGLQQTPEEIIQCIKKMSLHGEASKTDEAVLHVTIPITRPDVLHPCDIMEDAAIGYGYNNLPKGEKLSNANFIASPLPINKISDIFRVASSQASWLEVLPLTLCSHDENFKFLRLEDDGKQVVKLENPKTLEYQVVRTTLLPGILKTVKENRKHSLPIKVFETGDVVFKNEALERKSYNERHWGAIYAGKNSGFEIIQGLLGKIMQTFRTQWVADYGKASTGRGYWIEQDDTLATYFPGRGAKIMFRSKEGEQAKQIGHLGVLHPEVMSNFEVPYAASYVELNAEVFL

SEQ ID NO: 45598 - protein, 393 aa, Bradyrhizobium sp. BTAi1
MGMKALVWHGKEDIRCDTVSDPEIEHDRDAIIKVTSCAICGSDLHLFHNYIPAMMPGDIMGHETMGEVVEVGSGVNGKLKKGDRIVVPFTIICGECEQCRRGNYSVCETTNRNKHLAEKVFGHTTAGLFGYTHLTGGYPGGQAEYLRVPFADATHIKVPDGMTDEQALFLSDIFPTGWQAAAQCDIEPDDTVAVWGCGPVGQMAIRSAILLGASRVIAIDRIPERLAMAEAGGAITINFDKESVVGRLNELTDNKGPEKCIDCVGFESHISMAQPDSVLDRAKQMFMLENDRPHALREIIYVCRPGGIVSIPGVYSGFSDMVPMGALMNKGLTIRTGQTHVNRWTDDLTQRIADGQIDPSFVITHTVPLAQGPEMYRAFRDKQDSCVKVVLKP

SEQ ID NO: 45599 - protein, 587 aa, Kluyveromyces lactis NRRL Y-1140
MNDSVLVAPSLSTAQTEDTFEFQSYGETEHSRSYLGSDVTKDNLVELVSAYYSVPELIQYFEEHPQYKKITLQFPDELVLDSSIVVQLMQQELVKAEDETSQSFNTIDTDEVLHNEKSCGNCSGCDCSSKIDKTETKRKVWILADTSYSSCCVDEVASEHVKGDIVVHFGDACMNAVQKLPVVYSLGRPVLDLDLVVSQFKLKYAAKDQKICLMADAPHSMHMKSIYDILHDKEGYKNVVYSDINQDMLQSDTHIVGYNNAVEHDERLRKCVTCGNRNIYAEVDVSELNEYDLFHVTIPKDPHLLYLTTKFQSVTLYDPSSGMLNEGPFPSMMKRYKFMHMARTAGTIGILVNTLSLRNTKETMNKLTKLLKENGKKHYLFVVGKPNVAKLANFEPIDIWCILGCGQGGIVLDQYNEFYKPIITPYELLMALSDEVTWTGQWITDFKSIINQIENEVNDSDDMEQDILSSGTECRSDEDEAPEFNAVTGKYVSTSRPLRQIARLEIETPVEEVRASDSTELVKQFSQTVAIRNTVSTSAAFLQTRHWTGLGSDYKDDEDGEEDGATVEEGTAGVARSYQFDELNKKT

SEQ ID NO: 45600 - protein, 147 aa, Aspergillus oryzae
MALKRINKELSDLGRDPPSSCSAGPVGEDLFHWQATIMGPGDSPYSGGVFFLAIHFPTDYPFKPPKVNFTTRIYHPNINSNGSICLDILRDQWSPALTISKVLLSICSMLTDPNPDDPLVPEIAHVYKTDRGRYEATAREWTRKYAI

SEQ ID NO: 45601 - protein, 302 aa, Desulfitobacterium hafniense DCB-2
MAIVDEQAELVYENRKILTVPEGERGLAQSAALFQHVQNLPQLVTAVPPQYWEKVSALGVSTAPRPIQESYMPVFLPGYGVAAAMASARCIPLVETSHQEGHLAAGIASSKLKEPHFLAIHISGGTTELLEVHHTQPGKLDIQLLGGTTDLHAGQFVDRVGVRLGLPFPAGKSLEELARQADPGAAAWLPSAVRGFEVSFSGVETAAQRLIDQGKNPADVARAVEGCIVRTLGKLLQAGMEKTTLSEILIVGGVASNQFIRQELKKRLARHANLHWAEPDWSRDNAIGVALLALEKVRGCII

SEQ ID NO: 45602 - protein, 1126 aa, Magnetococcus sp. MC-1
MRRHSGHILFAASDLNGFLGCRHSTFLDLMDLDERLPRAEVSAQDRLIQERGHEHEAEYLESLKRSGLSVVEIPSEGGLTDRVQMTADVMADGPDIIYQAGFLDGQWHGYADFLQKTDRPSGLGPFSYEAVDTKLTKHPKPKFVIQLCLYSDFIAKMQGTRPQGMSLVLGDLSQVHLRFDDFAYYHGIIRRRFEEYVSEPPERSRSEPCGFCELCKWRDLCGEQWEREDHLSQVANIRRSQILKLESAGIATVQALAHMDDDATVPSLAQETLEKLRAQARLQVAKRETGENRVETLPSVPGRGFARMPRPAEGDLFFDMEGDPLYPDGLEYLFGFYFVSEGRPVFKPFWAHDHEEEKRTFQAVMDFLVAHLREHPSAHVYHYNHYEETALKRLASRYGAREGEVDDLLRGRKLVDLYKVVREAIRVSEPSYSIKNLETFYMEKRSAEVATAGDSIVVYETWRKTRAAGLLQQISDYNEDDCRSTLLLRDLLAGLRPDDLPWFDLTAEVPPEEKLAAQLEAEETRQRYEQSLTGGEKRPDHEFRELVAQLLEFHRREAKPQWWAMFDRQDRADEDLVDDAECLGSLRADRKQPPYKDKRSTVFTYRFPPQETKLRAGDSCLRADTLERAGEIVELDMRSQRVRIKKGAKGGPLPEALSITPTGPIDNKVLRNAVYRFADAIIAENGRFQALTAFLRREMPSIANHVAGSPIVPEDDNLLTATIRAVSGLQESYLFIQGPPGAGKTYTSSHVIVELLRSGKKIGISSNSHKAINNLLSGIEKAAIQEGLTFRGQKKSTAQNADSLFQGEMVENVYDSKNINLDSDLIAGTAWLFARDEIDEALDYLFIDEAGQVSLANLVAMGLSAKNIVLVGDQMQLGQPIQGVHPGLSGMSILDYLLEGESTIPADRGIFLGTTWRMHENVCRFISDAVYDGRLHPEPGTRNQALILSESAHPALQPNGIRFIEARHVGCSQKSEMEGEIVRDLIASLTAQRYRDRDGQERPLGLDNILVVTPYNVQVNHLREVLPEGAQVGTVDEFQGQEAEVVIISMVTSGAEDLPRDIEFLYSKNRLNVAISRARTLALIVANPNLLEIPCKTVEQMRLVNTLCWARQYSERPMAETERATC

SEQ ID NO: 45603 - protein, 482 aa, Gibberella zeae PH-1
MDSRIAMRPTRPQTVKELVAQAENFSFNMNIPFKHWMRAAETLYQEASFAVSDGDFGRAYMMLYRHSLLILKYLPTHPQFKEPDNKKAYIVLSKRIQRVIQDLEQLKPEIENAVKEWERMALSPKAAIESPDPPSRYEQFAARDPTLSGNARILDASDHQDLAVDLAQRELTRRDTVRRTTRHSGIADEDIMSRRRGGKWDQWDGVRIGDDEDLRRQMEATRHALDSAHERRNDDDFRPTSHTYNYPSISRPRPVEYERSTTPTTPSIQPSRPPKEPVALPPKEPLHPSLSQPLPPSLPQKVPLSGYAPLIPSPSPQTAGDRPEVPRKEALSPTGDAGPPAIPQKERLTFKPGAYLENGDPIRSLFLPKNLRQKFLDIAADNTRRGLEMCGMLCGTPINNALFVRCLLIPDQKCTSDTCETENEEVMFDYCMSEDLLLLGWIHTHPTQTCFMSSRDLHTHAGYQVMMPESVAIVCAPKFQPS

SEQ ID NO: 45604 - protein, 229 aa, Triticum aestivum
TSLAQKARLVRSGIPGISSTHAPGSPRTLTWTEPSRKFQSASCASKLYTYIVQPWPPTVMASWPTSVALFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 45605 - protein, 175 aa, Kluyveromyces lactis NRRL Y-1140
MGAAPSRIVDNLLDDTNFDRAEIERLKKRFMKLDKDSSGSIDKTEFMSIPGVSANPLAKRIIEVFDEDNSGDVDFQEFITSLSIFSGRGETDAKLRFAFRIYDIDKDGYISNGELFIVLKIMVGTNLEDEQLQQIVDRTIMENDVDGDGKLSFEEFKKAAETTEVIQSLTLQHNI

SEQ ID NO: 45606 - protein, 737 aa, Arabidopsis thaliana
MRLLKVATCNLNQWAMDFESNMKNIKASIAEAKAAGAVIRLGPELEVTGYGCEDHFLELDTVTHAWECLKELLLGDWTDDILCSIGMPVIKGAERYNCQVLCMNRRIIMIRPKMWLANDGNYRELRWFTAWKQREELEEFQLPIEISEALEQKSVPFGYGYIQFIDTAVAAEVCEELFSPLPPHAELALNGVEVFMNASGSHHQLRKLDIRLNAFMGATHARGGVYMYSNQQGCDGSRLYYDGCACIVVNGNVVAQGSQFSLRDVEVIISQVDLDAFLGSSCLFVFDAVTSLRGSISSFQEQASCKVKVSSVAVPYRLTQSFNLKMTLSSPKKIIYHSPQEEIAFGPACWMWDYLRRSGASGFLLPLSGGAESSSVAAIVGCMCQLVVKEIAKGDEQVKADANRIGNYANGQFPTDSKEFAKRIFYTVFMGSENSSEETKRRSKQLADEIGAWHLDVCIDGVVSAVLSLFQTVTGKRPRYKVDGGSNAENLGLQNIQARMRMVLAFMLASLLPWVHSKPGFYLVLGSSNVDEGLRGYLTKYDCSSADINPIGSISKMDLRLFLKWAATNLGYPSLAEIEAAPPTAELEPIRSDYSQLDEVDMGMTYEELSVYGRMRKIFRCGPVSMFKNLCYKWGTKLSPAEVAEKVKYFFKYYSINRHKMTVLTPSYHAESYSPEDNRFDLRQFLYNSKWPYQFKKIDEIVDSLNGDSVAFPEEEANSNKEIGVVAANSGDPSAGL

SEQ ID NO: 45607 - protein, 204 aa, Yarrowia lipolytica CLIB122
MPQPADLRRKLVIVGDGACGKTCLLIVFAKGTFPEVYVPTVFENYVADVEIDGRRVELALWDTAGQEDYDRLRPLSYPDANVIIICFAIDSPDSLDNVQEKWISEVLHFCQGVPILLVGCKVDLRNDPKTIEELRRTSQRPVTTEEGNAVAQKIGAGKYLECSARTHDGVREVFEHATRAALTAHGQKGSKSSSREGKKKCLIL

SEQ ID NO: 45608 - protein, 364 aa, Candida glabrata CBS 138
MDLVLETLDHYIFDDVYAKIAPVELQRGIDDSLVNALSLNKIVSNSTLLHETLSITNSLKRVNKDVYGLTPFLFDFTEKTYASLLPRNNLIREFFSLWAVVTVFGLLLYLITASLSYVFVFDRTIFNHPKYLKNQMYLEIKLAVSAIPTMSLLTVPWFMLELNGYSKLYYDVDWEHHGLRKLLIEYATFIFFTDCGIYLAHRWLHWPRVYKALHKPHHKWLVCTPFASHAFHPVDGYFQSLSYHIYPMILPLHKISYLILFTFVNFWSVMIHDGQHMSNNPVVNGTACHTVHHLYFNYNYGQFTTLWDRLGGSYRRPEDSLFDPKLKMDKKVLEKQARETAAYIQEVEGDDTDRVYNTDKKKTN

SEQ ID NO: 45609 - protein, 451 aa, Aspergillus oryzae
MKARAVPASGLVLPSRVTPATSICWQCLRNDLISIQINSQTRAYHPTRRKFASPFGAAVTAAQTLLKGLPKAPPGISVDPLRIVGKELKFLTKNIRQLLGSGHPTLDKVAKYYTKSEGKHMRPLLVLLMSQATALTPRHGRWSSSPSYTVNDPISSPSVLADTNPDLNPLVSSSAEAKYDFAGDENILPTQRRLAEITELIHTASLLHDDVIDNAVTRRSSSSANLQFGNKMAVLAGDFLLGRASVALARLRDPEVTELLATVIANLVEGEFMQLKNTASDEKNPVFTDETISYYLQKTYLKTASLISKSCRAAALLGDSTPQVVEAAYAYGRNLGLAFQLVDDMLDYTVSDAELGKPSGADLELGLATAPLLFAWKQNPELGPLVGRKFSREGDVQRARELVYQSNGVEKTRVLAQEYADKAKAAISSFPDSEAKDGLLQMCEKTMNRRK

SEQ ID NO: 45610 - protein, 428 aa, Pseudomonas fluorescens
MPTKTADTLQYKANSRVSTFDQYKWRALIGVTFCYLFYYTGRQTLGFAIPGIQHDYCLSKYEIGWISAMMLWCYAGGQFINGNLGDKFGGKRMMIAGAILSLGANWVFSFGHSFWFFLLAWGANGYFQSMGFAPGSRLLSNWWSHKHRGFVYGVYVGFSGFSSVLAFILPLVILGAMQLDWIWIFRLAPLSMLLGAIVLWFFVSERPEDNKSAPLEQADDTSLPAAENNSTSAQRYVTVLRNWRLYITGFAIGFQNAARYALVVWVPVHFLGLDWKTSSAIIDPKWITIALPVGMALGALSNSWISDVVFQGRRYLAIVSYMVLASTTAMIMMFVPHASMVAIGLLFLCGFFVFGPASSFWALCPDIFGRHVAGTATGVLNTMSYAFAGMSEPVIGHMIDSTGSTSIIFPIVAGLCGASAMLSLLIKR

SEQ ID NO: 45611 - protein, 291 aa, Glycine max
MMSTSGAGRYMAFPPSPSAPPSPHLSGLRSTPLSDPDKYLAELLGERNKLSPFMAVLPHCFRLFNQEILRVTTLMGNASVLGQSGLEHASPLATGGIFSNGGADVNGWASRFQSERPSLLQSSSTQNWLSPQGSSSGIIVKKTVRVDIPVDAYPNFNFVGRLLGPRGNSLKRVEASTECRVLIRGRGSIKDPAREEMMRGKPGYEHLNEPLHILVEAELPVEIVDARLMQAREILEDLLKPVDESQDFYKKQQLRELAMLNGTLREEGSPMSGSVSPFHNSLGMKRAKTRG

SEQ ID NO: 45612 - protein, 427 aa, Pseudomonas syringae pv. syringae B728a
MSRSETLFANAQKHIPGGVNSPVRAFKSVGGTPLFFKHAAGAYVTDEDDKRYVDYVGSWGPMILGHSHPDVLDAVRSQLEHGLSYGAPTAMETEMADLVCELVPSMEMVRMVSSGTEATMSAIRLARGFTGRDSILKFEGCYHGHSDSLLVKAGSGALTLGVPSSPGVPAAFAKHTLTVPFNNLDAVRDLLAEVGQEVACIIVEPVAGNMNCVPPAPGYLQGLRELCDEHGVVLIFDEVMTGFRVALGGAQAYYGVTPDLSTFGKIIGGGMPVGCFGGKREIMSHIAPLGPVYQAGTLSGNPLAMAAGLTTLRLISRPGFHDELSDYTRRLLEGLQQRADAAGIPFVTTQAGGMFGLYFSEADEIVTFEDVMTSDSERFKRFFHLMLDGGVYLAPSAFEAGFTSIAHGDAELKLTLDAAEKAFAALK

SEQ ID NO: 45613 - protein, 324 aa, Pseudomonas aeruginosa PAO1
MSTLSTDQLLHAYRVMRTIRAFEERLHVEFATGEIPGFVHLYAGEEASAAGVMAHLRDDDCIASTHRGHGHCIAKGVDVHGMMAEIYGKKTGVCQGKGGSMHIADLEKGMLGANGIVGAGAPLAAGAALAAKLKGSDAVAVAFFGDGGSNEGAVFEAMNLASVWNLPCLFVAENNGYAEATAANWSVACDHIADRAAGFGMPGVTVDGFDFFAVHEAAGAAIERARAGEGPSLIEVKLTRYYGHFEGDAQTYRDPDEVKHYRETRDCLKQFRERTCHAGLLSASDLDAIDAEVEARIEDAVQRAKNDPKPEPDDLLRDVYVSYP

SEQ ID NO: 45614 - protein, 388 aa, Arabidopsis thaliana
MEECDYINELPDSLLTQILLDLRTKDSVKTSVSSKRWRNLWLNVPGLDLFSLQFTNPHHEEGLIKFMDRFMESNCRSRLQKFMIRYFECNGYRDRFMELIGTVVDCGIQHLYVYMHTCNRVDFIRQNIYKSKTLVSLKLYNVELKNPDFVVSLPCLKILKLMKICYGEDGPLVVEKLISGCPVLEDLELIKPFDILTQDVILFLRVSSQTLKSLRLYFATNGSEDPRKRAIICDFLTVISSVRHMIISGSILEELHSYSKLGWIPQFRNLYHLQASFFGTSLQLLPTFLESCPNLKNLIMDYGAFKEENIDFHEVPQCLISTLEYVHINKLMMMEQSGIKLVNYFIENSAVLKKLTLRFSFFSSIESESYKKLLTSTKLSPTCQVIFV

SEQ ID NO: 45615 - protein, 339 aa, Pseudomonas aeruginosa PAO1
MARKISYQQAINEALAQEMRRDPSVFIMGEDNAGGAGAPGEDDAWGGVLGVTKGLYHQFPGRVLDTPLSEIGYVGAAVGAATRGMRPVCELMFVDFAGCCLDQILNQAAKFRYMFGGKAVTPLVIRTMVGAGLRAAAQHSQMLTSLWTHIPGLKVVCPSSPYDAKGLLVQAIRDNDPVIFCEHKLLYSMQGEVPEELYSVPFGEANFLRDGDDVTLVTYGRMVHLALDAAASLARQGISCEVLDLRSTSPLDEDSILESVEKTGRLVVVDEANPRCSMATDIAALVAERAFSALRAPIRRVTAPHTPVPFSDALEDLYIPDAAKIEAAVRQALEGRDAA

SEQ ID NO: 45616 - protein, 107 aa, Triticum aestivum
MTKLMCLCFIILTIGVAVSADECEGDRQAMIKECAKYQQWPANPKIDPSNACCVVWQKANIPCLCAGVTKEKEKIYCMEKVGYVANFCKKPFSHGYKCGSYTFPPVV

SEQ ID NO: 45617 - protein, 186 aa, Methanothermobacter thermautotrophicus str. Delta H
MFMILIINNHGQYNHRIHRTLRYLQIPSELVPNTTPLDEIISRDPEGLILGGGPSLERSGNCVEYIQKLEIPILGICLGHQLIAKAYGGEVATAEAESYAQIELEILDEDDIFRGLGPRMSVWASHKDEVKKLPDEFDVLATSSICEVEAMKHHDKPVYGIQFHPEVHHTREGHRVFENFYDVCRS

SEQ ID NO: 45618 - protein, 175 aa, Secale cereale
  misc_feature (168)..(168): Xaa can be any naturally occurring amino acid
MAPAVMASSATTVAPFQGLKSTAGLPVGRRSGSAGLSSVSNGGRIRCMQVWPIEGIKKFETLSYLPPLSTEALLKQVDYLIRSKWVPCLEFSKVGFVFREHNNSPGYYDGRYWTMWKLPMFGCTDATQVLNEVEEVKKEYPDAYVRVIGFDNMRQVQCVSFIAFRPPXCEESGKA

SEQ ID NO: 45619 - protein, 311 aa, Methanothermobacter thermautotrophicus str. Delta H
MMLMLNPSDFIEEAVEEIRSTVGNEKAIIALSGGVDSSVASVLAGRAIGDNLTAVFVDHGLLREGEAEYVRKTFSERLNFRYIDASEEFLKELEGVTDPEEKRKIIGRVFIEVFERVAEEIGARYLVQGTIAPDWIESEGQIKSHHNVALPHGLVLEIVEPIRELYKDEVREIGLELGLPREMIQRQPFPGPGLAVRIVGEITREKIEICRRANAIVEEEVVESGLHESLWQYFAVLTDTMVTGVKGDVRDFGYLVVIRMVESLDAMTASVPELPWDLIKRISKRITAEIPEVTHVALSVSDKPPSTIEFA

SEQ ID NO: 45620 - protein, 175 aa, Secale cereale
MAPTVMASSATSVAPFQGLKSTAGLPVSRRSNGASLGSVSNGGRIRCMQVWPIEGIKKFETLSYLPPLTTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 45621 - protein, 385 aa, Cryptococcus neoformans var. neoformans B-3501A
MSSRMACRLAARAARQQRAFSATSITRNAPVTPWEPALPQGVSPAYDAAISYLADYQSRTLSKLNAFKSNLPETPSHEELQQLAKLEIEAYANDPAVRRMFKETGGEGQMDKRIMRWLGEENWRKEGGLDLLMQRALQMNVVPDLLPEIPPTAPLTITLSSPVTPGAFQRPSSFAQPPKITHQIFHHPSLPTLTNPNPAALHTLLVIDPDAPHHETHSFQERVLYMKTDIPISVVDGTVNLTDKSFGKELLAWEPPAPEQGTPYHRYVVLVFRQPSPSSVTTISREGFKLRDFLSSQGLTSHSLSGLSLFRAEWSEEEDEFINSVFREKRGVPEGAPVYGKVPKEVRYGYPMKAKLRRREEIRDQIWEGAMRELEGLGDVERVGV

SEQ ID NO: 45622 - protein, 302 aa, Oryza sativa
  misc_feature (150)..(150): Xaa can be any naturally occurring amino acid
MRAAAAPDPSPAPARSMLKRLFDRQLLRVSPAERIVAVGGGEKDEVEPSSVCLDGMVRSFLEDGSGVGAAVERAGGHGARRCNCFHGGGSSDDDDDEDDAAASSDVAETIKGLVHCATLRERNLLADVCGHVERHRAGGARRRELLGLVXAASLRAAGHDAAVCVSRWDKSPTHPAGEHAYVDVLLPPASDRGARERVLVDVDFRSAFEVARPTKAYRALLQRLPAVFVGKDDRLRLLVAASADAARASLRKRGLHLPPWRKPEYMRAKWLSPYDREPAPPDEASASAAAAEVAGEEAPAAA

SEQ ID NO: 45623 - protein, 347 aa, Aspergillus nidulans FGSC A4
MAEFIRSDILGTTFETTSRYANLQPVGLGTAGVVCSAYDLISEQVVAIKKMMKPFHSTSVAKRTYREVKLLRHLRHDNLINMSDIFISPLEDVYLVTELLGTDLHRLLNGKPLESKFAQYFTYQILRGLKYIHSAGVIHRDLKPGNLLINENCDLKICDFGLARVQEPQMTGYVSTRYYRAPEIMLTWQRYGSKVDLWSVGCILAEMLLGRPLFPGTDHINQFWLITDLLGNPPDEVIDRITTNNVRNPAPDLQPSNHLEPANGNRRIDSSGALNLLDNLLVFDPDRRISAEQGLMHPWMAPYHDPTDEPVATEQFDWSFNDADLPLDTWKIMMYVHHCSDVVSFTL

SEQ ID NO: 45624 - protein, 482 aa, Staphylococcus epidermidis RP62A
MAYFNKFLSNSERKRGKVSKKVAIIGAGITGLSSAYFIKKQDPSIEVTIFEASNRVGGKIQTYRSDGYTIELGPESYLGRKTIMTDVAKDIGLENDLITNTTGQSYIFAKNKLYPIPGGSIMGIPTDIKPFIKTRLISPIGKLRAGLDLFKKPIEIEDDISVGSFFRQRLGNEVLENLIEPLMGGIYGTDIDQLSLMSTFPNFKEKEEQFGSLIKGMKDEKEQRIKKRQLYPGAPKGQFKQFRHGLSSFIEALVKDIESKGVHIRYNTPVKDILISQKDYEILLEDDSKEKFNGLLVTTPHQVFLNWFSHDPAFDYFKNMDSTTVATVVLAFDEKNITNTYDGTGFVIARTSQTDITACTWTSKKWPFTTPEGKVLIRAYIGKPGDTVVDDHTDEEIVSIVRKDLSQMMTISGNPDFTIVNRLPKSMPQYHVGHIKMIKEIQQHIKTTYPRLRVTGAPFEAVGLPDCIQQGKNAVDEILEEL

SEQ ID NO: 45625 - protein, 773 aa, Arabidopsis thaliana
MDKTSQLPDELLVKVLSFLPTKDAVRTSLLSMRWKSLWMWLPKLEYDFRHYSVSEGQGLARFITLSLLGHKAPAIESLSLKLRYGAIGSIKPEDIYLWVSLAVHDSNVRELSLKLCTFAERPTKLPKSLYKCKSIVILKLKDEILVDVPRKVCLPSLKTLFLGRVTYSDEDSLHRLLSNCPVLEDLVVERDRIDNLGKLSVVVKSLQRLTLKMSCPCHLDGIMMNTPSLKYLKVTDERQESDSDNESDSDSPRYFYDFEDMPKLEEADFVLTFQNIKKDGISGLPDAMICHILSFLPTKVAASTTVLAKRWKPLLAFMPNLDFDESFRFDPRMTCEERRKGSESFMLVVDSVLALQAEANATLNKFYVKCEGVEQNSVLEWIPKVLKRGVLDIDLQIPSSRGFGSNSTFYPLPSEIFVSKTLVRLKIQFQDGANVNVEGDVSLPMLKTLHLDYVKMDTRMLQKLLSGCHTLEELLLMNLIWKESSEPEPCFVSVSVRTLKILKFSRFENFMKAKDFKPIVLLSFDIPNLVYLEYLDTIADKYEQVRFDSLVKASIGLCKTSKQIENDNNNVTKLFMGICNVTILYLTEDTLKVLGCCRETMPVFENLIHLTIRTGVHIGWKSLPHLLKNCPNLQTLVFEGMHHIYRKGRACGDVDEDGTCMCKNLDNMRVKKDIDACLSSSPVKVIKILNFGELCGFCEFCDVEEDVAGQIKQVKQFLETMPDLEKVILYYNTPEDEDVMKVFKKLKKLPRVASAKCEVQIISDNINLSFTFR

SEQ ID NO: 45626 - protein, 308 aa, Xylella fastidiosa Ann-1
MSLDSALRSRIETLLHSNRVVLFMKGRPGMPQCGFSAKAAGILQALGVEYAHVNVLDDQEIREGIKRYGDWPTIPQLYIDGELIGGSDIVSQMYENGELSTLLGVAAPDLTPPSITITPTAVEMLKGTLANAPGSTLALSIDSRFQPTFELAPINTQAIAAESNGLRVQFDLASARRAEGITIDWVDDIRGQGLVIDNPNAPQPIQELSPGDAAAQVDAGVLTLVDVRPADERAVASVAVPFRTMDGGERAVLEQLPKGTPLAFLCHHGGRSLQAAEHFRSLGFTSIYNIGGGIDAWSTQVDPGVPKY

SEQ ID NO: 45627 - protein, 570 aa, Salmonella typhimurium LT2
MSEKHPGPLVVEGKLSDAERMKLESNYLRGTIAEDLNDGLTGGFKGDNFLLIRFHGMYQQDDRDIRAERAAQKLEPRHAMLLRCRLPGGVITTTQWQAIDKFAADNTIYGSIRLTNRQTFQFHGILKKNVKPVHQMLHSVGLDALATANDMNRNVLCTSNPYESQLHAEAYEWAKKISEHLLPRTRAYAEIWLDQEKVATTDEEPILGQTYLPRKFKTTVVIPPQNDIDLHANDMNFVAIAENGKLVGFNLLVGGGLSIEHGNKKTYARTASEFGYLPLEHTLAVAEAVVTTQRDWGNRTDRKNAKTKYTLERVGLETFKAEVERRAGIKFEPIRPYEFTGRGDRIGWVKGIDDKWHLTLFIENGRILDYPGRPLKTGLLEIAKIHQGEFRITANQNLIIASVPESQKAKIETLARDHGLMNAVKPQRENSMACVSFPTCPLAMAEAERFLPSFTDKVEAILEKHGIPDEHIVMRVTGCPNGCGRAMLAEIGLVGKAPGRYNLHLGGNRIGSRIPRMYKENIAEPDILASLDELIGRWAKEREAGEGFGDFTVRAGIIRPVLDPARDFWE

SEQ ID NO: 45628 - protein, 606 aa, Azoarcus sp. BH72
MSLVEVKVPDIGDFDSVPVIELFVKVGDTIKVDDAICTLESDKATMDVPSSAAGVVKEVLVKVGDKVGEGAVLLKVEAAGAAASPLQGEGRGGDGVKPASDVPHPPPSLPLEGGGAKAAPAAASHTGGADAEYDMVVLGAGPGGYSAAFRAADLGLKTAIIERYATLGGVCLNVGCIPSKALLHVAAVIEEAEHVETAGIKFAKPSVDVDALRKHKDGVIGKLTGGLAGMAKARKVDVIRGYGSFLDPHHLEVEETTGNGQDKTGAKKVVKFKNCIIAAGSAAVHLPFIPKDPRIVDSTGALELRQVPGKMLVIGGGIIGLEMATVYSTLGARIDVVEMLDGLMQGPDRDAVKVWEKQNAARFDKVMLKTKTVAVEAKDDGLWVKFEGEGAPAEPVRYDMILQSAGRSPNGKKIGADKAGVIVGERGFIPVDVQMRTNVPHIFAIGDIVGQPMLAHKAVHEAHVAAEVAAGHKAAFDATVIPGVAYTHPEVAWVGYTEAQAKSEGKKVEVAKFPWAASGRAIANGADYGFTKLIFDAETHRVIGGTIVGPSAGDMIGEVCLAIEMGADAVDIGKTIHPHPTLGETVGMAAEVAHGSCTDLPPMRKK

SEQ ID NO: 45629 - protein, 619 aa, Mesorhizobium loti MAFF303099
MHEQRSLTMNALTPAVSTGPLPASRKIHKSGVLHPQIRVPMREISVHPTAGEPPVIVYDPSGPYTDPTVETSIEKGLARLRHEWITARGDVEAYDGRHVRPEDNGFAVGERLTPEFPVRNRPLRARSGKAVTQLAYARAGIITPEMEFVAIRENLGREMLRGTLQRDGEAFGASIPDLVTPEFVRDEVAHGRAIIPANINHPESEPMIIGRNFLVKINANIGNSAVTSSMAEEVEKMVWAIRWGADTVMDLSTGRNIHNIRDWIVRNAPVPIGTVPLYQALEKVGGIAEDLTWEVYRDTLIEQAEQGVDYFTIHAGVRLHYIPLTVDRVTGIVSRGGSIMAKWCLHHHRESFLYEHFAEVCDICRAYDVSFSLGDGLRPGSIADANDAAQFAELETLGELTKIAWAKDCQVMIEGPGHVPMHKIKANMDKQLAVCGEAPFYTLGPLTTDIAPGYDHITSGIGAAMIGWFGTAMLCYVTPKEHLGLPDRNDVKIGVITYKIAAHAADLAKGHPAAKVRDDALSRARFEFRWEDQFNLSLDPETARSFHDQTLPKEAHKLAHFCSMCGPKFCSMRISHDIRAEAQKEGMAAMAAKYREGGDLYVPAEESGAPLMPEAHELS

SEQ ID NO: 45630 - protein, 562 aa, Azoarcus sp. BH72
MSQLIEVKVPDIGDFDSVPVIELFVKVGDTIAVDDAIATLESDKATMDVPSSAAGVVKEVLVKVGDKVSEGALLIKVEAAGAAAAAPAAAAAAPAPAPAPAAPAPAPAPAGAAPAAAGGVVDVVVPDIGDFSDVPVIELFVKVGDTIKVDDAIATLESDKATMDVPSSAAGVVKEVLVKVGDKVSQGSLLLKLESGAAAAAPASPPPLQGEGRGGDGVKPASNVPHPPPSLPLEGGGAKTAAAPAAPSAVTLGGKVHASPSVRAFARELGVDLAQVKATGPKNRVLKEDVAAFIKGAMSTGVVPGKTPAAAAGASLGGGLDLLPWPKVDFAKFGEVEVKPLSRIKKISGQNLARNWVMIPAVTYHEDADITDLEAFRVQMNKEYEKSGKKLTMLAFIIKASVRALQEFPEFNTSLDGDNLVYKKYFNIAFAADTPNGLVVPVVKDADKKSVFQIAEETGALAKKARDGKLGPADMSGACFTISSLGGIGGTYFAPIVNAPEVAILGVNKSVMKPVWDGKQFVPRLTLPMSLTADHRVIDGALATRFNVYLAQLLADFRRVML

SEQ ID NO: 45631 - protein, 893 aa, Azoarcus sp. BH72
MTGTPNAFLQTDPDAQETQEWLQALAGVIENEGSERAHFLIEKLIESAREDGVDIPYSATTQYINTIPADAQPRYPGDPDMEIKLHSYIRWNAMAMVVRANKHTNVGGHIASFASAAALYDVGFSHFWHAPSADHDGDMIYFQGHSVPGVYARAFMLGRLSEEQMDNFRQEVGGKGISSYPHPWLMPDFWQFPTVSMGLGPLQAIYTARFTKYLASRGLIDAAKADQRKVWAFLGDGETDEVESLGAIGMAAREKLDNLVFVINCNLQRLDGPVRGNGKIIQELEAEFRGAGWNVIKVIWGTHWDALLQRDKKGILKKRMMECVDGEYQTFKAKNGAYVREHFFNTPELKELVADWTDDEIWQLNRGGHDLFKIFAAYKAASEHKGQPTLILAKTIKGFGMGGAGEAMNISHQQKKLDLDAIRRFRDRFGLPVPDDQLEKLPYLKFPEDSAEYKYMMERRMALGGFLPQRRRTADPLPVPPLSAFEALLKASGEGRELSTTMAIVRIMNTLLKDKGIGRHIVPIVPDESRTFGMEGMFRQYGIWNQQGQNYVPEDHDQLMFYKESKTGQVLQEGINEAGAMADWIAAGTAYSVHNVQMVPFYIFYSMFGLQRTMDLCWAAADQRTRGFMIGGTAGRTTLNGEGLQHEDGHSLLLANMIPNCVSYDPTFQYEVAVVVQDGMRRMFAEQEDVYYYITVMNENYEHPEMPAGAEQDILKGMYAFRKGAEKTGPRVQLMGSGTIFREVIAAADLLKNDWGVEADIWGCPSFNELARDGQDAERWNMLHPLEAPKQSHVAQKLAGAQGPVIAATDYIRLFAEQIRPFVPGRYVTLGTDGFGRSDTREQLRHFFEVDRHWVTLAALKALADEGTIERDKVAAALVKYQLDPNKPNPLSV

SEQ ID NO: 45632 - protein, 264 aa, marine gamma proteobacterium HTCC2207
MHALTRPLQREFYSLVINLQALNSAEKAADRLLIEPAICKIRLEYHPPNNSLAEELSVLKDLSHLFERNVKWAGEVKDKNPDFFTELSKQQAPEYLWIGCSDSRVPANQIVALPPGEIFVHRNIANVAVHSDLNCLSVIQYAVDALKVKHIVVCGHYGCGGIKAAMGNEENGLIDNWLGHIKDVSRFHAEELSQLEGDEKFNRLCELNVLEQAANVCNSTVVQSAWKRGADLSVHAWIYSIENGLLKDLSLSISSPQDLEKLNS

SEQ ID NO: 45633 - protein, 157 aa, Bordetella parapertussis 12822
MLKVSEILRVKGDTLYTASPDTHVSMAVQTMSEQDIGSLVIMESGMLAGMLTFREIIRHIDQHGGNVGDTTIRAIMDDAPVSVSPNTSADEVQRLMLEKHARYIPVMDGPTLLGVISFYDMAQAIVAAQQFENNMLKAYIRDWPMGVGAVQALIRQR

SEQ ID NO: 45634 - protein, 472 aa, Oryza sativa
MAFFRGLTAVSRLRSRVAQEATTLGGVRWLQMQSASDLDLKSQLQELIPEQQDRLKKLKSEHGKVQLGNITVDMVLGGMRGMTGMLWETSLLDPDEGIRFRGLSIPECQKVLPTAVKDGEPLPEGLLWLLLTGKVPTKEQVDALSKELASRSSVPGHVYKAIDALPVTAHPMTQFTTGVMALQVESEFQKAYDKGMSKSKFWEPTYEDCLNLIARLPAVASYVYRRIFKGGKTIAADNALDYAANFSHMLGFDDPKMLELMRLYITIHTDHEGGNVSAHTGHLVGSALSDPYLSFAAALNGLAGPLHGLANQEVLLWIKSVIGETGSDVTTDQLKEYVWKTLKSGKVVPGFGHGVLRKTDPRYTCQREFALKYLPEDPLFQLVSKLYEVVPPILTELGKVKNPWPNVDAHSGVLLNHFGLSEARYYTVLFGVSRSIGIGSQLIWDRALGLPLERPKSVTMEWLENHCKKVAA

SEQ ID NO: 45635 - protein, 493 aa, Candida glabrata CBS 138
MFRAVSRRGFSSSSYLAAIKKQHDLVIIGGGPGGYVAAIKAAQLGLDTACIEKRGSLGGTCLNVGCIPSKALLNNSHLYHQIKSDTKNRGIDVKGDVEINVEQFQKAKDTVVKQLTGGVEMLFKKYKVNYYKGVGSFESENSVKVTPVEGIKGTVEDETIIEAKNIIIATGSEVTPFPGIKIDEERIVSSTGALSLKEVPKRLAVIGGGIIGLEMGSVYSRLGSKVTVLEFQPKIGASMDGEVAATSQKFLKKQGFNFKLSTKVVSAERNGDVVDIVVEDTKSGKTENIQADVLLVAVGRRPYIEGLGAEKLGLEVDKRGRLVIDEQFSTKHPHIKVIGDVTFGPMLAHKAEEEGIAAVEYIKKGHGHVNYGNIPSVMYTHPEVAWVGKTEEQLTEEGIKYKVGKFPFIANSRAKTNMETEGFVKILIDAETERMLGAHIIGPNAGEMIAEAGLALEYGASAEDVARVCHAHPTLSEAFKEANLAAFDKPINF

SEQ ID NO: 45636 - protein, 525 aa, marine gamma proteobacterium HTCC2207
MSDLHSQKILILDFGSQYTQLIARRVREIGVFSEIRAWDITEEEIREFNPKGIILSGGPESVTGGASAPRAPDCVFTMGLPVLGICYGMQTMAGQLGGKVDTSDVREFGYAQVKVENQSALLRDIKDHIGSDGESLLDVWMSHGDKVVAMPEGFSLMASTPSCPIAGMVNEEKKFYGIQFHPEVTHTLQGERMFQHFALEICGCEGLWTAAAIIEDQIARVKQQVGDSHVLLGLSGGVDSSVVAALLHKAIGAQLTCVFVDNGLLRKNEGDMVMEMFANNMGVKVIRANAQDKFLDGLAGVSDPEKKRKVIGNTFIEIFDEESQKIKNVNFLAQGTIYPDVIESAASKTGKAHVIKSHHNVGGLPDDMALELVEPLRELFKDEVRKIGVELGLPHDMVYRHPFPGPGLGVRILGEVKREYCDILREADAIFIEELHNFGWYQKTSQAFAVFLPVKSVGVVGDARRYEWVIALRAVETIDFMTARWAHLPYELLEKVSNRIINEISDVSRVAYDVSSKPPATIEWE

SEQ ID NO: 45637 - protein, 503 aa, Oryza sativa (japonica cultivar-group)
MATAAACISFASPSPARVVIRRQTRASASASATDRQEVVSPKRRLPLRKVPGDYGPPVVGAIRDRYEYFYGPGGRDGFFAARVRAHRSTVVRLNMPPGPFVARDPRVVALLDAASFPVLFDTSLVDKTDLFTGTFMPSTDLNGGYRVLSYLDPSEPNQAPVKTLLFYLLSHRRQQVIPKFREVSARCSASPPHLVEDTLLHSLRLPPALVKKDYDRLADFFRDAAKAVVDEGERLGIAREEAVHNILFALCFNSFGGMKILFPTLVKWLGRAGARVHGRLATEVRGAVRDNGGEVTMKALAEMPLVKSAVYEALRIEPPVAMQYGRAKRDMVVESHDYGYEVREGEMLFGYQPMATKDPRVFARPEEYVPDRFLGEDGARLLRHVVWSNGPETAAPTLHDKQCAGKDFVVLVARLLLVELFLRYDSFDVESHLHARLICHRHLAQEGHLLTTAGQSLRRPVILFSVLFFFTKYFSSISNFFTLYGVINQLVRIRSCTGSDFLC

SEQ ID NO: 45638 - protein, 279 aa, Coxiella burnetii RSA 493
MNEDPHPHRSWLERLSHALLWEPKDREQLIELLHDAKERNLLDQDALAMIEGVLRVSEKKVRDVMIPRAQMVVVDHDATPQSTLPIIIESAHSRFPIISESRDEVIGILLAKDLLQYTVGEKQAKAQIKDLARPAIFIPESKRLDVLLNEFRLKRYHMAIVVDEYGSVSGLITIEDVLEQIVGSIQDETDIVEEEPITKLNPKEFTVKALTPIDVFNNYFGTKINDEDFDTIGGYVMQQIGHLPKRGESIVIDSMKITVMLATKRSIQLLHLTKKTENE

SEQ ID NO: 45639 - protein, 455 aa, Chlamydophila pneumoniae CWL029
MNVWTKFFQPPKHIKEIEDQEVVKKKYKYWRIRIFYSMFIGYIFYYFTRKSFTFAMPTLIADLGFDKAQLGIIGSTLYFSYGISKFVSGVMSDQSNPRYFMAIGLMITGLTNIFFGMSSSIVLFALWWGLNGWFQGWGWPPCARLLTHWYAKSERGTWWSVWSTSHNIGGALIPILTGFIIDYSGWRGAMYVPGILCIGMGLVLINRLRDTPQSLGLPPIEKYKRDPHHAHHEGKSASEGTEEIERELSTREILFTYVLTNQWLWFLAAASFFIYIVRMAVNDWSALFLIETKHYAAVKANFCVSLFEIGGLFGMLVAGWLSDKISKGNRGPMNVLFSLGLLFAILGMWFSRSHNQWWVDGTLLFVIGFFLYGPQMMIGLAAAELSHKKAAGTASGFTGWFAYFGATFAGYPLGKVTDVWGWKGFFIALLACASIALLLFLPTWNATEKNTRSKA

SEQ ID NO: 45640 - protein, 432 aa, Moorella thermoacetica ATCC 39073
MTQLEAAQVGQVTRAMEQVAAREKVRVEDLMAEVAAGRVVIPVNKNHHKLQPCGIGRGLRTKVNANLGTSTDYPDIAAELEKLQVALDAGADAVMDLSTGGDINECRRQVIARSPATVGTVPIYQATVEAQEKYGALVKMTVDDLFRVIEMQAEDGVDFITVHCGVTMEVVERLRREGRLADIVSRGGSFLTGWMLHNEQENPLYAHYDRLLEIARRYDVTLSLGDGLRPGCLADATDRAQIQELIILGELVDRAREAGVQAMVEGPGHVPLNQIQANILLEKRLCHEAPFYVLGPLVTDVAPGYDHLTAAIGGALAAAAGADFICYVTPAEHLGLPTLADVREGVIAARIAGHAADLAKGLPGAWEWDREMARARKALDWQRQIELALDPEKARQYRRARNDEGAVACSMCGDFCAMRLVGEYLGKPSETC

SEQ ID NO: 45641 - protein, 591 aa, Oryza sativa (japonica cultivar-group)
MAPATAISCAVVKCGGGGGPRQPRVSAPPRQQGHAAAAASLEQLLLLPRWSPPSSPLSFARPAAERVAARRARAAAVAMKVVEDATPPAAGAVLLAGAQSRHAIFRDELVRRAFYAAEAAHRGQMRASGDPYLQHCVETAALLAELGAGPAVVAAGLLHDTVDDAGLGYGSLSVQFGAGVADLVKGVSNLSHLSKLARRNDTASRVDEADKLRTVFLAMEDARAVLIKLADRLHNMRTLDSLPKVKQQCFAKETLEIFAPLANQLGILNWKEQLENLCFKYLYPELYEELSSNLLEFYNQDMIAAAIRRLEQALQVRGLCYHTISGRNKSMYSIYSKMARKKLDMDEIYDIHGVRVILDNKADCFTTLEIVHHLWPRIPGKFKDYINSPKPNGYQSLHTVVLSEETLPLEIQIRTRDMHLQAEFGIAAHWRYKEAVRNCCSSVPEMVEWVRWVVTWQCETLHIDHPSSLTHGAPPRAICSCSSQSDDCPFSYSKRCDHSGPILVILLENEKMSVQEFPQNSTVLDLLKRTSSYDMQLRLRLNCHVVHNLNQELKMGDVVELIPLAQCNPGAGGYAREFHQMYDHRLTVSQS

SEQ ID NO: 45642 - protein, 355 aa, Nostoc punctiforme PCC 73102
MLEINAFSTNSGYVYPKNCKWQVGAKAENKPWVKFLIQGLLLKMANEKDGGNKCPIQYSITKKKPMAKSKEKKEQTLQPPQQQEVPGVESEMTPKPKADDAQYRGSGKLQDKVALITGADSGIGRAVAIAFAKEGADVAILYLNEHDDAKETKHLVEKQGRRAVTIAGDIGDETFCQQAIQQTVGEFGKLDILINNAAEQHPKQSIEEITKEQLERTFRTNIFSMFFMTKAALKHLQTGSAIINTTSVTAYKGSPQLLDYSSTKGAIVAFTRSLSQNLVSKGIRVNAVAPGPIWTPLIPSTFPEEKVESFGKQVPMQRAGQPEEVAPSYVFLASDDASYVSGQVLHVNGGEVVNG

SEQ ID NO: 45643 - protein, 157 aa, Triticum aestivum
MSPPPQPQQKDKAEHEVPRATVASAVASLTKWMRERAAEAPPNLLADERDDLVVLQLSLRRVPPKPTTKPHLLPLPHPVVAHSAASVCVISDDRAGSGSPAAAAILDAARSLKLPVSEVVPFSALRTDYRPYESRRRFAASYDLFLADRALLPCCLA

SEQ ID NO: 45644 - protein, 80 aa, Oryza sativa
  misc_feature (51)..(51): Xaa can be any naturally occurring amino acid
FSSDLVSLSLATVPSATWRVTVSVYDETLYPFCSVLVVNDLARIFRDGFSXPYVVVDLRLILFGNGRVSSDGSITCQCSH

SEQ ID NO: 45645 - protein, 884 aa, Cryptococcus neoformans var. neoformans B-3501A
MKSNFVFQNLCGTVYRQGNVVFTPDGNSVLSPVGNRVSVFDLVNNKSRTLPFENRKNIASIALSPDGNVLISIDEDGRALFVHFRKGTVLHHISFKRKVHHVSFSPDGKYIAITHGHMVQIWNTPSHLVREFAPFTLHREYTGHHDEVVSVCWSKTSRYFITTSRDMTARLYTINPLEGFQPKQFGGHRDVVLGAFFSQDEKTIYTVSRDGAVFVWKAKKGVSEADSDVEMDILDAPTTSTSAANLALEHAVAYTRWGVHARHFFNQPGTKVICATFHPKTSLLIVGFSSGVFGLWEMPEFTPVHTLSISNEKISSVAVSASGEWLAFGAAKLGQLLVWEWQSESYVLKQQGHYYDMNTLAFSPDGQNIATGGEDGKVKLWNASSGFCFVTFPEHTAAISTVEFAKQGQVLFTASLDGTVRAYDLIRYRNFRTFTSPTPVQFSALAVDPSGDVVCAGSQDSFEIYMWSVQTGKLLDILTGHTAPISGLAFSPTGNQLASSSWDRSIRLWSVFGRSRATEPIELSGEATALAFRPDGNEICASTLNGELIFIDVEEGQIKSVIEGRRDISGGRKVDDRLTAANNAASKYFNSVIYTADGACVLAGGSSKYVVLYDRTEGVMVKKFQISENLSLDGTQEMLDSRKMTEAGTIDSFDRQGEEEDLEDRLDSTLPGASKGDLSKRRYRREARTNCVRFSATGRSWAAASTEGLLIYSLDESTTFDPFDLSLDLTPESVMQTVVSGDHLIALIMALRLSEKPLIQRVYESIPPSSIRLIARQLPRVYITQFMKFISDHIENTPHVEFDLVWTAAMLTSHGKFLKERKGEMASTLRGLVRGLMGLEMSVAKISDENTFSLNYILSQAGKDDQIEFEEGEGDAFILDVDGA

SEQ ID NO: 45646 - protein, 394 aa, Zea mays
MQAAAASVKSSTTAAAAAATCKAGFKPLHLPPLPAAGSRPLSLSVSARPLYRQDHVLATTVAMAAAGRSDRAASPAPPSATADGARPVVEVAAPAETARRAKIGVYFATWWALNVIFNIYNKKVLNAFPYPWLTSTLSLAAGSAIMLASWATRIAEAPQTDLDFWKALTPVAIAHTIGHVAATVSMAKVAVSFTHIIKSGEPAFSVLVSRFFLGEHFPAPVYFSLLPIIGGCALAAVTELNFNMVGFMGAMISNLAFVVRTIFSKKGMKGKSVSGMNYYACLSIMSLVILLPFAVAMEGPKLWAAGWQQAVAEIGPNFVWWVAAQSVFYHLYNQVSYMSLDEISPLTFSIGNTMKRISVIVASIIIFQTPVQPINALGAAIAILGTFIYSQAKQ

SEQ ID NO: 45647 - protein, 1075 aa, Azoarcus sp. BH72
MPKRTDIKSILIIGAGPIVIGQACEFDYSGAQACKALREEGYKVVLVNSNPATIMTDPETADVTYIEPITWQVVERIIEKERPDAVLPTMGGQTALNCALDLARHGVLEKYGVELIGASGEAIDKAEDRLKFKDAMTKIGLGSARSGIAHSLEEALQVQGGIGFPVIIRPSFTLGGTGGGIAYNMEEFHDICKRGLEASPTNELLIEESLLGWKEYEMEVVRDRADNCIIVCSIENLDPMGVHTGDSITVAPAQTLTDKEYQILRNASIAVLREIGVDTGGSNVQFAINPKDGRMIVIEMNPRVSRSSALASKATGFPIAKVAAKLAVGYTLDELKNDITGGATPASFEPSIDYVVTKIPRFAFEKFPAANDRLTTQMKSVGEVMAMGRTFQESFQKALRGLEVGVYGLDEVEADREDLEHELANPGAQRIWYVGQAFREGMTQEQVHNLTKIDPWFLAQIEDIVLTEKSLAGRSLKAMQAAELRDLKKKGFSDRRIAKLLGTDETAVRLQRHSLGVRPVFKRVDTCAAEFATSTAYMYSSYEEECEARPTDKKKIMVLGGGPNRIGQGIEFDYCCVHAALALREDGYETIMVNCNPETVSTDYDTSDRLYFEPITLEDILEIVHIEKPVGVIVQFGGQTPLKRAQALQDNGVPIIGTSPDMIDAAEDRERFQKLLNDLGLKQPPNRTARTPEAAVRLAAEIGYPLVVRPSYVLGGRAMEIVHEQKDLERYMREAVKVSNESPVLLDRFLNDATEVDVDALSDGEQVIIGGIMEHIEQAGVHSGDSACSLPPYTLSAKLQDELRRQTEAMARALNVVGLMNVQFAIQGEGDNAVVYVLEVNPRASRTVPFVSKACSLPLAKIAARCMAGQSLASQGVTGEVIPPYYSVKEAVFPFVKFPGVDTILGPEMKSTGEVMGVGRSFAEAFVKSQLAASIRLPTSGAAFISVKPTDRPAAVEVARELHELGFSLVATKGTGAALEAAGLPVTAVNKVNEGRPHVVDMIKNNEIALVINTVEEKRQAINDSRSIRTSALAAKVTVYTTIEGARAACMGMRHLSGLEVYAVQDLHNELKQIA

SEQ ID NO: 45648 - protein, 497 aa, Mesorhizobium loti MAFF303099
MKGDDGLTVTQSLTRRLKNPELFDDLAGVPGRKAEQSTRRFSVFNPSTGELLAELPDMDVRDVSKAIDKAEAAQEHWAALTARERSDILWEWHQLILDHSEDLAAILTAEMGKPLAEAKSEIAHAAAYLQWYAEEANRIYGETISPPSNDRRMLVIKQPIGVVGAITPWNFPASMVARKISPALAAGCAIVLKPAEQTPLVAGAMFTLARMAGFPDGVLNLIYASEGDAVGRELCSNPKVRKISFTGSTEVGRLLMRECSDQIKRTSFELGGNAPFIVFDDADVDAAVDGALQAKFRNAGQTCVSANRLYVQSSVYNEFCDKFTKRVSALRVGDGFEPEVAIGPLIDKCALAKIEDHIRDAVRQGGKIRCGGNRIGESGTFFEPTVITDVERTMRVAQEETFGPLAPIIRFNDPDQVVREANDTIYGLAAYFYASNLKRVWRVAEALEYGMVGINTGRMSSEAAPFGGMKQSGIGREGSRHGLEDYLEMKYLCMGGL

SEQ ID NO: 45649 - protein, 537 aa, Archaeoglobus fulgidus DSM 4304
MSEAYNYQLLLKHILESGVTYAPKQEIVYRDLKRFTYRDIYERVHRLASALEELGVKKGTKVAVLDWDTNRYLECFFAIPMMGAVLHTVNVRLSPEDILYTMQHAEDEVVLVYKDFVPLIESIADKLDTVKKYVVMTDDTMPETKLTDVEYEEMLKKASPNYDFPDFDENTMATLSYTTGTTGRPKGVWFTHRKLFLHTLAGCIAMTGYRSVLRLKEDEVVYMPLTPMFHVHAWGVPYMMWLLGHKHVYPGRYEPQMIVKLVMTEGVTYSHCVPTILQMIVDNLPEGFKFPGWKMIIGGAKLPKGLALRAREKGIITMAGYGMSETCPILTGGFLKPHLLNVDEETKVELSIKTGIPFPLVYVRVVHDDFTDVKPDEQDMGEVVVRAPWLTDSYLKDPEKTKELWEGGWLHTGDIAVMDEEGYITIVDRLKDVVKSGGEWISTLTLENLLSLHPKVREVAVIGIPDEKWGERPLAIIVPMPGEKPTPEELRAHLMKFVEEGKITKWAVPDRFEIVDEIPKTSVGKIDKKVLKQMYSR

SEQ ID NO: 45650 - protein, 295 aa, Desulfitobacterium hafniense DCB-2
MMTITEWENHSVVLSKSFGGVDLVKHFAVIGDPIAHSLSPVMHNAGYKALNLAADYQKFQVSPEDLGEAVLGLKALGFSGWNVTVPHKETILPFLDELTEEAVRAGAVNTVKVDKGRLIGHNTDGSGFVRSLQEHMELDERQQIVILGAGGAAKGIAMALAPFQAQLCIMNRTPERGAELVGKVLEWGGQAHQEEWGRGAWLVQADCVIQTTSIGLKKEEYPFSLAGIRPGTLVVDIIFNPWETPFLHSAKAMGCKTVNGIDMLLYQGVNAWEFWLEDKAPVESMRKALYQALAV

SEQ ID NO: 45651 - protein, 340 aa, Coccidioides immitis RS
MAAMIAGLYRLLKGRISTPVDPNTSLEGKTVLITGGNRGLGLEAAIKYVNLGATTVIIGCRSTERGNQAKATIETLTRRRGVVQIWPLDMSRYDSVIAFAGRVNEEIPRLDIALLNAGVLHRNYTLSSEGWEDTLQINTLSTILLALLLLQKLRASRTDGGGPANLTFTSSGTHKFVKGEQLVGSEDQSILQHVNAESNFSSIVQYKVSKILIEFAVKCIAKIARQENGTVDVIVNSACPGFCSTNLEREFDSFVHRLLGPIFYFIFGRSAEQGSRTLVSATLLGEESHGKFWTHDSFPDLSQFLISTEEGKRLQERAWTEIVEELKTRSPLIKELLNPS

SEQ ID NO: 45652 - protein, 338 aa, Bradyrhizobium sp. BTAi1
MRGAVLYGPHDVRFEDRETPDIIEPTDAIIRIAATCVCGSDLWPYRGLQPLNGPTPMGHEYCGVVEEVGRAVRRIKPGQFVVGSFATSDNTCPHCNFGYQSSCVKREFISRAQAPFLRVPQADGTLVPTPGVPSPEQLASILTTSDVLGTGWFAADAANVKPGTTVAVVGDGAVGLLGILSARQMGAERIIAMSRHESRQKLALEFGATDIVTQRGDAGVAEIMDMTDGIGADSVLECVGTQQSMLQAIHAARPGGYVSYVGVPHGVELNGEELFFAHVHLHGGPAPVRKYLPKLIDLVMSGAITPGKVFDLTLPLEKVADAYRAMDERRAIKVLLQP

SEQ ID NO: 45653 - protein, 213 aa, Pinus krempfii
QAKAAGARIIVTQAAYVEKLADLQSHDVLVITIDDAPKEGCKHISVLTEADETQCPVVKIHPDDVVALPYSSGTTGLPKGVMLTHKGLVSSVAQQVDGENPNLYFHSEDVILCVLPLFHIYSLNSVLLCALRAGAATLIMQKFNLTTCLELIQKYKVTVAPIVPPIVLDITKSPIVSQYDVSSVRIIMSGAAPLGKELEDALRERFPKAIFGQ

SEQ ID NO: 45654 - protein, 410 aa, Methanothermobacter thermautotrophicus str. Delta H
MENNSQNVLKKIEDLKKEVRMLKEENSKTKRNLMWKIRKLEKDKLLIENERTRLDREVKSLRGEIERFRTPPLVIATVTEVLDDHRVAVKSTTGPHFVINYSRFIDRKQLEPGARVALNQQTFSIVDVLPSEKDPVVTGMEVEEKPDVSYEQIGGLEEQVREVKETVELPLKKPELFEKIGIEPPKGVLLYGPPGTGKTLLAKAVAHETNATFIKIVASEFVRKYIGEGARLVRGVFELAKEKSPSIIFIDEIDAVAAKRLKSSTSGDREVQRTLMQLLAELDGFESRGNVGIVAATNRPDILDPALLRPGRFDRFIEVPLPNEDGRREILKIHTSGMALAEEVDIELLARITDGASGADLKAICTEAGMFAIRDERDEVTMADFMDAVDKIMGVEKEEEYKQETGVMFG

SEQ ID NO: 45655 - protein, 496 aa, Burkholderia sp. 383
MTPFDTSLVPDGNILIGGEWRRGRGTPFASIYPADQSVNMEVSTANAEDAAEAVVAADAAWRRADWAGLKPHQRAQVLYRIADLIMQRHEALANLQRRDNGKPIGETRVLVASAANTFRYFAACLETLDEELTPSRGDYLTMSVYEPIGVIAAITPWNSPIASDAQKLAPALAGGNAVVLKPAEVTPLVSLALARICEEAGVPKGVLSVLPGKGSVIGDVLVRHPLVKKVSFTGGTEVGRGIARIAAEKLMPVSLELGGKSPTIVCDDADLDHAVNGVLYGIFSSSGEACIAGSRLFVQRAVYDEFMTRLVAGARKLRVGDPTRPDTQMGPLITAKHRESVERYVALGLEEGGRLLCGGERPSGDGRENGFFYQPTILEGLPNSARICQEEIFGPVLVAMPFDDEASLIAQANDSVFGLAAGIWTRDYKRAWRIARALETGTVWINTYKLFSISTPFSGWKESGMGREKGRLGIREYMQQKSLYWGLNDAPLPWAN

SEQ ID NO: 45656 - protein, 230 aa, Cryptococcus neoformans var. neoformans B-3501A
MSVSAGIRNTSKRSFLIEITDAAQTYDSAPMRRPDIKKKLVVVGDGGCGKTCLLTVYAENRFPEEYVPTVFENLMTTVPSPTDPSKIIELALWDTAGQEDFDRLRPLSYNDTDVILIVFACNHRPSLLNVQDKWYPEMAHFCENVPLILVCTKTDLREDQQTVSLMAAQGTTPISASEGERIAKEIGARRYMECSAKAGMGVGEVFDAAIRESMKKGGLKKMKGRKCVVL

SEQ ID NO: 45657 - protein, 402 aa, Chlamydophila pneumoniae CWL029
MDKLTVQDLSPEEKKVLVRVDFNVPMQDGKILDDIRIRSAMPTINYLLKKHAAVILMSHLGRPKGQGFQEEYSLQPVVDVLEGYLGHHVPLAPDCVGEVARQAVAQLSPGRVLLLENLRFHIGEEHPEKDPTFAAELSSYGDFYVNDAFGTSHRKHASVYVVPQAFPGRAAAGLLMEKELEFLGRHLLTSPKRPFTAILGGAKISSKIGVIEALLNQVDYLLLAGGMGFTFLQALGKSLGNSLVEKSALDLARNVLKIAKSRNVTIVLPSDVKAAENLQSKEYSVISIDQGIPPHLQGFDIGPRTTEEFIRIINQSATVFWNGPVGVYEVPPFDSGSIAIANALGNHPSAVTVVGGGDAAAVVALAGCSTKVSHVSTGGGASLEFLEQGFLPGTEVLSPSKS

SEQ ID NO: 45658 - protein, 382 aa, Cryptococcus neoformans var. neoformans B-3501A
MGLLILMAQRSSSPGIDDGALSGDDLNPLRKAASFIKSGNAKDVIFLLGAGISTSAGIPDFRSPSTGLYHNLQALELPFPEAVFELGFFQRRPEPFWTLAKEIYPGRHFPTPTHYLLQLFNRHNLLKRVFTQNIDTLETLAGLPPHLIVEAHGSFATAHCLKCRREVDREEVLKAGVRKGEVVRCDATLKAMGKGKKCGGLVKPDIVFFGEGLPDRFFKLVPELRKCDLLIVIGTSLQVQPFASLVDYVPSTCPRLLINREAVGPFSNLENTFSSLPPSISKLLNGPSPSRDMFYEGDADLGAWKLAEELGWKDELEEMVKKGREELEREWRKQEGDVAGEGTKEAEKTAEKVAKAVTKNIQEGEGLEEEELEEAIRKVLKL

SEQ ID NO: 45659 - protein, 414 aa, Burkholderia sp. 383
MSEETAQEQAAPGTVVVIGGGQAAGWVLKTLRAEGFAGRLVMIADEPHLPYERPPLSKAVLAGDADIETVRVVRPDEFDALNVEAWQPERAASIDRARRVVTTESGREIEYDRLVIATGGTSRRLPDALVKTQNLHYLRTLDEAAALGEKLRASQRVLVIGGGWIGLEVAATARKLGVDAVVVEGAPRLCGRSVPRIVSDFLLDLHRANGVDVRLGAALASLDAQPDDASKVRATLADGTTIDADFAVAGIGLALNASLASDAGLAIDDGIVVDEFGATSDPAIFACGDVANHHNGWLKRRVRLESWANAQNQAIAAGKAVLGVRAPYAEIPWFWSDQYDVNLQILGDLPADAQLVVRGDLAARRATLFFVGEGHVRGVIAVNNARELKLARKWMNQGRAVDTEALADTTKTLA

SEQ ID NO: 45660 - protein, 466 aa, Burkholderia sp. 383
MSTFDNVVAGRATMEAAASTPGAIIARLERLPANAMQIRARVLIGAATFFDGFDVITIAATLPLLIHKWGLSPTQIGLLIASGAIGQLIGAFLFPALAEKHGRVKAIAWSSAVIGITSIACGFAPTFEIFVLLRILQGLGLGGELPVAATYINEITRAHGRGRFVLLYEIVFPIGLLVSMGLGAWLVPRFGWEIMYFVGGLPLILSLVLTRLVPESPRWLASRGRLPEAGRAVGVFEASVRGELPPVTQAAAFDEMVRQHPKRKMSDLFSAAYRKRTLAVATLWATCGFIQYGLSTWLPTIYKNFYHAPLQLALNLAVIGSVMGVLGSLASALLVDKLGRKPVIVWSFVLCAVSLAFAGIYHASSVYVVSIFCSLSLGLMASGFITAYVYTPEQYPTSIRASGCGLGSAWLKIASFVAPMVVPHAIIGGNLAPAFYLIGIVPLIAAVTVHFVGIETKGKVLEALEA

SEQ ID NO: 45661 - protein, 328 aa, Synechococcus sp. RS9917
MSALTRCLQEEAAAIAAAAERLSGEQVEGALALLERCADRKAKLVITGVGKSGIVARKIAATFSSIGLMALYLNPLDALHGDLGVVAPDDVCLLLSNSGETSELLEVLPHLKRRGTARIALVGRAESSLARGSDVVLEASVDREVCPLNLAPTASTAVAMAIGDALAAVWMERRGISPADFALNHPAGSLGKQLTMTVADLMVPAAQLAPLRPTTPLPEVIGRLTQGAIGSGWVEDPQQAGRLIGLITDGDLRRALRNHGSERWASLTAADLMTADPITVAADLLAVEALQRMEHNRRKPIGVLPVVDTSDRLQGLLRLHDLVQAGLA

SEQ ID NO: 45662 - protein, 396 aa, Glycine max
MSGAALSPPTNSKSLTQTVSGSHKFVIEGYSLAKGMGVGKHIASDVFTVGGFHWAIYFYPDGKNPEDNSAYVSVFIALASEGTDVRALFELTLLDQSGQGKHKVHSHFDRSLETGPYTLKYKGSMWGYKRFFRRSLLETSEFLKNDCLKINCTVGVVVSAIDCPQLHSINIPESDIGSHFGALLDNMEGSDITFDVAGDKFPAHKLVLAARSPEFRSKFFNGLDEEKNEIIVTDLEPKVFKAMLHFIYKDTLTEEVDTVSSTTTSDFPVSEILTAKLLAAADKYDLGRLRLMCESRLCKDICVNSVANILTLADHCHATELKAVCLKFAAQNLAAVMRSDGFEHMKEKGPWLQSEILKTIAGCEGDGCSAVEKSQSVWGQLSDGGDMNGRRVRQRI

SEQ ID NO: 45663 - protein, 788 aa, Ehrlichia chaffeensis str. Arkansas
MRFTLSWLMQYLDTDVSLDIIVNKLSDIGIEVDNVDYCEHLKTFVVAEVLEVVPHHAANRLKVCQVFDGKETFQVVCGASNVRAGIKSVLARVGSIIPKNQSVIEVVKLRGVESYGMLCSKDELGIVDHSNSNDGIIELSSAYNVGNTFFSCDPIIEVSITPNRGDCLGVYGIARDLAAAGMGKLKCIDNNIVNDSTASNSSPVDICMQAEGIVKGRYIKGIKNCESPKWLKDNLLVCGINSVSFVVDITNYIMLSFNRPLHVYDASKIKKKLIFKKADSQMEFSALNDKKYILGTENIIAVDSNDNIHSVAGIIGSQLSSCSLETEDIFLESAWFNPMDIVLSSRKIKLSTDASYRFERFVDPKFLQTGLDLATKMILEYCGGEFFDVVSDENYLINDIRLDFLPESVRKVGNVDIATKQIFDFLVKLGFFVDNSNEDVWKVTVPSWRSDIQHSSDIVEEVLRLYGYDKICEEPIPISHVDVVDNSYDRLRSVLLSEGLMEVITWSFTSMTFAKKLGYDSELLLLDNPINDKLNLMRPSVLLNLLQVVSDNQAYGSSEVAIFEIGQIYNIDNVCSGNSYVVGGVRYGNNFPRNLYKLDRSVDIFDVKSDVISILRELNINSDAVEFKKSDKPYLHPVKSADVYFNNILLGYFGELHPDIIHLYEIKRPVVCFEVFLYKIPQINVISKEFVESCYQLVKRDFAFLIDKNISVQCLVDVTKNSNSTLIDNVVVFDLYEGDNIGDNKLSVALSVTFRPVDHTLNDQEIKDASDRIISAVAQELGGVLRSF

SEQ ID NO: 45664 - protein, 113 aa, Glycine max
MQGIKLGFTIMLVVAGIVAVPRISGQVCNGNLGTIQEECEEYYKPGGPTIPPSTECCNALRNVDVPCMCRLANNFQSYFSGGKVVYTLRQCGKDVPPGTTCGGYRAPPASTQV

SEQ ID NO: 45665 - protein, 989 aa, Bordetella parapertussis 12822
MLLTKKTSGAAAGASESHFIQSLRRGMAQALPTMDRRTFLRRSGLGVGAGLAATQLALVKRAEAAEGDGKVAIGNTKIEVRRTVCTHCSVGCAVDAVVENGVWVRQEPVFDSPINLGAHCAKGASVREHGHGEHRLRYPMKLVNGKYQRISWDTAYEEITAKLMQLRKESGPDSVYWIGSSKHNNEQSYLLRKFVSFWGSNNCDHQARICHSTTVAGVANTWGYGAMTNSYNDMQNSKVALYIGSNAAEAHPVSMLHMLHAKETGCKMIVVDPRFTRTAAKADQYVRIRSGTDIPFLFGLLYHIFKNGWEDQAYIDARVYGMDEVKADILAKWSPDKVEEACGVDEATMYSVAKTMHENRPGTLVWCMGQTQHSIGNAMVRASCIVQLALGNVGKSGGGANIFRGHDNVQGATDVGPNPDSLPGYYGLAEGSWKHFANTWGVDYEWIKGRYASPAMMTKPGITVSRWIDGVLENPDLIDQDTNLRAVFYWGHAPNSQTRGLEMKRAMDKLDLLVVVDPYPSATAAMAAMPGKAEDLNPNRAVYLLPAATQFETNGSCTASNRSLQWREKVIDPLWESRTDHMIMYQLAEKLGFGKELSKNYKMQKVKGMDEPVVEDILREINASVWTIGYTGQSPERLKAHMRNMHVFDVKTLRAKGGKDAETGYDLTGDYFGLPWPCWGNPSLKHPGTANLYDTSLHVMDGGGNFRANFGVERNGVNLLAADGSHSKGADLTTGYPEFDHVLLKKLGWWEDLTPEEQKAAEGKNWKTDPSGGIIRVTMKVHGCHPFGNARARAVVWNFPDAIPQHREPIYGTRPDLVAKYPTHNDLKTFWRLPTLYTSLQQKNVAEKLYEKFPIILTSGRLVEYEGGGEETRSNPWLAELQQESFVELNPKAAADRGIRNGDRVWVLTPTGARLNVQALVTERVGPDTAFMPFHFSGHWQGVDMLASYPEGAAPIVRGEAVNTGTTYGYDSVTMMQETKTTICNIEKA

SEQ ID NO: 45666 - protein, 242 aa, Azoarcus sp. BH72
MTTKLIAGNWKLNGSLAKNAALIDELRRAEMHCVVCVPYPYLAQAQALVAGSLIELGAQDVSEYEQGAYTGEVSAAMLVEFGCRYVIVGHSERRALFGDSDQVVGRKAASALAAGLTPIVCVGETLAERELGEVEAVIRRQLQAVADCVGGEALPTLVVAYEPVWAIGTGRSATPEQVAQTHGFIRAWFSARCDASAVRILYGGSVKPENAAVLFSTDDVDGGLIGGASLVGSDFVAICRAA

SEQ ID NO: 45667 - protein, 769 aa, Ustilago maydis 521
MGVITHPNIRDGWFHETNSQWPGQAMSLEVQRILHHEKSLFQDVLVFESTTFGNVLVLDGVIQCTERDEFSYQEMIAHLPIASHPNPERVLVIGGGDGGVLREVVKHDSVKEAVLCDIDEAVPRVSKQYLPHMAEGLTHPKSTVIIGDGFAFLQDPKNKASFDVIITDSSDPVGPAEALFQQPYFALLKEALKPGGHISTQAECVWIHLNLIGELRRSTKELFPVADYAFTTIPTYPSGQIGFVVCSLDANRNVREPLREVPDCRYYNSQVHKAAFTVPEFARKVIEDGAPAPGRVIPTGEGIAKTQRAPKKILLLGSGYVAGPFAQYVTRFPEYSLTVASSKLEHSERLTQGLHNASAAAVDVNDAAALSALVKGHDIVISLIPYIYHAAVIKAACEHKVNVVTTSYVSDAIRALEPEIQKAGITVMNEIGLDPGLDHLYAVKAIDDVHAEGGKIKSFLSYCGGLPAPEAADNPLGYKFSWSSRGVLLALRNTAKFWQDGQELTVSGHELMAAAKSFYINPAFAFVAYPNRDSTPFKQWYNIPEAETVIRGTLRYQGFPEFILALVKLGFLDEESKPFLAYNTKATWAEVTANMVGASSTSETDLIAAVKAKVSFKSAQEEETIIRGLRWLDLFSTTAPVTVRGTAAQEAAQVAGNPLDSLCATLEDKCAYAPGERDMVMLQHKFEIETASGEHKTLTSTLLDYGIPHGVTSMAKLVGVPCAIATRLILEGHPALSKTGILAPYTKDICDPIRLELEKEGIALEERYV

SEQ ID NO: 45668 - protein, 1483 aa, Kluyveromyces lactis NRRL Y-1140
MEGSNNGLSSRPEKLDGDPRSTSDTSSSGSCTSLKEFSGNNHELHQDTDQQVVKDAAEDPAFLKKVETLSRSLSRRTTTLSEWDEVDENFDMYREIQGILKASNDGGIHLRKAGITARNVAVKGVDAQFLEGATYGDMLMLPATIFKGIKKARQTTLRDIISNVNLLVRPGEMLLVLGRPGSGCSTFLKTMAGELSHFKGVSGDISYDGVSQKDMLKYFKSDVIYNGEMDVHFPHLTVQQTLDFAVACKTPSKRINDFTRQQYIEFIRDLYATIFGLKHTYNTKVGDDFVRGVSGGERKRVSIAEALAARGSIYCWDNATRGLDASTALEYTEAIRCMTNLLKSTALITVYQASENIYETFDKVTILYEGKQIYFGRIEEAKKYFENLGFICPARQATAEFLTSLTDSKGLRRVRPGFENKVPRTRDDFVRVWEESKEYHDLIQSIEHYETKEVDGAKTIQFFKESMVEEKDKASRKKSKFTISYWAQIRLCTRRGFQRIYGDKSFTITNTVAAIIQALVTGSLFYNTPSSTQGAFSRGGVLYFAILYFSLMGLANISLANRPILQKHIAYSLYHPSAEALASTISNAFFRMISLTAFLIILYFLSGLTRNAGRFFMVYLFVALASESINALFEFITAACDSISQANAIAGLVMMALSLYSTYMIQTPSMHPWFEWISYILPLRYAFENMLNAEFHARRMDCGGTLVPTGPVYENVSSEYKVCAFIGSQPGESYVLGDNYLKLQYDYSYSHQWRNFGILIAFLVGFLVFKSVITEFKTPIKSSGDALLFKKGTSLNTIPKDEESNVNSTDSITKTTDSSSRSDDPALFADMRSEGIFLWKDICYTIPYKGGERLLLDNVSGYVKPGTLTALMGESGAGKTTLLNTLAQRTDIGVVTGDMLVNGKPIDASFERRTGYVQQQDVHIKEMTVRESLQFSARMRRPLTVPDEEKLDYVEKVIEILDMSAYGEALVGNIGYGLNVEQRKKLSIAVELVAKPNLLLFLDEPTSGLDSQSAWAIVQLLKKLAGAGQSILCTIHQPSATLFEEFDRLLLLRKGGQTVYFGDIGEHSSTLLSYFERNGARRCEEKENPAEYILEAIGAGATASVKEDWHEKWIKSSEFVSVNQEINDLIEKLAHQPNDDSSTELITKYATPYWYQFVYVLRRTMVMFWRDVDYLMAKTMLYISSGLFIGFTFYNVGTSFVGLQNAMFAAFMACIVSAPAMNQIQARALQSRELYEVRESRSNMFHWSCMLFSQYITELPYQLWCSTLFFVSFYFPLKAEYTSLKAGLFYLNYCVIFQLYCVGLGLAVLYMSPDLPSSNVIMGLLLSFMITFCGVVQPVNLMPGFWTFMWKVSPYTYLIQNFVSLMLHDKTVICTDKELSYFNPPPGSTCGSYMTDYFTEGFGYIKNPEATSNCAYCRYKIGDQYLSYISAKYADLWRNFGFLWVYICFNLIAMVSLYYIFHVKRFSPKSLVMGVVGKFKKEK

SEQ ID NO: 45669 - protein, 1560 aa, Kluyveromyces lactis NRRL Y-1140
MSDDSGSSIDDRDGRNSTSPAAELNQYTGLNAAGAHRPYLGFENDPQEQQRIQTLARTLTNSSIASKQNSSVGAQGINNGNHGQDTADADSSTNESLQRTLTRASLHINPDDVKIPFDEDARSADPRLDPYSANFDSKFWVQTMHQMFNSDPDYYKPVSLGVCLKGLRVSGVSVDADYQATVANAPLKVLNAARHFVSKRDESRYFDILRPMDALFEPGRLCTVLGRPGAGCSTLLKTVSARTYGFTVRPESVISYDGISQHDIEKHYRGDVIYSAEMDYHFANLNVGYTLEFAARCRCPSARPQGVSREEYYKHYAAVVMATYGLSHTYSTKVGDDYVRGVSGGERKRVSIAEVTLAGAKVQCWDNATRGLDSATALEFVRALKTNATISRTTPLLAIYQCSQDAYDLFDDVLVLYEGRQIYFGPADSAKQYFLDMGWECPDRQTTADFLTSVTAANERKCRPGYEKKVPKTPDEFYEHWKSSSEYAQLMNRIDAYLNKHNNEDSAKEFFDHHTARQSKHSKSSSPFLLSFMMQVKAVMDRNVQRLKGDPSVYAFNIFGNCSMAFIISSMFYNQKDNTGSFYYRTAALFTALLFNSFGSLLEILSLFEARKIVEKHKTYAFYRPSADALASIITELPSKFIIAICFNLIYYFLVNFRRSPGHFFFYFLIAITSTFTMSHLFRSIGAACTTLEQAMLPASILLLILSIYAGFVIPKGNILGWSKWLYYLNPIARSMEAMVANEFAGRTFECSQFIPAGGEYDELPLALKICSVVGSEPGSAYVSGTAYMEESFSYKDSYRWRNWGIVLCYAVFFLAVYLLLIEYNKGEMQKGEMTVFPRSVLMKLKKKNQNLKNDIESNDSLLKDMTNGNDSQDEKSDSSNEKMAEKIGSDQVVFWKNICYDVQIKTETRRILDNVDGWVKPGTLTALMGSSGAGKTTLLDALADRISTGVITGDVLVNGRPTDASFQRSTGYCQQQDLHGRTQTVREALTFSAYLRQPYNVSKKEKDEYVETIIRLLEMETYADALVGVTGEGLNVEQRKRLTIGVELVAKPKLLLFLDEPTSGLDSQTAWSVCQLMRKLANHGQAILCTIHQPSAILMQEFDRLLLLQKGGQTVYFGELGHGCCKMIEYFESKGSQKFPADCNPAEFMLHVIGAAPGSHVTTDYHKVWLESQEYQAVQKEIDRMSREMVNIPQEDSEDLKKEFATPLWYQFLIMTRRVLEQHWRSPIYIYAKIFTTSFSALFIGFSFFNANNSMQGLQNQMFSLFMLLVMFSPLVHQMLPQYTDQRDLYEVRERPSKTCSWITFVLSQIAAELPWSFLIGTITYFCFYYPVGLYRNAPNTEQVHERGALFWLICIAFINFTMTFGQACIAGVERRENAALLANNCFMICLAFCGVLVTRDKLPGFWKFMYYLSPFTYLISTMLATAVGNSDVRCSAKEYLHFSPAPNMTCQQYMSPYMSVAGGYLLDGNATDSCGFCVMAETNVYLATVNIKYSQIWRNWGIFLCYIGANVFLFVLLYWAFRVPRDHYLLIKIHAIKSKITNSLKSRKLIRSSKNNEA

SEQ ID NO: 45670 - protein, 514 aa, Cenarchaeum symbiosum
MRTVRVLYKLLPSVLALRKDRRQWVKQEGRNVQVERYRKNARRALEAFISLGPVYIKLGQWLSSRADILPQPYMEELSKLQDSVPPAPFEEVRPVIEGDLGPLDRAFDGMEKEAFSGASLGQVYKATLGGQSVVVKVKRPGIERVVEEDLRVLKKILPLAMRFVDPNLQLSARAMLAQFTETIREEMDYTRESANLKKIKENMQRHPGVVIPDVYDDRTTRNVLTMQYLPGTKVTDIEALDRMGIDRRQLVIDVHKIFFSMLLHDAIFHADPHPGNISVTKDGKLILYDYGMVGRLDNETRLQLVRLYLALVEKDPSRTVDAMSALGMITPDFNRTVIEKAIELTVRAMHGRKPEEMEIQGLMEIANKTMSRFPFMLPKHLALYMRMASIIEGIYKTHKVDFKFVKVLKEILAEEDLIKEAYVEEIKHSLGKFAKSAEAAILLAPEIRRFIDDSRSMSMRRGGGTGHILPGSILSAAVFLGSAIMYTSDAALGTAGMAGALLIMAAFAVLGRRR

SEQ ID NO: 45671 - protein, 99 aa, Coxiella burnetii RSA 493
MRVHEEIQQQVTSNPVVLYMKGTPDFPQCGFSGRVVQILRQCKIDFTSFNVLESPELRQGIKEFSSWPTIPQLYIKGEFIGGCDIVGELFETGKLQELL

SEQ ID NO: 45672 - protein, 95 aa, Triticum aestivum
LQQVYVKYSALFRITREAYPYEDTSQLLSRAISSYGASRIMWGSDFPYVVPECGYKGAKEAISHVAGKAAVSSSDLEWILGKTVSQLFQGAWVTP

SEQ ID NO: 45673 - protein, 140 aa, Triticum aestivum
  misc_feature (69)..(69): Xaa can be any naturally occurring amino acid
  misc_feature (82)..(82): Xaa can be any naturally occurring amino acid
  misc_feature (92)..(92): Xaa can be any naturally occurring amino acid
  misc_feature (97)..(97): Xaa can be any naturally occurring amino acid
  misc_feature (118)..(118): Xaa can be any naturally occurring amino acid
  misc_feature (127)..(127): Xaa can be any naturally occurring amino acid
  misc_feature (130)..(130): Xaa can be any naturally occurring amino acid
MAPTVMASSATSVAPFQGLKSTAGLPVSRRSNGASLGSVSNGGRIRCMQVWPIEGIKNSETLSYLPPLXSTEASSKQVDYLXIRSKWVPCLXFSKLXHLPVSTTTPGYYDGRSGTMWXLPISGCTDXTMXNEVEESRRIP

SEQ ID NO: 45674 - protein, 200 aa, Helicobacter hepaticus ATCC 51449
MVKIGICGPVGSGKTALIESLTRKMNEQYSLAVITNDIYTQEDAEFMSKNSVLPSERIIGVETGGCPHTAIREDASMNLEAVEEMQERFPDIEILFIESGGDNLSATFSPELADFTIFVIDVAQGDKIPRKGGPGIMRSDLLIINKIDLAPYVGANLSIMERDAKKMREDKPFLFTNIRAKEGIDAVVEWIKKYALLEDI

SEQ ID NO: 45675 - protein, 621 aa, Oryza sativa (japonica cultivar-group)
MWVTKRLGITVLIVLFPLLIVHHLIVNSPVSGPSRYQVIHSNLLGWLSDSLGNSVAQNPDNTPVEVIPADASASNSSDSGNSSLEGFQWLNTWNHMKQLTNISDGLPHANEAIDNARTAWENLTISVHNSTSKQIKKERQCPYSIHRMNASKPDTGDFTIDIPCGLIVGSSVTIIGTPGSLSGNFRIDLVGTELPGGSGKPIVLHYDVRLTSDELTGGPVIVQNAFTASNGWGYEDRCPCSNCNNATQVDDLERCNSMVGREEKRAINSKQHLNAKKDEHPSTYFPFKQGHLAISTLRIGLEGIHMTVDGKHVTSFPYKAGLEAWFVTEVGVSGDFKLVSAIASGLPTSEDLENSFDLAMLKSSPIPEGKDVDLLIGIFSTANNFKRRMAIRRTWMQYDAVREGAVVVRFFVGLHTNLIVNKELWNEARTYGDIQVLPFVDYYSLITWKTLAICIYGTGAVSAKYLMKTDDDAFVRVDEIHSSVKQLNVSHGLLYGRINSDSGPHRNPESKWYISPEEWPEEKYPPWAHGPGYVVSQDIAKEINSWYETSHLKMFKLEDVAMGIWIAEMKKGGLPVQYKTDERINSDGCNDGCIVAHYQEPRHMLCMWEKLLRTNQATCCN

SEQ ID NO: 45676 - protein, 108 aa, Gracilaria tenuistipitata var. liui
MRLLFAFFIICHIFTNNVQLTFAADLDAGEQIFSANCSACHANGNNAIMPDKTLKSDALSENKMNSIEAITNQVKNGKNAMPAFGGRLADEDIENVANYVLNKSENGW

SEQ ID NO: 45677 - protein, 128 aa, Sulfolobus acidocaldarius
MGFAPDYVKSLNVPKLGICLGHQLIAKVLGGEVRKANKPEYGLTTVNIVDEDTILRGLKPSIKAWESHNDEVVRPPSGFRILASSENAKVQAMVNNDNSIFGVQFHPEVKHTEKGIEVFKNFIKICRK

SEQ ID NO: 45678 - protein, 228 aa, Fusobacterium nucleatum subsp. vincentii ATCC 49256
MKLVLIRHGESAWNLENRFTGWKDVDLSPKGVEEAKAAGKSLKEMGLVFDVAYTSYLKRAIKTLNIVLEEMDELYIPVYKSWRLNERHYGALQGLNKAETAKKYGDEQVHIWRRSFDVAPPSIDKNSEYYPKSDRRYANLADSDIPLGESLKDTIARVLPYWHSDISKSLQEGKNVIVAAHGNSLRALIKYLLNISNEDILNLNLTTGKPLIFEMDKDLKVLKAPESF

SEQ ID NO: 45679 - protein, 417 aa, Azoarcus sp. BH72
MAEIRNYTINFGPQHPSAHGVLRLVLELDGEVVERADPHIGLLHRGTEKLAETRTWVQSVPYMDRLDYVSMMCNEHAYCMAIERLLGVEVPLRAQYIRVMFDEITRILNHLLNIGTHALDIGAMTMVLYTFREREDLMDAYEAVSGARMHAAYYRPGGVYRDLPDRMPQYQPNKFKNANVVKDLNAARQGSLLDFLDDFTQRFPRYCDEYETLLTDNRIWKQRTVGIGVVTPEQALAWGFSGPMIRGSGIAWDLRKKQPYEVYDKVDFDIPVGKNGDCYDRYLCRMEEMRQSNRIIRQCIDWLRKNPGPVITDNHKVAPPSREQMKSNMEELIHHFKLFTEGMHVPKGEAYAAVEHPKGEFGVYAVSDGANKPYRLKLRAPGFAHLAAMDEISRGHMIADVVAIIGTMDVVFGEIDR

SEQ ID NO: 45680 - protein, 422 aa, Mesorhizobium loti MAFF303099
MMPQSRVWHPFTQHALEPAIPEIARTEGAYLYKADGTRILDAISSWWVVTHGHRHPRIIKAIETTASSLVQIIFAGFTHEPAERLAKALVGLAPAGLDWVFYSDSGSTSVEVALKMALGYFRNIDAPRSRIVVMEHSYHGDTIGTMSVGARGAFNAAYEPLLFEVDTIPFPAAGREQETLDRFEAVARDRRTAALIVEPLVLGAGGMLMYPAWVLAELKKIAETSGTLLIADEVMTGWGRTGTMFACEQASISPDILCTSKGLTGGAIPLAATLATDAIFQAHYSEDRKKTFFHSSSYTANPIACAAALANVEIWRDEPVAERVAALSAKQAAGLQRFRDNPYFTDCRATGTIAALDLRTGSAGYLAEIGPKLRAFFLERGLLVRPLGNVLYLLPPYCITGGELDALYDAIEEAAERFGSRP

SEQ ID NO: 45681 - protein, 367 aa, Bordetella parapertussis 12822
MFSRLQEFFMTHQIAVLPGDGIGPEIVEQAERVLKALDLPLELRQAPVGGAAFDQFEHPLPPATLELAQGSHAVLFGAVGDWKYDTLPREFRPEQAILGLRKALGLFANLRPAILYPELASASSLKPEIVSGLDILIIRELTGDIYFGTPRGVRTAADGAFAGEREGYDTMRYAESEVRRIARIGFESARKRNKKLCSVDKANVLETSQFWRDLVIEVSRDYPDVELSHMYVDNAAMQLVRNPRQFDVIVTGNLFGDILSDEAAMLTGSIGMLPSASLNAAGQGLYEPSHGSAPDIAGQGIANPLATILSAAMLLRYSLNLAPQADRVEAAVRKVLADGLRTADIHEAGTTKVSTSQMGDAVLKALG

SEQ ID NO: 45682 - protein, 380 aa, Glycine max
  misc_feature (185)..(185): Xaa can be any naturally occurring amino acid
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGXPTLNVAKPKKGSTVAIFGLGAVGLAAMEGARMAGASRIIGVDLNPAKYEQAKKFGCTDFVNPKDHSKPVQEVLVEMTNGGVDRAVECTGHIDAMIAAFECVHDGWGVAVLVGVPHKEAVFKTYPMNFLNERTLKGTFFGNYKPRTDLPEVVEMYMRKELELEKFITHSVPFSQINTAFDLMLKGEGLRCIMRMDQ

SEQ ID NO: 45683 - protein, 161 aa, Azoarcus sp. BH72
MGAKDYIGSLFLKELVKGMALTGRHFFARKITVQFPEEKTPQSARFRGLHALRRYPNGEERCIACKLCEAICPAMAITIESEQREDGSRRTSRYDIDLTKCIFCGFCEEACPVDAVVETRVFEYHGEQRGDLYYTKQMLLAVGDRHEQQIAADREQEAKFR

SEQ ID NO: 45684 - protein, 214 aa, Oryza sativa (japonica cultivar-group)
MGWATRFLAAVCFFAAGVVFAPDVLLGARSGSGSGGGAAAAAKVAHLLCFATSWGAALWATFIGGIIMFKNLPRHQFGNLQGKLFPAYFMLISACAAVSVAAFAYLHPWKTASTVERYQLGFLLAALGFDLSNLLVFTPMTIEMMKKRHKIERDLSIGEEVGWSKNVQVAKNNPTLAAINKKFGMIHGLSSLANIMSFGSLAMHSWYLASKLEM

SEQ ID NO: 45685 - protein, 303 aa, Pseudomonas aeruginosa PAO1
MKFEGIYTPAITPLSADGSIDTQAFAEVLEFLVESKVHGIVIGGSTGEYYAHTAEERLALAAHASEVIAGRLPLVVGTGAIRTEDSLAYAEAARAIGADAILVGSPPYALPTSREIAEHVLAVDRAAGLPIMLYNYPARMGVEMDEAFFAAVAGCRNIVAIKESSGSTAQLHRLACRHPRIALSCGWDDQALEFFAWGARSWVCAGSNFIPGEHLALYQACVVENDFAKGRRIMAAMMPLMDFLESGHFVQSIKHGCELAGLRAGGVRAPLKALDEAGKAALAEIVARLKGEVARIVEGGRHD

SEQ ID NO: 45686 - protein, 389 aa, Thermoplasma volcanium GSS1
MAEKRLFNGFNTRAVQSGELRDPRFGNVTTPIFETSTFVFPNSEKDAYIDNTRNLPYIYTRWGNPTVQAFEEKYASLEKAEHALSFSSGMGAITSVILALAERGDKILSVSDLYGQTFYFLNKVLPEYGISVEYISTDRLNSGEFKPSDYDIIYLESITNPTLKVPDIKAVSERSTGKKIIVDATFASPYNQNPLDLGADVVIHSATKYISGHSDVVMGVFSTNDKSIFDKVVVRRKTFGSNPDPIQSYLALRGIKTLGLRMEKHNKNGMELAKYLRTEPRISHVYYPDTEIGKKVLRGFGGMISFELRPELDVHVFMRNLKIPMVAASLGGVESLITLPVETSHSSMTKEERERIGITDNLVRFSIGIEDHVDLIDDIKQALDKASES

SEQ ID NO: 45687 - protein, 496 aa, Pseudomonas aeruginosa PAO1
MTELLSREEYAAIAATLDLPQRAFIDGGFRDACGGRTFASTNPATGELLAQVAACDAEDVGHAVASARRAFEDGRWRSRTPAERKAALLRLAELLEEHLLELAVMESLDSGKPIRECQHTDLPETINTLRWHAELIDKIYDSTAPVGSAALAMVVREPIGVVGLVLPWNFPLLMLAWKIGPALAAGCSVVVKPAPETSLTALRVAELASQAGIPAGVFNVVPGGGREAGEPLGRHPDVAMVSFTGSTATGRLFLKYAAESNLKRVVLECGGKNPAVVMNDVEDLDLVAQHVVNGAFWNMGENCSASSRLIVHAEVREALLERIGAQLREWRMGDPLDPRNRLGALVSPAHFEKVRAYLDQARTERLAVRFGGATEAGIFVEPTVVDGVSPHSRLFREEIFGPLLSVTSFDDIDEAIALANDTVYGLAASAYTGSLRHALRLSREIRAGIVTVNCFGEGDASTPFGGYKESGFGGRDKSVWAHDQYTELKTIWIDAS

SEQ ID NO: 45688 - protein, 485 aa, marine gamma proteobacterium HTCC2207
MEFKHFINGQFVASSNGAAFENRAPVNNRLIGMVCEASSEDVDAAVIAAKAALKGPWGKMTQAQRTGLLNKVAARINERFEEFLAAECLDTGKPRSMASHIDIPRGAANFTAFSETLVNHPTECFKLDTPDGAGALNYGHRTPKGVVAVISPWNLPLLLMTFKVGPALACGNTVVVKPSEETPATATLLGEVMNECGVPSGVYNVVHGFGPNSAGEFLTTHPLVNAITFTGETRTGEVIMRAASVGLRNISMECGGKNPALVFADCDLDKAIEGTMRSAFVNCGQVCLGTERVYVERPIYDEFVARLKAGVEQLKLGRPEDQEANFGPLVSLEHRDKVLSYYKLAEDEGATVIIGGGVPDMGPELNAGAWIEPTIWTGLDDNARVIREEIFGPCCHIRPFDSEEEVIELANDTVYGLCASVWTENSARASRVPEALEVGLVWVNSWFLRDLRTAFGGAKQSGIGREGGVHGLEFYSELKNVSIKL

SEQ ID NO: 45689 - protein, 334 aa, Pseudomonas aeruginosa PAO1
MSTPSLPIIDIAALAGSDPAARRSVAVRIDRACREQGFFYVVGHGVEAQLVERLERLARQFFALDETSKLRWRMELGGRAWRGYFPLGGELTSNRPDWKEGLYLGSELDAEHPEVRAGTPLHGANLFPEVPGLRETLLEYLDATTRVGHRLMEGIALGLGLEADYFAARYTGDPLILFRLFNYPSQPVPEGLDVQWGVGEHTDYGLLTLLHQDAIGGLQVRTPQGWLEAPPIPGSFVCNLGDMLERMTGGLYRSTPHRVARNTSGRDRLSFPLFFDPNFHARVQPIEGLPEVPEQDDSARRWDQANVHAFHGEYGDYLLNKVAKVFPQLRRDLL

SEQ ID NO: 45690 - protein, 223 aa, Bradyrhizobium sp. BTAi1
MVTVIVRSVSDEAIQTCFFAPGLLRFARNDEFLAVTAKQGNESAMTFDLDIKNTVRTIPDYPKPGILFRDITTLLADARAFRRAVDELVHPWAGSKIDKVAGIEARGFILGGAVAHQLSAGFVPIRKKGKLPHKTVSMSYALEYGTDEMEMHVDAVQPGERVILVDDLIATGGTAEGAVKLLRQIGATVVAACFIIDLPDLGGAAKLRALDVPVRALIAFEGH

SEQ ID NO: 45691 - protein, 447 aa, Moorella thermoacetica ATCC 39073
MKGTDVLVIGGSAAGLTAAITAKRYFKDKKVTVVRKEEKVLVPCGIPYIFGTVGSPDKNLIPDATLVNNGIELVIDEVIGIDRQSKAVSTVKSGSITYEKLVLATGSSPVVPPVKGADLEGVFVVKKDVAYLEQLKKALDKAKNLVIVGGGFIGVEFADECRKGRELNITIVELLPHCLALAFDDEVCTMVEDKLRSQGINIITGTKVEEFLGNGKVEQVRLSNGETLPADIVIFGIGVAPNIELAQMAGLKVDHRFGIWVDDYMRTSDPSIFAIGDCAKKSSFFGHGPSLIKLASVATHEARVAGANLFGLRRSRVAAVGVFSTIVGDLALGSVGLTERAAREAGIEVVTGTAKAPDRHPGSMPGTRELGVKLIFTKDTGVILGGQVYGGTSVGELTNLLAAAVQHKMRADELETMQVGTHPALTASPVAYQVTNAAEDAVLKLRS

SEQ ID NO: 45692 - protein, 520 aa, Zea mays
  misc_feature (492)..(492): Xaa can be any naturally occurring amino acid
  misc_feature (504)..(504): Xaa can be any naturally occurring amino acid
MMVGHSHVVCRLKHRGPDWSGLYQHEGNFLAQQRLAIVSPLSGDQPLFNEDRTVVVVANGEIYNHKNVRKQFTGAHSFSTGSDCEVIIPLYEKYGENFVDMLDGVFAFVLYDTRDRTYVAARDAIGVNPLYIGWGSDGSVWMSSEMKALNEDCVRFEIFPPGHLYSSAAGGFRRWYTPHWFQEQVPRTPYQPLVLREAFEKAVIKRLMTDVPFGVLLSGGLDSSLVASVTKRHLVKTDAAGKFGTELHSFVVGLEDGIDAIEEVIYHDETYDVTTIRASTPMFLMARKIKSLGVKMELHRETCRKVKALHQYDCLRANKATSAWGLEVRVPFLDKEFVDVAMGMDPEWKMYDKNLGRIEKWVLRKAFDDEEHPYLPEHILYRQKEQFSDGVGYNWIDGLKAFTEQQVTDEMMNSAAQMFPYNTPVNKEAYYYRMIFERLFPQDSARETVPWGPSIACSTPAAIEWVEQWKASNDPSGRFISSHDSAATDRTXTSWRWSTATGTXANGTVNGNDVAVAIAV

SEQ ID NO: 45693 - protein, 177 aa, Oryza sativa (japonica cultivar-group)
MAAPAAPQETNAAAGEMVTLISSDGARFEVPEAAVRLSQTVLDEMKKDDYNAINGIPLPNVAGDVLAKVVEYCTKHASAAAAAINADTAKTSKEEEELMMKSFDDEFILVDNHMLYSLLTAADAMRIQGLMDLACQRLADMIKGKTSEQMRQTLGITNDFTPEEEEEFRREDEEQWL

SEQ ID NO: 45694 - protein, 589 aa, Aspergillus oryzae
MPTISVDKAALFKELGREYTTEEFDELCFEFDRPIVDGVQEPPQLKIEIPANRYDMLCFEGIALMLNIFLGRKSLPNYRLVEPANGELQKIIVKEDTTKIRPLVSGAILRNIKFDQARYESFIALQDKLHQNLARQRTLVSIGTHDLDTIQGPFTYEALPPKDIKFVPLNQTQEMNGEELMAFYEKDKHLGRYLHIIRDSPVYPVIYDSKRTVCSLPPIINGDHSKITLDTKNVFIEITALDKTKVEIVNKMMVAMFSQYTSEPFTIEPVQIVSDHNGETRITPDMSSRTTQAEVSYLNQCCGLNLSAEEIAKILTKMAYTARPSAESADLIDVDIPPTRADVLHQADIMEDVAIAYGFNNLPRSFPSKSGTIAQPLPINKLSDIVRTEAAMAGWSEVLPLILCSHDENFAWLNRKDDGNTAVKLANPKTLEFQVVRTSLLPGLLKTIRENKHHSVPMKIFEVSDVAFKDLSLERKSRNERHFAAAWYGKNSGFEVVHGLLDRVMAMLKSAFITGEEGLEKPGMSDSQYWIEELDEATYFPGHAASVHLRIGGKEHVIGAFGILHPTVLEKYELKYPVSTLELNIEAFL

SEQ ID NO: 45695 - protein, 603 aa, Aspergillus oryzae
MESQGENDELYPIAVLIDELKHDDVLIRLNAIHRVSTIALALGAERTREELIPFLDDSVEDEDEVLTALSEELGNFVEYVGGPEYGHVLLSPLENLAAIEEPLVREKAVESLNKIGEQLSEKQIEEHFIPMVLRLSKADWFTSKVSATGLYCIPYKKSGQALQQSLRQYFGGLVHDDTPMVRRQAANNLAKFVKEMKTPVVIEEMIPLFQYLASDDQDSVRLLTVDILISIAEEIPKEQQPSHGVLLTSLRNLFEDKSWRIAKAVHEEVITRDMVPSFVKLLKDTEAEVRTAIAGQIPGFCSLIDRETLLNEIMTSVEDLVSDPSQHVRAALGTQISGLAPILGKEETIAHLLPMFLQMLKDEFPDVRLHIISKLELVNNVIGIELLSQSLLPAIVQLAEDKQWRVRLAIIEYIPLLASQLGVKFFDEQLSDLCMSWLGDTVFSIREAATQNLRKLTEVFGVDWAKGSIIPKVMAMGQHPNYLYRMTTCFAISTLAPVVSLDIIENSILPILDRLVTDEIPNIRFNVAKSYAVLIDTLRRLPAEGTLANVEGKTATPSPRSQDLIQQRIIPSLEKLQGDDDVDVRYFATTAAGGNDEVMQTSP

SEQ ID NO: 45696 - protein, 887 aa, Arabidopsis thaliana
  misc_feature (21)..(21): Xaa can be any naturally occurring amino acid
MLSSIGCNMFVPSTFCSVSSXEFVSIDCGCSSNYTDPRTGLGWVSDSEIIKQGKPVTLANTNWNSMQYRRRRDFPTDNKKYCYRLSTKERRRYIVRTTFLYGGLGSEEAYPKFQLYLDATKWATVTIQEVSRVYVEELIVRATSSYVDVCVCCAITGSPFMSTLELRPLNLSMYATDYEDNFFLKVAARVNFGAPNMDALRYPDDPYDRIWESDINKRPNYLVGVAPGTTRINTSKTINTLTREYPPMKVMQTAVVGTQGLISYRLNLEDFPANARAYAYFAEIEELGANETRKFKLVQPYFPDYSNAVVNIAENANGSYTLYEPSYMNVTLDFVLTFSFGKTKDSTQGPLLNAIEISKYLPISVKTDRSDVSVLDAIRSMSPDSDWASEGGDPCIPVLCALSRKNLRGEIPPGINYMEALTELHLENNQLSGSLPPYLAHLPNLQELSIENNSFKGKIPSALLKGKVLFKYNNNPELQNEAQRKHFWQILGISIAAVAILLLLVGGSLVLLCALRKTKRADKGDSTETKKKGLVAYSAVRGGHLLDEGVAYFISLPVLEEATDNFSKKVGRGSFGSVYYGRMKDGKEVAVKITADPSSHLNRQFVTEVALLSRIHHRNLVPLIGYCEEADRRILVYEYMHNGSLGDHLHGSSDYKPLDWLTRLQIAQDAAKGLEYLHTGCNPSIIHRDVKSSNILLDINMRAKVSDFGLSRQTEEDLTHVSSVAKGTVGYLDPEYYASQQLTEKSDVYSFGVVLFELLSGKKPVSAEDFGPELNIVHWARSLIRKGDVCGIIDPCIASNVKIESVWRVAEVANQCVEQRGHNRPRMQEVIVAIQDAIRIERGNENGLKSSSSSSSKAQSSRKTLLTSFLELESPDISRNSLAPAAR

SEQ ID NO: 45697 - protein, 370 aa, Triticum aestivum
MMAGGIGVSMESTGGARAPTTVQELAGALAAPVVPARYVVRGQHDHDQQPATAVVAPIPVIDLGRLFKLDDTTASAEEAAKLRLALESWGLFLVTNHGVDAAVMDGMMAASREFFQRPPEEKQRYTNLIGGERFQLEGYGTDQVSSPDQILDWSDRLFLKVEPEDERSLALWPAHPETFRDLLDEFTNKCGEVKDGLLRAMSKLLELHDDYFVDQLGERADTYVRFSYYPECPRPELVFGLKPHSDGSVLTMLMVDDVVGGLQLLRDGVWWDVPVVPHTLLVNVGDQTEIINNGIFKSPVHRVVTNAKKERLSVVLFYSARSEREIEPATQLVDEKRPVLYRKIKVKDYIAGLYEHVSQGTMVIDTVKIF

SEQ ID NO: 45698 - protein, 420 aa, Streptococcus pneumoniae R6
MQTQEKHSQAAVLGLQHLLAMYSGSILVPIMIATALGYSAEQLTYLISTDIFMCGVATFLQLQLNKYFGIGLPVVLGVAFQSVAPLIMIGQSHGSGAMFGALIASGIYVVLVSGIFSKVANLFPSIVTGSVITTIGLTLIPVAIGNMGNNVPEPTGQSLLLAAITVLIILLINIFTKGFIKSISILIGLVVGTAIAATMGLVDFSPVAVAPLVHVPTPLYFGMPTFEISSIVMMCIIATVSMVESTGVYLALSDITKDPIDSTRLRNGYRAEGLAVLLGGIFNTFPYTGFSQNVGLVKLSGIKKRLPIYYAAGFLVLLGLLPKFGALAQIIPSSVLGGAMLVMFGFVSIQGMQILARVDFANNEHNFLIAAVSIAAGVGLNNSNLFVSMPTAFQMFFSNGIVVSSLLAIVLNAVLNHKKK

SEQ ID NO: 45699 - protein, 520 aa, Oryza sativa (japonica cultivar-group)
MPAASSLVVGVAFTAAVAVAVAAAVARRAWRHRGLRLPPGPPGWPVVGNLLQVVFAGKPFIHYIRDLRREYGPIVKLQMGVRTLVVISSAELVHEALVEKGREFATRPAESPIRSIFSSGKFTVNSAVYGPEWRSLRRNMVSGMLSAARLREFRPARLRAMERFVARVRAEAAASRDGASVWVLRNVRFAMFCVLLDMTFGLLDLDEELVVRVDAVMKRVVLAVAARIDDYLPFLRPFLWRQHRQAVALRREQIDTVLPLINRRRAIVRGMRAGSPPDPAVAAPYSYLDSLLDLRVEGRDAVPTDEELVTLCAEMINGGTDTTATAIEWAMARVMDNPSIQARLHGEIMQRVGDARPVDDRDTEGMPYLKAFVKELLRKHPPTYFALSHAAVEPGSKLAGYDVPVDANLDIFLPTISEDPKLWERPTEFDPDRFLAGGETADITGSAGVRMIPFSAGRRICPGVGMGTAHIALMVARMVQAFEWRAHPSQPPLDFEDKVEFTVVMKRPLLAMVTPRKLSF

SEQ ID NO: 45700 - protein, 636 aa, Glycine max
MNSSTTVRKLQVVSPVPADIDIANSVEPVHISQIAKELNLSPNHYDLYGKYKAKVLLSVLDELQGSEDGYYVVVGGITPTPLGEGKSTTTVGLCQALGAFLDKKVVTCLRQPSQGPTFGIKGGAAGGGYSQVIPMDEFNLHLTGDIHAITAANNLLAAAIDTRIFHESTQSDKALFNRLCPPNKEGKRSFSDVMFRRLKKLGISKINPDDLTPDEVNKFARLDIDPNSITWRRVMDINDRFLRKITIGQGPDEKGMVRETGFDISVASEIMAVLALTTSLADMRERLGKMVIGNSRSGDPVTADDLGVGGALTVLMKDAIHPTLMQTLEGTPVLVHAGPFANIAHGNSSIVADKIALKLVGPGGFVVTEAGFGADIGAEKFMNIKCRYSGLTPQCAIIVATIRALKMHGGGPAVVAGKPLDHAYLTENVALVEAGCVNMARHISNTKSYGVNVVVAINKFSTDTEAELNAVQSAALAAGAYDAVICTHHAHGGKGAVDLGIAVQKACKNVTQPLKFLYPVELSIKEKIEAIAKSYGARGVEYSEQAEKQIEMYSKQGFSGLPICMAKTQYSFSDNAAAKGAPSGFVLPIRDVRASIGAGFIYPLVGTMSTMPGLPTRPCFYDIGLDTTTEKVIGLS

SEQ ID NO: 45701 - protein, 3982 aa, Bacillus subtilis
MYTSQFQTLVDVIRERSSISDRGIRFIESDKNETVVSYRQLFEEAQGYLGYLQHLGIKPKQEIVFQIQENKSFVVAFWACILGGMIPVPVSIGEDDDHKLKVWRIWNILNHPFLIASEKVLDKIKKYAAEHDLQDFHHQLNEKSDIIQDQTYDYPASFYEPDADELAFIQFSSGSTGDPKGVMLTHHNLIHNTCAIGTALTVHSKDSFLSWMPLTHDMGLIACHLVPFITGINQNLMPTELFIRRPILWMKKAHEHKASILSSPNFGYNYFLKFLKNEPDWDLSHIKVIANGAEPILPELCDEFLKRCAAFNLKRSAILNVYGLAEASVGARFSKIGKEFVPVYLHRDYLNLGERAVKVSKEDQNCASFVEVGQPIDYCQLRISDETNERVEDGIIGHIHIKGDNVTQGYYNNPESTEKALTSDGWVKTGDLGFISESGNLVVTGREKDIIFVNGKNIYPHDIERVAIEMEEVDLGRVAACGVYDQKTQSGEIVLFVVYKKSPEKFAPLVKEIKKHLYKRGGWSIKEVLPIRKLPKTTSGKVKRYELARQYEAGNFSTESAAINECLESSTETSGQTPIHEIETELLSIFSDVLNGKKVHLADSYFDMGANSLQLSQIAERIEQKFGRELAVSDLFTYPSITDLAAYLSESRAEIKQDAAAKPSHVTPKDIAIIGLSLNVPGASTKSDFWNLLEKGEHSIREYPESRLKDAADYLKSIQSEFNESQFVKGGYLDEIDRFDYSFFGLAPKTAQFMDPNQRLFLQSAWHAIEDAGYAGGSMNGSRVGVYAGYSKVGYDYERLLSANYPEDLHQYIVGNLPSVLASRIAYFLNLKGPAVTVDTACSSSLAAVHMACKSLISGDCEMALAGGIRTSLLPICIGLDMESSDGYTKTFSKDSDGTGTGEGAAAVLLKPLQDAVRDGDHIYGVIKGRAMTQDGTTAGITAPNPAAQTEVIETAWKDAGIAPETLSFIEAHGTGTKLGDPVEFNGLCKAFEKYTAKKQFCAIGSVKSNIGHLFEAAGIVGLIKSVLMLNHKKNPPLAHFNEPNPLIHFHSSPFYVNQEAAAFTSGDEPLRGGISSFGFSGTNAHVVLEEYISQSEYAPEDEHGPHLFVLSAHTEKSLYELAQQYRQYVSDDSQASLKSICYTASTGRAHLDHGIAMIVSGKQELSDKLTRLIQGDRNLPGVYIGYKNMKEMLPAHKEELNQQAAALIKQRLRTQDERITWLHRAAELFVQGAVIDWRALYSGETVQKTPLPLYPFERSRCWAEADQLRLNEGEKKGGAALNINQSKAHIESFLKTVISNASGIRAEELDLNAHFIGLGMDSIMLSQVKKAIADEFGVDIPMDRFFDTMNNLQSVIDYLAETVPSSFASAPPQENVPAQEIQVISEAQSESDRREGHQEHMLEKIIASQNQLIQDTLQAQLNSFNLLRNSGHHSDEKEYAKAQKKSIPSVKQGHPTVNAEKKAAQEAKPYVPFQPQNLNDQGHYTARQKQYLEDFIKKYADKTKGSKQYTDNTRFAHANNRNLSSFRSYWKEIVYPIIAERSDGSKMWDIDGNEYIDITMGFGVNLFGHHPSFITQVIDDSTRSSLPPLGPMSDVAGEVADRIRTCTGVERVAFYNSGTEAVMVALRLARAVTGRKKVVAFSGSYHGTFDGVLGVAGTKGGAASANPLAPGIPQSFMDDLIILHYNNPDSLDVIRSLGDELAAVLVEPVQSRRPDLQPRPFLKELRAITQQSGTALIMDEIITGFRIGLGGAQEWFGIQADLVTYGKIIGGGQPLGVVAGKAEFMNAIDGGTWQYGDDSYPQDEAKRTFVGGTFNTHPLTMRMSLAVLRHLQTEGEHLYEQLNQKTAYLVDELNRCFEQAQVPIRMVRFGSLFRFVSSLDNDLFFYHLNYKGVYVWEGRNCFLSAAHTADDIENIIQAVKDTVEDLRRGGFIPEGPDSPDGGGRKKSGTRELSPEQKQLVMASHYGNEASAALNQSIMLKVKGELQHTPLKQAVRHIVDRHEALRTVIHPDDEVQQVQERMNIDIPVIDFTGLPHEHREPEIQKWLTEDAKRPFHFHEQKPLFRIHVLTSAHNEHLIVLTFHHIIADGWSIAVFVQELESSYAAIVQGIPISPKEADVSFRQYLDWQQAQIDSGHYEEGVRYWRRHFSEPIQQPILPSTASVRYPNRYEGDRCTVRLGRPLSEALRSLSIQMKNSVFVTMLGAFHLFLHRLTKQSGLVIGIPAAGQSHMKQHALIGNCVNMIPVKNTSSSESTLSGYLGNMKESVNLAMRHQAVPMTLVARELPHDQVPDMRIIFNLDRPFRKLHFGKAEAEPVAYPVKCTLYDLFLNITDAHQEYVLDFDFNTNVISPEIMKKWGAGFTKLLQKMVEGDSIPLDAMMMFFDEEQHDLQALYADHQKRVSSIGSNTANFTEAYEAPVNETERQLARIWEELFGLERVGRSDRFLALGGNSLQATLMLSKVQKTFHQKVSIGQFFNHQTVKELARFIQNETKVIHLPMKTAEKKAYYPTSPAQQRVYFLHQLEPDQLAQNMFGHISITGKYDEQALISSLQQVMQRHEAFRTYFDIIDGDIVQKLENEVDFNVHVRTMSRDEFDAYSDRFVKPFRLDQAPLVRAELIKIENEQAELLIDMHHIISDGYSVNILTNELLALYHQKPLPDIEFEYKDFAEWQNQRLNDDAMKRQETYWLEQFQDEIPILDLPTDGSIAAERSSEGQRVTCSLQPDVIRSLQDLAQKAETTLYTVLLAAYNVLLHKYTGQEDIVVGTPASGRNHPDIEKIIGIFIQTIGIRTKPHANRTFTDYLEEVKRQTLDAFENQDYPFDRLVEKLNVQRETTGKSLFNTMFVFQNIEFHEIRHNECTFKVKERNPGVSLYDLMLTIEDAGQQIEMHFDYKPGRFTKDTIEQITRHYTAILNSLVEQPEMTLSSVPMLSETERHQLLTECNGTKTPYPHKETVYRWFEMQAEQSPDHEAVIFGNERYTYRQLNERANRLARTLRTKGVQADQFVAIICPHRIELIVGILAVLKAGGAYVPIDPEYPEDRIQYMLRDSRAEVVLTQRSLLDQLPYDGDVVLLDEENSYHEDHSNLESDSDAHDLAYMIYTSGSTGNPKGVLIEHQGLADYIWWAKEVYVRGEKTNFPLYSSISFDLTVTSIFTPLVTGNTIIVFDGEDKSAVLSEIMRDSRIDMIKLTPAHLHVIKEMNIAGGTAIRKMIVGGENLSTRLAKRVSEQLKGRLDIFNEYGPTEAVVGCMIYHFDAERDKREFVPIGTPAANTDIYVADASRNLVPFGVIGEIYISGPGVARGYWNRPDLTAEKFVENPYVPGAKMYKSGDLAKRLKDGNLAYIGRVDEQVKIRGHRIELGEIEAAMHNAEAVQKAAVTVKEEEDGLKQLCAYYVSDKPIAAAQLTEQLSSTLPDYMVPSYFVHLEHMPLTSNGKINRKALPAPEASLQQTAEYVPPGNETESKLTDLWKEVLGISHAGIKHNFFDLGGNSIRAAALAARIHKELDVNLSLKDIFKFPTIEQLADKALHMDKNRYVPIPAAKEMPYYPVSSAQRRMYLLSHTEGGELTYNMTGAMNVEGTIDPERLNAAFRKLIARHEALRTSFDLYEGEPAQRIHQNVDFTIERIQASEEEAEDRVLDFIKAFDLAKPPLMRAGLIEIAPARHVLVVDMHHIISDGVSVNILMKDLSRIYEGNEPDPLSIQYKDFAVWQQSDIQKRNIKSQEAYWLDQFHGDIPVLDMPADYERPAIRDYEGESFEFLIPEHLKQRLSQMEEDTGATLYMILLAAYTILLSKYSGQEDIIVGTPSAGRTHLDVEPVVGMFVNTLVIRNHPAGRKTFDAYLNEVKENMLNAYKNQDYPLEELIQHLHLPKDSSRNPLFDTMFVLQNLDHAELTFDSLQLKPYPFHHPVAKFDLTLSIQADRDNYHGLFEYSKKLFKKSRIEVLSNDYLHILSAILEQPSILIEHIGLSGSNEEEENALDSIQLNF

SEQ ID NO: 45702 - protein, 444 aa, Oryza sativa (japonica cultivar-group)
MDPCPFVRVLVGNLALRMPVAPPAAGAGAGVHPSTAPCYCKIRLGRMPWQVAAAPLVVADGGEQAPSGALAAAFHLSKADLEWFARKPSLLFSSSSSSRGPATLKVAVYAGRKGTTCGVSSGRLIGKATIPVDLKGAEAKAAVVHSGWICVGKKSGGKGGSAAAELSLTVRAEPDPRFVFEFDGEPECSPQVLQVRGSMKQPMFTCKFGCRSNSDLRRSVVQTERDAAAAAGKERKGWSVTVHDLSGSPVALASMVTPFVASPGTDRVSRSNPGAWLILRPAGDGSWEPWGRLECWRERGGAGASDSLGYRFDLLLPGVDHAVPLAESSIAASKGGKFAIDLTSMQPQSRGGTPGCSPRGSGDFSQWPLASYSYRGFVMSSSVQGEGRCSKPTVEVGVPHVGCAEDAAAFVALAAAVDLSMDACRLFSHKLRKELSHLRSDVLR

SEQ ID NO: 45703 - protein, 504 aa, Magnaporthe grisea 70-15
MEKFPDLDVGITNHNANKLNGHANGIANGGSHSQPVGVRWTPASSTYSGSGRSGGHSRQKSISEAIRTIRSRHGSVSQNAHEIADALKAPLSPRLIFAFVCGYCLLLSWLASISPGLRTAVPALKHGIRYPSRDVIQTTMPLAAFQIFGHLLSSTATSKIPVSLVHTIKGLSPLFTVLAYRIVFNIRYPAATYLSLVPLTLGVMLACSGKHKFGGEILGIVYALVATLIFVTQNIFSKRLFNEAARAEAEGMGHKSRKLDKLNLLCYSSGMAFILTVPIWFWSEGIGIIGDFLRDGSVDLTTAPGTFDHGRLFIEFVFNGTFHFGQNIMAFVLLSMVSPVTYSVASLIKRVFVIVIALVWFRSPTTKIQAVGIALTFVGLYLYDRTKEGNRADKRATYLGDKGAKDSLLPLSTKSNGVNGGLVFESPASAGPDGFDGGINAPRPYVNGYALPVRTEGDNKKSDDQTPGRGGRQRGASTTSWLPPGTRQEDTWRVGDRSSGGPVR

SEQ ID NO: 45704 - protein, 791 aa, Oryza sativa (japonica cultivar-group)
MLFARRPLATAASHLAPFSPPLLLFFASASSSCSSAASPSSASGPRGCSAVRMETGAVEPASTGAIWSTPSVEPRTISVGKEIFCNRSLNMRNITAVGFDMDYTLAQYKPETFEALAYHGTIEKLVKDLGYPEELLTWQFDWKYMVRGLVLDKKRGNILKMDRHKYVKVAYHGFREMSKEEKVSAYGSTLIRDSFDEPDYALIDTLFSLGEAYLFAQLVDFMDNNPGKVPSGTDYPLMYRDVRSAVDLCHRDGTLKRMVAKDPSRYINEDLAIVPMLEMIRKSGRSTFLVTNSLWDYTDVVMNYLCRPYTSDVSSSHNHKWLGYFDVVITGSAKPGFFHDGNRAGLFEVEPDSGKLLNADLHVSNMILLEAPDQGGNVGHLHRLLSVASSSQILYVGDHIYGDILRSKKVLGWRTMLVIPELEQEVKLLSESKSTRKELRHLRMERDSIEDKIHRLEWSLKFENLTEDEKEKLFSEHDILLQKKEHVRRLHQEAQRQHHHKFHKVWGQLMKTGYQNSRFAHQVERFACLYSSQVTNFALYSPNKYYRPSEDYMPHEFDVLGLQPVHFIPGSPGLRGQMGQTLVQLPQTGPTNRLRVLSRPHPNAQLGPSATAMQGHIRTYMGAGKPTRFKEDEEKEKLAKEIAKDWNAVFERSINTLFLTEMINYPFEKGPLSPRFRGEHALRRYPTGEERCIACKLCEAICPAQAITIEAEEREDGSRRTTRYDIDMTKCIYCGFCQEACPVDAIVEGPNFEFATETHEELLYDKEKLLENGDRWETEIAANLESESLYR

SEQ ID NO: 45705 - protein, 384 aa, Staphylococcus aureus subsp. aureus MRSA252
MKLSLNSNSKFLRAPSIRQFSNRMNNLDDCVNLTIGQPDFPMPDVVKKAYIDAINNDKTSYSHNKGLLETREAISQYFKNRYHFSYDPEEIIVTNGASEAIDTTLRSIIEPGDEIIIPGPIYAGYIPLIEVLGGKPIYIDTTATQFKITPDALESHISPKTKAVLLNYPTNPTGVVLKRNEVLNIVNVLKKYPIFIISDEIYAENTFSGKHVSFAEFEDIRDQLILIGGLSKSHSATGIRIGFLLGPQYLIDKLTFMHAYNCICANVPAQIACITALNEGLEAPKYMNEAYVERRNYLVSELTKLGFEITAQPEGAFYIFPNIKHITDDDFEFCVDLLESTHLAIVPGSSFTEFGKGFVRISYAYEMDVLKEGMKRLAKYLNTK

SEQ ID NO: 45706 - protein, 499 aa, Medicago truncatula
MASSAKDDNPRSVKRVAVVGAGVSGLAAAYKLKSHGLDVTVFEAEGRAGGRLRTVSRDGLVWDEGANTMTENEIEVKGLIDALGLHEKQQYPLSQHKRYIVKNGTPVLVPANPAALLKSKLLSAQSKIQVIFEPFMWKRSDSSAVRDENSEESVSRFFERHFGKEVVDYLIDPFVGGTSAAGPESLSIRHSFPELWNLEKRFGSIIAGALQSSVFGKKDKAGETKDVPRKNKHQRGSFSFQGGMQTLTDTLCKELGKDDIKLNAKVLTLAYSHDGSSPSQNWSITCTSNRKAQDVDAVIMTAPLGNVRDIQIKKKGNPFPLNFLPEVTYLPLSVLITTFKKENVKRPLEGFGVLVPSKEQQNGFKTLGTLFSSMMFPDRAPSDMHLYTTFIGGTRNRELAQASTDELTKIVTSDLRKLLGAEGEPAFVNHFFWSKGFPLYGHNYGSVLEAIDKMEKDLPGFFYAGNHRGGLSVGRAIASGCKAADLVISYLNNASDNSV

SEQ ID NO: 45707 - protein, 357 aa, Coxiella burnetii RSA 493
MAMLFPFVYHPSMQTIPIPLQLIGPIKIIGSEVNTEVEVPLATFETPMWPSTNRGASVTRRCGGLHCLVLDDRMTRSVLLEGVDAYSVKTVLDDLNRHGALTEVVSSTSRFCRNVSWHAQIVGNLLFLRLEATTGDASGHNMLTKAADAVIDWMLKKYPGLRYVSISGNMCVDKKVSAINGILGRGKYVIADMLIPRAVCQERLKTTPEAIVNLHVKKNLMGSIVSGGLRTANAHFANLLYAIYLATGQDVANIVEGSQGFTHAELRNGDLYFSVTLPNIIVGTVGNGKHYDFVKKHLQLLGCLDNQNPGQSARRLAIIVAATVWCGELSLLAAQTNPGELMRAHEKFERSSATNVT

SEQ ID NO: 45708 - protein, 529 aa, Burkholderia sp. 383
MNARTLPFGPPGHDGLDETIDIAIIGTGFAGLGMAIRLRQTGVTDFVVLEKAASVGGTWRDNHYPGCACDVQSHVYSFSFAPNPRWTRMFAPQPEIRAYLEDCVQRFGIGAHLRLNHELQRAEYDEAAQRWRLTFANGKRLSARVLVSGMGGLSRAALPSIPGVENFKGRAFHSQQWDHDYSLEGKRVAVIGTGASAIQFVPQIAPRVKELALFQRTPPWIMPKPDRNLTGLEKWLFRTLPFTQKAVRSSIYWMLESRVLGFAIHPSLMKNVQKLALRHIRKQIPDPELRKTVTPNYTLGCKRVLISNDYYPALSRKNVDVITTGIDHIEADAVVTTDGRRHEVDCLIYGTGFQVADPYPRGAIIGRGGLDIVDAWRDGAHAYLGSTLPGYPNFFMIVGPNTGLGHNSMVFMIESQIEYILGALQAMRRERADALEVRPLVEAQFNSDLQGKLKKAIWSTGGCKSWYLDPRTGKNTTLWPGFTWRFRQATAHFSIADYHAYRAPQHDTTARPAAAPAASASTSPSAEAA

SEQ ID NO: 45709 - protein, 394 aa, Arabidopsis thaliana
MAETQGKVITCKAAVVWGPKVPLVIQEICVDPPQKMEVRVKILYSSICHTDLGCWNGTNEAERAFPRILGHEAVGIVESVGEGVKDVKEGDYVIPTFNGECGECKVCKREESNLCERYHVDPMKRVMVNDGGTRFSTTINKDGGSSQSQPIYHFLNTSTFTEYTVLDSACVVKIDPNSPLKQMSLLSCGVSTGVGAAWNIANVKEGKSTAVFGLGSVGLAVAEGARARGASRIIGVDANASKFEKGKLMGVTDFINPKDLTKPVHQMIREITGGGVDYSFECTGNVDVLREAFLSTHVGWGSTVLVGIYPTPRTLPLHPMELFDGRRITGSVFGGFKPKSQLPNFAQQCMKGVVKLEPFITNELPFEKINDAFQLLRDGKSLRCILQISKLLKR

SEQ ID NO: 45710 - protein, 345 aa, Streptococcus pneumoniae R6
MKSAVYTKAGQVGLASIERPQIIEADDVIIRVVRACVCGSDLWRYRNPETKAGHKNSGHEAIGIVEEAGEAITTVKPGDFVIVPFTHGCGECDACLAGFDGSCDNHIGNNLGGDFQAEYIRFHYANWALVKIPGQPSDYTEGMLKSLLTLADVMPTGYHAARVANVQKGDKVVVIGDGAVGQCAVIAAKMRGASQIILMSRHEDCQKMAMESGATAVVAERGQEGITKVREILGGGADAALECVGTEAAIEQALGVLHNGGRMGFVGVPHYNNRALGSTFMQNISVAGGAASATTYDKQFLLKAVLDGDINPGRVFTSSYKLEDIDQAYKDMDERKTIKSMIVIE

SEQ ID NO: 45711 - protein, 1110 aa, Photobacterium profundum SS9
MNFKLSTIAKLMFPLLSTAAIVGCNSSSDSSGDSGNGYFDTTNPPAININLPVTDGPVAKLPAGGAVEEPIKAANGEAVLYFVEKSDSAVAKSTADYLNYSLHIWNNDKCDRADDELLVGWDDESNKPVGADQYGPYWKLPLTAGSTNCINLIVRDNNKQNLLGADGSINFDDITDRTASIVAGSGTSVDRRESAFVSISGIANASAHLVDQNTLLWDGAEGADEVRLYVSLAADIEPKGDAYAYENDYIVLDSGTMSADAIAKFPQLVGKPAFSVDSAINMRPVMKAEMAVIAVDKDGNVLGGTKVQPAGAYDDMFAQYARNAELGAVLAGSEATFQVWAPSAQNIVTVLYDANKKELGRLQMDFDEDSGVWFLKTDKAPSGTFYRYLVLVVHPVTGDVEEYEVTDPYSLSLSMNSEYSQVIDLDDPALKPDGWDSLERPFKQDNPSKFVIYESHVRDFSAQDASTPEAVRGKFEAFTQDDTVPVRHLKSLQENGVTHLQLLPIFDIATINEDPDQVANINEPFSKLCDVNSDVKTSSFKNDCSSGLTIAEILEREQGNDTAANPSVQELNRLVSATDSFNWGYDPLHYTVPEGSYSTNPDGKQRILEMREMVKSIKTDIGMNVVMDVVYNHTNSAGPESETSVLDKIVPWYYNRLNPVTGSVENSTCCSNTAPERTMMGKLIKDSLVVWSRDYKIDSFRFDLMGHHPLAQIQESLAAVKNVDPNTYFYGEGWNFGEVENDRLFVQATQPNLGGTGIGSFSDRLRDAVRGGGPFDGGDGLRENQGFGNGAFVQPNDITTTDKETALHLADLTRLGMAGNLESFVMIDSTGSKVRGDQVDYNGQPAGYAVDPSEVQNYVSKHDNQTLWDNNQYKIPYDVTSATRVRMQTVSLSTAMLGQGVPFLHMGSELLRSKSMQRDSYDSGDWFNKVDFTLQDNNWNKGLPRKDKDGDNYAIITEVIDGSGTNAQPSPKDMADMVSFYQELANLRQSYPLITLGTGEEVNARVDFHNTGTTQEAGLIVMSIDNGTGSGADLDSTLDAMVVVINATPTVKTFDIKQTGFTVSEKHTTALATGALVADETKLTVPAWTPVVFVQKRSGERGVGLPVSTK

SEQ ID NO: 45712 - protein, 193 aa, Oryza sativa (japonica cultivar-group)
DPRVRLHVGDAVEFLRNAPEGTYDAIIVDSSDPIGPAQELVEKPFFDTIARALRPGGVLCNQAESMWLHTHLIQDMLSICRETFKGSVHYAWTSVPTYPSGVIGFLLCAKEGPPVNFLTPANPIEKLEGAMEAGRDIRFYNSEMHRAAFVLPTFARRELEAYCTTVEREQQEETTAEPLKMNIMPNSEILTAS

SEQ ID NO: 45713 - protein, 604 aa, Cryptococcus neoformans var. neoformans JEC21
MIALTDEIYFLWVKTLKQLVSITLDRQVTDITPSDPDMLWIRQLWPLGTKAINREKAEALCAQIGLQIKADGMLDITVFHDLIKASQTRPDINQVYRDLTLSGLLDKGRVVSFLTHIQRIPSSSVENVFNRYKSGDLWTIDSLTSFLSSSDNTPNQPQDMTHPLQHYFISSSHNTYLVGEQWKGESTVEGYIRVLLAGCRCVEMDVQSGDVEPVVYHRKTLTSSVPVRDICRAIKQYGFVTSPYPIIISTEIHCASEQQNRLAIILKEVFGDMLVSAPLVEEFSELPSPEDLKGKILFKAKPPKPELNSPKLEANLFYQESPSSTDSDTSFVRLARRLSIQSKTERPDIFSPQLSELLVYTHGVKYQGFSKLNEYLPSHQFSVSERTAAKILKENKVDWIKHNFKHISRVYPRGTRLGSTNFNPVDSWSAGCQIVALNWQTLDESILLNHAMFHDSNGYILKPLSLREKVVEVPEKYLLTVRIISGQRTPLCADLYVEAILNGKISKRTRALSQVTLNPLWDETLTFEITSTPSLLMLNFLHLEVRNKALQAQWMRPVSLAPRGYHHLPLYDSLLSRFVFATLFVKITVEKLQDVVENEKSNLI

SEQ ID NO: 45714 - protein, 204 aa, Zea mays
  misc_feature (109)..(109): Xaa can be any naturally occurring amino acid
GEEPCGFKSGRILRAVIFVHGFQGHHLDLRLVKNQWLLLDPGAECLLSQINEDRTSGDFKEMGRRLANEVVAFLKRKVDKYSRNGGCKEIKLSFVGHSIGNIILRSALXPFLKNLYTYMSISGPHLGYWYSPNSLFNSDLWLMKRLKGMQCMHQLTFSDDHDPQNTFFYKLCKLKTLENFKNIILVSSPQVLQMYAQRSFFCQA

SEQ ID NO: 45715 - protein, 149 aa, Pseudomonas syringae
TETRDLLVSLAGEVGLKDAIKAQYDGELVNSSEGRPVLHTALRRPVGDKLKVNGVDVMPDVHRVLNQMTELVGRIHDGLWRGYTEKPITDVVNIGIGGSFLGPELVSEALVAYAHKGVRCHYLANIDGSEFHELSMKIRAETTLFIVSS

SEQ ID NO: 45716 - protein, 906 aa, Pseudomonas syringae pv. phaseolicola 1448A
MTSLAIQTTRVTASTCCYCGVGCGVLIEHDGQNILGVSGDPKHPANFGKLCSKGSSLHLTGDIEARALYPELRLSKGLARSVTDWDTALEHAANVFADSIREHGSDSVAFYISGQLLTEDYYAFNKLARALVGTNNIDSNSRLCMSSAVAGYKRSLGADAPPCSYEDIELSDCVMIVGSNMAYAHPILFRRLEEAKSRRPQMKLIVIDPRRTDTCELADLHLPIQPGTDVALFHGILHVLISESLIDPEFIAAHTQGYEALSALVRDYPPERVANLCGITQEQLYTCASWVGEAPGFLSLWCMGLNQSTAGSAKNSALINLHLATGQIGRPGAGPFSLTGQPNAMGGRETGSLSNLLPGHRDAANSEHRAQVAHYWGVDSLPAKPGLSAIELFEQLQNGTIKALWIACTNPAQSLPDQNRIRQALETCPFVVLQEAFKTTETARYADLLLPAASWGEKEGTVTNSERRISNVRKAIAPPGEARSDWAITVDFAQRLQKRLQPDAPALFDFHTPKALFDEFKGLTAGRDLDMSGIDRQLIDLHGPQQWPFPRGASVGTPRLYTDGIFPTDSGRAQFLSEPYIAAKELRDADYPLTLNTGRLRDQWHGMSRTGTAARLFGHVSEALLSLNPRDMQRYDLQPGDLVKLISRRGELLLPVGGDDSVACGQAFLPMHWGDRFLKGGVNALTQPAFDPISKQPELKHSGVKIEKAHLPWQFFALIEGNVQQQMERLRPLCDVFTYLSMGLAGRERPALIIRAASAEAPDPMLLQHIDQVLGLDEGPVMAYDDPKRSIGKRVRIDNGRITAIRLAGETLARHWLQALWLEERIDASLRRWLLAPLSSEPGKDSTQAFDKTLCNCMNVSQSAVKECIERGLDLNQLKTQLGCGTQCGSCVPEIKRLINTVAVTQ

SEQ ID NO: 45717 - protein, 142 aa, Malus x domestica
VADFGVARVISQSGVMTAETGTYRWMAPEVIEHKLYDHKADVFSFGVVLWELLTGKLPYEYLTPLQAAVGVVQKGLRPTIPKNTPPKLAELLEKCWQQDPKSRPDFLEIIEILQALAKEVGDGEERHKSSGGFMSILRRGHH

SEQ ID NO: 45718 - protein, 467 aa, Bacillus cereus E33L
MKSLLRKKALSTESPRQLQRTLTALDLTFLGIGAVIGTGIFVLTGIVAAKHSGPGIMLSFLIAAFTCACVAFCYAEFASSIPVSGSVYTYAYMTVGEVVAFIVGWCLMLEYLLAVAAVAVGWSGYLQSLLQGFNIHLPAIIASAPGVGKGGLIDLPAVCILLIITGLLSFGIRESARINNIMVLIKLAVIIAFIVAGAKYVKPENWTPFIPFGYDGIITGAATVFFAFLGFDAIATAAEETKKPQRDLPIGIIGSLLICTVLYMIVSFVLTGMVPYTQLDVSDPVAFALHFVGEDTIAGLLAVGAMTGMTTVLLVVMYGQVRVSYAMSRDGLLPKALARVNKRVKIPLLNTWITGVVAALLAGLLDLHVLANLVNIGTLTAFTFVCCAVLILRKTHPDLKRGFRTPFVPVLPVVAILCCLYLMINLSKTTWISFAVWLIVGLCFYFFYSRKHSHLATEKTNDEQKKA

SEQ ID NO: 45719 - protein, 564 aa, Bordetella parapertussis 12822
MARGYAIGRAVVMGAAALEVAHYRIAPEDVAAESQRLTEALAKAQADLLQMADTLPEDAPRELGAMLNVHRLLLGDPLLAEQALALIAERHYNAEWALTAQGQILGQQFEAMEDEYLRERGGDVRQVIERALHVLAGTSAMLPDGAQLDGDDPLVVVAHDISPADMLRLRGGRFAAFVTDLGGPTSHTAIVARSMGVPAVVALGNVRELVRDGDMLIVDGADGVVVLNPSARILAEYQARQRVYADERAELALLRDEPAVTLDGIDIVLHANIELPEEASLSLACGAHGIGLFRSEFLFMGRPDLPGEEEQYEAYASVVKVMAGRPVTIRTLDIGADKTLDDEATVATNPALGQRAIRYCLARPEMFATQLRAILRASAHGPVRVLIPMIAHMHEVHAAYAALESARRELDARGQPYAARVEVGAMVEIPAIAIAIEPFVQPLDFLSIGTNDLIQYTLAIDRGDHDVAGLYDPLHPAVLRLVANTINAGERAGKPVAVCGEMAGDARLTRLLLGLGLTEFSMHPQQLLDVKREVRRAHSNALRVKVAAALNRALPIDPDTLDAL

SEQ ID NO: 45720 - protein, 613 aa, Methanothermobacter thermautotrophicus str. Delta H
MYFDAYITGCVPEEWKNQPLKILKIIYLPVDSLMQPTPTDSLVAVNYLFDTMITFKHHIYWRITMPVITFDYDDLKELGIDIDREKLLDVLPMMGSDIEDFDDESIKVEFFPNRPDLLSVEGVARSLRGFLGIEKGMPSYDVHDSGVEVTVDESVLDVRPYLGMAVIEDVQFTDKKLKQVMEFQEDLHWVIGRDRRKVAIGIHDLDRVEPPFLYSGVEPEGVTFTPLDSVCEMTPHEILEEHPKGVSYAHLLRDHDRYPLITDKNGDVLSMPPIINGELTKLTVNTRRILVDVTGTDDRAVRQTLNIICTSFAEAGGRIGSVRVKRPDGELHLPDLTPREMRVSVSEASRITGLELSADEVMDLLMKARMDARRTSDDEVVAVIPAYRVDILHEVDLVENIAVQHCIGRIEPELPDIATIAEEDTWSRADASIREVMVGLGFQEVMSLMLTSEESHYRRMRLEEDERVEVAQPISQDRTMIRKSLLNGLLEFFEDNKHEDLPQKIFEVGDVVYINPESETRSRVVTKLACAVTHSSAGFTEIKSLAAAVVENLGYEFRIEPLEHPSFIEGRCAAIESEGKSSAIGGFFGEVHPEVVTNFNLEYPVIALEIEFK

SEQ ID NO: 45721 - protein, 126 aa, Glycine max
MKGQQQLKKSKVVKIDSRKSWEHHITNATNKGYPVMVHFSAYWCMPSIAMNHFFQQLASTYQNVLFLNVDVDEVKEVASKLEIKAIPTFCLMNGGAPVDKIVGANPDELRKRINCFIHQKHSPKSV

SEQ ID NO: 45722 - protein, 411 aa, Moorella thermoacetica ATCC 39073
MKRTDILVAGGGIAGCTAALAARRYYSDKKITLVRREVRALMPWGLAYACGAGSLNEYILGDSRLYKEGIELVIDEVTAIDPGGKRVTTAFGEKIAYDKLILAIGSSPVTSLLQGTELPGVFVLKKELPYLKSLKEHLARARNVVIVGGGLNGVELAAACSANHQLHITLVEQLPHCLSGVFNDDTCILIEEKLRRKGVAIITGAAAEGLEGCHRVEGVRLTGGRTLPADVVVLATGIVPNTLLARQAGLATDENAGILVDEYMQTSATDVFAIGDCAAQKSLVPTGGSLTRQAGPAGHEARVAAANLFGLKRAREITVKKISVAIGDLVFGSVGLIKISLAETGTGMPTTALAHDVIAKDLAVKVVYVRETGATLGAEVYGKPLIRVRETMNNLASAIERQTPFAGLALA

SEQ ID NO: 45723 - protein, 212 aa, Cenarchaeum symbiosum
MSSLEVLSKDERKISIRLRGVPLQYANALRRICLNGVPVFAVDTVDIVENTSVLADEGLAHRLGLIPLRTDSSEFKNLAEIDPDDPINRVMLTLDSGEAAETRTVLSSELVSEDSSVKPISDTIPIVELAPGQRIKVEAYARLGRGTEHAKWNSSNVSVLTATDKEDERILTIESTGAMDPAQLVLEGVTELSRRLADFRTMLDEMKAQSAP

SEQ ID NO: 45724 - protein, 382 aa, Spinacia oleracea
MPSRPSRVVKEQHPTKKSFLDLESLNELPDSFAWGSFEDPCSIDNPSGYGPDSVPVINLQDPQAQQLVGLACRSWGVFQVTNHGIQKSLLDDIEAAGKSLFALPVNQKLKAARSSCGVTGYGPAGISSFFPKRMWSEGFTILGSPLDHARQLWPNNYNKFCDIIEKYQKEMNQLAKKLMQLVVGSLGISNQDIMNWADLLEGANGAMQLNSYPIRPDPNRAMGLAAHTDSTLLTILHQSNTTGLQVFRERSGWVTVPPISGGLVINIGDLLHILSNGRYPSVYHRAMVNRVQHRLSVAYLYGPASGVRVQPLPKLIDATHPPLYRPVTWSEYLGIKSEHLTKALSLIRINHNTNPSLTGLIGNDEPKSINVDSDKTILAVFG

SEQ ID NO: 45725 - protein, 337 aa, Spinacia oleracea
MVVLSHVALDQFMKTCKPIDTHLFPTVIPTIDLNSPDVKSLIVKACKEFGFFKVVNHGVPIEMTRQLEDEASKFFSLPQGLKESAGNPNPFGYGNKKIGRNGDVGWIEYLLLSASDEFISQTCLSIYPDNPDVFRCALNNYISKMKKMGVRVLETMAEGLNLKGEDRYALSNLIKDSKSDSYFRLNHYPPRPEAFEGINGRNLVGFGEHTDPQIISVLRSNKIGGLQISLNDGTWVSVPPDDNSFFILVGDSLQVMTNGRFKSVKHRVLADNMKSRLSMIFFAGPPLCQKIAPLPCIMQKGEESLYEEFTWCEYKKSAYKSRLSENRLLRFVKRNHN

SEQ ID NO: 45726 - protein, 103 aa, Zea mays
YIQPQDFFSEILPRAVRGHCVHACIFTGYWEDAGTINSFFDANLGLIVLPSKVDHYEQKTPLLTVPRYLPDTQFDYCPTIDASIYERLPLTECHIELPAIGGC

SEQ ID NO: 45727 - protein, 329 aa, Spinacia oleracea
MVVASPNPLKRSKKTKAMGVPTIDLSLKYQQRSTLTDLIVEACEDFGIFKVVNHGISTEVISALENHGLDFFSKPTPEKHLVVGPTVPKPFGYGFRNIGNNGDVGDLEYLLLHANLSSTHPPLFGEAVDDYVGAVADLSCELLDLMAEGLWVSDKTIFSKLIRDVQSDSLLRLNHYPPLKNKDSFINGSGERIGFGEHSDPQILTILRSNDVGGLQICMPDGLWVPVQPDPNAFYVMVGDALQVLTNGRFGSVKHRAMANNSTTKARMSMNFFGAPPLNATISPIQEMVSPMNPNLYKPFTWGEYKRAMHSSRLSDCRLNLFKRRINDQ

SEQ ID NO: 45728 - protein, 404 aa, Clostridium difficile 630
MRNCIIAQSGGPTAVINASAVGIYEKNLETKYFDKVYFGINGIEGILNKNIIDSDSLNKDNVLNLKQTPSSGLGSCRYKLADYKINSYDYDRVINILDEYEIDTLFYIGGNDSMDTVMKFSQYCKNTTCKIKFIGIPKTIDNDLLGTDNCPGFGSAAKLISTLIMETYLDFSIYKNNGIFIVETMGRDTGWLAASSSLARLNDTPLVDLIYLPEIDFYEDKFIEDVRKIFKEKNKAYIVASEGIRDKYGNFICEQKTSAHDKFGHSQLGGVSNYLKNLIVSSSITTRVKTLELGVIQRCAMHLASDTDLKQAAEVGAYGIELSKKGYTGVMAIINRTCNNPYKYEVSHTDISKIANKTKYFPKEWINEECNYITDEALNYLYPLIQGKPDIKYKNGLPYFSIIY

SEQ ID NO: 45729 - protein, 758 aa, Ehrlichia chaffeensis str. Arkansas
MVDLENNGFDEKRKEALEFHCKDLKPGKVSLLPTKPLLTQRDLSLAYSPGVAVPCLEIARNPDLVYEYTARGNYVAVISNGTAVLGLGNIGPLASKPVMEGKAVLFKRFADIDAVDIEVNTSDVDEFVNTVKYLGLSWGGINLEDIKAPECFIIEKRLSEIMDIPVFHDDQHGTAIIVAAGLINALDITGKSFKDVKIVINGAGAAGIACLEMIKLIGVPAENITLCDQNGVIYKGRQLGMNEWKEKHAIETENRSLKDALIMADVFLGLSVKDVLSKDMLLSMNRDPVIFALANPDPEINPNVAHEIRPDAIIATGRSDYNNQINNVMGFPYIFRGALDVRAKSVNNEMKIAAANAIAMLAREYVSDEVSDAYGGRKMNYGKDYIIPTPFDPRLITVVSPAVAKAAIDSGVARKNIENWDEYTKQLASRLSLTSNILSMMYSAVKCDPKRVIFSEGEEEKVIEAAVQWRNQEYGLPILVGRIDKVQEAFDRLGIKDTKGIEIANAAISQRNNEYTDYLYKKLQREGYLYRSCVRDVKTDRNVFAACMLACGDGDVLITGMTRGYYASINDVQKVIGSQGVVFGLSIIVMKERTIFVADTAIHESPTPEQIAEIAIQASVQAKKMGYEPRVSFISSSNFGSHSQEDAKKMRQAIKILDSYNVSFEYDGEMSVDTALNPELLTLYPFCKLTGEANVLVMPTLHSASISSKLLQRAAGVSVIGPILIGMEKPVQIVQMSSSVSEILNLTVLASLVNNTNF

SEQ ID NO: 45730 - protein, 467 aa, Myxococcus xanthus DK 1622
MVRSTCASGSSPLQDPFMSQVRLPPGPQGHFIAGNLVEFSEDPLGFLTRCAREYGDVVRLGKRNFLLNHPDLIERVLVNGDGNFVKLAGVGQGKRHKGGFPEAMMNSEGEDWLRKRRLVQPAFHRKHVAACGDTVVALTETMLQTWRPGDARDVHADVSALALDIVSRFLFHTPIDDEARHVADAVDAVMRHTDSPLRPPIWVPTPTNLRLRRALGRLNTLLATLVRRYREQPESRTDLLALLLSAPVPLSENQLRDELATMIMSGHETTADALVWAWYLLAQHPEAEARLVAELETVLGGRLPGAEDLPRLRYTEAVVKEAMRLYSPAWITSREALRDCELGGFHVPAGTMLAVSQWVTHRDARYFDAPESFRPDRWLSEDAQRMHRYVYFPFGGGPRFCIGSALAMMETVLITACVARRFRLELAPGCVVRPRPALALQPLGVWLIPRHRSHTTQEGEVRHAAGA

SEQ ID NO: 45731 - protein, 230 aa, Brassica napus
  misc_feature (188)..(188): Xaa can be any naturally occurring amino acid
  misc_feature (214)..(215): Xaa can be any naturally occurring amino acid
MTFPKMMSFREKTPRSPKSPLRRRRSSWTSSWLNNSTTSFKQVVSAVMQSQSPRSISKPQTPTDFEFSSNTDRTLSLPDSLLLKILHKLPESQNDDVSLVCKRWLNLQGRRIGTLRVLDLDFLLSGKLLSRFPKLTNVDLSNACIYPSRNSAILLSQKSISFRVSSNWDFVEENLLHSETVDRGLRVXGRGSCDLLRLVVINATEMGLLGLAEXXCDLQELELHKVHDNL

SEQ ID NO: 45732 - protein, 231 aa, Helicobacter hepaticus ATCC 51449
MQDVFRQIDWERYELIPTIVQEKQSQQILMLAYSSKQSLELSLQTHLAHYFSRSKQRIWQKGEQSGHIQHIKEVKLDCDNDSLIFIVEQVGVACHTGEKSCFFRIFSLDKNCQNPPVSMPQKYPIGVYHILDDLYHIIEQRRCENIEHSYTASLLAKGVNGIGKKIIEEAGELCFALKDKDEKAIIYECADLFYHILVGLALEHITPERVLQELRRRMGQSGIEEKASRKH

SEQ ID NO: 45733 - protein, 304 aa, Klebsiella pneumoniae
MRFCQALMTELYRHLGADTDVPAGDIGVGGREVGFMAGMMKKLSNNTACVFTGKGLSFGGSLIRPEATGYGLVYFTDAMLKRHGLGFEGMRVAVSGSGNVAQYAIEKAMALGARVITASDSNGTVVDEAGFTTEKLARLCQIKSQQDGRIADYAKEFGLTYLEGQQPWGVSVDIALPCATQNELDAPAARILIANGVKAVAEGANMPTTIEATDLFLEAGVLFAPGKAANAGGVATSGLEMAQNAARMGWKAEKVDLRLHHIMLDIHQACVEYGGEDKQTHYVRGANIAGFVKVADAMLAQGVL

SEQ ID NO: 45734 - protein, 576 aa, Oryza sativa (japonica cultivar-group)
MASSALICDTEQWKGLQIGRAHYDFVFWCGEQAHVGEIQKTHLRHLMHDVERCKAMTACLLIDSEYEGIYLDYSRQRATGETMEKLFKLAEAAKLKEKIEKMFRGDKINSTENRSVLHVALRAPRDEVINSNGVNVVPEVWGVKDKIKQFSETFRSGSWVGATGKALTNVVSVGIGGSFLGPLFVHAALQTDPEAAESAKGRQLRFLANVDPVDVARSIKDLDPETTLVVVVSKTFTTAETMLNARTLKEWIVSSLGPDAVAKHMIAVSTNLELVEKFGIDPKNAFAFWDWVGGRYSVCSAVGVLPLSLQYGFPIVQKFLEGAASIDKHFRSSSFEKNIPAILPYSQALEKFAPHIQQLSMESNGKGVSIDGVQLPFESGEIDFGEPGTNGQHSFYQLIHQGRVIPCDFIGVVKSQQPVYLKGEIVSNHDELMSNFFAQPDALAYGKQFTGYFQTPEQLHSEKVPEHLIPHKTFQGNRPSLSLLLPSLSAYEIGQLLAIYEHRIAVQGFLWGINSFDQWGVELGKSLASQVRKSLHASRVEGKPVLGFNSSTTSLLTRYLAVEPSTPYNTTTLPKV

SEQ ID NO: 45735 - protein, 353 aa, Oryza sativa (indica cultivar-group)
MTEQEHHAYARVGLLGNPSDMYGGKTLSFTISNFWATVHLAPSDDGGPLVIRPHPRHDLVDFASLPQLVTRLQNEGYNGGVRLLMAICKVFYSHCIQHGIALKEQNFTLSYDTNIPRQAGLSGSSAIICAALSCLLDFYNVRHLIKVEIRPNIILDAEKELGIVAGLQDRVAQVYGGLVYMDFGKEHMDTLGHGVYTPLDINLLPPLHLIYADNPSDSGKVHSTVRQRWLDGEEFIISSMEEVARLALDGRKALLDKNYRELARLMNRNFDLRRQMFGDDVIGTVNIKMVEAARSVGAAAKFTGSGGAVVALCPDGEAQVLLLEKACRDAGFLVQRIQVAPSPLPFTEGNPPF

SEQ ID NO: 45736 - protein, 210 aa, Archaeoglobus fulgidus DSM 4304
MKELMRNVYLLDDTLVTKSKYGSHYGEKVFDGYREWVPWRSKLAAMILKGHRLKLRGDERVLYLGAASGTTVSHLADIVDEGIIYAVEYSAKPFEKLLELVRERNNIIPLLFDASKPWKYSGIVEKVDLIYQDIAQKNQIEILKANAEFFLKEKGEVVIMVKARSIDSTAEPEEVFKSVLKEMEGDFKIVKHGSLMPYHRDHIFIHAYRF

SEQ ID NO: 45737 - protein, 560 aa, Glycine max
MEEVPDTAANRSEPGLRAEIDTSAPFESVREAVTRFGGVGYWKPILNGLSNKHFAATEPHHTEELDPEKLEEQATVLEKELILKERETLDVLKELESTKRLVENLKSKLQKEESEANLNFQTSVCENILSVKEDEKEDKENGMSNVVQDSKEGCTPYTSSSPGLILMELKQAKFNLNRTTSDIADVRASVESLNKKLEKERLSLEKTRKRLTQNSSKICSLEEELNQTKLKLLVAKDAGSDNHSDITRELQRLSFEAEHFKNMGEAAKSEVMKEMSEIEQTKAMIKTAEIRLIAAQKMKEAARAAEAAALAEIKALSSHHENSPGDCVEKHDGVTLSFEEYTALTCKVREAKEQSKKRVVDAMHLVDEANVSKMDILRKVEEATEEVKTSKKALEEALERVEAANQGKLAVEEALRKWRSEGHKRRSSILNSTKFKNAYPSHHRKDSRLLDVNGLNLVNDEAKPVLKPALSIGQILSRKLMMPEEYEASEMHRERSSERRKVSLGQMLGKQIADPSFDRQAEKENGQKPFSAKRKKFGFGRFSLLLTKQQKKKKPTLNLR

SEQ ID NO: 45738 - protein, 535 aa, Oryza sativa (indica cultivar-group)
MEFLSQMWSLLGLLTILQNVLPTQLLSLLHSLWQSLQDSLTPYSYFDVPEFLGSAAVEPNALYRHVQLYLHRSLLLSSPPPPRLTLSLPRSVAVSGGGGGHDAGAAAAAATPSVSLSPNHSVADSFDGHRAVWTHHADTLQDSLEERRSFSLRLPKRHAAAVLPAYLAHLAAAADHLERSSRARRLHTNAASPRGAAAWSSVPFCHPSTFDTLALDPELKARLLADLTAFADGSEFYRRTGRPWKRGYLLHGPPGSGKSSLIAAMANHLRYDVFDLELTRVATNADLRALLIQTTNRSLIVIEDIDCSLHLTGDRKSRRNKRRRLLHATAASDDDSSDSDSDGGDNHHSKVTLSGLLNFTDGLWSCCGEERIIVFTTNHVDGIDPALLRPGRMDVHVRLGACGAHAMRELVGRYVGVEDHEMLDAAECCVRGGAEMTPAEVGEVLLRSRDDPDAAVTELAVELKARQSAAADELQWEDSAAELSDESPRKKGLGWEGKVRSPSKFDLMFKSQDCVHLDKLMHGFVNASQKGYKSD

SEQ ID NO: 45739 - protein, 1046 aa, Coxiella burnetii RSA 493
MTDTHLLFFEKAIAQNAIRPSLNKTYRMDETTCVNHLLKTIAFTPRLEAAVSRLAKELVTAVREQESEKGGIEGFMMQYDLSTEEGILLMCLAEALLRVPDKETENLLIRDKLTSAEWNKYVGASESSFVNFATWGLALSGKILKKEKDGQFKNVWRNLVRRSGEPVIRKAVREAMKLMSEHFVLGRTIEEAVKRSQSAIKEGFRHSYDMLGEVARTQEDADRYYDSYHRAISVLGKSHPTKSVHEAPGISVKLSALYPRYDFKKRELAVPFLIERVKELALHAKEQKIGMTIDAEEADRLDISLDIFEALFTDEAFENWQGLGLAVQAYQKRAFYLIDWLIDLAQRQKRRIPVRLVKGAYWDTEIKLAQMEGLSGYPVFTRKVNTDISYIACAQKMLNAQDAIYPQFATHNAYSVAAILNLMDHHYDNYEFEFQQLQGMGKALHHYIVTKLKLPCRVYAPVGYHEDLLPYLVRRLLENGANSSFVNRIADKTVPVDQLIESPVKKIEAFGDIPNPKIPLPKGIFKTRTNSSGIDLSNFAELMPLNEEIHHALEKEWEAAPFLQEIKNGKPVFDPTDNRRQIGVIELANESDVEKAIQAGHSAFPNWDQKGISARATILRKMADLLEKHKAELMAVVVREGGRTLQNALSEVREATDFCRYYAEQAEQHLSDKALPGYTGESNTLRMNGRGIILCISPWNFPIAIFTGQIAAALVTGNAVIAKPSGQTPLTGALVTRLFHEAGVPKEILQLMPGSGKTVGQALIEDTKISGVIFTGSDATARHIQKTLAARPGPIVPFVAETSGINAMIADSTALPEQLVNDVIVSAFDSAGQRCSALRILYIQEDIADDVIKMLKGAMAEIKMGDPLLLSTDVGPVIDANAQKTLQKHQALMQKEAKLIYKVDLPRETDFGTFVAPQAYELPNLGLITEEVFGPILHVIRYKRENLNKVIEEINGLGYGLTFGIQSRIDETVDYIQQRINAGNIYVNRNTVGAVVGVQPFGGSWLSGTGPKAGGPHYLPRFCIESTLTINTTAAGGNASLMAMED

SEQ ID NO: 45740 - protein, 287 aa, Streptomyces peucetius
MTASTPHHGTPRGGLSGRTVLVTGATSGIGRAAALAVARQGARVVLVGRDPERLRTVTNEVARTAGPAPDAFRADFAELRQVRDLGERLRDRYPRIDVMASNAGGMFWSRTTTQDGFEATIQVNHLAGFLLARLLRERLAGGRLILTSSDAYTQGRIDPDDLNGDRHRYSAGQAYGTSKQANIMTAAEAARRWPDVLAVSYHPGEVRTRIGRGTVASSYFRFNPFLRSAAKGADTLVWLASAPAEELTTGGYYSDRRLSPVSGPTADAGLAAKLWEAGAAAVGDTAH

SEQ ID NO: 45741 - protein, 495 aa, Pisum sativum
MALQVLTLPSWVTLFTTFAILLLFSRRLRRRQYNLPPGPKPWPIIGNFNLIGTLPHQSLHGLTQKYGPIMHLWFGSKRVVVGSTVEMAKAFLKTHDATLAGRPKFSAGKYTTYNYSDITWSQYGPYWRQARRMCLLELFSAKRLESYEYIRKQELHVFLHELFDSRNKTILLKDHLSSLSLNVISRMVLGRKYLEKVENSIISPDEFKNMLDELFLLNGILNIGDFIPWIHFLDFQGYVKRMKVLSKKFDGFMEHVLEEHIERRKGVKDYVAKDMVDVLLQLAEDPDLEVKLERHGVKAFTQDLIAGGTESSAVTVEWAISELIRKPEIFKKATEELDRVIGRERWVEEKDIANLPYVYAIAKETMRLHPVAPMLVPREAREDCNINGYDIPKGSLILVNTWTIARDSNVWDNPNEFMPERFLGKDIDVKGHDYELLPFGAGRRMCPGYPLGIKVIQSSLANLLHGFNWRLSDDVKKEDLNMEEIFGLSTPKKIH

SEQ ID NO: 45742 - protein, 290 aa, Burkholderia xenovorans LB400
MFIRQPDVCRIPAAKTSSTFLTHSADTSMKARLDISDITIAGHAQDITLRSFHPFAHSAMPIVLYFHGGGFVKGSLDETSKPATLIAAQTPAWVIAVGYSLAPEFPFPAATEDAHLALEWAVGNARGYRADPNRIAAVGHDAGGNIAAGLAAIARDRGVRRLSAQALLAPLLDPSMTRLMEGQCPGRSDLAPEDCARSYRAYLPSANHRIHPYAAPLESRRLATLPPTLIATAEQDLVRGDGETYARELITAGVPVEMTRHGGVCHGELISHSPALDGVVEFLRKRLARD

SEQ ID NO: 45743 - protein, 496 aa, Brassica napus
MAGTGIFTEILDGEVYKYYSDGEWRTSSSGKSVAIVNPATRKTQYKVQACTQEEVNKVMEMAKSAQKSWAKTPLWKRAELLHKAAAILKDNKAPIAESLVKEIAKPAKDSVTEVVRSGDLISYCAEEGVRILGEGKFLLSDSFPGNERTKYCLTSKIPLGVVLAIPPFNYPVNLAVSKIAPALIAGNSLVLKPPTQGAVSCLHMVHCFHLAGFPKGLISCITGKGSEIGDFLTMHPAVNCISFTGGDTGISISKKAGMIPLQMELGGKDACIVLEDADLDLVASNIIKGGFSYSGQRCTAVKVVLVIESVADERRQKRPAKVAKLTVGPPEENCDITAVVSESSANFIEGLVMDAKEKGATFCQEYKREGNLIWPLLLDNVRPDMRIAWEEPFGPVLPVLRISSVEEGINHCNASNFGLQGCVFTKDINKAMLISDAMETGTVQINSAPARGPDHFPFQGLKDSGIGSQGVTNSINLMTKVKTTVINLPTPSYSMG

SEQ ID NO: 45744 - protein, 159 aa, Oryza sativa (indica cultivar-group)
IKPSNLLIDSGRRVKIADFGVGRILNQTMDPCNSSVGTIAYMSPERINTDLNDGAYDGYAGDIWSFGLSILEFYMGRFPLGENLGKQGDWAALMCAICYSDSPAPPPNASPEFKSFISCCLQKNPARRPSAAQLLQHRFVAGPQQQQQPQPQPLAPPPS

SEQ ID NO: 45745 - protein, 424 aa, Arabidopsis thaliana
MATPMVEDTSSFEEDQLASMSTEDITRATRLLDNEIRILKEDAQRTNLECDSYKEKIKENQEKIKLNKQLPYLVGNIVEILEMNPEDDAEEDGANIDLDSQRKGKCVVLKTSTRQTIFLPVVGLVDPDSLKPGDLVGVNKDSYLILDTLPSEYDSRVKAMEVDEKPTEDYNDIGGLEKQIQELVEAIVLPMTHKERFEKLGVRPPKGVLLYGPPGTGKTLMARACAAQTNATFLKLAGPQLVQMFIGDGAKLVRDAFQLAKEKAPCIIFIDEIDAIGTKRFDSEVSGDREVQRTMLELLNQLDGFSSDERIKVIAATNRADILDPALMRSGRLDRKIEFPHPTEEARARILQIHSRKMNVHPDVNFEELARSTDDFNGAQLKAVCVEAGMLALRRDATEVNHEDFNEGIIQVQAKKKASLNYYA

SEQ ID NO: 45746 - protein, 165 aa, Ricinus communis
MAAADIEYRCFVGGLAWATSDKALEEAFSAYGEVLESKIINDRETGRSRGFGFVTFNNEKSMRDAIEGMNGQNLDGRNITVNEAQSRGGGGGGGGGYRNGGGGGYGGGRREGGYGGGGGYSRGGGGYGGGGGGYGGGRDRGYGGGGDGGSRYSRGGGASEGNWRS

SEQ ID NO: 45747 - protein, 600 aa, Triticum aestivum
  misc_feature (215)..(215): Xaa can be any naturally occurring amino acid
MAAPSRTSWADVADAEPAPPAPVPAAAPATSNGPARADRSSYVPPHLRNRSSNAPPVSSAPPPRAAPGLLGRPTGGVGGRFGGGGAPPRRWDREPNPFGDEEEVPAEPVPFDEHQNTGINFEAYEDIPVETSGREVPPAVGTFAEIDLGAALNDNIRRCKYVRPTPVQRHAIPISLAGRDLMACAQTGSGKTAAFCFPIISGIMRGPPMQRSQLXGSRTACPLALILSPTRELSMQIHEEARKFSYQTGVRVVVAYGGAPITQQLRDLERGVDILVATPGRLVDLLERARVSLQSIRYLALDEADRMLDMGFEPQVRRIVEQMDMPPRGVRQTLLSSATFPGEIQRMASDFLENYIFLAVGRVGSSTELIAQRVEFVQEADKRSHLMDLLHAQRDSSEQGKQALTLVFVETKRGADSLENWLCTNGFPATSIHGDRNQQEREYALRSFKSGQTPILVATDVAARGLDIPHVAHVVNFDLPNDIDDYVHRIGRTGRAGKSGIATAFFNDNNSSMAKSLADLMQESNQEVPAWLTRYAARPSYGGGGGRNRRGAGGGSRFGGRDFRRESSSFGKGGGASDYAGGSSYGGGGYGGAGAPSAWD

SEQ ID NO: 45748 - protein, 173 aa, Ricinus communis
MAANPKVFFDMTVGGAPAGRIVMELFADTTPRTAENFRALCTGEKGVGRSGKPLHYKGSSFHRVIPGFMCQGGDFTAGNGTGGESIYGAKFADENFIKKHTGPGILSMANAGPGTNGSQFFICTAKTEWLDGKHVVFGRVVEGMDIVKAIEKVGSSSGRTSKPVQIADCGQLS

SEQ ID NO: 45749 - protein, 647 aa, Zea mays
MGVATVTELKQSISGKRTFRPSLISRHANEWPPTDVSSDLTVEVGTSSFALHKLFAQFPLVSRSGKIRRLVAEAKDAKLARLSLHGTPGGAPAFELAAKFCYGVHVDVTVANVAMLRCAAHYLQITDDFSDKSLELRAEAFLRDAVLPSIASSVAVLRSCEALLPAAEDVGLVPRLIAAVATNVCKEQLTSGLSKLDQCAQLKPAAAFADLDPPADWWGKSVAALGLDFFQRLLSAVKAKGLKQETVTRILINYAQNALHGLMARDVHRCGGADADAVKKQRAVVEAIVGLLPAQSRKSPVPMAFLSGLLKTSMAVSASSICRADLEKRIGMQMDQAILEDILIAAGAAVGAPAGQQHALYDTDVVARIFSVFLNLDDDHNEEDDGFDYDSPRSPKQSLLVKAAKLLDSYLAEVALDSNILPSKFISLAELLPDHARVVTDGLYRAVDIFLKVHPNIKEAERYRLCKAIDCQRLTPDACSHAAQNERLPVQMAVQVLYFEQLRLRSAIQAGGGSSMGGHDGAVFFGCAAAAASVQGSVNMRSGSGVGSGAMSPRDNYASVRRENRELKLEVARMRMRLTDLEKDHVSMKRELVRVGPANRLLRGLARSLGRLFRMRPAAEPGLQQLGAKATADAKVLFQRRRRHSIS

SEQ ID NO: 45750 - protein, 197 aa, Novosphingobium aromaticivorans DSM 12444
MRTGSITRKTEETDIAVSVNLDGTGTYKVDTGIGFLDHMIEQFSRHSLIDIECRVKGDLHVDQHHTTEDSAIALGQAISQALGDKKGITRYGHTYSPMDEALCRVALDISGRPVLVWKAAFTQPRLGEMDTELFEHWFQSISQAAGITLHIESLYGSNNHHIIEGIYKGFARAMRAAIAIDPRKADAVPSTKGILGG

SEQ ID NO: 45751 - protein, 149 aa, Pseudomonas syringae pv. tomato
AETRDLLVALAGEVGLKDAIKAQYYGELVNSSEGRPALHTALRRPVGDKLKVNGVDVIPDVHRVLNQMTELVGRIHDGLWRGYTEKPITDVVNIGIGGSFLGPELVSEALVAYAHKGVRCHYLANIDGSEFHELSMKIRAETTLFIVSS

SEQ ID NO: 45752 - protein, 543 aa, Xanthomonas campestris pv. campestris str. 8004
MRSGRPSSCRPPMRASPSTAMAMAAATWSPAFPTRWLPPPTIWSRLAGNAPAPGAWKCACRPASTPTRPAAPAANRCRPGRPPACSAPTASRSPRPGCRPRPGGGLLVSAGPTGPAFLVSRNYDAIYAYNAAESYALSIALLADRLRGGAGLVASWPTDDPGLGRPERRQLQQLLLARGHQIGEADGMVGTATRRAIQVEQTRLGLQPADGRAGQRILTALRTAPPVTGAAVRGTAFTLPAAYPAFVQSPIVQKASPMSDVTGLRTGDFHGFPSLLIDTPYSTAAISLFGGQLLSFVPKGGQDVMWLSPTAKQPPTPIRGGAPVCWPYFGRQDQTGDVPAHGFVRTVPWQLTESRREDDGTLVLTLTPPTFDDLALRLHMTLRIGRTLEQRLVTENVSKAPVRFTQALHNYFRVGDALKVSVQGLDGLDYLDKYENYAIAHRQQGDWSLRDPRDPGRSDRIYTNAGGHYTLTDPVLGRRIDIRTEGSRSLVAWNPGEDAASKMADVGTGWRDYVCLEAANAGPDVIELAPGASHTLGQTISVE

SEQ ID NO: 45753 - protein, 143 aa, Glycine max
MASLVAVQPVAVRGLAGSSISGRKLAVRPSSAAVSRSTRRARGAAVVAKYGEKSVYFDLDDIANTTGQWDLYGSDAASPYNGLQSKFFNTFAAPFTKRGLLLKVLLLGGGSLLAYVSATASPDLLPIKKGPQLPPTPGPRGKI

SEQ ID NO: 45754 - protein, 647 aa, Oryza sativa (indica cultivar-group)
MTTPKPSPTIRRLDVASPVPADIDIANAVSPLPIADIAAELGLRPEHFDLYGKYKAKVLLSVLDELKGQQDGYYVVVGGITPTPLGEGKSTTTVGLCQALGAFLDKKIKFVIGVEVVTCLRQPSQGPTFGIKGGAAGGGYSQVIPMDEFNLHLTGDIHAITAANNLLAAAIDTRIFHEASQSDKALFNRLCPPNKEGKRRFADVMLRRLIKLGISKTDPNELTPDEVRRFARLDIDPESITWRRVMDVNDRFLRKITIGQGPDEKGMVRETGFDIAVASEIMAVLALTTSLADMRERLGRMVIGNSKAGEPITADDLGVGGALTVLMKDAIHPTLMQTLEGTPVLVHAGPFANIAHGNSSIVADKIALKLVGKGGYVVTEAGFGSDIGTEKFMDIKCRYSGLMPQCAIIVATIRALKMHGGGPDVVAGKPLDHAYVSENVALVEAGCVNLAKHIANTKSYGVNVVVAINKFASDTEAEMDVVRNASLAAGAFDAVVCTHHAHGGKGAVDLGLAVQRACESQADPLKFLYPLESGIKEKIESIAKFYGASGVEYSEQAEKQIEMYTKQGFSNLPICMAKTQYSFSHVPSMKGAPSGFVLPIRDVRASIGAGFIYPLVGTMSTMPGLPTRPCFYEIDVDTATGKVMGLS

SEQ ID NO: 45755 - protein, 517 aa, Medicago truncatula
MGNRISSKHKPSSDSQTRSKSEPSHSTPTSFHPPNRTPKQSTHTPTPSSSPLGRVLGKPMEDVRSTYTFGRELGRGQFGVTYLVTHKLTKEQFACKSIATRKLIRRDDLDDIRREVQIMHHLTGHRNIVELKGAYEDRHSVNLIMELCAGGELFDRIISKGHYSERAAAELCRQIVTVVHNCHTMGVMHRDLKPENFLFLSKHENSPLKATDFGLSVFFKPEDVFKDLVGSAYYVAPEVLRRSYGPEADIWSAGIILYILLSGVPPFWAENEQGIFDAILRGHLDFASDPWPKISSIAKDLIKKMLRADPKERISAVEVLDHSWMKEDGASDKPLDIAVLTRMKQFRAMNKLKKVALKVIAENLSEEEIIGLKEMFKSMDTDNSGTITFEELKAGLPKLGTKISESEVRQLMEAADVDGNGTIDYIEFITATMHLNRMEREDHLYKAFEYFDNDKSGYITKEELESALTKYNMGDEKTIKEIIDEVDSDNDGRINYEEFVAMMRKGNPDLITNKRRK

SEQ ID NO: 45756 - protein, 376 aa, Zea mays
  misc_feature (287)..(287): Xaa can be any naturally occurring amino acid
MAMSFFSPTTTPSSSASLLPIRRQCATGPSVSFPLKPHRFRVHLKPPRSSRTRIHTLSTSSLKIPTESILSSVVSTSTTLLFVLVAGLLSLSGVRSLPALACAPAPTQQPQETEEQESKEKKQQEEAGERKEDVLPQLDEEDAEDDEVRMYSAILSRNSGDVDALKCALYAKMRRADWGGALRFARLLRDAEPSELEWRLMVAQLHELKGDLAEAERHFRELLAEEPLLVRALHGLALCMQKKPEGPAVFEMLENALQLATSERRVPEERNIKLLIAQMHVVMFWWXQGQLDVASEKLQNLINEDPRDFRSHLCQGIVYALLDRKEDADMQFDVYRSLVPDEFPDKSFISDVILAARTESHDRLQKEFDSEFQAKK

SEQ ID NO: 45757 - protein, 362 aa, Helicobacter pylori J99
MPIDLNEHLKKKNSQRENPTPNTPNNGGRFIPPSNSFNSKKLSVLIVIVLLGVIAFLAKPFEVISSGEIGIKITAGKYEPTPLQPGIHFFVPIIQDILIVDTRIRNINFSRTEDMGVAGKNQGIFRNDAINVMDSRGLTVSIELTVQYRLNPQTTPQTIATYGLSWEQKIINPVVRDVVRSVVGRYPAEDLPIKRNEIAALINSGINKEVSKLPNTPVELSSIQLREIVLPAKIKEQIEKVQIARQESERVKYEVERSKQEAQKQAALAKGEADANRIKAQGVADAIVIEAKAKSQANLSISQSLSDKLLRLRQIEVQGQFNEALKTNNNAQIMLTPGGAVPNIWIDTKSKVKSSIAESKEP

SEQ ID NO: 45758 - protein, 505 aa, Oryza sativa (indica cultivar-group)
MELTTISPVFLISLLGVPLLYLLWSKASKSPSGAPAAPPPPPGPTPFPVIGNIPDLLRGGELHRALTGLAASYGPVMSLRFGMASTVVLSSPDVAHEALHKKDGAISSRWVPDNANVLGHQDVSMAWLPSSSPLWKHMRTLASTLLFTSRRLGASRGIRERKARELVDYLGARSGRPVRVGLAVFGSVLNFMSNVFFSEDVVELGSETGQEFQQLIADSVAETAKPNISDFFPFLSALDLSRRRRAAAKNLKKFYDFFDDVIDRRLSSGEKPGDLLDSLLELHAKSQLERPLIRALMTDLFIAGSHTTTTTVEWALAELLRNPSKMAKARAELGEAFGRGAIEEGELARLPYLNAVIKETLRLHPPAPLLLPHRVSSDSEPAGGVTLGGYSVPSGARVLINAWAIGRDPAAWSPEPDAFSPERFLGREADYWGRTLEFIPFGSGRRACPGIPLAVAVVPMVVAAMVHSLEWRLPEGMAPGDVDVGDRFGAVLELATPLWAVPVKV

SEQ ID NO: 45759 - protein, 326 aa, Coxiella burnetii RSA 493
MDKITLVEAVNQALSYEMAKDDSVIVLGEDVGINGGVFRATVGLVEKFGPQRVLDTPLAESMIAGISVGMAAQGLKPVAEFQFEGFIYSGLDHILSHAARLRNRTRGRLHCPIVYRAPFGGGIHAPEHHSESMEALFAHIPGVRVVIPSSPARAYGLLLASIRNPDPVLFFEPKRIYRLVKQKVPNDGKALPLDQCFLLREGGDITLVTWGAMIKETLEAAEQLKEQGIEAEVIDVATIKPIDMDTILQSVEKTGRCVIIHEAPLTGGVGAEIAAGIAEHGLLSLIAPVKRVAGYDTIMPYFKLEKKYMPSADRIIKTVQSLMEFS

SEQ ID NO: 45760 - protein, 339 aa, Sinorhizobium meliloti 1021
MPNASEHSFPFPILIGDIGGTNARFALLTDAYGEPKQLAPIRTGDFATIEEAMQKGILDKTSVQPRSAILAVAGPIKGDEIPLTNAGWVIRPKDMLAGLGLEDVLVINDFEAQALAIAAPADQDVVQIGGGAVRPFHSRVVLGPGTGLGVAGLVYAQHTWIPVPGEGGHVDIGPRTERDFRIWPFLEPIEGRMAGEQILCGRGIMNLYRAVCAANGEEAVLADQAAVTTSALSGADAAAVETVSLFATYLGRVAGDMALIFMARGGVFLAGGISQKILPALTKPEFRAAFEDKAPHSALMRTIPTFAVIHPMAALSGLAAFARTPRDFGVAMEGRRWRR

SEQ ID NO: 45761 - protein, 517 aa, Lolium rigidum
MDKAYIAILSCAFLFLVHYVLGKVSHGRRGKKGAVQLPPSPPAIPFIGHLHLVEKPIHATMCRLAARLGPVFSLRLGSRRAVVVSSSECARECFTEHDVTFANRPKFPSQLLASFNGTALVTPSYGPHWRNLRRVATVQLLSAHRVACMSGVIAAEVRAMARRLFHAAEASPGGAARVQLKRGPFELSLSVLMETIAQTKATRSEADADTDMSVEAQEFKEVVDKPIPHLGAANMWDYLPVMRWFDVFGVRNKILHAVSRRDAFLRRLIDAERRRLADGGSDGDKKSMIAVLLTLQKTEPKVYTDTMITALCANLFGAGTETTSTTTERAMSLLLNHPAALKKAQAEIDASVGTSRLVSVDDMPSLAYLQCIVNETLRLYPAAPLLLPHESSADCKVGGYNVPADTMLIVNAYAIHRDPAAWEHPLEFRPERFEDGKAEGLFMIPFGMGRRRCPGETLALRTIGMVLATLVQCFDWEPVDGVKVDMTEGGGFTIPKAVPLEAVCRPRAVMRDVLQNL

SEQ ID NO: 45762 - protein, 900 aa, Magnaporthe grisea 70-15
MKTDFKFSNLLGTVYCRGNLLFSPDGTHLYSPVGNRVTVFNLVDNKSYTLPFAHRKNIVRLDLTPRGNLLLSVDEDGHAILTNVVRRISIYHFSFRTAVTALSFSPSGRHFAVGIGRRIEVWQVPQTPDSATGDDGLEFAPFVRHHSHAAHFDEVRHIEWSRDSRFFLSASKDLTARIWSLNQEEGFTPTVLSGHRQGVVGAWFSMDQETIYTVSKDGAVFDWQYVGPQDKEDDDMDGADESDLRWRIVKRHYFMQNNASLKCAAFHAESNLLVAGFSNGIFGLYEMPDFNLIHTLSISQNGIDFVSINKSGEWLAFGASKLGQLLVWEWQSESYILKQQGHFDSMNALAYSPDGKRIVTAADDGKLKVWDIESGFCIVTFTEHTSGVTACQFAKKGNVLFTASLDGSIRAWDLIRYRNFRTFTAPTRLSFSCMAVDPSGEVVAAGSLDSFDVHIWSVQTGQLLDQLSGHEGPVSAVAFAPDGGLLVSGSWDKTARIWSVFNRTQTSEPLQLQADVLSVAVRPDSSQLAVSTLDGQISFWSVTEAQQVSGVDGRRDVSGGRKITDRRTAANAGGTKAFHTIQYSMDGSCLIAGGNSKYMCLYSTTTMVLLKKFTVSVNLSLSGTQEFLNSKQLTEAGPQELLDDHDASDREDRVNRSLPGSKRGGDPSARTTHAEVKVSGVSFAPDGAAFCAASTEGLLIYSLDHTVQFDPFDLNMEITPASTLAVLENEKDYLKALVMAFRLNEAGLIKRVYQAIPHRDIPLVVEQFPPVYVARLLRFVAAQTEESPHIEFCLLWIKALVDKHGKWLAANRAKVDVELRVVARAIARMRDEIRRLADENVYMVDYLLGQAENKPKAIEGTSIDDILKPLPAKGANAALMDANMAQEDESSDEDGWIGLD

SEQ ID NO: 45763 - protein, 168 aa, Triticum aestivum
MATREAGKKMIMLKSPDGMEFEVEEAVAMESQTIRKMIEDDCADTAILIPNINSKILSRVIEYCNKHVPTTGATGAAASDTVAPAALAEDLKIWDAEFIKVNRATRFDLIQAASYLNIKGLLDLTSQTTIDTISDNSLEEIRSFLSTKNDYLPEEEQTIRRENQWAFQ

SEQ ID NO: 45764 - protein, 517 aa, Lolium rigidum
MDKAYIAILSCAFLFLVHYVLGKVSHGRRGKKGAVQLPPSPPAIPFIGHLHLVEKPIHATMCRLAARLGPVFSLRLGSRRAVVVSSSECARECFTEHDVTFANRPSSRRKLLASFNGTALVTSSYGPHWRNLRRVATVQLLSAHRVACMSGVIAAEVRAMARRLFHAAEASPDGATRVQLKRRLFELSLSVLMETIAQTKATRSEADADTDMSVEAQEFKEVVDKLIPHLGAANMWDYLPVMRWFDVFGVRNKILHAVSRRDAFLRRLIDAERRRLADGGSDGDKKSMIAVLLTLQKTEPKVYTDTMITALCANLFGAGTETTSTTTEWAMSLLLNHPAALKKAQAEIDASVGTSRLVSVDDVLSLAYLQCIVSETLRLYPAAPLLLPHESSADCKVGGYNVPADTMLIVNAYAIHRDPAAWEHPLEFRPERFEDGKAEGLFMIPFGMGRRRCPGETLALRTIGMVLATLVQCFDWEPVDGVKVDMTEGGGFTIPKAVPLEAVCRPRTVMRDVLQNL

SEQ ID NO: 45765 - protein, 517 aa, Lolium rigidum
MDKAYIAILSCAFLFLVHYVLGKVSDGRRGKKGAVQLPPSPPAIPFIGHLHLVEKPIHATMCRLAARLGPVFSLRLGSRRAVVVPSSECARECFTEHDVTFANRPKFPSQLLASFNGTALVTSSYGPHWRNLRRVATVQLLSAHRVACMSGVIAAEVRAMARRLFHAAEASPDGAARVQLKRRLFELSLSVLMETIAQTKATRSEADADTDMSVEAQEFKEVVDKLIPHLGAANMWDYLPVMRWFDVFGVRNKILHAVSRRDAFLRRLIDAERRRLADGGSDGDKKSMIAVLLTLQKTEPKVYTDTMITALCANLFGAGTETTSTTTEWAMSLLLNHPAALKKAQAEIDASVGTSRLVSVDDVPSLAYLQCIVNETLRLYPAAPLLLPHESSADCKVGGYNVPADTMLIVNAYAIHRDPAAWEHPLEFRPERFEDGKAEGLFMIPFGVGRRRCPGETLALRTISMVLATLVQCFDWEPVDGVKVDMTEGGGFTIPKAVPLEAVCRPRAVMRDVLQNL

SEQ ID NO: 45766 - protein, 125 aa, Novosphingobium aromaticivorans DSM 12444
MAVDATLPYDDQNIFARILRGEIPNRTVYEDDFALAFHDINPQAPTHVLVIPKGAYVCWDDFSAKASDAEIAGFIRAVGKVARDLGLVAPGYRLLANAGTDSHQEVPHLHVHLFAGRPLGPMLVR

SEQ ID NO: 45767 - protein, 628 aa, Medicago truncatula
MSQMNMTCTARFLSFILLHIFLFTLTNAQSPYYRLNFCQNSTEKTNNTSYRSNVRNLLLWINTDSATGSVSNHIAINSNKTNSNDNDGDVVYGFYDCRGDVTGSFCQFCINAAVRAIAQCCPNGVSAMIWYDICVIGYSDHNTSGKISVTPSWNLTGTKNTKDSTELEKAVDDMRNLIGRVTAEANSNWAVGEFDWSDTEKRYGWVQCNSDLTKDGCRYCLETMLDKVPQCCGTKVKWAVVSPSCGMEIDDNKFYNFQTESPPSLPNPGGLLLRTITPKSFRDHVPREDSFNGDLPTIPLTVIQQSTDNFSESFKLGEGGFGPVYKGTLPDGTEIAAKRLSETSGQGLEEFKNEVIFIAKLQHRNLVKLLGCCFEENEKILVYEYMPNSSLNFHLFNEEKHKHLDWKLRLSIIKGIARGLLYLHEDSPLRVIHRDLKASNVLLDDEMNPKISDFGLARAFEKDQCHTKTKRVIGTYGYMAPEYAMAGLFSVKSDVFSFGVLVLEIIYGKRNGDFFLSEHMQSLLLYTWKLWCEGKSLELIDPFHKKTYVESEVMKCIHIGLLCVQEDAADRPTMSIVVRMLGSDTVDLPKPTQPAYSIGRKSKNEDQSSKNSKDNSVDEETLTIVSPR

SEQ ID NO: 45768 - protein, 432 aa, Marchantia polymorpha
MAASSMISSTLASSISTTLQSGAKAEGRNANSQSMVAFSNQGRSVNMQTKGSFFSSTELLSSGTPSRKQQLSGPIRATATQTPTISKKSGSKEKAKIGINGFGRIGRLVLRIALSRDDVEVVAVNDPFLTADYVRYLFKYDSTHGVYPGEVEVIDENTLSVDGHKIKFFGSKTPADIPWGDSGVDYVVESTGVFTNIAKASAHLQGGAKKVIISAPSEDAPMYVMGVNEEKYSADQNIVSNASCTTNCLAPLAKIVHQEFGIVQGLMTTVHATTATQKTVDGPSGKDWRGGRGAGQNIIPSSTGAAKAVGKVLPELNGKLTGMAFRVPTPNVSVVDLTCRLEKKASYDDIKKVIKAASESSMKGILGYTEDAVVSSDFIGDARSSIFDAHAGIGLGDGFMKFVSWYDNEWGYSNRVVDLIEHIAAVVSAKKN

SEQ ID NO: 45769 - protein, 484 aa, Burkholderia xenovorans LB400
MSRSRRFLRGANLAGYMVAVMPLYGGSMSVDNIKTIIVVMMENRSFDHVLGYLSLDGKDVNGLSADPAWQQNFTNLYDDRTYAIHALSPSTQLIPDPPHDRAPISTQINTPCANGGCPELGGFVASYATRNPPPADLSMVMGYYTADALPVFDFFANNFTICDSWFAPLPTGTQANRLMAMSGESTISDNVSGFLPQQSLVYDWLTAHGTSWCVYQSGGFFPFFSLMPKWLPEIVTSLALPLDGNGGRFRRYSRFKADWTNGSNMPQVIFIEPEYTDGPHLAPNDDHSPTGVARGQAFLADIYRTVSASERWNETLMIVTYDEHGGFFDHVSPLSIPTEVAGYQFQTTGLRVPAFLISPYVTPGGVFSGDLDHTSILQLLADKFNAGGTYSAPVSARTQLSKLSAALSGVKTPGPAPRLNAPSLANSPVPPPAAAPVTPSAGLSACAQAFRSVALKVQQDHPELLSSPNWGDLAGFVATYKGAS

SEQ ID NO: 45770 - protein, 430 aa, Physcomitrella patens
  misc_feature (217)..(217): Xaa can be any naturally occurring amino acid
LEGRPTPRSSAALGSSSLRASSTSRGHVSVSTSGVCAQKKNVSFSAEDSFAGSVKSLRVAASPVSRSISRSFTVRATATEFPVRTTKSGSQEKIRIGINGCGRIGRLVLRVILARDDVEVVAVNDPFIDTKYMAYLLKYDSTHGLLKSEVNAVDDNTLQVGSQTIKVFGCRDPAEIPWGSVGADFVVESTGVFTAVDKASAHFKGGAKKVVISAPSXDAPMFVMGVNQQSYKDSMNVVSNASCTTNCLAPLAKVIQDNFGIEEGLMTTVHATTATQKTVDGPSGKDWRGGRGAGQNIIPSSTGAAKAVGKVLPELNGKLTGMAFRVPTPNVSVVDLTVRLKKSGSYEDIKAAIKAASEGPMYGILGYTEDDVVSNDFVGDARSSIFDAKAGIALSDKFVKLVSWYDNEWGYSNRVVDLDLHMAGVKANLY

SEQ ID NO: 45771 - protein, 248 aa, Bdellovibrio bacteriovorus HD100
MYKLVLIRHGESVWNQENRFTGWQDVDLSEKGRAEALKGGKALREKGFSFDVAYTSVLKRAIKTLNFVLDEVDQVWLPVHKDWRLNERHYGALQGLNKAETAARHGEEQVKIWRRSYDTPPPPMEVSDPRHPSHDPRYKNVDAQLLPSNESLKDTVARFLPLWDGTIAPAVKSGKNVLIVAHGNSLRALMQHLEGMTPDEIMGVNMPTGIPMMYELDANLKVLKKEFIGDPDEVKAAIEAVANQGKAK

SEQ ID NO: 45772 - protein, 1083 aa, Myxococcus xanthus DK 1622
MPKRTDIRKVLVIGSGPIVIGQAVEFDYSGTQAIKALRDEGVEVVLLNSNPATVMTDPEFAHRTYIEPITVEAAERILASERPDSLLPTMGGQTALNLAKALAEQGILEKYGVRLIGASLDAINKAEDRQLFKAAMQKIGVALPKSGYATTLDQAMSLVEDIGFPAIIRPSFTLGGTGGGIAYNREEFETICRSGLKASPTTTILVEESVLGWKEYELEVVRDTADNVIIVCSIENLDPMGVHTGDSITVAPAQTLTDREYQRMRQASLAIIREIGVETGGSNIQFGINPKDGRMVVIEMNPRVSRSSALASKATGYPIAKIAAKLALGYTLDELRNDITRDTPASFEPTLDYVVVKVPRFNFEKFPHADRTLTTSMRSVGEVMAIGRTFPEAYMKALRSMELGRVGLESPELPAEKEEREKVLREALRIPRPERPWFVAQAFREGMTVEDVHALSAIDPWFLRYIQMLVNEAQSLQEYGRLDQLPDEVLRQAKAHGFSDKYLGRLLGYPAEEVRAHRHARNIRPVYKRVDTCAAEFEAYTPYLYSTYEEEDEAPPTDRQKVLILGSGPIRIGQGIEFDYACVHAAFALREAGYETVMVNCNPETVSTDYDTSDRLYFEPLTIEDVLEVSQREKPVGAIVQFGGQTPLRISVPLEKAGLPILGTSPDAIDRAEDRERFAALIEKLGLKQPENGVARSHAEAFKVAERIGYPVMVRPSYVLGGRAMETVYDVASLERYMREAVSASPEHPVLIDRFLKEAIEVDLDLVADRTGAVMIGGVLEHIQEAGVHSGDAAATLPPHSLSPDLVERMKDQAIALARELGVVGLMNVQFAIQGKTIYILEVNPRASRTVPFISKATGVAMAKIAALCMVGKTLKELGVTQEPEFKHVAVKESVFPFARFAGVDVILGPEMKSTGEVMGLANDYASAFAKSQLAAGVKLPKSGKVFISVKDDDKPAVVDLARRLRSMGFSLVVTSGTHTYLATKGIEAQVVQKVTEGRPNIVDKIVDGEIVLVINTTFGKQEIADSFSIRRESLMHSVPYYTTVQAARMAVGALESLKCTELEVKPLQEYLGINAAPPGTRR

SEQ ID NO: 45773 - protein, 419 aa, Bdellovibrio bacteriovorus HD100
MKQEIKVPAVGESITEATIGSWTKKSGDFVKRNEVLMLLETDKASVEVVAENDGVLTINPGCEAGAVVQIGATVATLDTDAKPAAGAAAPAAETAKAAAPASAPAGAAALPAAAGKDASAHLSPAVNRIVNEKGLDPSAIQGTGKDGRLTKGDVLEAQPGAKPAAPKAAPASAPTGAPALPAAASKQGDKKLVPMTTIRKRISEKLKEAQNTAALLTTFNEVDMGKVMELRSKYKDKFKEKYGVNLGFNGFFVKAVVEALKDFPAVNAWINGTDIEYHNYYNIGIAVSTEKGLMVPNVKDADTLSLAGIELAIRDLAAKGRDGKITPNDLGGGTFSITNGGVFGSLLSTPILNFPQSAILGLHKIQDRPMAINGKVEIRPMMYLALTYDHRIIDGKEAVSFLVKIKELVEDPERLLLEV

SEQ ID NO: 45774 - protein, 469 aa, Bdellovibrio bacteriovorus HD100
MADTQFDLIIIGSGPGGYVGAIRAAQLGLKTAVIEKDKTYGGTCLNVGCIPSKALLESSEHYQAAQHDLAAHGVKVSKVDLDLPTMQARKDKVVKTNTEGIAFLFKKNKITPFNGMGKIVAAGKVEVKGADGNTQILTAKNIVIATGSVPVELPFLKYDEKRIVSNTGALALDQVPKSMIVVGGGVIGLELGSVWQRLGAKVTVIEYANRLGGTMDQDCMNVLKKSMEKEGMSFLLSTKVTGSKVGNDGVEVTYESLTDGKASSMKADVVLVSTGRKAFSAGVGCEEMGIQKDPQGRIIVDKHYQTNVPGIYAIGDVIAGPMLAHKAEEEGVALAEILAGGAGHVNYDTVPGVIYTHPEIASVGITEEFAKEKGLEINVGKFPFMANGRARAKGYTEGFVKIIADKKTDKILGAHMVGPSVSELIHEVIVCMEFGGSSEDLARSFHAHPTLSEVVREAALAVEKRQRQM

SEQ ID NO: 45775 - protein, 579 aa, Candida albicans SC5314
MFKKEDQAVSKEVRPEELGSFTGSEEKYSSNEFLNTESKTGFQNFIDSFRRKQATEDESAGQQLAKGISKRHLILMSLVTGIGTGLLVGTGQVLRKSGPLFLVVGYAIAGSFVYPTLQAAGEMAVNYSELSGGYNSYTRMFVEDSINFAISWNYCIQWLSVISIELVTAAITIEYWISETRVNPDAWVAIFYVVIVVIHFIGSKAYGEFEFIIGSIKVCLLVGFIIMGIVVDTGGGPTGEFIGGRYWRDPGPTKNGFKGFCSVFVTAAFSYGQSEFVALSAAEQPNPRKAIPTACRLIFWRIIVLFLGSLTIVGLLVPSNSDHLMSEGGGSNTSPFVLSAALHGVKAVPSIINAVILMSVTSVASSSLYSASRTLQSLAEQGFAPTWFNYIDRAGRPTRALLVSAIIGLFAFIAAYKKQVTVFNWLLAISGLSQVFTWSGICLSHVRFRQALKYNNISTDALGYKASTGVWGSYYALVWYALVLISQFWIALFPIGASKPDANNFFQSYLGAIVLVVFYIGHKLYTRKWRLLIPISEIDINNERTIFDEEILNLERQEEQDKWDRAPWHKKIMIFAFSH

SEQ ID NO: 45776 - protein, 465 aa, Pseudomonas putida GB-1
MTMTSASGAGNQLAQGFKQRHVTMLSIAGVIGAGLFIGSGHAIAAAGPSAIVAYALAGALVVLVMRMLGEMAVASPDTGSFSTYADRAIGRWAGFTIGWLYWWFWVLVIPIEAIAAGVVLNNWFPHIDAWFFALSMTVLLTATNLFSVAKYGEFEFWFAMLKVIAIVAFIALGAAALAGVLPGREVSGLPRLLEQQGGFMPNGWTAIIGALLTTMFSYLGTEAVTIAASESKDPARNIAKATRSVIWRISVFYLLSIFVIISVVPWNDPLLPVQGSYQRALEIMSIPYAKQLVDIVVLVAVASCLNSSIYISSRMLYSLSKRGDAPGFIQRTSKVGVPRAAVIGSTLIGMLATIVNYFAPAEVFAFLLASSGSIALLVYLAIACSQLRMRAILQRQNVEIAFRMWLYPWLTYAVIGFIIFALGTMFVMPKHRMEVSLTLALALVILVLGVVTSKRHARREALATA

SEQ ID NO: 45777 - protein, 535 aa, Saccharophagus degradans 2-40
MTLKVHELLNNARLNKGTAFTLEEREELGLSGLLPPHVSTMKEQVERALSSIRRKESDIDRYIFLSALQKRNERLYYRLLIDHTKELMPLVYTPTVGQACLEFASIFRETSGFYLSYADKGLIQKRLANWPEQDVRLIVVTDGERILGLGDLGANGMGIPIGKLALYCACAGVKPEQCLPIMLDLGTNNESIRNDPLYLGVPEPRKRGSEYDDFLEEFVRAVEKQFPNALLQFEDFATGNAVNLLEKYRDQLLCFNDDIQGTASVVLAGLMATTRISKIPLQEQRFLFLGAGSAATGIGHLLTTALEREGITTDEARARLFFIDRKGLVTQCRDDLPGHVAPFAANMPPMDLKQAIDTIKPNALIGASGTAGVFTEEIIHTVASCHRNPTIFALSNPTSKAECTAEDAYKFSDGRAIFASGSPFDVVHINGEIKVPGQGNNAYIFPGLGLGAIHGKITRITDDQLITAAQELAGSVSDKQIQHGCLYPPLDEIRNVSVKIAAAVARDAERTGLTSEPVPENFEELLTAELYDPLY

SEQ ID NO: 45778 - protein, 282 aa, Ralstonia eutropha JMP134
MTVDTRPAVGNPGYATSSPELERWLARHISEGFGAESLVLSMLRSGYDAAFARSAVATAMGHRRPDASATQPAPRLARREVPVLFSLQSPSIRLYQHLLSDAECDALVELARGRLARSPVINPDTGDENLIDARTSMGAMFQVGEHTLIQRIEDRIAAVLGVPVDHGEGLQILNYKPGGEYQPHFDFFNPKRPGEARQLRVGGQRTATLVIYLNTPQAGGATAFPRIGLEVAPVKGNAVYFSYLQPDGKLDERTLHAGLPVQSGEKWIATKWLREHPYRAGA

SEQ ID NO: 45779 - protein, 126 aa, Brassica napus
EKELLENNCCPVHQMPCVARKEDNYFFALSKYQKPLEEVLSQNPRFVQPAYRLNEVQTWIKSGLRDFSISRALVDWGIPVPNDDKQTIYVWFDALLGYISALTEDNEQQNLDTAVSLGWPASLHLI

SEQ ID NO: 45780 - protein, 297 aa, Pseudomonas putida GB-1
MKFEGIYTPAITPLAADGSIDKAAFAEVLEYLVESKVHGVIIGGSTGEYYAHTTQERIDLAAQAKDVLNGRLPLIVGTGGIRTEDAVAFAQHAKEIKADALLVGTPPYALPTQQEIALHVKAVDAAAGLPIMLYNYPGRMSVSMGEAFFDAVADVKNIVAIKESSGDMAQLHRLAIHRPNIQLSCGWDDQALEFFAWGAQSWVCAGSNFIPREHVALYEACVIEKDFAKGRKIMAAMMPLMDFLEGGKFVQAIKNGVALNGLKTGGVRKPLYDLDDAEKQALKRVVTELKATIAQIK

SEQ ID NO: 45781 - protein, 496 aa, Pseudomonas putida GB-1
MAELLSKEQYAAIAAELQLRTKAFIDGEFRDAISGKTFVTTNPATGKQLAEVAACDVNDVNVAVAAAKRVFEAGTWSKMQPSDRKHVLQKFAQLLEDNAHELAVLEALDSGKPVSECQTVDVPETIHTLRWHAELIDKIYDATAPTGNAAVTMVVREAIGVVGLVLPWNFPLLMLAWKIAPSLAAGCSIVVKPAKETTLSALRVAELAHEAGIPAGVFNLVPGGGREVGEAIGRHMDIPMVSFTGSTDTGRLFLKYAAESNLKRIVLELGGKNPAVVMNDVEDLDEVAQFVTAGAFWNMGENCSASSRLIVHKDVKDELLSLIAKHLKGWKLGDPLDPDNRLGAMVSKSHFEKVKSYLEYAAEQKLSIVQGGETEDGVFVQPTIVDNVGRDNKLFVEEIFGPVLSVTSFETIDEAIELANDTVYGLAASAYTGSLRNALRLSREIRAGVVTVNCFGEGDVTTPFGGYKESGFGGRDKSIWAHDQYTELKTIWINAS

SEQ ID NO: 45782 - protein, 536 aa, Zea mays
MAVAAPAAVSTGAGQGKEYPGGLTLYVLLTCAVAATGGLVCGYDIGISGGVTSMDAFLHKFFPSVYRKEQTARGGGSQYCKFDSQLLTAFTSSLYLAALAASFFVASVAHSLGRKWCMFGGGVSFLAGAALNAAAQDVAMLIVGRILLGIGVGFAGLSIPIYLSEMAPHHLRGTLNIGFQLMITVGIFSANLVNYGVDKIRGGWGWRLSLGLAAVPAAVITVGSLFLPDTPNSLIRRGYHEQARQVLARIRGADVDVADEYGDLVSASEASAAVRRPWLDVLGRRYRPQLTMAVLVPFFQQLTGINVIMFYAPVLFKTIGLGGDASLMSAVITGLVNIVATFVSIATVDRLGRRSLFLQGGCQMLVCQIVIGTLIGVQFGASGDGAAIPKASAATVVAFICIYVAGFAWSWGPLGVLVPSEIFPLEIRPAGQGINVAVNMMCTFAVAQAFLPMLCHLRFGLFYFFGGWVLVMTLFVAAFLPETKGVPVEKMGTVWRTHWFWGRFVADAGMDGRAGNRDSAFHKGKDIAIESRSRPV

SEQ ID NO: 45783 - protein, 379 aa, Bradyrhizobium japonicum
MNTLSNTITVAVVGGEGIGPEVTDQSHRILKWFSDRRGAPVILREAQYGLIPYLATGKVLPDDTVEAMEEADAILWGATGGPETTEVPPAARKAGSLLSLRSKYDLYANLRPIVANPALADSAPLKAAVLKDVDFIIIRELTSGIYFGEPRGIETLPDGQRRGFNTQQYTTSQIRRVARTAFELARTRKGRVCSVDKANVLETSVLWREEVTALHEAEFSDVELTHLYVDNAAMQIVRAPSQFDVMVTCNIFGDILSDCAAMASGSLGMLPSVSLGPPDRLGRRKALYEPVHGSAPDIAGKGIANPLGSILSVAMMLRITLHRPEDAALLEKAVDTALAAGARTADIAEPGAKRLSTQEMGDAVLNALDKVVGKEREHA

SEQ ID NO: 45784 - protein, 470 aa, Geobacillus kaustophilus HTA426
MQPVQELKRELKSRHLFMIALGGVIGTGLFLGSGYTIHEAGPGGAVVAYLFGGLVMYLTMLSLGELAVRIPDAGSYQTYATKFISPAVGYCIGWLSWLNWSVTVGIELLTVSILMKRWFPDVPTWVFCAVFALLLFLINALSVKGFGEVEFWFSSIKVLTVIAFIVLGLAAMFGVIHMKNGQPAPFFSNFTDHGGLFPNGFWAIFTTMILVNFSFQGTELVGVAAGESREPEKTVPVALRNTVWRILIFFILAIFVLAGLFPWEKAGVVESPFVEVFDNIGIPYAADIMNFVIITAVLSVANSGLYATSRVLWSMSRQGMVTPFFSKLSKRGVPINALIASIAIGCLSLLCSVYAEDTVYVWLTAIAGFGAVTVWASIALSSYFGRKAFLREGGDVRDLKYRTPLYPFVPLAAFALNMATIIGLAFIPDQRIALYCGIPFLLACYGYYHLVAKKRVQPLAAEEGELKAAK

SEQ ID NO: 45785 - protein, 366 aa, Oryza sativa (japonica cultivar-group)
MTNHAGFAADDAVTAAVPVQAAQGGRHFPPFLAPSSRLTDCKKAAAHVDLAGAGGVATVPGSWPRHAKPVSGAELDDWMEKHPSALAWFESVAAAAKGKEIVVFLDYDGTLSPIVADPDRAFMSDEMREAVRGVAKHFPTAIVSGRCIDKVFDFVKLEELYYAGSHGMDIRGPTAAASEYNHNMKAKQGDAVTFQPAADFLPVIEEVYHVLKERMASIRGSLVENNKFCLSVHYRCVDEAEWGVLDGKVRAVIEGYPDLRLSKGRKVLEIRPVIDWDKGSALQFLLKSLGYEGRNNVFPIYIGDDRTDEDAFKVLRNMGQGIGILVTKVPKETAASYTLREPSEVKEFLRKLVKIKINGDKGLIGK

SEQ ID NO: 45786 - protein, 515 aa, Geobacillus kaustophilus HTA426
MVQPYRHEPLTDFTVEANREAFLAALKKVESELGRDYPLVIGGERVMTEDKIISINPANKTEVVGRVAKANKELAERAMKTADEAFRTWSRTSPEARADILFRAAAIVRRRKHEFSAWLVKEAGKPWREADADTAEAIDFMEYYGRQMLKLKDGIPVESRPGETNRFFYIPLGVGVVISPWNFPFAIMAGTTVASLVTGNTVLLKPASATPVVAYKFVEVLEEAGLPAGVLNYIPGSGAEVGDYLVDHPRTRFISFTGSRDVGIRIYERAAKVHPGQIWLKRVIAEMGGKDAIVVDKEADLELAAQSIVASAFGFSGQKCSACSRAIIVEDVYDQVLSRVVELTKQLNVGDPAEQATFMGPVIDQNAYNKIMEYIEIGKQEGRLMTGGEGDDAKGFFIQPTVFADVDPNARIMQEEIFGPVVAFAKARDFDHALEIANNTEYGLTGAVISRNRANLEKARHEFHVGNLYFNRGCTGAIVGYQPFGGFNMSGTDSKAGGPDYLILHMQAKTVSEMF

SEQ ID NO: 45787 - protein, 435 aa, Geobacillus kaustophilus HTA426
MGVRTDCECLVPSINRVKEANETMEENMFLSTQRVIKEALAKLGYGEEMYELLKEPLRVLTVRIPVRMDDGTVKVFTGYRAQHSDAVGPTKGGIRFHPDVTEEEVKALSMWMTIKAGIVGLPYGGGKGGIVCDPRNMSMGELERLSRGYVRAISQIVGPSKDIPAPDVFTNSQIMAWMMDEYSRIREFDSPGFITGKPLVLGGSQGREKATALGVTICIEEAAKKAGIELQGARVIIQGFGNAGSFLAKFLHEAGARVIGISDAYGALYDPNGLDIPYLLDRRDSFGTVTTLFENVITNQELLEKECDILVPAAVANQITRDNAANIRAKIVVEAANGPTTLEATKILTERGVLLVPDVLASAGGVTVSYFEWVQNNQGYYWTEEEVVEKLKEKLTSAFHRVYELAESRRVDMRMAAYMIGLRQTAEAARYRGWV

SEQ ID NO: 45788 - protein, 330 aa, Sinorhizobium meliloti 1021
MAKYDVLTIGNAIVDIIARCDDSFLEENGIIKGAMNLINADRAELLYSRMGPAVEASGGSAGNTAAGVASLGGRAAYFGKVADDQLGEIFTHDIRAQGVHFQTKPLDGHPPTARSMIFVTEDGERSMNTYLGACVELGPEDVEDDVVAQSKVTYFEGYLWDPPRAKDAIREAARIAHAHGRETAMTLSDSFCVHRYRSEFLELMRSGTVDIVFANRQEALALYETEDFDRALELLARDCKLAAVTLSEEGSVVVRGAERVRVGASVLEQVVDTTGAGDLYAAGFLFGYTSGRSLEECSKLGNLAAGIVIGQIGPRPLVSLATAARQAALV

SEQ ID NO: 45789 - protein, 90 aa, Brassica napus
ADYSIPSDASKSFAETLQRLGGKAEVILYEGKTHTDLFLQDPMRGGVDEMFEDIVSVVLGGDSEVVGKSVDRRRLVPEFMLKLAHWVSPF

SEQ ID NO: 45790 - protein, 55 aa, Malus x domestica
PDMEVVGISGNFCSDKKAAAVNWIEGRGKSVTCEAVIKEEVVRKVLKTDVDSLVK

SEQ ID NO: 45791 - protein, 691 aa, Oryza sativa
  misc_feature (15)..(15): Xaa can be any naturally occurring amino acid
MMEVADKIVEPKGPXLVATAQLPNNVELLKSVVLNPSREGGSSQEQYEKDLLAEGEESFRSEESSDEGGRSSFSGVSHPPEPIDVDLMSTVYVAIDEEKPEPPECLMRGLSVKGASMEDLSVHAMDAKPDVIVCTVNVNGLVEERKVHCAVVAPDAVEAVSSTQASEEKDCVWDASFPPSGNVSPHSSSDSTGAVAATSIRGSSTSTCRSGVLTSESILTVEKTCESAKDSARGNSMESTKTSMSQASDSSGVSDDSNWSNITGSANKPHKGNDPRWRAILAVRGRGNVLGMSHFRLLKRLGCGDIGSVYLSELSGTRCYFAMKVMDKASLASRKKLNRAQTEREILQLLDHPFLPTLYTHFETDRFSCLVMEFCPGGDLHTLRQRQPRKHFSEYAARFYAAEVLLALEYLHMLGVVYRDLKPENVLVRDDGHIMLSDFDLSLRCAVSPTLIRASASDSDPRRAGGSFCVQPACMEPSSVCIQPACFMPKLFGQRSKKQGRRPRSELGQGGGAALPELVAEPTSARSMSFVGTHEYLAPEIIKGEGHGSAVDWWTFGIFLHELLYGKTPFKGSGNRATLFNVVGQQLRFPESPSTSYAGRDLIRGLLVKEPQQRLGVKRGAAEIKQHPFFEGVNWALIRCSTPPEVPRHVEAELPAKYGVAEPVASGGGGGKRVVGAEVRSGGKYLDFEFF

SEQ ID NO: 45792 - protein, 106 aa, Malus x domestica
TDVPAPDMGTNAQTMAWILDEYSKFHGHSPAVVTGKPIDLGGSLGREAATGRGVVFGTEALLAEYGKSCKGLTFVIQGFGNVGSWAAKLIHEKGGKVIAVSDITGA

SEQ ID NO: 45793 - protein, 198 aa, Cryptococcus neoformans var. neoformans JEC21
MATTRNIKCVVVGDGAVGKTCLLISYTTNAFPGEYVPTVFDNYSSQVIVDGMTVSLGLWDTAGQEDYDRLRPLSYPQTDVFLLCFSVVSPASFENVRTKWYPEIQHHSPGTPIILVGTKLDLRDDPMQIEKLRERRQAPIGYSQGSSMANDIKAAKYLECSALTQKNLKSVFDEAIRTVLNPNRRAGKAKKSSGCLVM

SEQ ID NO: 45794 - protein, 457 aa, Ostreococcus tauri
MDASAAEAPMRSPNAIANTKTVAAVILGGGAGTRLYPLTKSRAKPAVPIGGAYRLIDVPMSNCLNSGISKVYILTQFNSASLNRHLARTYNFGNGIMYGGNGFVEVLAATQTPGQGGKEWFQGTADAVRQYSWLFNDVKNKDVEDIVILAGDHLYRMDYMKFVEAHRESNADISVGTLPIDEARASDFGLMKIDSTGRIVEFTEKPKGDALQAMKVDTTVLGLTADEAKEKPFIASMGIYVFKKSALVKFLEKDYPEDNDFGGEIIPRAAADGAKVQAYLFNDYWEDIGTMKSFFEANLNLAKDPPNFEFYNAEAPIYTSPRFLPPAKVERCHVKESIISHGASLADCQVEESIIGLRSVVNKGCRIKRAMIIGADFYESDEKKASLLASGEVPVGIGEGTIIENAIIDKNARVGKNCVITNAAGVEDLADEERGVFIRNGIITILRNCTIPDGTII

SEQ ID NO: 45795 - protein, 238 aa, Acidobacteria bacterium Ellin345
MRLAPRWLDTHPILCSAWERPARHSPAVNLEMPKPQLVLPPGDFQAYLFDCDGTVADSMPLHFIAWTEALSEWGCLFSEERFYEWGGVPIVEIIERLGREQHITMPIADVARRKEQLYFEHLPRLKAIPEVLEHIESHWGRIPFAVVSGSTRDSVEASLRMIGLIEKFKTLVCAGDYTKSKPDPEPFLMAAQKLGVPPEACLVFEDTQMGIDAARAAGIAWVRVPDPRTRSNSEATKL

SEQ ID NO: 45796 - protein, 604 aa, Magnaporthe grisea 70-15
MSGAEAPLIANIDATGEVEPENASSEGIHEDGANLPRLPDAPPGLFIWLLVLSAGISGLLFGYDTGVISSTLVSIGDSLSGRQLTSLDKSVITSCTSLFALLISPFSSSIADSLGRKRVILVADFLFAVGAILQACSDTVAEMVAGRSIVGAGVGAASFVVPLYIAETAPADHRGKLITINVLFITLGQVIAYVIGWLFAEYGDKSSGWRWMVGLGAVPAVVQAVLLLGMPETPRWLVKSGREEEALEIIRRVSGGKHRSTSDRVAQRVLEEIQVEIREESEARRRLLASRDGMQSSRPEWMERWSELVKVRRNRRALTVACLLQGLQQLCGFNSLMYFSASIFTMVGFATPTLTSLTVAVTNFVFTVLALLLVDRIGRRRILLYSLPFMIAGLLLAAFAFSFISISSAPTSSPIPSAAKTGDAQLSPRAAAVMILISIMIYVASYAIGLGNVPWMQSELFSLSVRSVGSGVATGTNWLANFVVGLTFLPLMDAFGPAATFTMYGAVCGIGLVLIWRIYPETTGLSLEEAASLLEGSAWGVRDNQASFGCKISGANWDRARNHLRATIGTLKGGATGGPERIGKTDTEAPAWDLLGEGIRYYLV

SEQ ID NO: 45797 - protein, 317 aa, Oryza sativa (japonica cultivar-group)
MAAPPPSSPSPPPAAAAAATQQTQPHPQTPFYELVKGNSGIEKVLLRGTRGFSAEAIFKPPKAIRGGIPICFPQFGTHGNLEQHGFARNRLWTIDDNPPPLPVNPAIKSFVDLILRPSDEDLKIWPHSFEFRLRVALGPNGDLSLTSRIRNTNTDGRSFSYTFAYHTYFSVSDISEVRVEGLETMDYLDNLKGKERFTEQGDAIVFESEIDKVYLAAPSKIAIIDHEKKRTFVLTKEGLPDAVVWNPWDKKAKAMQDFGDGEYKHMLCVEPAAVEKPITLKPGEEWKGRLALSAVPSSYCSGQLDPLKVLQGAPHCP

SEQ ID NO: 45798 - protein, 419 aa, Geobacter metallireducens GS-15
MILTEQNGKTCLRNICFEELAARYGTPFYLYDLDKVKEKCAAVRKAFGDSLELLYAVKANPNRELLAAMRGEVDGLDIASAGELERALETGYDAGCISFAGPGKTRDELRRSLEAGVGCISVESLRELNDLRDLVRAGSHRAYILVRVNPQLLIRDFAVKMGGKASQFGIDEEELPSALDFIKANADAFDFKGIHIYAGTQCLNEEALAQNLANTLAIAARITTDYGMECRVINIGGGLGVSYYEEHPGLDLDKLALLFRAEFDRYREATGTKPRILLELGRFLVAEAGIYVTRVVSEKLSRGEQFYVLDGGMNHHLSASGNLGMTIRKNYLVRNLSRPGAERIICTLVGPLCTPLDLMGKGVTVEVPEVGDLVGFLNSGSYGYSASPLLFLGHGEPCELLVEGKDVRPCRLMGEMGSR

SEQ ID NO: 45799 - protein, 149 aa, Zea mays
MSVELILWLFSFVSVMVLIGLTAYQLICLSDLEYDYINPYDSSSRINAVVLIEYSLQGALCASFLLTLHWFPFLVMTPVTYYHVKLYLARKHLVDVTEIFRQLSDEKKYRMIKLAFYFCLFIITIYRLVMTAVMLFIDEDINLAETRSI

SEQ ID NO: 45800 - protein, 331 aa, Marinobacter sp. ELB17
MSTYKAINLVKHLKGKPGPELFEVVEKTVPEPGDGEFLVKQAFMSMDPAMMGWMTGDTDSYIPPVELGTVMRSSGVGEVVASKHADFAVGDQVMGMFGWQEMALTDGKGINKVDKKIPLEMALAVFALPGLTATQGLFGCGHLKSGETLVVSGAAGSVGSIVGQLAKAEGLRVIGVVGSQEKADWIINELGFDGAVNYKTDDLGAKLDELVPNGIDVYFENTGGPIQHYVFDRMNAHGRIVVCGMIADYTAETLRPGPSWMRIIKKRLSIQGFTMPDHMHKAQELQAKLAPYVQNGDIKYRTHVLEGLESAMDGLNLFLSGGNKGKLMVKI

SEQ ID NO: 45801 - protein, 352 aa, Marinobacter sp. ELB17
MKAARFYDKGDIRIEDIPEPTVEPGTVGIDVAWCGICGTDLHEFMEGPIFIPPCGHPHPVSGESAPITMGHEFSGVVYAVGDGVDDIEIGQHVVVEPYIIADDVDTGPGESYQLSKNMNFIGLGGHGGGLSEKIAVKRRWVHPISDAIPLDQAALIEPLTVGYHAFVRSGAKAGDVALVGGGGPIGLLLASVLKAKGITVILTELSAKRKEKAEETGVADYVLDPSEVNVTEEVMKITKDRGVDVSFECSSINEVLDTLVETTKPGGTVVIVSIWSHPATVNVHSVVMKELDVRGTIAYANNHAETIKLVEEGKVNLEPFITQRIQLDDLVSEGFERLIHNNESAVKIIVHT

SEQ ID NO: 45802 - protein, 325 aa, Ralstonia eutropha JMP134
MTQPSATALLAPVAADMRAVDAVIRQRLSSEVPLIEQIGEYIISAGGKRLRPVILLMSARAFGYDGNRHHELAAVVEFIHTATLLHDDVVDESELRRGRETANAVFGNAASVLVGDFLYSRAFQMMVDAGSMRIMEILSNATNVIAEGEVLQLLNMHDPDVTIERYLQVIRYKTAKLFEASAQLGAVLAGADAAMEEAAAEYGRRIGTAFQLIDDMLDYTASAEQMGKNAGDDLREGKPTLPLLHLLEYGTPEQRVLAREAIVQGGTEHFDAVFSAIHASGALDVTFEAARREAEAAEKAAQQFPASDWKDTLIALCEFSLQRQS

SEQ ID NO: 45803 - protein, 450 aa, Staphylococcus aureus subsp. aureus MRSA252
MNNKRHSTNEQLSLDEINNTIKFDHRSSNKQKFLSFLGPGLLVAGGYMDSGNWITSMQGGAQYGYTLLFGNLISRLSAMLLQSMTVRLGIATGMDLAQMTRHYLSRPIAIIFWIIAELAIIATDIAEVIGSAIALNLLFNIPLIVGALITVLDVFLLLFIMKYGFRKIEAIVGTLIFTVLFIFIFEVYISSPQLNAVLNGFIPHSEIITNNGILYIALGIIGATIMPHNLYLHSSIVQSRTYSRHNNEEKAQAIKFATIDSNIQLSIAFVVNCLLLVLGASLFFNSNADDLGGFYDLYHALKTEPVLGATMGAIMSTLFAVALLASGQNSTITGTLAGQIVMEGFLRLHIPNWLRRLITRSLAVIPVIVCLIIFKGNAAKIEQLLVFSQVFLSIALPFCLIPLQLATSNKDLMGPFYNKTWVNIISWTLIIILSILNVYLIVQTFQELQG

SEQ ID NO: 45804 - protein, 598 aa, Medicago truncatula
MKRQRTNSFKLNSCSQQLNSSSSSELDLPDDIWERVFRLLKNNDDDDHRKRYLKSLSVASKHFLSVTNRHKFCLTILYPALPVLPGLLQRFTKLTSLDLSYYYGDLDALLTQISSFPMLKLTSLNLSNQLILPANGLRAFSQNITTLTSLICSNLISLNSTDIHLIADTFPLLEELDLAYPSKIINHTHATFSTGLEALSLALIKLRKVNLSYHGYLNGTLLSHLFKNCKFLQEVILLRCEQLTIAGVDLALLQKPTLTSLSITCTVTTGLEHLTSHFIDSLLSLKGLTSLLLTGFRISDQFLSSIAMESLPLRRLVLSYCPGYTYSGISFLLSKSKRIQHLDLQYTDFLNDHCVAELSLFLGDLLSLNLGNCRLLTVSTFFALITNCPSLTEINMNRTNIQGTTIPNSLMDRLVNPQFKSLFLASAACLEDQNIIMFAALFPNLQQLHLSCSYNITEEGIRPLLESCRKIRHLNLTCLSLKSLGTNFDLPDLEVLNLTNTEVDDEALYIISNRCPALLQLVLLRCDYITDKGVMHVVNNCTQLREINLDGCPNVQAKVVASMVVSRPSLRKIHVPPNFPLSDRNRKLFSRHGCLLVM

SEQ ID NO: 45805 - protein, 346 aa, Triticum aestivum
  misc_feature (9)..(9): Xaa can be any naturally occurring amino acid
MAAAAEVSXKRVILKRYVTGFPSEDDMELVPATARLAVPRGSNAVVVKNLYLSCDPYLRSRMSGNDEPSHVPDFVQGEVLTTLGVSKVVESGHQDYKPGDLVWGLTGCEEYTLITNLESHFKINHPELPLSYYTGVLGMPGLTAYVGFFDVAKPKKGEYVFVSAASGAVGQLVGQLAKISGCYVVGSAGSDEKVNLLKTKFGFDDAFNYKKEQDLDATLKRCFPEGIDIYFENVGGAMLDAVLLNMRLHGRVSVCGLISQYNLEQSEGVRNLFCIITKRIRMEGFIVTDHYGTYRKFEEEMAGYLKDGKITYVEDVAEGIESFPTALIGLFYGRNVGKQLVAVARE

SEQ ID NO: 45806 - protein, 331 aa, Marinobacter sp. ELB17
MSTYKAINLVKRNEGHIGPELFEMVEKTAPQPADGEFVVKQAYMSLDPAMMGWMTADTDSYIPRVELGTVMRSSGIGEVVASNHADFAVGDQVMGMFGWQEMALTDGTGVNKVDKKIPPEMALSVFALPGLTATQGLFGCGHPKAGETLVVSGAAGSVGSIVGQLAKAEGLRVIGVVGSDEKAGWIINELGFDGAVNYKIDDLGAKLDELAPEGVDVYFENTGGPIQDAVFERMNAHGRIVVCGMIADYTSANPSPGPNWMRIIKKRLKIQGFTMPDHMHKAGELQAKLAPYVQSGQVKYRAHVLEGLESAMGGLSLFLTGDNKGKLMVRL

SEQ ID NO: 45807 - protein, 531 aa, Oryza sativa
MRIPRRKGVAGPLVGAPSRRAQVAAVFALALLLGVSVLYDSAHIAASLRRHGVGGGGSSGGGGGGGGDGARAYTNTKLSATTEEAEAEAAEVRSPPAQGVESAVEATDRGEAPPEQPVAADSGASSAETPPSLLEQVTETPPPSPSSSSAAAAAAEAQVGGDHGGESCDVYKGRWVYDEANAPLYKESACEFLTEQVTCMRNGRRDDDYQKWRWQPDGCDLPRFDAKLLLEKLRNKRLMFVGDSLNRNQWESMVCLVQSEAPWEKKSLVKNDSLNVFRLEEYNATIEFYWSPFLVESNSDDPNMHSIVDRIIKPTSIAKHAANWEGVDYLIFNTYIWWMNTPEMKILHGGSFSKKPVKYDEMERVAAYRKVLKTWSRWVEKHVDPKRSTVFFMSVSPVHMQSEGWGKPDAIKCFSETQPAINYTKKLEVGTDWDLFSTAHHVTKAMKRVPVHFINITALSEIRKDAHTSVNTLRQGKLLTKEQKANPRKFADCIHWCLPGLPDTWNEFIYGHIVSSPQRRPVEPIENQPQR

SEQ ID NO: 45808 - protein, 141 aa, Streptococcus pyogenes M49 591
MNWLITSQPYKELNMKAATYLSTGNLQLIDKPKPVIIKPTDAIVQLVKTTICGTDLHILGGDVPACKEGTILGHEGIGIVKEVGDAVTNFKIGDKVIISCVTSCHTCYYCKRSLSSHCEDGGWILGHLINGTQAEYVHISH

SEQ ID NO: 45809 - protein, 344 aa, Aspergillus oryzae
MPPGNGSASMAIPVVDFSSWKNTQDEASRLRTAHELVKACQTVGFVYIINHSLPKSVLDEAFDWVKRLFNLPEEEKMRAPHPEGWAVHRGYSWPGLEKVSQTMSTGNDEEAKRKLREVPDVKEVYDIGSDENTEQPNQWIPDEALPGFRTFMIKFYWECWAVGEELLRALAIGLNLEDDSYLVDKHSGHGNQLRLLHYLPVPAEDLEKERTTRCPAHTDWSSLTMLFQDDCGGLEVEDVSRPGTFVPATPLKNAIVVNVGDLLQMWSNDQLRSTNHRVRMPPLADRYEGPDRMTRERFSIPYFISPDPTSVIECIPSCMSEDQPAKYKPITQAEYNKMRASMMY

SEQ ID NO: 45810 - protein, 513 aa, Geobacillus kaustophilus HTA426
MTTHVQVHHFPLFIDGQWQPATSGETFHVYNPATGEVVATVAKATADDVDRAVKAARKAFDETDWKAMKPKERARVLNAIAQAIAANAQELAYLEAISSGGTIRRISSIDILQTVDLFQTMANIVQEYPFSETLPIPPFPGPAHNFVWREPIGVCAAITPWNLPLMIASWKIAPALAAGNTIVVKPASYTPLSTLKLAEIISSFVPPGVINVVAGPGADVGEALVRHPQVDKVAFTGSTEVGRRIMALAAETVKNVTLELGGKSPNILLEDADLDLAVPGSLFGVFLHSGQLCESGTRLFVPDRLHDEVVERLVALTKTLQIGHPLDPATDVGPVISKRQKETVLSYIEAGKQEGATIVCGGHEVEVPGCEGGHFVAPTIFSNVTNDMKIAQEEIFGPVLSIIRYHDVEEAVTMANDTIYGLAAGVWTRDVNKAYAIAGRLQAGVVWINDWHMLRNDAPFGGYKQSGIGREMGKYSLDAYTQLKHVHTSMVPELGKRKWYQVLFSRLHTMMKK

SEQ ID NO: 45811 - protein, 470 aa, Ehrlichia chaffeensis str. Arkansas
MFLSIEDTLNYIKKNAINFIDLRFTDSNGKWHHITRSAETINAQVLLAGVNFDSSSIPGWQSIEKSDMILLPDVSTAFMDPFSAQSTLVILCNIVDPYKQSQYSKDPRYIAQKAYKYMLSTGIADKCYFGPEVEFFIFDNAQFYAGMYNSYFKIDSAEHDILFQKREFSNNSHRPKVKGGYMPTPPIDSLHDIRSEMLTMFKEVGIIPLIHHHEVAASQCEVGFQHDELLLSADNVQKCKYIVHGVASSYGKTATFMPKPVIKDNGSGMHCHQSLWKDNVNIFVNPDGSISETCLYYIGGIIKYGKAINAFTNPSTNSYKRLVPHFEAPTWLTYSYENRSSAIRIPYVPKNDLNAKRIEARFPDPLANPYLCFSAQLMAGLYGIQNKIHPGPAIDKNLYSLDKEELQQFTSVASSLEEALDSLDNNREFLLVGDVFTNDQIDAYINLKMLEVKDLQLHPHPIEFINYYSS

SEQ ID NO: 45812 - protein, 213 aa, Malus x domestica
PIKAPILVEQGLFWDNEELISLLSKESEQNELQKPLQISPSLAGARREAVDWMLRVASHYSFSALSAVLAADYFDGFLSSLQLQVEKPWMTQLAAVACISLAAKVEETQVPLLLDFQVEDSKYVFEARTIKRMEILVLSTLQWKMNPVTPISFIDYITRRLGLKNHLCWEVLKRCELVLLSLISDSRFMSFLPSVVATAIMLHVVNNIEPCLL

SEQ ID NO: 45813 - protein, 379 aa, Sinorhizobium meliloti 1021
MKRDLYETLGVQKNADEKELKSAFRKLAMKYHPDRNPGDQESEKSFKEINEAYETLKDPQKRAAYDRYGHAAFEQGGMGAGFGNGFAGGGAHGFSDIFEDIFGEMMGGRQRRSSGGRERGADLRYNMEISLEEAYSGKTAQIRVPTSITCDVCTGTGAKPGTSPKTCGTCQGTGRVRAAQGFFSIERTCPTCGGRGQTIADPCTKCHGQGRVVEERTLSVNIPAGIEDGTRIRLSGEGEAGLRGGPAGDLYIFLSVKPHEFYQRDGADLYCAVPISMTTAALGGKFDVTTLDGTKSRVTVPEGTQAGKQFRLKGKGMPVLRSSQTGDLYIQIQIETPQKLTKRQRELLQEFEQISSKENNPESTGFFSRMKDFFDTLSE

SEQ ID NO: 45814 - protein, 172 aa, Oryza sativa
MAAAAAEATTDGGGKMIILISADGKRFEVTEAVASQSQLISNMIEDDCTENGVRLPNVDGDILTMVVDYCNMHAGDAAAAGDTMKASSTEEELKKFDAELVQALENPVLFKLILAANLLNIKSLLDMTCQRVADMMSGKTPEQMRETFSFENDFTPEEEAAIRQENAWAFDD

SEQ ID NO: 45815 - protein, 253 aa, Streptococcus pneumoniae R6
MAKNVVITGATSGIGEAIARAYLEQGEDVVLTGRRIDRLEILKSEFAVSFPNQTVWTFPLDVTDMVMVKTVCSDILETIGRIDILVNNAGLALDLAPYQDYEELDMLTMLDTNVKGLMAVTHCFLPAMIKVNQGHIINMGSTAGIYAYAGAAVYSATKAAVKTFSDGLRIDTIATDIKVTTIQPGIVETDFSTVRFHGDKERAASVYQGIEALQAQDIADTVVYVTSQPRRVQITDMTIMANQQATGFMIHKK

SEQ ID NO: 45816 - protein, 797 aa, Rickettsia sibirica 246
MLPEIASSMPIASARNDEKLKQTNKTGISKMDEMNKINYAEALEYHEKDKPGKIAISATKSLVTQQDLSLAYSPGVAAPCLEIAKNLEDVYKYTARGNLVAVISNGTAVLGLGNLGAAASKPVMEGKAVLFKKFADIDAIDLEVNTEDPEEFINAVKYLSYSFGGINLEDIKAPECFIIEEKLKSLMDIPVFHDDQHGTAIITAAGLINAAYLTNRKLEDLKIVVNGAGAAAIACIDLLIALGADKSKIIVCDTKGVVYKGRLEGMNKWKELYASDTKFRTLAQSLNNADVFIGLSVKGAVTKDMVSRMASNPIIFAMANPDPEITPEDIQLVRDDAIIATGRSDYNNQINNVMGFPYIFRGALDIRAKTINTEMKIAAAKAIADLARRPVPEEVYKAYSGRKMVFGKEYIIPVPFDPRLITVVAAAVAVAAIESGVARVKDFSIGKYKKELGSRLNPTANYMNFLAEKIHNAPLKRIVFAEGEEEEVISAALMMRDKKYGHPIIIGRVERIEAMLKKIGQDISLDGIQIMNAALSDSLEKYTDYLYKRLQRKGYLYRDCAKLVKTDKNIFAACMLACGDGDALLTGVTKSYIDSLEDIMKVIAPKTNRSILGYSIMIAKDNNIIIADNCITEYPNSWELAQIATQTAEIAKNMGITPRVALLSFSTFGNSSKAKTARIREAVNILDNFSKDKEELSGMKVDFEYDGEMSVKVALDGDLRKLYKFCRLSGSANVLIMPGLNSAAISTELLQEFSSNSFIGPITNGFEKPVQILQAAATANEILKIATFACVEAINEV

SEQ ID NO: 45817 - protein, 205 aa, Mycobacterium avium subsp. paratuberculosis K-10
MPNTSPVTAWKSLKEGNERFVAGKPQHPSQSVEHRASLAAGQSPTAVVFGCSDSRVAAELIFDQGLGDMFVVRTAGQAIDTAVLGSIEFAVSVLNVPLIVVLGHDSCGAVKAALGAIEEGAIPGGFVRDVVERVAPSILMGRREGLSRVDEFEERHVRETVAQLVSRSTTIAERIGDGTVAVAGVTYHLADGRAALCDHVGDIGE

SEQ ID NO: 45818 - protein, 423 aa, Magnaporthe grisea 70-15
MAAGDSQRLREAQEAAKSNPKKAEELYKEIVSKPPSVTSDAAVKEYELALLSLGELYRDQKNSNDLVELIKRSRTVLSSFAKAKTAKLVRQLLDFFDGIPNTTDLQVSVTKSCIEWATSERRTFLRQNLETRLVTLHMAKQSYYEALTLINGLLKELKRLDDKLMLVEVQLLESRVYHALGNISKARAALTSARTSAASVYTPPMLQANLDMQSGMLHAEDKDFNTAFSYFIEALDGYHSQDATKNATAALQYMLLCKIMLNLVDDVNTLMASKQAAKYAGQSLEAMKAIARAHANRSLEEYEQSLAAYRHELGGDAFVRSHLRRLYDAMLEQNLIKVIEPFSRVEIDHIAKMVGLDTQQVERKLSQMILDKVIIGVLDQGAGCLIIFDETQRDEAYDHALATIEKLSSVVDVLYTNQASMLE

SEQ ID NO: 45819 - protein, 386 aa, Listeria monocytogenes str. 4b F2365
MKHVFPTYKRFPIDLVNGTGTVVTDKNGKTYLDFTSGIAVCNLGHCPANVAEAVQQQLTNIWHTSNLYECALQDSVAELIADGKDRLVFFCNSGTEANEAALKLARKYTGKEKIITFEKSFHGRTFGSMSATAQAKIHQGFGGLVPGFTYVPYNDIEAFRAEIDEHTAAVMLEVIQGEGGVIPANAAFLLEVQLLCKKMGVLLIIDEVQTGLGRTGTLYGFEQIGLEPDIFTLAKGLGNGLPIGAMVGKANLSSAFGPGSHGSTFGGNKLALAAAKEILRTMKQAGFLEEVNAKADYFRYLLEVHLEALDNVSVIRGGGFLIGIELENTAEPVVTELRDKGLLILTAGANVLRILPPLTVSYAEIDQAIYLLKSVLENQLIGSEEG

SEQ ID NO: 45820 - protein, 656 aa, Geobacter metallireducens GS-15
MSQGIFGIIDFRNAIADRDVLGNAMAAYLKMSGSGEFSVSTGLGHLIGMRRSAADSPSRQTRIEHDPDAGLAAVIHGEVNNYRELLSQHPPSGRPCCGDLDLVLRMYRRSGASFARSINGLFTIGILDEREKTFRLMNDRFGLAHQLYWTVADGRLIFATHLKTLLACPGVRRELDHEGLNLFLKYAYITSPWSILKGINKLPPGHMLTFRDGKAEVAPYWQFDAVTRPGMTMEEAIPAYRDLLRGAIARRMGSDGSTGVMLSGGLDSSANAALAASCSSTPVKTFAIGFEDPRFDERPFARIVAKHFGTDHHEYTITGREIDDLPSLVWHLEEPYFEFGLFLTYMGLKSASGHVQAVIGGEGADQMYGTGGFAGGRPAAVHYLFRKSGMIGPARTVSSLLRGPLFYDRDNLGFQLRLFWNRAADLNDWYFYGYDGHELSQLYRNGNLARVPRIFGEPAGSPESFAQVYLETQIEQDMRHYVNENVMVKSGRMADMLGLVLRESFLDADVADFLVSLPMPVKRGGGLVDHLRGRFKSKLLHRKAMEGILPPEIMSKPKQGGFVPVMIFLNDPALRKRIYEKLLRSEVMGEYFRTDYLRTLFEKYESFQQGAVGWPNFLNSKANRILFLLTFDIWHHCYLANDPLGVTPPSLNEYLG

SEQ ID NO: 45821 - protein, 288 aa, Bacillus cereus E33L
MPQQKNFVTMPAQHQNKQPGIESLMNPLPQFEDPNYKGSEKLKGKSVLITGGDSGIGRAVSIAFAKEGANIAIAYLDEEGDANETKRYVEKEGVKCVLLPGDLSDEQHCKDIVQETVRQLGSLNVLVNNVAQQYPQQGLEYITAEQLEKTFRINIFSYFHVTKAALSHLKQGDVIINTASIVAYEGNETLIDYSATKGAIVAFTRSLSQSLVQKGIRVNGVAPGPIWTPLIPSSFDEKKVSQFGSNVPMQRPGQPYELAPAYVYLASSDSSYVTGQMIHVNGGVIVNG

SEQ ID NO: 45822 - protein, 984 aa, Thermoplasma volcanium GSS1
MIVVEVGEVIEFYAGSKSLKGEKNQTILQALLLNGIDIPHICYHPSLGPINTCDTCLVDMNGKIVRSCSTYLEQGAKIDYNSNRVLELQREAVQRMLHNHDLYCTVCDNNNGDCPLHNAVHDLEIDNQKYPYEPKPYPVDDSNPFYVYDPNQCILCGRCVEACQDVQVNETLSIDWSRERPRVVWDNDVPINESSCVSCGHCVTVCPVNALMEKTMLGKAGFLTGLEKNTKQKMIDVVKSIEPEITMSPIMAISNIESKMRSSRIKKTKTVCTYCGVGCSFEMWTMGREILKVQPQPESPANGISTCIKGKFGWDFVNSKERLTSPLIRDGERFRRATWEEALDLVAKKLREIKDKYGGDAIEFIASSKGTNEEAYLMQKLARQVFGTNNVDNSSRFCQAPATTGLWRTVGYGGDSGSIQDIYMADLVIAIGTNTAESHPVLATRVKRAHKLNGQKLIVSDLRMHEMARRADLFLHPKPGTDIVWLSAVTKYILDKGWEDKSFIRERVSGFEDYVKSLEPFTMEFAEEATGISKETLMKVANMIHEAKNMVILWAMGVTQHQAGSDTSTAISNLLLITGNYGRHGTGAYPLRGHNNVQGASDFGAMNAYLPGYQPVSDPTVRKKFEDAWHCTIPEKPGLDNNTCLEGIMNGKIRAMYVVGEELVETGSDSNFIRDQLEKLDFLVVEDLFLSETAKYADVVLPASASLEKEGTFVNTERRIQRIYEVMAPLPGTRPDWQIIQDIANRLGARWNYGHPSEIMEEAASLSPIFAGVRYELLEGFKSLQWPVRSDGKDSPLLYEKEFNFPDGKARLYPLKYNPPLSSGLEFDLHLNNGRLLEHFHEGNETYKSPGIRSKVPGTFVEVSPDLAKERGLETGDLVRITSEYGSIKVSVLVSDRVSGKELYMPMNASGDSAVNLLTGRLMDPTAHTPAYKEVSVRLEKITGKRGPPPLPSTNPRNAIPHPQIGVQVEKKWARKDYVKLTTE

SEQ ID NO: 45823 - protein, 645 aa, Triticum aestivum
  misc_feature (129)..(129): Xaa can be any naturally occurring amino acid
ARGSNGISNGISRVMSVGSNEAAPRRGMVLPFSPLSMCFDDVNYYVDMPAEMKQQGVTDDRLQLLRDVTGSFRPGVLTALMGVSGAGKTTLMDVLAGRKTGGYIEGDIRISGYPKNQATFARISGYSAXRQNDIHSPQVTIRESLIYSAFLRLPEKIGDQDITDEIKIQFVDEVMELVELDNLKDALVGLPGISGLSTEQRKRLGAWVELVANPSIIFMDEPTSGLDARAAAIVMRTVRNTVDTGRTVVCTIHQPSIDIFEAFDELLLLKRGGQVIYSGKLGRNSQKMTEYFEAIPGVPKIKDKYNPATWMLEVSSVAAEVRLSMDFADYYRTSDLYKQNKVLVSQLSRPEPGTSDLYFPTEYSQSIIGQFKACLWKHWLTYWRSPDYNLVRFSFTLFTALLLGSIFWKIGTNMGDANTLRMVIGAMYTAVMFVGINNCATVQPIVSIERTVFYRERAAGMYSALPYAIAQVVMEIPYVFVQTSYYTLIVYAMMSFQWTAVKFFWFFFVSYFSFLYFTYYGMMTVSISPNHEVAGIFAAAFYSLFNLFSGFFIPRPKIPKWWIWYYWICPLAWTVYGLIVTQYGDMEDIITVPGQPNQTISYYITHHFGYHRSFMAVVAPVLVLFAVFFAFMYALCLKKLNFQTR

SEQ ID NO: 45824 - protein, 352 aa, Novosphingobium aromaticivorans DSM 12444
MKIAVLPGDGIGPEVTREAVRVIEALGLGDIEMKEAPVGGAAYKAYGHPLPPETLEIARLSDGILFGAVGDPDCDSLERHLRPEQAILGLRKALTLFANLRPARVFKGMEDFSALRPEVAGAIDLLIVRELNGDVYFGEKGFRTAANGDREGYDVMSYSESEVRRIAHVAFRAAMGRKKRLCSVDKANVLETSQLWRDVMLEVAKDYPEVALEHMYVDNAAMQLVRAPGNFDVVVTGNLFGDILSDQASMCVGSIGLLASASLGERETEYGTFGLYEPIHGSAPDIAGKGLANPMATILSAAMLLRHSLGLEVAADRIEAAVAKALADGVLGRDLGGTAGTTEIGDAVLARL

SEQ ID NO: 45825 - protein, 328 aa, Magnaporthe grisea 70-15
MPPSLLHPPSHLSPEGARQQATLAPSILKNFPESISSTPILSLFSAPETAELWVTYENLLLACLRTGDDLSAHKCLERLIKRFGDKNERMMAFKGLVKEATAKNNTELEAILKEYDNILAEEENNIPIAKRRIALLRSLDRTPDAVSGLLALVDISPTDAEAWAELADVYLAQGMYSQAIYALEEVLVLQPNAWNIHARSGEVLYMAATATQSNDATAAKQLAEATKRFCRSVELCDDYLRGYYGLKLVTSRLLNDKPYSQTRKGDDADDLSLPDSATLQKLDELATRKLAEIVRRWSAGEHNWRGYEESEIVAAREFLNQDNSSAPK

SEQ ID NO: 45826 - protein, 583 aa, Arabidopsis thaliana
MEVQSSSNNGGHSSFSSLRVYLNSLSATPSRLSRRAISVSTSSDEMSRVRAVSGEQMRRTLRWYDLIGLGIGGMVGAGVFVTTGRASRLDAGPSIVVSYAIAGLCALLSAFCYTEFAVHLPVAGGAFSYIRITFGEFPAFFTGANLVMDYVMSNAAVSRSFTAYLGTAFGISTSKWRFVVSGLPKGFNEIDPVAVLVVLVITVIICCSTRESSKVNMIMTAFHIAFIFFVIVMGFIKGDSKNLSSPANPEHPSGFFPFGAAGVFNGAAMVYLSYIGYDAVSTMAEEVENPVKDIPVGVSGSVAIVTVLYCLMAVSMSMLLPYDLIDPEAPFSAAFRGSNGWEWVTKVVGIGASFGILTSLLVAMLGQARYMCVIGRSRVVPFWFAKIHPKTSTPVNASTFLGIFTAALALFTDLNVLLNLVSIGTLFVFYMVANALIFRRYVPVGPTKPWPTLCFLTLFSITSLVFTLIWKLVPEGKPKAFMLGASAVVAIAIVLSFQCVVPQARKPELWGVPFMPWTPCVSIFLNIFLLGSLDAPSYVRFGFFSGLIVLVYLFYGVHASSDAEANGSFGVKDGQVMKELIEV

SEQ ID NO: 45827 - protein, 312 aa, Prochlorococcus marinus str. MIT 9301
MNSVIFQETAKLKKPVPAEKVIELSEKLLEPSSHSKRYPPRLHKTWGTIVFMVTIHILSLIAIQPKFWSLPAVTSLLFFYWVTACLGVTLGYHRLLSHRSFVVPRWLERFFATCGAISCQHGPIDWVGLHRHHHSFSDTEVDHHNSKKGFWWSHMGWMFKDVEALKAVPKLSADLIKDPYYRFLNKYFLFLQIPIGLSLYAIGQKLGVGGWALVLWGIPLRLVVVYHVTWLVNSATHCWGKAPFESGDSSKNNAWVAALTFGEGWHNNHHAFPNSAKQGLFRGQIDITWEHIKILAKFGLAKKVKLPSRSYY

SEQ ID NO: 45828 - protein, 139 aa, Brassica napus
  misc_feature (27)..(27): Xaa can be any naturally occurring amino acid
  misc_feature (31)..(31): Xaa can be any naturally occurring amino acid
  misc_feature (44)..(44): Xaa can be any naturally occurring amino acid
  misc_feature (46)..(46): Xaa can be any naturally occurring amino acid
  misc_feature (51)..(51): Xaa can be any naturally occurring amino acid
  misc_feature (53)..(53): Xaa can be any naturally occurring amino acid
  misc_feature (69)..(69): Xaa can be any naturally occurring amino acid
  misc_feature (71)..(71): Xaa can be any naturally occurring amino acid
  misc_feature (76)..(77): Xaa can be any naturally occurring amino acid
  misc_feature (96)..(96): Xaa can be any naturally occurring amino acid
MFSAATCKQSDHTWEKDLCAKFGSVSXSKVXEEERYMLQYVRVXQXDDSVXEXAIKNAKSLYWAEINRXSXSLTFXXPDVYVDDVKWDAEVDTGEXIRLGPVIVHGWSSQNRNLGSKEKNNNKTETWQEKNNDNSCYNY

SEQ ID NO: 45829 - protein, 493 aa, Rhodococcus sp. RHA1
MRGYYTADEVRAAEAPLLASLPDGALMRRAAHGLATVVAAELRARTGGVAGRTITVLVGSGDNGGDALWAASMLRGRGVAATAVLLKPEKAHEAGLAAFTAAGGRVAAPSDELGLPDLVVDGIVGISGRGPLRPDAAALVDRIEAPIVSADLPSGVDPDTGAVDGPAVRAAVTVAFGALKPVHVLGAAYCGRVELVDIGLSLGDAGITALDAADVGAAWPVPGADDDKYSQGVVGVVAGSDGYPGAGVLCTGAAVTATSGLVRYAGPCTHEVLAHAPEVIATADLGKAGRVQSWVVGPGMGTDDAARRTLRTVLDSDVPVLVDADGLTLLAEDPDLVRSRTAATLLTPHAGEFARLTGTDPGPDRVASVRALAADWNVHLLLKGRATVIAEPGGRIFVNEAGGSWSATAGAGDVLAGIIGSLMAAGIGPARAAAVGARAHSLAANLAARGGGADLSAGRGTAPISAGTLLAHLRESIRVLRAGVSPEEMPAPS

SEQ ID NO: 45830 - protein, 429 aa, Shigella flexneri 2a str. 301
MTRRAIGVSERPPLLQTIPLSLQHLFAMFGATVLVPVLFHINPATVLLFNGIGTLLYLFICKGKIPAYLGSSFAFISPVLLLLPLGYEVALGGFIMCGVLFCLVSFIVKKAGTGWLDVLFPPAAMGAIVAVIGLELAGVAAGMAGLLPAEGQTPNSKTIIISITTLAVTVLGSVLFRGFLAIIPILIGVLVGYALSFAMGIVDTTPIINAHWFALPTLYTPRFEWFAILTILPAALVVIAEHVGHLVVTANIVKKDLLRDPGLHRSMFANGLSTVISGFFGSTPNTTYGENIGVMAITRVYSTWVIGGAAIFAILLSCVGKLAAAIQMIPLPVMGGVSLLLYGVIGASGIRVLIESKVDYNKAQNLILTSVILIIGVSGAKVNIGAAELKGMALATIVGIGLSLIFKLISVLRPEKVVLDAEDADITDK

SEQ ID NO: 45831 - protein, 603 aa, Oryza sativa (japonica cultivar-group)
MDPKLVEVTQLFSRFKAAFARNDFDTCVDLLSQLKVRLTKFPSLPPSFQQTPNAVEELKIARDIYEHAVVLSVKIEDQDAFERDFCQLKPYYMDTCGIIPPSPQEYPILGLNLLRLLVQNRIAEFHTELELLPVTALENPCIKHAVELEQSFMEGAYNRVLSARQAVPHETYVYFMDLLAKTVRDELAGCSEKGYDYMSIAEARQVLMFSSDKELHQYIAEEHPEWEVKDGSVFFQKAKETQPCKEIPSLQVQRHAVDDITVGALNATMHNTTSNHLESLLAVTGSSELATSNGIVGEFGALALASAVAPSLPLPSPPRYTGSKKIVDSKATQEDLQPQMQTIFSSTGEHSVSKLKSCRDSVAGTTTEEDEGALEARHAACELTARVLEYAGTLVKPLATTDEIDRAVHQMIIDAGAYPSPLGYGGFPKSVCTSVNECICHGIPDSRVLQNGDIINIDVTVYLNGYHGDTSRTYLCGEVDESTMQLVKKLIYCSVTNMLRGISACKHGASFKTIVSTWTSTGTASIPLSDMELGKYSTRNRSFGIPARHSQLVEPTLSMGGTQCTLWDDGWTAVTVDSSLTAQFEHTILVTGDGAEILTMHPR

SEQ ID NO: 45832 - protein, 343 aa, Triticum aestivum
TRVYKKAGCYRSGIPGISSTHASGERGESRESRGARGGEREPREIQSNPAQPSPLPRLRPRRRRRLRRAASIRSGSALARSGEVRRRGRRRRGIGMGARVSKATSCCCLRGQLHGSTRLDDPGSEEDEQGEAYELPAFQEYTFEQLRLATAGFAVENIVSEHGEKAPNVVYKGKLDAQRRIAVKRFNRSAWPDPRQFLEEAKSVGQLRSKRLANLLGCCCEGDERLLVAEYMPNDTLAKHLFHWETQAMKWPMRLRVVLYLAEALEYCTSKGRALYHDLNAYRVLFDDDCNPRLSCFGLMKNSRDGKSYSTNLAFTPPEYMRTGRITPESVIYSFGHLATGRS

SEQ ID NO: 45833 - protein, 394 aa, Magnaporthe grisea 70-15
MYSNWTIQQQRLPSTTRGYELTRRTPFLGAKDSESNPDQVFHLIEGIINEDLLHPLAANLHKLPFESRKDAQFIFSSVFRFRPASASTKSDPVALGWVVNQRPQVLLELCRGYDHKESATAAGSVLREVLKHEGACKVILYDDGDQPGSSVNGVQAIDRDRPQSGTGVFWKFFDWIDRGSFEVSADAFTTFREILTKQKEVVPHYLRVNFDLFCSKYNTVLVQSSSYVTKRQSIKLLGEILLDRSNYSVMTEYVASGEHLKICMNLLRDDRKMVQYEGFHVFKVFVANPNKSIPVQRILIMNKDKLLNFLSHFLEDRTDDEQFIDEREFLIKQIRNMPASPVPPQGSPAVRPPDAKPNLRYDVRQGERREARGRDESLDEHMHLLLSSLDDDNG

SEQ ID NO: 45834 - protein, 405 aa, Helicobacter pylori J99
MFNYEELFQTYKTPFYLYDFDKIKQAFLNYKEAFKGRKSLICYALKANSNLSILSLLANLGSGADCVSIGEIQRALKAGIKPYKIVFSGVGKSAFEIEQALKLNILFLNVESFMELKTIETIAQSLGIKARISIRINPNIDAKTHPYISTGLKENKFGVEEKEALEMFLWAKKSAFLEPVSVHFHIGSQLLDLDPITEASQKVAKIAKSLIALGIDLRFFDVGGGIGVSYENEETIKLYDYAQGILNSLQGLDLTIICEPGRSIVAESGELITQVLYEKKAQNKRFVIVDAGMNDFLRPSLYHAKHAIRVITPCGGREISPCDVVGPVCESSDTFLKDANLPELEPGDKLAIEKVGAYGSSMASQYNSRPKLLELALEDHKIRVIRKREALEDLWRLEIEGLEGV

SEQ ID NO: 45835 - protein, 132 aa, Zea mays
  misc_feature (23)..(23): Xaa can be any naturally occurring amino acid
  misc_feature (68)..(68): Xaa can be any naturally occurring amino acid
  misc_feature (83)..(83): Xaa can be any naturally occurring amino acid
  misc_feature (93)..(93): Xaa can be any naturally occurring amino acid
  misc_feature (100)..(100): Xaa can be any naturally occurring amino acid
MTTMRRLPSALEGVNDLDRDVLXRSTAVSGEVNFYFAHGTRWQDERRNESLFVSNNAIFKPSKAMRGXIPICYAQYYIFGNLXPHGFARNTTXSAYHKTXPLAAPTFNSAYIDLILKPTENDEKIWPHNFEY

SEQ ID NO: 45836 - protein, 365 aa, Salinibacter ruber DSM 13855
MDDTRSYDIAWLPGDGIGPEVTREALRVLEAVGSAHGFSVTATEHRMGGVALDETGMPLPDSTRDACLESDAVLLGAVGGPKWADNTGDQRPESGLLALRKALGVYANLRPVRVPAALADASPLRPDRVGGTDILFVRELTGGIYFGTPEGRTDDGARSTMAYSDDEIERIAHVAFQRARRRDGNVTSVDKANVLEVSELWREVVTEVHDDCPDVTLRHLYVDNAAMQVVRDPRQFDVVLTGNLFGDILSDLAAALPGSLGLLPSASVGGTVGLFEPVHGSAPDIAGQDVANPTAAILSAALLLDEVGETAAADAVRHGVDAALDAGFRTADLAADNEEDASTSAFGREVATRAADSVPQNAPTP

SEQ ID NO: 45837 - protein, 380 aa, Geobacillus kaustophilus HTA426
MMKVLFLPLFQMNTGHHKVADTLMDFLRRQFPAVESKKIDFLSYCNELMEKMVSEAYLRWIRSHPASYHRVYKTLMYQEPPRFEFISFEPWLPYFESKMKKMVEEEQPDLIVCTHSFPSRILQRLKRKRVLTVPVVNVYTDFFMNSIWGKRFIDYHFVPHQEAKWELITKYGVDKGRIIVTGIPVHDVFMNRSEARRKRDLAHVLVAGGNQGLGNMLAFLRAARTSTLFRYSVLCGANRQLYEEIASWQLPHIRPLPYIADPEEMNRLYEEADAVITKPGGVTVSELLHKRIPIFTIDCLPGQERINLQYLQQNGLIYHLVGPESGEQHMLRLLMDDVEKNRLFRRVSDYFAGVEKTGQEALAEVVAAMPQRMAWRVLHP

SEQ ID NO: 45838 - protein, 102 aa, Aspergillus oryzae
MSAAKIKAQGIINANAVVVFSKSYCPYCKSSKSLLSQLDAKYLTIELDEESDGSAIQDALVEISGQRTVPNIFIKQKHIGGNSDLQARKSELPALLKDAGAL

SEQ ID NO: 45839 - protein, 169 aa, Triticum aestivum
MAPTVMASSATSVAPYQGLKSTAGLPVSRRSNGASLGSVSNGGRIRCMQVWPIEGIKKFETLSYLPPLSTEALLKQVEYLIRSKWVPCLEFSKVGFIFREHNTSPGYYDGRYWTMWKLPMYGCTDSTQVINEVEEVKNEYPDAYVRIIGFDNMRQVQCVSFIAFKPPGC

SEQ ID NO: 45840 - protein, 274 aa, Alteromonadales bacterium TW-7
MDKYAVFGNPIKHSKSPAIHKQFAISLGEQIDYRAILAPIDSFEKTVSTFFEQGGKGANVTMPFKEQAFAMADELTPLAKIVGAVNTLKKRNDGTLLGDNTDGVGFVNDLLANKVVITNKRILIIGAGGAARGVILPLLEQKPAEIIIVNRTAQKAKDLAQLFAEYGKVSGYGFDDLPVSDYSLIVNSTSSSMNNELPALAKKHLTCCDVAYDMFYSLTNTIFMNWVAEHNNNTKLLDGSGMLVGQAAQAYYVWHNKMPEILPVVKALKQGSLK

SEQ ID NO: 45841 - protein, 106 aa, Malus x domestica
TDVPAPDMGTNAQTMAWILDEYSKFHGHSPAVVTGKPIDLGGSLGREAATGRGVVFGTEALLAEYGRSCKGLTFVIQGFGNVGSWAAKLIHEKGGKVIAVSDITGA

SEQ ID NO: 45842 - protein, 283 aa, Prochlorococcus marinus str. MIT 9301
MTNIQTWIDEYHKGSRFGLNGDVLIKQKSQYQEIIVIENEYYGRALMLDGCWMTSLKDEKYYHECLVHPALSSIDEKSNVLIIGGGDGGTVRECVKYAQISKIDLVEIDEEVIKISKKFLKEIGGEAWHDKRLEIHVDDGVKWVKKTRDNYYDVIFIDCSDPSEFSNLLFSDSFYKECKRILTPKGILATQSESPESFKNIHINILKTLKNIFKVSETMYSFVPIYPSGIWSWTFASSEDLNLSKQNYDEILKIEKGCEIWNLNFQNAAFKMMPNKIIKELDS

SEQ ID NO: 45843 - protein, 557 aa, Shewanella oneidensis MR-1
MDQPWIRHLPKDVPAEINVDQYSSLIDMFETAVAKYADQPAFINMGATLTYRKLEERSRAFAAYLQNELKLQKGDRVALMMPNLLQYPIALFGILRAGMVVVNVNPLYTPRELKHQLIDSGAKAIVVVSNFARTLEEVVDQTPVKSVIITGLGDLLSAPKRTLVNFVVKYIKKLVPKYDLPHALSMRETLSRGRRMQYVKPVITGDDLAFLQYTGGTTGVSKGAMLTHSNVVANVLQANGAYSPALRDGSEFVVTALPLYHIFALTVNCLLFLHKGSQNLLITNPRDIPGFVAELKKYPFTALTGVNTLFNALVNSSDFSELDFSRLKLSIGGGMAVQKAVADKWQNITKTRLLEGYGLTEASPLLTCCPYNLDGYNGSIGFPAPSTLIQVRDDAGNVLPQGETGELFGKGPQIMKGYWQRPEETAKVIDNDGWLATGDIGYMDEQGFFYIVDRKKDMILVSGFNVFPNEVEEVVALHPKVIEVAAVGVPNDASGELVKVFVVKKDKSLTAEDIIKHCRVHLTGYKVPKLVEFRDELPKTNVGKILRRELRDEVKRA

SEQ ID NO: 45844 - protein, 766 aa, Ostreococcus tauri
MTTVKDRAQIQRGDGKGCNCKNSRCLKLYCECFAAGALCASARCRCANCMNTVEHAGERTAAIETVLDRNPNAFRPKIAAVASPSRDVALRHNRGCHCKRSGCLKKYCECFQAAIYCAETCRCVSCENYEGSDAHEEVKRVYGSGARFHDHASAAASPSPSRRKLLAQRAARDSIDGAGAGLARARAPPLMHNLVQQGAVEELARILLVVADETKKALELIDKAKSTKRLDLSGLGLRALPVEALELTELLELQVSNNNLYDLPSEMFERCTKIERLGLAGNRLRRLPKSVGNLKSLRGVWAHGNCLRTIPREIGACESLRNLVLGGNYLAELPEEIEKLKNLEELSAPGNRLRAIPDLGSMPLLREIDLHGNFIERLPEDMSGLRALETLSLQGNRVREVPKSLTKLRRLRALNLAENAMTTLPDEIADMTMLTSVWLYSNALTSLPGTSVRKMPSIRQIWIEGNDGLSGESLDAFVAAVDGSKTLKTLGVDSRQAGKMRTRGAAIVATAEIPENNPRGYFKLVRWPKGDGSTRAPVLVVSFGSAPGVPNWGGLLKKLQKNVRDGDSYDVLYVCDVDRSWYASSDASGDQELEFERWSAPLREACEKYERVLYVGDSMGASAALMFAEHATKVLAFCPQVDLYDASIRPSRSNVWFKRFKGVMMSGLNQSTADIDVHTGSWDHDKDQAALLPRDKVKHIVHQVDSHRLALALDGEEKLLPIIKSAFESELTAARGGGSAEESSSSSSSSSASLNAFAPWQSLGLK

SEQ ID NO: 45845 - protein, 458 aa, Pseudomonas fluorescens
MTTTSSSLADKDMRHQLHPYTNARAHEELGPLVIDRGDGVFVIDENGKPYIEAMAGLWSAALGFSNKRLVAAAEKQMSTLPFYHLFGHKAHAPSIELAEKLINMAPVPMSKVFFTNSGSEANDTVIKLVWYLNNAQGKPARKKIISRIGGYHGITLASASLTGLLANQRGFDVPLPGFLHVGCPHHYRHALPHETEEQFADRLAAELDALIVKEGPETIAAFVGEPLMGPGGVIVPPRTYWEKIQRVCRKHDILVVADEVICGFGRTGKDVRQPDFGIEPDIMILSKQLSSSYQPISAILINDRVYQGIADQTKSFGALGHGFTGGGHPVAAAVRLENLKIIDEENLVVHAAHMGELLRRGLQGFSDHPLVGEVRGAGLIAAVELVADRATKAPLDAPGTLGRFLAGRAQEHGMITRNLGDAIAFCPPLIINEDEDEVQSIVDRFGMALDDTSKWVNG

SEQ ID NO: 45846 - protein, 394 aa, Oceanicola granulosus HTCC2516
MIPSILPTYNRAPLSFEKGAGSWLWTTDGRRFLDLGAGIAVNALGHAHPALVETLTEQAGKVWHLSNLFEIPQQTRLADLIVDKTFADTVFFTNSGTESCELAVKMARRYWSDRGAPERSRILTFTGAFHGRSSAAIAAAGSEKMTKGFGPLLPGFTVLPFGDHDTLREAAAAPDIAAILVEPIQGEGGIRVLPDVCLKGLRDLCDETGALLIFDEVQCGVGRTGKLFAHEWAGVAPDIMMIAKGIGGGFPLGAVAATEAAARAMTAGTHGSTYGGNPLGCAIGARVLEIVGDDAFLAEVNRKAGALRQRLEGLVAAHPEVFEEVRGTGLMLGLKCKPPAADLVAAGYAEEVLTVAAADNVVRLLPALNISDEDIAEAAARLDRAAARLETAAA

SEQ ID NO: 45847 - protein, 391 aa, Rickettsia sibirica 246
MTNNTKTITLNLGPQHPATHGVLRLILEMDGEVVNNADPHIGLLHRGTEKLIEHKTYLQAIPYFDRLDYVSPMCQEHAFALAVESLLECEVPRRAQFIRVLFSELTRILNHTLNIGSQALDIGATTPLLWLFEEREKIMEFYEHVSGSRMHSNYFRPGGVAADLPEGLLEDIDKFIEQFPSKLHDIESLLNENRLWKQRLVDIGVVSQKEAMDWGFSGPMLRGSGIAWDLRKSNPYDVYDEMDFKVPIGKNGDCYDRYFVRMLEMYESIKIIKQCIEKMPKGAIKTDDPKLTPPTRAKMKESMEAMIHHFKLYTEGYDVPAGETYKAVEAPKGEFGVYLYSQGGNRPYRCRIKAPGFAHLQGLDFMSKGHLMADVITIIATLDIVFGEIDR

SEQ ID NO: 45848 - protein, 363 aa, Rhodopirellula baltica SH 1
MGHEFQFTLVLTMSTSEAPAPPESAKRDKLVCDESNDYGSGAVPTEAMAVGETGIDPQRLPRPEETQPLRIMWQYVIVLSLVHLVALAAFVPAWFSYLFTWSGLIAGIAGHFIFGMFGITIGYHRLLTHRGFKCPKWMEHTLAILGMCNLQDSPARWVAIHRMHHQHSDHQPDPHSPLVNFLWGHMGWVVCRHKDLDKTSHYERYVRDLLRDRFYLKLERKDGWFFVFLIHGIIISLIGGAVGYAVSGGDWAVAYRYLLSWTVWAVAIRTVFVLHGTWSVNSLSHVFGYRNYDTRDHSTNNWLVALISHGEGWHNNHHATPRSARHGHKWYEFDMSWGIIRVWEMMGLITDVQRPTKASVAGK

SEQ ID NO: 45849 - protein, 703 aa, Gibberella zeae PH-1
MRSSNWINPILLASSLSAQCMGAVVSNDQKALINDTAHGKKKNIVFILTDDQDSVLDSVSYMPKLKENIIDKGASFINHFTTTAICCPARVSLWTGKQPHSTNVTDVSPPYGGYPKFVSQGLNENYLPVWLREAGYKTYYTGKLFNSHTVNNYNSPYPAGWTGTNFLLDPGTYDYLNPIYQHNQEAPVYHKGEHTSDLIAKYSHDLLKEAIDSNNPFFVAIAPIAPHSDISVDRVAGSGMTIPIPAERHSHLFEGVKVPRTENFNPDSPSGVSWIKELKQFNESSVSHLDNYYRARLQALQGVDEIVEQVTQQLEDAGLLDDTYIIYSSDNGYHLGQHRLPPGKECGFEEDIRVPLFIRGPGISSGAVEKTVTTHIDLAPTILKLAGVELRHDFDGTPIPVLDYEEGKRHEHVAVEFWGVAIAEGGFGGFDGKGLLQVHNNTYKGVRIVHEDYDLYYSAWCNNAHELYDVKTDPGQLNNLFPLDSKATADKEFLGTTVQQVINRLDALMLVLKSCKGNTCIEPWKTIHPDGKVANLKGALTGKFDSFYEEQVKVRFDRCEEGYLVDAEGPQVGCAALCFKHTSTNQDAADLEPREHLTTALPIYDNLTLRSSIESATMGSDAITEPRQATREEMRDAKLPLAYRDSCAHLLIPLNKCRRDTWYAPWKCSDERHSYEKCQYVEFKKRVAKMDELRESKGGARSN

SEQ ID NO: 45850 - protein, 257 aa, Saccharophagus degradans 2-40
MNTNTKRKPIVIANWKLNGGLELICTSVASFIGKHFEADIAICPPYIYMRDMLTFLQHSEISIGSQNVSKFKSGAYTGETSAQMLKEAGCKLCLIGHSERRSMFKENNLSCQIKIGNALNHGLMPILCVGENKEEHDAKITKDVIFRQVTECLEGVELDGRKICIAYEPIWAIGTGASATPEIAQDVHSFIRQELIKLYGEETANSIRLLYGGSVTKDNAKDLLAKEDVDGLLVGGASLDPGHFLAICQHASDSSAS

SEQ ID NO: 45851 - protein, 165 aa, Zea mays
PVGPIPLPPPEGHIIFGGALWPGEGGPIPPFVPQGKGFPRRGGVGFFPEEIQKFGVLGFVMGGGGPPGGNAFRFRKENPVFCVGGKGPLPLFYFGGKSKRGPQVLAAFPPLGQGTLGPDGGPSPDPFVSPEGGVMIFFSTSPPFPGGFPRLGFLPPLVISVFELP

SEQ ID NO: 45852 - protein, 1174 aa, Oryza sativa (japonica cultivar-group)
MEPRRDDVRSAAQSTIHGSSSSAPTSSPVPDYPISGSVKPVLNYSIQTGEEFALEFMRDRAIPKKHLVSGMSHDQNVASGAGLKDPRGLLGAHRTGAESRFDAAIFLTTDIQQTEGIERKSFAENENRSRHVSTSSVPRIPSRSGSSQRLSHGYASSESSDSSRRIKILCSFGGKILPRPSDGKLRYVGGETHIIRISRNISWQELKQKTTAIYNQPHVIKYQLPGEDLDALISVSNDEDLRNMMEECGFLDNGEGSQKLRIFLVSSIDFDDMSFSLGSMDSDSGIQYVVAINGMDVGTTKPSSGHGLGNTSINELDQFINLNNDSNQPNSSRDGSNLYSMSASTAVPPALISVPLPVTLSSDSTANLYPYHSHGMQHVQGSDYSLPASSERFYDIEGQTSIPLSVPSGYRYTSQCTPYSGTTSLQSFDQQSYHDSMMEGSMKEEKQPSVRVPLQKNDLDYFQSLENMSVPVIHHDSSSTNYMNSDVPVTTSIQEGLKSSLQPSDSAKSLETYTASKAMSAAQDSECNEDDRHSSGAFASGCSDFQVDMMDHSNKNPPPHSGRVFHSERIPREQAGSLNRLSKSDDSLNSQFLILQSQSGVAKESIAEASDPAIEGTEKSNLDARAINLNDPATVDSVTPEKECANTVQQTSTFSEQLLGEKRSSTDMSTRNVEKNMHAAENAVAKCNLNDATSDGTKIVNQQADHSAVPHHVSWDTPNPAIPTDVGCDPFVPSTSSLDDSHKEPIIPKKDNKDIVGGMSERTSPDILSDFFANTAAQSLSPFNEPVLSLNMHNYEPQRWSFFRNLAQNEFEHKNKEQDLAKIEEGVYPLDNPPMTKNVEGFQVDNPYTNMHEMMPSVPEFEEPKFEEGKAVGPVMDASFKDNNFEYLQIIKNEDLEELRELGSGTFGTVYHGKWRGSDVAIKRIKKSCFTGRSSELERLANEFWREAEILSKLHHPNVVAFYGVVKDGPGGTLATVTEFMVNGSLRHVLQRKDKYLDRRKRLIIAMDAAFGLEYLHSKNIVHFDLKCDNLLVNLKDQSRPICKVGDFGLSKIKRNTLVSGGVRGTLPWMAPELLNGSSNKVSEKVDVFSFGIVMWEILTGEEPYANMHYGAIIGGIVNNTLRPPVPASCDPEWRRLMEQCWAPDPSQRPAFTEIAGRLRAMSVAANQAKAASK

SEQ ID NO: 45853 - protein, 455 aa, Oryza sativa (indica cultivar-group)
MPLNPSSSASFLLSSLRRSLVASLRKASPAAAAALSPMASASTVAAENGAAKAAAEKQQQQPVQSTLGPGVTVAKRLEKFKTTIFTQMSMLAIKHGAINLGQGFPNFDGPDFVKEAAIQAINAGKNQYARGYGVPELNSAIAERFLKDSGLQIDPEKEVTVTSGCTEAIAATILGLINPGDEVILFAPFYDSYEATLSMAGANVKAITLRPPDFSVPLEELKAAVSKNTRAIMINTPHNPTGKMFTREELEFIATLCKENDVLLFADEVYDKLAFEADHISMASIPGMYERTVTMNSLGKTFSLTGWKIGWAIAPPHLTWGVRQAHSFLTFATCTPMQAAAAAALRAPDSYYEELRRDYGAKKALLVNGLKDAGFIVYPSSGTYFVMVDHTPFGFDNDIEFCEYLIREVGVVAIPPSVFYLNPEDGKNLVRFTFCKDDETLRAAVERMKTKLRKK

SEQ ID NO: 45854 - protein, 361 aa, Tagetes erecta
MSLVNPTSLFYGSPIMTRSPIFLNPTRKSQPVSSFSASNFPQISAILTKEHQSNAPEDKIKETQSKFEFDFKSYMLEKANLVNQALDLAVPLKDPIKIHESMRYSLLAGGKRVRPVLCIAACELVGGDGLTAMPAACAVEMIHTMSLMHDDLPCMDNDDFRRGKPTNHMVYGEEIAVLGGDAMLSFAFEHMATATKGVSSDRILRAIGELAKCIGSEGLVAGQVVDICSEGADVGLEHLEFIHLHKTAALLEGSVVLGAILGGGSDGEIEKLRKFARSIGLLFQVVDDILDVTKSSEELGKTAGKDLVSDKTTYPKLLGIEKSREFAEELNKDAQEQLSEFDPRKAAPLIALANYIAYRQN

SEQ ID NO: 45855 - protein, 560 aa, Ralstonia eutropha JMP134
MDRFWLKHYPAGVPAEIDASQFRSLAQLLEHSFRTYADRRAFVCMDKAITYGELDRMSAHFAAWLQSRGLRPGARVAIMMPNVLQYPVVLAAVLRAGFVVVNVNPLYTPRELEHQLKDSGAEAIVILENFATTLQQVLARTPVKHVVVASMGDLLGGLKGAIVNFVVRNVKKMVPEWELPNCVRFNAVLAEGRKLTLQPATTGPDDVAFLQYTGGTTGVSKGAVLLHRNVVANVLQSEAWMQPALNKGAPIEQVVTITALPLYHIFALTVCCLLGMRNGGMSVLIPNPRDIPGFIKELQKYKFHMFPAVNTLYNALLNNPEIGKVDFSGLRVANGGGMAVQEAVAKQWLAKTGCPIIEGYGLSETSPSATCNPTDSNAFSGTIGLPLPSTEIAIRDDDGRDVPLGQPGEICIRGPQVMAGYWNRPDETAKVMTPDGFFKTGDIGVMDERGYTKIVDRKKDMILVSGFNVYPNEIEGVAAECPGVLEVAAVGVPDTHSGEVVKLYVVKKDPALTEADVIEFCKERLTGYKRPKYVEFRTELPKTNVGKILRRELRDTRQAA

SEQ ID NO: 45856 - protein, 351 aa, Arabidopsis thaliana
MTNAEAVTVTNKQIIFPDYVTGFPKESDLKITTTTIDLRLPEGSTSVLVKNLYLSCDPYMRICMGKPDPLSSSLVPPYKTGVPIIGLGVSKVIDSGHPDYKKGDLLWGLVGWEEYSVITLTTYSHFKIEHTDVPLSYYTGLLGMPGMTAYAGFYEVCSPKKGETVFVSAASGAVGQLVGQFAKLMGCYVVGSAGSKEKVYLLKTKFGFDDAFNYKEEKDFSAALKRYFPEGIDIYFENVGGKMLDAVLINMKLHGRVAVCGMISQYNLVDPEGVHNLPTILYKRIQLQGFGVCDFYDKYPKFLDFVLPYIREGKITYVEDIAEGFESGPSALLGLFEGKNVGKQLFVVARE

SEQ ID NO: 45857 - protein, 467 aa, Geobacillus kaustophilus HTA426
MTTFQELGLSQEVMKAIERMGFEETTPIQAKTIPLSLQNKDVIGQAQTGTGKTAAFGIPIVEKVNVKNSAVQALVVAPTRELAIQVSEELYKIGAVKRVRVLPIYGGQDIERQIRALKKHPHVIVGTPGRIIDHINRGTLRLEHVHTVVLDEADEMLNMGFIEDIEAILSHVPAERQTLLFSATMPDPIRRIAERFMNEPELVKVKAKEMTVPNIQQYYLEVHEKKKFDILTRLLDIQAPELAIVFGRTKRRVDELAEALNLRGYAAEGIHGDLSQAKRLSVLRKFKEGAIEILVATDVAARGLDISGVTHVYNFDIPQDPESYVHRIGRTGRAGKTGVAMTFVTPREIGQLHHIERTTKRKMERMKPPTLDEALEGQQRIAIEKLLNVVETENLSFYKRAAEELLEEHDSVTIVAACLKMLTREPDTTPVQLTEEPPLAVKREKKRGGRPDGSARSRTKKRRITAH

SEQ ID NO: 45858 - protein, 146 aa, Zea mays
KPLQAQIQPIPTLPSTRPQATPNPRSSTDELAGERATEMEAAAAAAGVELGSSKPQIATQAEMAEARVPLAYRDQCAHLLIPLNKCRVAEFYLPWKCEPERHAYEKCQYELVMERMLQMQKIREAQETKVKGGASIGLIPATAKLA

SEQ ID NO: 45859 - protein, 430 aa, Clostridium difficile 630
MSVIELVYAREVLDSRGNPTVEVEVVLEDGAMGRAIVPSGASTGAFEAVELRDGDKGRYLGKGVETAVANVNEIIAPEIEGMDAFDQPAIDAIMIELDGTPNKGKLGANAILGVSMAVARAAADEIGLPLFQYLGGVNAKQLPVPMMNILNGGEHADNNVDVQEFMILPVGACCFKEGLRMGAEVFHSLKKVLGEKGLACGVGDEGGFAPNLGSNREALELIVEAITKAGYKPGEDVMLGLDVAATEMYNKETKKYVLAGEGKELTAAEMVALYEDWSNNFPIITIEDGLDEEDWDGWKLLTEKLGNKLQLVGDDLFVTNTERLEKGIENGVANSILVKVNQIGTITETLDAIEMAKRAGYTAVISHRSGETEDSTIADLAVAVNAGQIKTGAPSRTDRVAKYNQLLRIEEMVGEQARYCGLKSFYNLKK

SEQ ID NO: 45860 - protein, 510 aa, Clostridium difficile 630
MMKKPVALIIMDGFGYNKDVKGNAIAESKTPNLDRIKKEYPNTLINASGLDVGLPDGQMGNSEVGHTNIGAGRIVYQDLTRITKSIKDGDFFTNKVLCEAMDNAKENSLHVMGLLSDGGVHSHIDHLKAIIKMAKDKGVQKVYVHAFTDGRDTDPQSALEYAKEVQASMDEIGVGEFATVSGRYYAMDRDKRWERVELAYNAMVRGIGEKANSIEEAIQNSYDDGKNDEFIMPTVIMKDDKPVGSIKENDSIIFFNFRPDRARQITRALVCEEFDGFKREDIKNFFVCLTEYDITIENVHIAFGPQSLANTLGEYLAKNGKTQLRAAETEKYAHVTFFFNGGVEEPNKGEERLLIPSPKVATYDLKPEMSAYELTDKALDKLGEDKFDFIVLNFANPDMVGHTGSIEAAIKAVETVDTCVGKLIDKIVELGGSAIITADHGNAEYMLDPETGKTVTAHSINPVPFIVVGQEYESAKLLDGGRLSDIAPTILDMMKLEKPEEMTGHSLISK

SEQ ID NO: 45861 - protein, 247 aa, Clostridium difficile 630
MRKPIIAGNWKMHKTIKEALEFVNEIKDKVNSDKVEAVICAPFTLLKDLKEATKGTNIKIGAQNMHFEEKGAFTGEVSPLMLKEIDMDYVVIGHSERRQYFNETDETVNKKVLKALEVGIDPILCVGETLEQREAGKTKDVCKVQVEKALENVLKDDLAKVVVAYEPIWAIGTGKTATAEDANDVISYIREVIKGLYGELANEVRIQYGGSVKPSNVAEIMGQSDIDGALVGGASLASNDYLDLVNF

SEQ ID NO: 45862 - protein, 562 aa, Pseudomonas putida GB-1
MQAEFWNDKRPAGVPSTIDINAYASVVEVFERSCKRFADRPAFSNLGVTLSYAELERHSAAFTAWLQQHTDLKPGDRIAVQMPNVLQYPIAVFGAMRAGLIVVNTNPLYTEREMRHQFKDSGARALVYLNMFGKRVQEVLPDTGIEYLIEAKMGDLLPTAKGWLVNTVVDKLKKMVPAYNLPQAVPFKQVLREGRGLSPKPVPLNLDDIAVLQYTGGTTGLAKGAMLTHGNLVANMLQVLACFSQHGPDGQKLLKDGQEVMIAPLPLYHIYAFTANCMCMMVTGNHNVLITNPRDIPGFIKELGKWRFSALLGLNTLFVALMDHPGFRQLDFSALKVTNSGGTALVKATAERWEALTGCRIVEGYGLTETSPVASTNPYGQLARLGTVGTPVAGTAFKVIDDDGNEMPLGERGELCIKGPQVMKGYWQQPEATAQALDAEGWFKTGDIAVIDPDGFTRIVDRKKDMIIVSGFNVYPNEIEDVVMGHPKVANCAAIGVPDDRSGEAVKLFVVPREGGLSVDELKAYCKANFTGYKVPKHIVLRESLPMTPVGKILRRELRDIA

SEQ ID NO: 45863 - protein, 400 aa, Clostridium difficile 630
MSMLNKKTIEDIDVCGKKVLVRCDFNVPLQDGVITDENRLNGALPTIQYLISKGAKVILCSHLGKPKGEAKPELSLAPVAKRLSEMLGKEVVFAADDNVVGENAKKATEKMENGDVVLLENTRYRKEETKNEENFSKELASLAEIFVNDAFGTAHRAHCSTVGAGEFLQERVCGYLIQKELKFLGEAVANPVRPFTAILGGAKVSDKLAVINELLEKVDNLIIGGGMAYTFLKAQGYEVGTSLLEIDKVEYAKEMMEKAKNKGVNLLLPVDVVMADHFAPDATPIVTEDANVKEDYMGLDMGPKTIANFVKTIKESKTVVWNGPMGVFEFENFANGTLSVARAMAELTDATTVIGGGDSAAAVNQLGFGDKMTHVSTGGGASLEFLEGKELPGIAALDNK

SEQ ID NO: 45864 - protein, 390 aa, Arabidopsis thaliana
MENGNSSSDNKSSHKPIRCKAAVSRKAGEPLVMEEIMVAPPQPFEVRIRIICTALCHSDVTFWKLQVPPACFPRILGHEAIGVVESVGENVKEVVEGDTVLPTFMPDCGDCVDCKSHKSNLCSKFPFKVSPWMPRYDNSSRFTDLNGETLFHFLNVSSFSEYTVLDVANVVKIDSSIPPSRACLLSCGVSTGVGAAWETAKVEKGSTVVIFGLGSIGLAVAEGARLCGASRIIGVDINPTKFQVGQKFGVTEFVNSMTCEKNRVSEVINEMTDGGADYCFECVGSSSLVQEAYACCRQGWGKTITLGVDKPGSQICLDSFDVLHHGKILMGSLFGGLKAKTHIPILLKRYLSNELELDKFVTHEMKFEEINDAFQLLLEGKCIRCVLWMG

SEQ ID NO: 45865 - protein, 257 aa, Rhizobium sp. NGR234
MTSSALPRTPSFRLDGKTALVVGASSGIGQAAAVALAEAGANVTLAARSIDKLERTVEALQHMELSATALALDVEDVEATELTIESGAAFDILVNSAGLACHGPALETTIADFDTVMGINVRGAYFVTRAVARKLVATGRTGSLINISSQMAHVGGIDRAVYSATKHAVEGFTKSMAIEWGMHGIRVNTICPTFIRTPLAERTFANPERVRWIEEKIKLGRIGELEDIMGPVTFLASEAAAMITGSALMVDGGWTAD

SEQ ID NO: 45866 - protein, 235 aa, Streptococcus pyogenes M49 591
MNVTGEEVIALAATYMTKADVAFVAKALAYATAAHFYQVRKSGEPYIVHPIQVAGILADLHLDAVTVACGFLHDVVEDTDITLDEIEADFGQDARDIVDGVTKLGKVEYKSHEEQLAENHRKMLMAMSKDIRVILVKLADRLHNMRTLKHLRKDKQERISRETMEIYAPLAHRLGISRIKWELEDLAFRYLNETEFYKISHMMKEKRREREALVEAIVSKVKTYTTQQGLFGDVY

SEQ ID NO: 45867 - protein, 321 aa, Magnaporthe grisea 70-15
MAYGAKTTGSAIVGDYASQIANKTILTTGVSPTTLGAAFVTTIATASPALLILAGRNLAKAEETAEAIRAVAPQVPIRTLELDLADKQSVRKAAATVLAWDDVAGIDVLVNNAAIITDEYGTIEGIERVFAVNHLGPFLFTNLVLPKVLAVKGRVVNVASEGHRFSNVRFMDLNFEDGKIYNKWRAYGQSKTANMLFSLSLARKLGSRGLVANSPHPGTIITPLSEGMDLALEYELTRPYDQFVGYYPKERGVIKTLDEGISTHIYAAFEPSLKDHNGTFLLDCHVADPNVDFVMSWAASEVEAEKLWKLSEELVGEKFEW

SEQ ID NO: 45868 - protein, 455 aa, Burkholderia vietnamiensis G4
MTNTQKPWGSRETASFFHTFTDLPSLREDGATVIDHGEGPFIVDTNGNRFFEGNSGLWNMTLGFSEHRLAKVAAEQYSAFPGYHTFFGRNSKPTVELSERMLALAPVPMSRVFFTNSGSEANESVIKLLWMMWAAEGQPQRRKLLTRKNAYHGATVMASALTGKDYVKAFGLPTPDVITLDCPHAWRFAQAGESEEAFVKRLVSNLEKTILAEGPDTIAGMFAEPVMGAGGVIVPPAGYFEQVQAVLKKYQIPLVADEVICGFGRTGNLWGCQTVGLRPDIIVASKSMSAGYFPVGAVMLSAEIDRRATAASEQWEEFPHGFTTAGHPVACAVSLEAIRIITDEGILENVQKVGRKFQDGLRALADHPMVGDVRGVGLMGALEMVSDKSSKTSFSGELRVGERIAKAAREFGYIIRPLGASVVLAPPFITTSEQIDDLLTVLKRVLDSVYKDISG

SEQ ID NO: 45869 - protein, 569 aa, Aspergillus oryzae
MSGAVSRLSGLLGHFVPGAEQRVNFHTLSPTSFLPRAAAIEPEAVAIHHVTANNQVLRRTYAETADRARGLAYYLKKHGFKRVGVLCPNTPAFLESIFGIAAAGAVNVAVNYRLKEDDIAYIFTHSDVEAIIVDQEFLSLLQSYRASRPSIPIIVDMDTDATEGELSGPFDEVVLEGLTYDLDTGAKGWPGLEAQAASEDDVIALAYTSGTTARPKGVEYTHRGCYLAAMGNVIESGLNSHRGRCRYLWTLPMFHACGWTFPWAVTAVRGTHYCLRKIDYPQIWKLLKQEHITHFNAAPTVNTLLCNSKEAEPLPEPVHVTVAASPPTPHLFEQMTNLNLHPVHVYGMTETYGPITKGYYLPAWDNLPSSERYKKMARQGHGFVTSLPVRVIKTDVAEGTVIDVARDGKEIGEIVFVGNICARGYYKDPDATRKLFAGGVLHSGDLAVWHADGSIQIQDRAKDIIISGGENISSVALESMLVTHPDILEAGVVAVPDSHWGERPKAFVTVKPGKFLTGSEVIEWARNASDISKFMIPREVEVVAELPKTSTGKVRKNILRDWAKGANRS

SEQ ID NO: 45870 - protein, 587 aa, Aspergillus oryzae
MPRSRQPARFSSEAPSESSSSTSPDRNVDDDTDFFTAQANDSQSSVGGIATSRDVHAQNEHYVLPPIGRLPPELLIAIFAKLSSPADMLSCMLVCRGWAANCVGILWHRPSCSNWVNMKSITMTVGKEDSFFSYSDLIKRLNLSALMEEVSDGTVVPFAQCNRIERLTLTNCSKLTDKGVSDLVEGNRHLQALDVSDLRSLTDHTLYTVARNCPRLQGLNITNCVKVSDDSLIVVSENCRHIKRLKLNGVIQVTDRAITSFARNCPAILEIDLHDCKSVTNRSVTSLMATLSNLRELRLAHCTEINDLAFLELPKQLSMDSLRILDLTACENIRDDAVERIISSAPRLRNLVLAKCRFITDRAVWAICKLGKNLHYIHLGHCSNITDAAVIQLVKSCNRIRYIDLACCVRLTDRSVQELATLPKLRRIGLVKCTLITDRSISALARPKASPHSSISSLERVHLSYCVNLTMPGIHALLNNCPRLTHLSLTGVQEFLRDELTKFCREAPPEFTHQQRQVFCVFSGDGVKQLRDHLNRTVPPAREMNEATMYDDDEELDEDEGQVTGLMHATAINDDDDDYIDIGHPQG

SEQ ID NO: 45871 - protein, 279 aa, Shewanella oneidensis MR-1
MKLETIDYRAADSAKRFVESLRETGFGVLSNHPIDKELVERIYTEWQAFFNSEAKNEFMFNRETHDGFFPASISETAKGHTVKDIKEYYHVYPWGRIPDSLRANILAYYEKANTLASELLEWIETYSPDEIKAKFSIPLPEMIANSHKTLLRILHYPPMTGDEEMGAIRAAAHEDINLITVLPTANEPGLQVKAKDGSWLDVPSDFGNIIINIGDMLQEASDGYFPSTSHRVINPEGTDKTKSRISLPLFLHPHPSVVLSERYTADSYLMERLRELGVL

SEQ ID NO: 45872 - protein, 158 aa, Brassica napus
  misc_feature (12)..(12): Xaa can be any naturally occurring amino acid
  misc_feature (14)..(16): Xaa can be any naturally occurring amino acid
  misc_feature (19)..(19): Xaa can be any naturally occurring amino acid
  misc_feature (21)..(22): Xaa can be any naturally occurring amino acid
  misc_feature (26)..(26): Xaa can be any naturally occurring amino acid
  misc_feature (32)..(32): Xaa can be any naturally occurring amino acid
  misc_feature (35)..(35): Xaa can be any naturally occurring amino acid
  misc_feature (50)..(50): Xaa can be any naturally occurring amino acid
  misc_feature (54)..(55): Xaa can be any naturally occurring amino acid
  misc_feature (57)..(57): Xaa can be any naturally occurring amino acid
  misc_feature (60)..(62): Xaa can be any naturally occurring amino acid
  misc_feature (65)..(65): Xaa can be any naturally occurring amino acid
  misc_feature (92)..(92): Xaa can be any naturally occurring amino acid
  misc_feature (94)..(94): Xaa can be any naturally occurring amino acid
  misc_feature (100)..(100): Xaa can be any naturally occurring amino acid
  misc_feature (105)..(105): Xaa can be any naturally occurring amino acid
  misc_feature (114)..(115): Xaa can be any naturally occurring amino acid
  misc_feature (118)..(118): Xaa can be any naturally occurring amino acid
  misc_feature (121)..(121): Xaa can be any naturally occurring amino acid
  misc_feature (126)..(126): Xaa can be any naturally occurring amino acid
  misc_feature (137)..(140): Xaa can be any naturally occurring amino acid
  misc_feature (144)..(144): Xaa can be any naturally occurring amino acid
  misc_feature (149)..(149): Xaa can be any naturally occurring amino acid
MVSSMLSSAAVXTXXXQDXMXXPFTXLKSSAXFPXTRKANNDITSIASPXGRVXXMXVGXXXGKXKFETLSYLPDLTEVELYKEVDYLLRNXWXPCDEFXLQNGXVYREHGSTXXYYXGRXYWTMXKLPLVACADSXXXXNESXECKTXYPNAFIKII

SEQ ID NO: 45873 - protein, 427 aa, Burkholderia xenovorans LB400
MAIVEVKVPQLSESVSEATMLQWKKKPGEAVAQDEILIEIETDKVVLEVPAPSAGVLAQVIANDGDTVTADQVIAKIDTEGTASAAAVEAEVKPAPQAAPAPAAAPAPAAQAASATGANTAASPAAGKLMAEKGLGAGDVAGTGRDGRITKGDVLTAGAPAAKAAAPAPAAAPKAAKPSLPDVKAPASAEQWLKDRPEQRVPMSRLRARIAERLLESQQTNAILTTFNEVNMAPVMDLRNKYKDKFEKEHGVKLGFMSFFVKAAVHALKKFPLVNASIDGNDIVYHGYFDIGIAVGSPRGLVVPILRNADQLSLAEIEKKIAEFGQKAKDGKLSIEEMTGGTFSISNGGVFGSMLSTPIINPPQSAILGVHATKERAVVENGQIVIRPMNYLALSYDHRIIDGREAVLSLVAMKDALEDPARLLLDL

SEQ ID NO: 45874 - protein, 523 aa, Rhodococcus sp. RHA1
MADIEQQRPVLVVDFGAQYAQLIARRVREAKVYSEVVPHTATVEEIAAKNPLAVVLSGGPSSVYADGAPQLDPALFDLDIPVFGICYGFQAMAGALGGTVAHTGTREYGRTDLKVQGGLLHEGLPASQPVWMSHGDAVTEAPAGFEVTATSEGAPVAAFEDRARKLAGVQYHPEVLHSPHGQQVLSRFLHEIAGIPPAWTAANIADALVEQVREQVGDGKAICGLSGGVDSAVAAALVQRAIGDNLTCVFVDHGLMRAGERAQVEQDFVAATGAKLITVDAADTFIGELAGVSDPETKRKIIGREFIRSFEGAVSDVLGENAAHGDTVEFLVQGTLYPDVVESGGGTGTANIKSHHNVGGLPEDLQFTLVEPLRLLFKDEVRAVGRELGLPEEIVGRQPFPGPGLGIRIIGEVTQDRLDILRHADSIAREELTAAGLDGQIWQCPVVLLADVRSVGVQGDGRTYGHPIVLRPVSSEDAMTADWTRLPYDVLERISTRITNEVHDVNRVVLDITSKPPGTIEWE

SEQ ID NO: 45875 - protein, 476 aa, Burkholderia xenovorans LB400
MSKEFDVVVIGAGPGGYIAAIRAAQLGKTVACIEKWKNPAGALKLGGTCLNVGCIPSKALLASSEEFENASHHLADHGISVENVKVDIAKMMARKEGIVEKMTKGIEFLFRKNKITWLKGHGKFTGKTDAGVQIEVSGEGETETVTAKNVIIATGSKARHLPNIPVDNRIVADNEGALSFESTPKKLAVIGAGVIGLELGSVWRRLGAEVTVLEALPEFLGAADQALAKEAAKQFKKQGLDIHVGVKVGEVKTTDSGVTIAYTDKDGNAQTLEADRLIVSIGRVPNTDNLGLEAIGLKANERGFIDVDEHCATAVPNVYAIGDVVRGPMLAHKAEDEGVLVAEIIDGQKPHIDYNCIPWVIYTEPEIAWVGKTEQQLKAEGREIKTGQFPFMANGRALGINKADGFVKMIADAKTDELLGVHIISANASDLIAEAVVAMEFKAASEDIGRICHPHPSLSEVMREAALAVDKRALNM

SEQ ID NO: 45876 - protein, 717 aa, Novosphingobium aromaticivorans DSM 12444
MVREIKGDANVNLVVLSIILGLLAVVYGFVTSRQVLGAPAGNSKMQEIAAAIQEGAQAYLKRQYTTIAIVGVVVAVIIAATLGTISATGFVIGAVLSGVAGFIGMNISVRSNVRTAAAAQNGLQAGLTLAFRAGAITGMLVAGLALLAIAVFYHYLTDIAGYTVGGDDRTVVDGLVALAFGASLISIFARLGGGIFTKAADVGADLVGKVEAGIPEDDPRNPAVIADNVGDNVGDCAGMAADLFETYVVTVGATMVLTALLLKGLGAALAPMMALPLLIGGVCIVTSIIGTYFVKLGSSNNIMGAMYKGFLVTAVLSVGAIWWAISYALGDMETSMSYTILDNTVTFSGRVLFYCSLLGLVITGLIIWITEYYTGTNYRPVRSIAKSSETGHGTNVIQGLAISLESTAMPTIVICAGIIIAYQLAGLIGIAYAATAMLALAGMVVALDAYGPVTDNAGGIAEMAGLDDSVREKTDALDAVGNTTKAVTKGYAIGSAGLAALVLFAAYTTDLREFFPNLAVSFSLENPYVIVGLLLGALLPYLFGAMGMTAVGRAAGDVVIDVRDQFRENPGIMAGTSKPDYARTVDLVTKAAIKEMIVPSLLPVLAPIAVYFVIAAVGGQANGFAALGALLLGVIVGGLFVAISMTSGGGAWDNAKKYIEDGNHGGKGSDAHKAAVTGDTVGDPYKDTAGPAVNPMIKITNIVALLLLAALAAHAAG

SEQ ID NO: 45877 - protein, 139 aa, Bacillus cereus E33L
MTRVRDVMSTHIVQCTPLDNVYEAAVKMKEESIGLIPVVENEQVVGLVTDRDLVVRGIAEKHPGSNKITNVMTTNIISVSPDDSIEKATELMAQHQIRRLPVVESGQLVGMLALGDLAIRESADDQAGFALSEISEHTK

SEQ ID NO: 45878 - protein, 96 aa, Zea mays
  misc_feature (67)..(67): Xaa can be any naturally occurring amino acid
AVVFVFSLLDCCALIFLSVYFIITLSDLECDYINARSCCSKLNKWVIPELIGHTIVTVLLLMSLQRXIFLLNLPVATWNIYRYIMVPSGNMGVFDP

SEQ ID NO: 45879 - protein, 565 aa, Pseudomonas putida GB-1
MIENFWKDKYPAGITAEINPDEFPNIQAVLKQSCQRFADKPAFSNLGKTITYGELYALSGAFAAWLQQHTDLKPGDRIAVQLPNVLQYPVAVFGAMRAGLIVVNTNPLYTAREMEHQFNDSGAKALVCLANMAHLAEKVVPKTQVKHVIVTEVADLLPPLKRLLINSVIKYVKKMVPAYSLPQAVRFNDALALGKGQPVTEANPQANDVAVLQYTGGTTGVAKGAMLTHRNLVANMLQCRALMGSNLHEGCEILITPLPLYHIYAFTFHCMAMMLIGNHNVLISNPRDLPAMVKELGKWKFSGFVGLNTLFVALCNNEAFRALDFSALKITLSGGMALQLSVAERWKAVTGCAICEGYGMTETSPVAAVNPAEANQVGTIGIPVPSTLCKIIDDAGNELPLGEVGELCVKGPQVMKGYWQREDATAEILDSEGWLKTGDIALIQADGYMRIVDRKKDMILVSGFNVYPNELEDVLAALPGVLQCAAIGVPDEKSGEVIKVFIVVKPGMTVTKEQVMEHMRANVTGYKVPRQIEFRDALPTTNVGKILRRELRDEELKKQGLKKIA

SEQ ID NO: 45880 - protein, 591 aa, Triticum aestivum
MRNCSGVILILSLAALLFLLSPSPLTTHQPATYPAGSVADLLPSLPGLSGLYPAPANSTAHLSWHLLRPILSRSDAIPGTAAGVLEAAAAWRNLTAAVAAAAAGSNQETRNASCRASVGGDLRARGVKIPCGLAEGAAVTVVAVPKQGAARFQAELVGGGGEVVACFNVSLGPSGMVVEQSSWTREDGWGEWERCPPLGHIGSNSSWQLSPVDALVRCNQQVSVNNIQGSSNTTQNVSANQPEDEKRLKGRAHFSGSTAIVEGEPFTATLWAGAEGFHLTVNGRHETSFAYRERLEPWSVADVRLSGDLELLSILANGLPVSEDVDMASVELLKAPPVPKKRIFLLVGVFSTGNNFKRRMALRRTWMQYESVRSGEVAVRFFTGLHKSEQVNMELWREGQLYGDIQFMPFVDYYTLITLKTVAICTFGTKIMPAKYIMKTDDDAFVRIDEVISSLKKANPHGLLYGLMSFQSSPHRDKDSKWFISPKEWPVETYPPWAHGPGYIISRDVAKFVVQGHQERKLQLFRLEDVAMGIWIQQYKDSGQQVNYANDERFYNEGCDSDYVLAHYQSPRLMMCLWEKLQKESQAVCCE

SEQ ID NO: 45881 - protein, 430 aa, Helicobacter pylori J99
MELLHSINDFNEAKQVIAGGVNSPVRAFKSVKGTPPFILKGKGAYLYDVDNNHYIDFVQSWGPLIFGHADEEIEENIINVLKKGTSFGAPTELETTLAKEIISCYEGLDKVRLVNSGTEATMSAIRLARAYSQKDDLIKFEGCYHGHSDSLLVKAGSGCATFGSPSSLGVPNDFSKHTLVARYNDLNSTEECFKKGDVGCVIIEPIAGNMGLVPAQKEFLLGLKALCEKYQAVLILDEVMSGFRASLSGSQEFYGVVPDLVTFGKVIGAGLPLACFGGRAEIMDLLSPIGGVYQAGTLSGNPLAVCAGLSALYKIKRDKTLYTRLNALAVRLTQGLQKSAQNYNIALETLNMGSMFGFFFNENAVRDFDDALKSDTEMFAKFHQKMLFKGVYLACSSFETGFICEPMTEEMIDLAISKADESFDEIINGV

SEQ ID NO: 45882 - protein, 509 aa, Oryza sativa (indica cultivar-group)
MGRTEGRLASVVHLPGRSRVSASPSPSRSPSPRRNRRRDRSPSPYRSRRDRSPSPYRDRRRQWSPYHRDRGRDVEREWARDRDHPAPRRGGGGGGGGAGGGAWSASDDDDDEQLKGLTYFEYRRVKREKLRKSMKRCIWNITPSPPRREGEDEDYGYSDEEEEEEEKKESPKKVASSDKSEEEDSKGSSESDSGESDSLSDSSKSDDTQRKKKGRKGSHRSSKRSRHRRRHHSSDTEGDDNSKAEEDSEGSYDSEDSMDRRKKKRSRRHKKSKRRGRSSRRKKRKSNDTASEGSSEEEAVAAASASSPSPLRDSKKKSRSSRRKRSKQSDTEDQAPSDADLGVKEIDETNEPEIDPEAIKFKEMLEAQKKAALENEMPVGPMPLPRAEGHISYGGALRPGEGDAIAQYVQQGKRIPRRGEVGLSAEEIQKFEDLGYVMSGSRHQRMNAIRIRKENQVYSAEDKRALAMFNYEEKSKREHKVMADLQRLVQRTIGNDVGPSHDPFATADG

SEQ ID NO: 45883 - protein, 891 aa, Oryza sativa (indica cultivar-group)
MASSQGLKKNYRCDRSLQQFYTGGPFAVGSSPGGGEGEVEGGEAEAEAFLACACGGEVRLVSAADASAIGEPIEGENEAVTALALSPDSRLLFTAGHSRLIRVWDLASRTCTRSWKGHDGPIRAMACHASGGLLATAGADKKVCVWDVDGGFCTHFFRGHAGVVTTVMFHKDPKRLLLFSGSEDATVRVWNLESKTCVAVLKEHFSAVTSLALSEDGQTLLSAGRDKIVNVWDVRKYNSKKTIPAFEMIEDVSFIGPGSNLLSCLGEPANIKRKTDGYFLTVGERGVVRIWCLESAQCIYEQQSSDVTINTENEESRRGFTSAVMLSDDQGLLCATADQQFLFYCPTRTDGGDFQLNLYKRLVGYNDEILDLKFVGEDEQYLAVATNLEQVRVYDVASMSCSYVLSGHTEIVVCIDTCISSSGKTLVVTGSKDSTVRLWDMERRSCIGIGKGHLGAIGSVAFSKKSKNFFVSGSSDRTIKIWSWDDTLDDVGSEVPLKAKAVVAAHDKDINSLSVSPNDGLVCSGSEDRTACIWKLPNLVPSVVLKGHKRGIWSVEFSPVEQCVITSSGDRTVKIWAVADGSCLKTFEGHTSSVLRASFLSHGTQFVSCGSDGLVKLWTIKTNECIATFDKHDGKVWALAVGKKTEMLATGGTDAVLNLWHDCTMEDKQEDFRKKEEELLRGQELENAVSDYDYAKAIQLAFELRRPHRLLELFTQLCRESDLEDPIEKALIGLPKEGLRVLLEYIREWNTKPKLCHVAQFVLFRVLRSLPPTDILEIKGISELLEGLIPYSQRHFSRVDRLVRSTFLLDYTLTRMSVVDPDIDEGTTRDDANGSSVENCEIAQAKPDALVAEENLQKSVKKRKSSKSSKKGGKKVKIASTGGSKDVPIEA

SEQ ID NO: 45884 - protein, 333 aa, Desulfovibrio vulgaris subsp. vulgaris str. Hildenborough
MSLNLGINGFGRIGRYLVRLLAEDNELSIAAINARADNASLAHLFKYDSCHGRFNGEVGHDADGLIVNGRHIAVTREKINEWRWGELGIDLAVETSGTVKDRAGLAQHIARGAKKCVISAPGKDADVTIVMGVNHGDYDPAKHDVISAASCTTNCLAPAAKVVHETFGIRHGIMTTVHSYTMSQRILDGSHKDLRRGRAAALSMIPTTTGAAKATALVYPALAGKLDGMAVRVPTPNVSLVDLTCELERETTVEEVNAALKAAAAGPMLGNMGFCEEPLVSIDFMGSTFGGVVDAQCTSVIDKTMLKLIIWYDNEAGFTNQLVRLLRMVGKSL

SEQ ID NO: 45885 - protein, 204 aa, Streptococcus pyogenes M49 591
MEAEMVTVSKEQHLDMFLKMERIREFDSRINKLVRRGFVQGMTHFSVGEEAANVGAVAHLSYDDIIFSNHRGHGQSIAKDMDLNKMMAELAGKATGASKGRGGSMHLADFEKGNYGTNGIVGGGYALAVGAALTQQYKGTNNIAVAFSGDGATNEGSFHESVNMAATWKLPVIFFIINNRYGISMSINNATNTPHLYTRITRRP

SEQ ID NO: 45886 - protein, 293 aa, Oryza sativa
PTCALPRLAQAPCAAGMPFPRRDIEAAGAGSGSGDDDSPAAKRGKPEAAGARPSLTRTEAAAAASVLVLFLVGIFCVFRAAPRREFEQILRLPRSLADVRLLKDNLAVYARDYQANFILGYCSIYIFMQTFMIPGTIFMSLLAGALFGVVKGGILVVFTATAGASSCYFVSKLIGRPLISWLWPEKLRYFQSEIAKRKEKLLNYMLFLRITPTLPNTFINMASPIVDIPFHIFFAATLIGLIPASYITVKAGRALGDLRSLRELYDSKTLVILFLIGTVAVAPTILKRKRIYE

SEQ ID NO: 45887 - protein, 137 aa, Streptomyces coelicolor A3(2)
MTQRSLVLLKPEAVRRGLTGEIISRIERKAGWQITALELRTLDTETLEQHYGEHKGKPFYEPLVEFMASGPVVAMVVEGERVIEGVRALAGPTDPIAAAPGSIRGDYGVIVRENLIHASDSEESAERELKIFFPGRV

SEQ ID NO: 45888 - protein, 365 aa, Sinorhizobium meliloti 1021
MTGSGEQTFLFEQNPTRVANSERDALLANPGFGRVFTDHMATIRYSEGRGWHDAKIGPRKAFDLDPSTLVLHYAQEIFEGMKAYRLPDGGATLFRPDANARRFRNSALRLAMAPLPEELFVQSVRELVRIDRDWIPAGEGAALYLRPFMIATEVLLGVKPSAEYLYCVIASSVGSYFKGGAPAITIWVSENYTRAAPGGTGEAKCGGNYAASLAAQAEAMQEGCEQVVFLDAVERRFVEELGGMNVFFGFRDGSLQTPPLTGTILPGITRDSLITLARDMGLTVREEPYAIDQWQADAESGRLTEAFACGTAAVVTPIGKVKGREHSFTIGDGGAGPVASRLKSALLDIQNGRAPDPHGWLDRLF

SEQ ID NO: 45889 - protein, 400 aa, Oryza sativa (japonica cultivar-group)
MAAAAAATNGGFDVIVVGGGIMGSCAAYAAASSSASRCGGARVLLLERFDLLHHRGSSHGESRGIRATYPQARYPPMVRLAARLWGNAEAEAGYRVLTPTPHLDMGPRADPALRAAIQNGGVAEVVGASDDSAASWLWSAGHQAVSMFQLLAPKKGPFLRDRTEVIDIAKQGDGSILVKTSSGEEFHGAKCIITVGAWASKLVKSVAGVDLPVQPLHTLICYWKARPGREHELTPESGFPTFASYGDTCIYSTPSMEFPGLIKVCAHGGAPCDPDRRDWCAGGDALADPVARWIDELMPGHVDTAGGPVIRQSCMYSMTPDEDFIIDFVGGEFGKDVVVGAGFSGHGFKMGPAVGRILAEMAMDGEAKTAAEAGVELGYFRIGRFEGNPEGNRAENKVKI

SEQ ID NO: 45890 - protein, 244 aa, Oryza sativa
EPPSSPPNPQIPKSNPPPPKPSLSQPQEPRRDHSRSSNAPLMTDLDDNIVAIPNPSGRGPGYRYFGAAKKLPGVRELFDKPPEVRKRRTRYEIHKRINAGYYGYYDDEDGMLERLEAVAEKRMRNEVITEWHRVERVRREAMKGVVSGEVASAGGRGGEAAREVLFEEVEEEVEEERRLEEEKREREKGEEAGKEFIAHVPLPDEKEIERMVLERKKKELLSKYTSDALQVEQEEAKEMLNVRR

SEQ ID NO: 45891 - protein, 286 aa, Prochlorococcus marinus str. MIT 9301
MISSKTSFIALIGNPVSHSFSPIMQNAAFQYLGLDLIYFAIPCKDEDLELVLNSLKKINCKGLNITIPHKEKVFNLCSEISPIARKLKAINTLKLNSENEWSATNTDLEGFIYPLKNLNLAKKKSIVLGSGGAAKSVIQGLINLNLSKISVIGRNKSSLDELIKNFGNQIELHSFLSNDNQTQNLIEEADLIINTTPVGMKTAKNEMNLLPYGDYFWRSLNSKTIVYDLIYNPAPTHLLKFSANKGCMTIDGLQMLVAQGLKSLSFWTNGLEVPFHIMNDALKNHL

SEQ ID NO: 45892 - protein, 276 aa, Listeria monocytogenes str. 4b F2365
MKKITPKAMCAWIPKREDETHKGDYGRVLIVAGNKQFGGAAIMAAEACVKSGAGLTTVASDSVNRPALQTRIPECMFIDYENISSLSEQISQFDTILIGPGLGLDAYAEEIFRLVLEKSTEQQQVIIDGDGITIYAKGENPHPAAKLTFTPHAGEWERLKVLAPDAVTPTDVALAIDATIVLKGHRTKVYSGESAWQNMYGTPAMATGGMGDTLAGTICGLMAQTEKPITGTLAAVFLHSYIGEILAKKRYVVLPTEIAEELPTYLKIFSETDEHA

SEQ ID NO: 45893 - protein, 499 aa, Burkholderia vietnamiensis G4
MKASTILSDLGIAHLAGAGDIEVRSPINGEVVGRVASQTVSDVDAALASAQEAYKAWRNVPAPRRGELVRLLGEKLREQKQALGSIITLETGKILQEGLGEVQEMIDICDFAVGLSRQLYGLTIASERPGHRMAETWHPMGVCTVISAFNFPAAVWSWNAALALVCGNAVIWKPSEKTPLTALAVDKILHDALKEFGDAPAGLTALINGGRDVGAKLVSDSRSNIVSATGSTEMGRAVGIEVARRFGRSLLELGGNNAGIVSNTADLELALRGILFSAVGTAGQRCTTLRRLFVQESIYDKVVDRLKTFYAKVAIGNPLEQGTLMGPLIDGQSFSRMQAALEQAKSEGGKVFGGERHVVAGNENGFYVRPAIVEMPSQTDIVLQETFAPILYVLKYSDFNEALEANNAAHHGLSSCVFTTDLRESERFLSASGSDCGIANVNIGPSGAEIGGAFGGEKETGGGRESGSDAWKAYMRRATNTVNFSSALPLAQGIDFNID

SEQ ID NO: 45894 - protein, 257 aa, Magnetospirillum magnetotacticum MS-1
MISIEGAKEMKFEDKVALITGGASGIGYCTVKSMAELGADVLIADINVEAGEKAATELKAKGLKAEFVRLDVTDKANIARVKEHVLATRGRLDILCNVAGWGHIQPFVDNDDAFIAKVMSLNLTGPIELIRAFFPLMIEKKTGKIVNVASDAGRVGSLGESVYSAAKGGLISFSKALAREGARYNINVNAICPGPTDTPLLKSEPEKFLEAFLKVIPMRRFGQPQEVADSIVFMASNRADYITGQVLSVNGGITMVG

SEQ ID NO: 45895 - protein, 317 aa, Magnetospirillum magnetotacticum MS-1
  misc_feature (291)..(291): Xaa can be any naturally occurring amino acid
  misc_feature (296)..(296): Xaa can be any naturally occurring amino acid
MLETGFFSLGTPGRLDADLEFILAKVAELKLPKLYELGPVGARTEFALRLSRSNPPAPHGVEAEDITIAGIPARRYQPQGGPKAKAMLLYFHGGGFVVGDLETHDPHCRALAAESGSVVVALHYRLGPEHPYPAAIQDGIAALKWAAAEYAGWTLGVAGDSAGGTLSAVVALHARDLNIPLALQMLIYPAVDQKGDFPSRTRLADGYLLTQGDIEWFTQQYFVGHEGPVLEPDASPLRAASHGGLAPALVLTCGFDPLVDEGDAYAQALIGAGVPVRHVRLEGSIHGCLGXWPGLXVALGQASLGGGLRGLAVRSSP

SEQ ID NO: 45896 - protein, 296 aa, Aspergillus nidulans FGSC A4
MSRMAKDNTFQAPESAQTQNTPGLESKMQPASEATKLETSDGIKDYKGSGKLQGKKALITGGDSGIGRSVAALYAKEGADITIVYLPVEEEDAQETKRLVEAEGRQCLLLSGDLRDRGFCKQAVDSHVQKYGHINILVNNASQQFSCPDLAQINLDTVTDVFQTNIIQMFAMTKFSLPHMSKGDSIINNTSVTAFRGTGSMVDYASTKGAIVGFTRSAALQLIPKGIRVNAVAPGSTYTPIQVDTRDAEQMQGWASSKPLGRPGQPSEVATSFVFLASSDASLFYGQILHPYPLGE

SEQ ID NO: 45897 - protein, 500 aa, Oryza sativa (indica cultivar-group)
MAASFVIVIVISFFISLAFMCYVHYTSRQRRKLHGYGHEKAVRLPPGSMGWPYIGETLQLYSQDPNVFFASKQKRYGEIFKTHILGCPCVMLASPEAARFVLVTQAHLFKPTYPRSKERMIGPSALFFNQGDYHLRLRKLVQGPLGPDALRALVPDVEAAVRSTLASWDGNVSSTFHAMKRLSFDVGIVTIFGGRLDERRKAELRQNYAIVEKGYNSFPNSFPGTLYYKAIQARRRLHGVLSDIMRERRARGEPGSDLLGCLMQSRAGDDGALLTDEQVADNIIGVLFAAQDTTASVLTWIVKYLHDHPKLLEAVRAEQAAIRAANDGGRLPLTWAQTRSMALTHKVILESLRMASIISFTFREAVADVEYKGFLIPKGWKVMPLFRNIHHNPDYFQDPQKFDPSRFKVSPRPNTFMPFGNGVHACPGNELAKLEMLVLIHHLVTGYRWEIVGSSDEVEYSPFPVPKHGLLAKLWRDDTVSVETDGCQNGDNDDNGVAMV

SEQ ID NO: 45898 - protein, 400 aa, Thermobifida fusca YX
MQTIVIAGAGMAGLTTAEALREAGFDGTITLVGDEPHRPYERPPLSKEVLTSQNSGKGVWLRTDDELAALSLDLRLGVRAMALRPSDRAVELSDGTSLVADAVVVATGARARRPRTDLPGVHVLRTLDDAEALRADLLRYGRVAVVGAGFLGAEVAASARALGAEVTLLEAADTLLPRVVDPRISAVFAELHRDHGVDLRLGVPVTSFAGTHRVERIELADGTSVAAPVVVAGIGVHPNTEWLSGSGVLLDPEVGGVSCDPYLATSIPHVYAVGDLAAWPHPRYGGRIRLEHWANAEEQARLAAHNLLAGEGARRPYTPVPYFWSDQYGRKIQLLGQASPADTVEIVHGSVADRKFVAFVGRQDRLVGVLGMRSTPRVMRYRPLLEEPTSWADALAAAQQ

SEQ ID NO: 45899 - protein, 552 aa, Oryza sativa (indica cultivar-group)
MDSKPTRPHRRPPPLPSKTSGVWPVALLVVLCFAALPLFLALSRARPTLSDVSQMGVTVTVHDEDPAGTPPESSPANRDRLLGGLLSPDIGESACLSRYKSSLHRKPSPHSPSPYLVSRLRKYEALHRKCGPGTLFYKKSLMQLTSAYSMGLVECTYLVWTPCGGSHLGDRMLSMASAFLYALLTHRVFVVHVTDDMAGLFCEPFPAASWELPAGFLVHNLTQLGRGSEHSYANLLGAKKIKTDDPAGVRSESLPSYAYVHLEHDYQQLDQLFFCDDDQTVLAKVNWLILRSNLYFTPGLFLVPQFEDELRWMFPARDTVFHHIGRYLFHPSNKVWELITRYHTSYMAKFEENIGIQITTFAGSKVSSEEYFKQIVACTSQEKILPEIDPNATSSANEAALATTPSKAVLVSSAQPSEYAEKLKAMYYEHATVTGEPVSVLQPAGAGKQAPNQKALVEMFLQSYCDVSVVSGRSTVGYVGHGLAGVKPWLLLTPTNRTASANPPCIQTTSMEPCFHAPPSYDCRAKKDGDLGAVLRHVRHCEDVGDGLKLYH

SEQ ID NO: 45900 - protein, 502 aa, Rhizobium sp. NGR234
MDESVRNYLDQYGVSDATRRFLAKPQKMFIDGAWSDSSNGATFDIFEPSTGGLITRAPSGTPEDLDRAVRAARRQFDGGAWRRLKPLERERLLHSLADLIEAHSDELAEIEAIDMGKSVTFAREIDIRGTVDTFRYFAGWASKLHGRTVEPSLPGNYLAYTRKEPLGVVAAIVPWNFPLQTLAWKLAAALAVGCTAIVKPAELTSLSTLRFAELVQEAGIPDGVVNIVTGKGSIIGAAMSTHPGINKVTFTGSTPVGQEVGRTAVGNLKHVTLELGGKSPVLVLDDADLQSAAVAVANGVFFNSGQVCDAGTRVYVQGSVHDAFLDELVSVTSALKIAPGLDRDCYIGPLVSAQQKKVVSGYIEAGRREGAELIHGGASLHRQGHFIEPAIFSHCKPQMSIVREEIFGPVLVTSPFDDLDDAVSLANDTPFGLAAAIYSNDLSRVHTLIPRLHAGSIYVNAHSTIDPAMPFGGFKASGFGKDLGPEQLDYLMETKAVWITLP

SEQ ID NO: 45901 - protein, 429 aa, Azoarcus sp. EbN1
MSAIVDIIAREILDSRGNPTVEADVLLESGVMGRAAVPSGASTGSREAIELRDGDAARYLGKGVLQAVENVNTEISETLIGLDAEEQAFIDRTLIELDGTENKSRLGANATLAVSMAIAKAAAEEAGLPLYRYFGGSGPMAMPVPMMNVINGGAHANNSLDIQECMIMPVSMTSFREALRCGAEIFHHLKKLTDKKGYPTTVGDEGGFAPNVGGTEEALNMIQDAIAAAGYEPGRDVLLALDCAASEFYKDGQYVLAGEGLTLSSEGFADYLATLADRFPIVSIEDGMAENDWAGWKTLTDKLGRRLQLVGDDLFVTNTRILEQGIDQGVANSILIKINQIGTLSETFAAVEMAKRAGYTAVISHRSGETEDSTIADIAVGLNAMQIKTGSLSRSDRISKYNQLLRIEEDLGDTVSYPGRRAFYNLRVR

SEQ ID NO: 45902 - protein, 510 aa, Geobacillus kaustophilus HTA426
MNQEMIVVLDFGSQYNQLITRRIREFGVYSELHPHTIRAEEIRALNAKGIIFSGGPNSVYDEQAFTCDPAIFELGLPILGICYGMQLMAHHLGGKVEKATHREYGKALIQVKNDSLLFHGLPDEQVVWMSHGDLVTAPPAGFAVDATSPSCPIAAMSDERRKWYGVQFHPEVRHSVYGNDLLKKFVFEVCGCRGDWTMENFIDEQVRRIREQVGGKKVLCALSGGVDSSVAAVLVHRAIGDQLTCIFVDHGLLRKGEAESVMKTFREQFQMNVIKVDAKDRFLAKLKGVTDPEQKRKIIGNEFIYVFDDEAAKLEGIEFLVQGTLYTDIIESGTATAQTIKSHHNVGGLPEDMKFELIEPLNTLFKDEVRALGTQLGIPDEIVWRQPFPGPGLGIRVLGEVTEEKLEIVRESDAILREEVKKAGLDREIWQYFTVLPDIRSVGVMGDARTYDYTVAIRAVTSIDGMTADWARIPWDVLERISTRIVNEVPHVNRVVYDITSKPPATIEWE

SEQ ID NO: 45903 - protein, 217 aa, Oryza sativa (japonica cultivar-group)
MAVLARTSRPAPTLLAATSPAVSRRPAAVSFAAAASPGSRGRVALSAAWGGRAARGRVSAAGRIVASSVEQSYIMIKPDGVQRGLVGEIISRFEKKGFVLKGLKLFQCPKDLAQEHYKDLKEKPFFPGLIEYITSGPVVCMAWEGNGVVASARKLIGATNPLQAEPGTIRGDLAVQTGRNVVHGSDSPDNGKREIALWFKEGELCEWESVLTPWLVE

SEQ ID NO: 45904 - protein, 489 aa, Burkholderia vietnamiensis G4
MQKSPTEARHRETAVDVRSAEFIQYTSNGSAAISAQIQEESNSALGHGLKQRHVVMLSIGGSIGAGLFVGSGHAIAEAGPAAIVAYIFASLLVVLVMRMLGEMACAMPDSGSFSTYAGKAIGPWAGFTIGWMYWWFWVLVVPLEATAAANILNSWFPDVAVWKFCLGVTLLLTATNLVSVKHYGELEFWFATIKVVAIILFIACGVAAILGFIPGLHINATANIFSDGGFAPKGWAPIAGAMLTTMFTFLGTEVVTIAAAESANPAREISRAITSVVWRISLFYLGSILVIIAIVPWNDPSLTTIGSYQAVLQKIGVPYAKFIIDALILVAVGSCLNSAIYTASRMIFSLGARGQAPRAVTRTSRSGVPVAAVLASTLVAFVGCAANYLAPKSVFDALLSTTGAIALLVYLVIALSQLRMRRRILLTSKLKVRMWLHPFLGLFVVFLITGALVVMVSGETHRQEVVATLAFSGLLAVAGYAHQRWQRRR

SEQ ID NO: 45905 - protein, 448 aa, Bifidobacterium longum DJO10A
MLTDEYIKRVYDQVVARDGDQPEFLQAVREVFETLQPVVEKHPEYEKAGVLERIVEPERTIKFRVAWVDDEGKVQVNRGYRIQFNSAIGPYKGGLRFHPTVTESVVKFLGFEQILKNSLTTLPMGGGKGGSDFNPKGKSDAEVMRFCQAFMTELSRHIGQFTDVPAGDINVGGREIGYLFGQYKRIRDEYSGVLTGKGLEFGGSLARTEATGYGVCYYTQEALRVLRNDSFEGKTVVISGSGNVATYAAQKAEQLGAKVVTVSDSNGYIYDPNGINVEVVKQIKEVERGRIKEYAERVPGSEYHEGSKGVWTVKGDIALPCATQNEVDGESAQKLVDNGVTVVVEGANMPSTPEAIEVYQKNGVLYGPAKAANAGGVAVSGLEMSQNSYRLSWTFEEVDAKLKSIMEEIVANSLAAAKEYGHEGDLMLGANAAGFVKVANAMVAQGVL

SEQ ID NO: 45906 - protein, 472 aa, Oryza sativa
MAKKKDVEVEELDEEVVAAAAAPAADGGEEQEAEPPARRPSTFAELGVVPELVAACDAMGWKEPTRIQAEAIPHALEGRDLIGLGQTGSGKTGAFALPIIQAPLKQDKPQALFACVLLPTRELAFQIGQQFEALGSAIGLSCTVLVGGVDRVQQAVSLAKRPHIVVGTPGRLLDHLTDTKGFSLNKLKYLVLDEADKLLNVEFQKALDDILNVIPKERRTFLFSATMTNKVSKLQRACLRNPVKVEVASKYSTVDTLRQEFYFVPADYKDCFLVHVLNELPGSMIMIFVRTCESTRLLALTLRNLRFKAISISGQMSQDKRLGALNRFKTKDCNILICTDVASRGLDIQGVDVVINYDIPMNSKDYVHRVGRTARAGNTGYAVSLVNQYEAMWFKMIEKLLGYEIPDRKVDNAEIMILRERISDSKRIALTTMKEGGGHKKKRRKNEDDEEEEERNAPVSRKSKSFNKSRRR

SEQ ID NO: 45907 - protein, 351 aa, Ophiorrhiza pumila
MHSSEAMVVSILCALFLSSLSLVSSSPEFFEFIEAPSYGPNAYAFDSDGELYASVEDGRIIKYDKPSNKFLTHAVASPIWNNALCENNTNQDLKPLCGRVYDFGFHYETQRLYIADCYFGLGFVGPDGGHAIQLATSGDGVEFKWLYALAIDQQAGFVYVTDVSTKYDDRGVQDIIRINDTTGRLIKYDPSTEEVTVLMKGLNIPGGTEVSKDGSFVLVGEFASHRILKYWLKGPKANTSEFLLKVRGPGNIKRTKDGDFWVASSDNNGITVTPRGIRFDEFGNILEVVAIPLPYKGEHIEQVQEHDGALFVGSLFHEFVGILHNYKSSVDHHQEKNSGGLNASFKEFSSF

SEQ ID NO: 45908 - protein, 453 aa, Gibberella zeae PH-1
MPPRPHIGLGFPAHAYQKRHVEPHDRSTGYQPKVRITDRYRIIGFISSGTYGRVYKAVGRNGKPVGEFAIKKFKPDKEGEQISYTGISQSAVREMSLCSELHHHNVIRLCEIMLEDKCIFMVFEYAEHDLLQIIHHHTQQPRHPIPPATIKSIMFQLLNGCQYLHTNWVLHRDLKPANIMVTSSGEVKIGDLGLARRFDKPLHSLFSGDKVVVTIWYRAPELILGSYHYTPAIDMWAVGCIFAELLSLRPIFKGEEAKMDSKKTVPFQRNQMQKIIEIMGVPTKDKWPLLPTMPEYNQLNTLANTMASSHHGHHGHHGHHPHHHGHYGSRNPPPPPPGGSNLEKWYFSTINHTSTPGGTPPLASLGQEGYKLLAGLLEYDPSKRLTAAQALQSPFFSTGDRVSANCFEGCKNEYPCRRVSQDDNDIRTSSLPGTKRSGLPDDSLMRPAKRLKE

SEQ ID NO: 45909 - protein, 590 aa, Oryza sativa (indica cultivar-group)
MAETKIEGPTIAVKLFVDKERSRVLSAESDKDFVDVLFGFLTLPLGTVVRLLGRQSQVGCLDELYKSVEDLSADYFHTKACKAMLLKPHNTAAELCCLLKVKVDDTDQSAVYVCRDANCSANGDCGVTSVAGSVCKCGKVMEYIGEWPQDGGSTAAAGSDGGVFVKGCYKFIVTDDLHVGPASTSLMMSIFDKYGVRDPANLEQKILQLNAEKITCLLKRSLTSKQTLTGYYFDVPNPNDEANLYVLPESLYSEQDAEVDHKLNNMKIKVLQRKNNTSLLYAEVGEDFVDLLFGLLSIPLGSILKTYEAAPKQRNISGCFKCFKIAGFSCYGHCSDQIWNTGKKAYVYKNCLGTTKTCKLCEINPKVPSGGSHKGEGYVKPGVQKFMVTDDLHILPLSLTSTVQVVSESKVQAKDLVEKEFTLTKIQVMELLRAVLVTRNTLSSVLPPPKKKKRLHLQSNSLGIPRGSEQGPAPPPPPRHGAGADGACITLQYIPNVIIHNIHVHDCVPAGNANMRASPTHYGWRTRSDSDGISLYSARDVWVDHCALSRCADGLIDAIMGSTAITVSNSYFSHHNEVMLLGHNDEYLSD

SEQ ID NO: 45910 - protein, 421 aa, Oryza sativa (indica cultivar-group)
MSTSNNGGPTVAVKLYIDKEKKKVLFAESDKEFVDVLFSFLTLPLGTIVRLLGKQSQIGCLDELYKSVEALSEDYFQTKACKAMLLRPRNAAGSHCDRLKVKVDDTNERLIYVCPTSSCDARSFSSFWGVCNSCTVTTTLILREKPVDCRTVESNDDGVFVKSDLKFIIFDDLHVAPASTSTMFPLLGKFGLLEQRNIEEKVLELNSHKIINLLKRALVSKQSLTGLLCDHPVETDSVNLDHLREKLFPKQENTTDPKFNAVRITIVQTKDDSSVLYAEVGYDFVDLVFGLLSLPLGSTIKAYGQVTSGGSSGLDNLYRSINGSGIGCVKQECQSLLLSPMLAPFFGCGSSVLLQVQESPIKSCSLRVIRAAKIPNEMLVKKELTLDRTQVFHLLLQVLKLLRAALVTRNALSSVLLPPKK

SEQ ID NO: 45911 - protein, 1278 aa, Oryza sativa (indica cultivar-group)
MEIEHLGARAAAAAGEDDQSPVEQVRLTVPTTDDPSLPVWTFRMWTIGLLSCAMLSYINQFFSYRSEPIVITQITVQVAALPIGHFLARVLPKRKFTVFGRECSLNPGPFNVKEHVLISIFANAGAAFGNGGAYAIDIINIIKAFYHRSISFPTSLLLVITTQVLGYGWAGLMRKYVVEPAHMWWPQSLVQVSLLRALHEKENLRMTRAKFFLIALICSAAWYVVPGYLFPTVGAVSWLCWAFPRSVTMQQIGSGMSGLGVGAFTLDWATVVSFLGSPLVYPFFAIVNVWVGFVLLVYVMLPIAYWVLNLYQASTFPFFSASLFDHTGEEYRISEIVNDRFELDTDAYARQGKIHLSLFFATSYGLGFATIAATLSHVTLFYGTEMYRRFRQAAREKPDVHTRLMRRYDDIPNWWFYGMLALAMVAALLLCTVFKDEVQLPWWALLCAVAVAFFFTLPISVITATTNTTPGLNIITEYVMGLIMPGKPIANVCFKVYGYISMNQAVSFLTDFKLGHYMKIPPRSMFLVQFIGTIVAGTVNMSVAWWLLSTVPHICDKKHLPEGSPWTCPGSRVFFDASVIWGLVGPRRIFGPLGYYGALNWFFLGGLAGPAVVWLLARALPRHAGWIRLIHLPVLLGATANMPPASTLNYTAWCSVGAVFNYLVFRRRKAWWQRYNYVLSAAMDAGVAIMGVLIYFCLSSRGITPDWWGNSDINIDHCDLSTCPTAKGVIVEGCPGPRERVPPLPQIMTSSLPLGEMGPRGRVPPLATNYDVHSPSWGDGFSQEKKNYVSMHISAAACSFSQPSIRSNLCNMFSPLPVTVLVSIAALAFISGDATIVHEPVAAAAAPSSDEADSIDGGGGGFSLPLVRRRSTTTTTTMIDVAKEEIQLATAIAAGDKKLLVPLYGRPQGGSTYLVQLRIGTPTDRISPRYVLFDTGSDLSWTQCEPCTNCSSFTPYPPHDPSKSRTFRRLSCFDPMCELCTAVVDGGGGSAGCLFRRRYGDGGAVSGELVSDVFHFGAAGDGGGYQLERDVAFGCAHVEDSKAVRGYSTGILALGIGKPSFVTQLGVDRFSYCIPASEITDDDDDDDEERSASFLRFGSHARMTGKRAPFKQDGSGYAVRLKSVVYQHGGRLNQQQPVPVYVAGEEAAAAMPMLVDSGTTLLWLPGSVFYPLQRRIEEDISLTRRYDLTHPSLYCYLGNMTDVEAVSVTLGFGGGADLELFGTSLFFTDENLTEDWVCLAVAAGNRAILGVYPQRNINVGYDLSTMEIAFDRDQCDRV

SEQ ID NO: 45912 - protein, 545 aa, Methanosarcina barkeri str. Fusaro
MKNTFILGIEGTAWNLSAAIVTETEIIAEVTETYKPTAGGIHPREAAQHHAKYAASVIKRLLAEAKEKGVKPSDIDGIAFSQGPGLGPCLRTVATAARMLSISLGIPLIGVNHCIAHIEIGIWRTPAMDPVVLYVSGANSQVISYMGGRYRVFGETLDIGLGNALDKFARGANLPHPGGPKIEAYAKNATKYIHLPYVIKGMDLSFSGLSTAASEALKKAPLEDVCYSYQETAFAMVVEVAERALAHTGKKEVLLAGGVGANTRLREMLNDMCEARGAKFYVPEKRFMGDNGTMIAYTGLLMYKSGNTLSLEDSRVNPSYRTDDVKVTWIQEEKMKRVPEISPGTSLKLGELLDNGAEAIVYLEEGPEGKKILVKERVPKAYRYKEIDERIRTERNRTEARLMSESRRHGVSTPIIYDVEDFKLKMQYIDGVPIKYLVTPELSEKVGELVGKLHSAGIVHGDLTTSNILLAGERLYLLDFGLAYYDKGLEARGVDVHVLFQTFESTHRNHEALIEAFKKGYRRTFIDSEDVLTRVEEIKKRARYA

SEQ ID NO: 45913 - protein, 1280 aa, Aspergillus nidulans FGSC A4
MSELPSRSISPRDPSPGETPGRDPSTPSTDAGVGYSASQDAPSFGAYDRVYPIRSLVSLEPPATSEPSSNKSKSPLSPTSGARQFSIIDGHTWTRLRSDSRANSTDYSGGTGLSPESSEAPSSQRMSDSSSARPPSNTTGLRRGDDHTTFTPSSEDSHPQVQEPYELMTTRFRHVVTDDGHAVITGRTVDSFKACEDEPIHIPGAIQSFGALVAVREEPGEQMVVRIVSENSQDILGYSPNDLFSLPTLCDIFPEDQADNFLDHVDFVKEEGYDPSVDGPEVFILTVNQPNGSTIRVWCAIHTNPALNGLVICEFELEDDHVNPLTSSGHISPAVPTNTLDVVPTIEQMAGSTITINQPLRVLRRARRRKGEAAAMEVFSIVSQIQEQLARADNMEALLDTTSGIVKELTGFHRILVYQFDSEFNGKVVSELVDPTMSIDLFKGLHFPAADIPKQARDLYRINKVRLLYDRDHVTARLVCRALEDLETPLDMTHAYLRAMSPIHIKYLANMQIRSSMSISINSMNDLWGLISCHSYGPRGMRVSFPIRKMCRLIGDTVSRNIERLSYASRLQARKLINTVPTDANPSGYIVASSDDLLRLVDADYGALCIRGEVKILAKSPQSQEMLALLEYLKVRKYNSVLTSNHIVKDFQDLNYPPGFKDISGLLYVPLSTDGLDFIVFFRRGQLTEVKWGGNPNEAKFTEGHLEPRKSFQTWRETVLDRCRDWTESEVDTAAVLCLVYGKFIKVWRQQEAALESSSLTKLLLANSAHEVRTPLNAIVNYLEIALEGALDGETRDHLSKSYSASKSLIYVINDLLDLTNVEKGQSLIKDEPFDLPTTFSEATAMFESEAKRKGLNYKVLSQPGIPETVIGDQRRVRQSISNLISNAVQNTSSGGVTVEVWHAPGEGDTDKATVKIAVLDTGRGISSSTLELLFRELEQVSGEDDSHYYGGSEEGEESAPEAKASKDKAVLGLGLALVARIVRNMHGQLTVRSEEGKGSRFQISLQFPIPEGSDTKSPTAEHRPVATGDSAAPFSTGDDVILVDSTTGSKRNSQDSLTRPDVPRKSEPEDTAPADGAGEQASGESEAQTRPKKTGESTASTSHEQSETARSRPSGPSSGPSAPERRPLRVLVAEDDPINAKIIEKRLEKLGHTVQRTVNGEECANAYSAESTQWDVVLMDIQMPILDGIESTKRIRQHESQSEVANLHIPIFAVSASLLEKDVQMYMDIGFDGWIMKPINFVRLNTLLAGIHEERARNGAVYQPGQWEKGGWFTPYTHS

SEQ ID NO: 45914 - protein, 797 aa, Oryza sativa (indica cultivar-group)
MLHPPPVRRCVSRMPRKVVSGPDYDDEYDDDYDEYDEDYDDYGETGHSDDIQHPVKEEKGIMSKHIKLTASSTAPLISNIMSPLYCAESSKKSSIHGIPSDFGTPSMPKSDCTKMPVNTRTTDFDGDPEIKNASISHEKVGSTQYTSAGSSSGAGKKVKHIALPEDVPVERTAQLISDHFQLKEDQSSRASSSAQNEDVAQKLSSDIQKLGLEKNEVDTAKPYLPEEYKPEKWMFANEESGVLSQLNLAIVGHVDSGKSTLSGRLLHLLGRISKKDMHKNEKEAKEKGKGSFAYAWAMDESSEERERGVTMTVAVAYLETKKYRVVLLDSPGHKDFVPNMISGATQADAAILVVDACTGSFEAGMDGEGGKSVGQTKEHAQLIRSFGVEQLIVAVNKMDAIGYSKERFEFIKVQLGSFLRSCNFKDSSVTWIPLSAVENQNLIKIPSDVRLTSWYQGFCLLDAIDSLQLPSQDVSKPLILPICDVIKSQSTGQFAAFGKLETGAIRIGSKVLISPCGEVAAVKSIERDSNSCDIARAGDNVAVSLQGIDGSKLIPGGILCNPGFPVPVSNFLELRVLVLDVTIPILIGYQVEFHIHHVKEAARVTKIVALLDKAGKPSKTAPRFLKSKQNAVVQVTLDAPVCVQEFSKCRALGRAFLRSSGSTIAVGVVTRPCFGAHIVADSKRDIKDPEHPYSLEELNVVTEDSVEINDELSHVRVTFTPTVEHCSMATVIGLCLRVKLMRSLPPRYKVDIRVAPGSHATETAVNKQLNDKERVAAALENPNLLDIVEECLSPTFA

SEQ ID NO: 45915 - protein, 292 aa, Shewanella sp. MR-4
MTDMPSVTTPALDRYAVFGNPIGHSKSPIIHGQFASLTLQPLSYEAILAPIDGFEASLRAFFQAGGKGANVTVPFKEQAFALCDSLSAEATLAGAVNTLSLLADGTLYGDNTDGLGLVADLLRHLGSLQHKRVLLVGAGGAARGCILPLLKAEVGQLVITNRTQSKAQALVEIFSQVQQGRYSDKLQAMSMPELSGEFDLVINSTSASLAGELPPLPQSIIGNKTACYDMMYGAKPTAFNQWAVQQGAAQVIDGLGMLVGQAAKSFALWRGVEPDTSGVLKLLRDKLQADAQ

SEQ ID NO: 45916 - protein, 559 aa, Thiocapsa roseopersicina
MSAPIHENERIKARSNCLRGTLRESLADTLTGAISPEDTQISKFHGFYQQDHRDRRQARPEQYLEPYFGFMLRAPLPGGVCTPAQWLAIDGMGRELGGGSLRLTTRQSFQYHGILKRDIASVIRGINAVMIDSIGGCGDVNRNVLCNPNPVESALHREVYDWAKRISEHLLPRTRAYHEIWLDGEQVGGGEDVEPIYGRTYLPRKFKTAVGVPPHNDVDVYANDLGFAAVADGSRLIGFNVSAGGTGRNTGIPATFPRLADVLGFVEPERTLAVAEAVVTTQRHFGDRLDRTQARLKYTIERMGLDAFRDEVERRAGIRFAPARPIGFTDQGDRTAWVRGQDGRWHLTLYIESGRLIDGPGQSSMQGLREIARIHQGDFRITPNQNLIVARVPEPGKSEIEALARKYGLLDKGIALRLNGMSCVALPTCPLAMAEAERYYPDFLAQVERLTRKHGLAEQEIVTRMTGCPNGCARPYLAELALVGKGPGRYNLMLGGNGRRYRLNRLYRENLDEAAILAEIDTLLGRYAACRQPGERFGDYLIRDGIVRPVVNPAEDFHE

SEQ ID NO: 45917 - protein, 216 aa, Pseudomonas putida GB-1
MAKTWRRTMQIHLLFKKALLAAAVAGVLSTSIVLIPDSITHGSSAYAKDGGGGGGGHGGGGGHGGGGGSGGGGGHGGGGGSGGGGHGGGGGSGSGGGHGSGGDGGGHAGNGNSGSGHDGQGHDGNSNSGRSSSHAEAGDDHGNHVGGEPGDDHGNHVGGEPGDDHGNHVGGEPGDDHGNHVGGEPGDDHGNHVGGEPGDDHGNHVGGEPGDDNSRS

SEQ ID NO: 45918 - protein, 399 aa, Zea mays
  misc_feature (20)..(20): Xaa can be any naturally occurring amino acid
  misc_feature (366)..(366): Xaa can be any naturally occurring amino acid
  misc_feature (383)..(383): Xaa can be any naturally occurring amino acid
MGSSIGCLGGGSKSRQDQNXSGRRGFVSQFSAGHVLSRAGNNVQVFSLNELKTATQNFHMLNCIGRGGFGAVYKGNLKDGTQIAIKKLAVESKQRISEFLTEINVISNVRHPNLVRLIGCCAEGKNRLLVYEYAENNSLANALLGPKNKCIPLDWQKRAAICIGTASGLAFLHEKAQPCIVHRDIKASNILLDKKLLPKIGDSGLAKIFPDTVTHISTRVAGTMGYLAPEYALLGQLTKKADIYSFGVLLLEVISSENSSKPTWGPNMHVLVEWTWKLREEGRLLEIVDPELKKYPEEQMLRFIKVALLCTQATSQQRPSMKQVVNMLSNKAEIDLQNVVAPGVLKEPRQRTGGFGSLTAGTTSSXQSTKGNPAESYSTIVQXTNMNSCQFSITDASPR

SEQ ID NO: 45919 - protein, 584 aa, Photobacterium profundum SS9
MKSDIQICRDTALTPIDQIALMAGIEPQDLTPQGTLKAKVKPSILNRLADKPEGKLVLVTAITPTPLGEGKTVTTIGLAQGLAKINKRVIACIRQPSMGPVFGVKGGAAGGGYSQVAPMEKLNLHLTGDIHAVTAAHNLAAAALDARLYHEERHGYEAFSDKTGLPALRIDIKNIVWKRVMDHNDRALRMITVGKNEAGKAINGLEREDGFDISAASEIMAILALSKDLADMRQRIGRVVLAYNIDGNPITAEDLQVAGAMTVTMCEAIEPTLMQTLEGVATLIHAGPFANIAHGNSSIIADRIALKLSEFTVTEGGFGSDMGFEKACNIKAQQADRGPDCAVVVATLRGLKANSGLYDLRPGQALPDAIFSPDEKALIAGFDNLKWHIRNAAQYGLPVVVAINRFPQDTDVELELLKNMVADTDFSTYVGVAISEAFGKGGEGATELAQAVVKACETPANFKPLYSLSQSLEEKLMAVAEVGYGARSIELSDCAKEQLATLKKHGHDNLAVCLAKTPLSITTDPGIKGAPSDFVVPVRELKLCAGAGFVYALCGNVMTMPGLPEKPAYMNLDIDADGNIVGLS

SEQ ID NO: 45920 - protein, 372 aa, Arabidopsis thaliana
MTRDSSRNSSLKPWPRKKFLFPSVVIVIVGIIVAFTYQSKLKPPPPKLCGSSGGPPITAPRIKLQDGRYLAYKEHGLPREKANRKIVFIHGSDCCRHDAVFATLLSPDLVEELGVYMVSFDRPGYCESDPHPSRTPRSLVSDIEELADQLSLGSKFYVLGYSMGGQAAWGCLKYIPHRLAGVTLVAPVVNYYWKNLPLNVSTEGFNFQQKRDQLAVRVAHYTPWLIYWWNTQKWFPGSSIANRDHSLLAQPDKDIISKLGSSRKPHWAEVRQQGIHESINRDMIVGFGNWEFGPLDLENPFLNKEGSVHLWQGDEDMLVPAKLQRYLAHQLPWVHYHEVPRSGHFFHYTKGVVDDIVKSLLTSDVRASRVCI

SEQ ID NO: 45921 - protein, 121 aa, Bifidobacterium longum DJO10A
MAAGHPLTDEDRWPWLDTIAAWIDERVAAGEPAVVTCSALKKIYRDKLRRQGVVFVYMQGTFDEVMERLSHRQGHFMKPSMLQSQSDILEEPGDDEIHVNVHIGQADPEHEAMAVAGALGL

SEQ ID NO: 45922 - protein, 477 aa, Burkholderia vietnamiensis G4
MSTDDKIQTYEQEDLKRDLKNRHIQMIAIGGAIGTGLFYGSSWAIRTAGPAILLVYLVAAIAIYFVMRALGEMAVEEPVSGSYISYSNRYIHRFAGFLNGWNAFIFLLATSAADLNALGNYMHFWFPGIPIWVTAGAAVSLMFVVNIIGVKIYGEAEFWFSLVKVVAIVAMIVFGVGMVLFGIGNNGVPIGYHNLIDHGGFFPKGAGGTFLAIVMVAFAFGGVENLGLAAGEAQDVKTTMPKAVNATFWRLLIFYVGAIAVLLLVFPWTSLTSKGSPFVEVFTKIGIPAAAGIMNLVVIMAVLSAVNASVFTNSRTFYNLSLQKNAPAFLGVTNSRKVPHRAILMVFATMFAGVMLNYLMPEQAFELFSSVTVFALVCAWGSIVISHLRFRKNKIRKGEDGQLGYKMPFYPYSNYIALIFLAAVLIGIAILPDMRMSLVVSAVWVLVVFIAYTFYVRKESTRESIASETGDAKDLLA

SEQ ID NO: 45923 - protein, 347 aa, Ostreococcus tauri
MSTEAERTTFAVKAGLAQVRYLMRAPDVSRSRTSSEASRTFDAVLGARPGAISKRRLTRDAADVDRYLQMLKGGVIMDVVNVEQARIAEEAGAVAVMALERVPADIRKDGGVARMSDPTMIRAIKEAVTIPVMAKARIGHFVEAQVLEAIGIDYIDESEVLTPADEINHLNKHKFKVPVLCGCRDLGEALRRIAEGSSMIRTKGEAGTGNVVEAVRHCRAVMGDIRRLCAMDEDEVFVYAKEIRAPLELVQQTRKLGRLPVVNFAAGGVATPADAALMMQLGMDGVFVGSGIFKSGDPAKRARAIVQAVTHYNDPKIIAEVSQDLGDAMVGIDCKEQSFVSYAARSE

SEQ ID NO: 45924 - protein, 514 aa, Rhodopirellula baltica SH 1
MIHRAPLHLLYLNVLVIATCGLIYELLAGTLASYLLGDSVTQFSLIIGVYLSALGFGAWLSQYVTTKLARVFIEVELALALLGGFSTPLLFLAFPMIEWFQWLLFGSVIVIGTLVGLELPLLMRILKEHLEFEELISRVLAFDYLGALFASLLFPIFLVPRLGLNRTAIVFGLLNALVGLWGTYLLRPLLAKKGLDGLRGRAFLVIGLLIAGFIKADSITSLAEENTLGGRIVYADTSPYQRIAVTRNEKGFQLYLNGHLQFNSVDEYRYHEALVHPVMSVCKDARRVLVLGGGDGLAVREILRYDHVESVTLVDLDPAMTRLATQFEPLAELNGRSLERDRVTVVHRDAFLWVGEGDEQFDAVVIDFPDPGNYSIGKLYSSRFYNLLRERMTEDAGLAIQCTSPLVAPKSYWCILRTMQASGFDVTPYHAPVPTFGIWGFALARIAEDPESDSDWRLPPELSAKVAGLRYLTPSTMAGLFDLPADQQPRDVPPNRLNDQILVRFYDEEWGQNQ

SEQ ID NO: 45925 - protein, 247 aa, Oryza sativa (japonica cultivar-group)
MKKGILRPFRYISNMMDGKEAAQDMQIGFPTDVKHVAHIGWDGPSVPNNNNNTAGAPSWMKDYHSAPLDSASFRSDRGGSAAANPWASQEIVVDGGSLGDTSFSETRSEASGSMDITAGDSPPSPDSRRSRRHRSRGSAATSSMDCTAADGGSAPEKKDKAKKSSRGKNRKKDKSDKSAPAGAGEEASGATCQDLPAVPKKSNRRKNKGGSEGTGAAAASKADGAGAGGEDPAAPEPPATEEAQDHD

SEQ ID NO: 45926 - protein, 578 aa, Zea mays
PRVRPFFLFIELALVLCFITLYYRHLQSKKTSPLEPTEWPVVGHLPGLVANIHRFHDWATGVLAGVGCNFEARGGRTGLRYFITCDPSNVRHIFTSNFANYPKGEEYAAIFDVLGGGIFNADGESWRRQRVKAQMLMTGPRFRAFTARCSRDKVERSLLPFLAHHAAADDEGRPTPCDLHDVFLRLTFDMTCTLVFGVDPGCLALGLPGVPFARAMDDALETLFLRHITPTACWKLMSVLGVGQEKKMAAARRTIDCFVATTVAKRRADKLREGEGEGVCSSFDLLSSFICHEDDSSENDDDDDVFLRDTTVNLLLAGRDTTGAALSWFFYLVSKNPRVEQKLLDELAPIVASRRRAGGAAADAASGMVTFDADELGSGLVYLHAALSECLRLYPSVPFEHKVAAAADVLPSGKELKAGDKVLVFNYSMGRMEGVWGKDCTEFRPERWLNEDGTKLRYEPSYKFISFNAGPRTCLGKEMAFVQMKAVAAAVLWNFAVEVVPGHVVEPKLSIILHMKNGLAVKVRRRDGTYGAAPPCVRHALAFLSSSLVTEHSDDSASRLCYVSIAWFFSHILRPEYI

SEQ ID NO: 45927 - protein, 298 aa, Aspergillus nidulans FGSC A4
MSDLNLNGILVALVTPFTDDKTAIDEARLELHIKHMLDAGIHGLVPGGSTGEFTTLSLSERKQLTELCVRFAGGRVPVVAGTGATSTSEAVELAVHAKEVGAAAVMVVPPFYDPVNLQQLTELLAEIHEKSTLPIMYYNIPSASGLKLSPSEIAGLSRVGVRWLKDTSGDAPAFTELVFGLSDQITALNGWDTLTFYGLAAGCPGGVWGAANIIPELAVELYEAVSIKKDLDKGKELWSKAWPICKFLESHNYAAAVKTGVELTGQATGGLRKPFALLGPELQEELKGLLKNAGVATV

SEQ ID NO: 45928 - protein, 325 aa, Glycine max
  misc_feature (183)..(183): Xaa can be any naturally occurring amino acid
  misc_feature (275)..(275): Xaa can be any naturally occurring amino acid
  misc_feature (284)..(284): Xaa can be any naturally occurring amino acid
MASNQEITAPLRYWVDNERKRVVMAEASGHFVDVLFSFLTLPLGTIIRLGNTFGQPIEIGCINNLFKSVEALNPDVFWNDICKRMLLSPRNPLEFSYQRLKLKVDDTQPTKYFVCHICSKGSDFSLSTFDEVKCHCGNLMKRQLDMLVEPAGGNGVFVKGDAMFLIFDDLTVLRSSPSVSFKXHSNSDTKTSGSKLEEKYSDVGTKEIFSILKEALTSKSPLSNVFLENRESNSSYSFSSHTGSDACGPFHWKGSLEIKIMFSKSKNEILFAGAXGRFVDFLVXLLHREPLGSILNLMNGKLSLGSIDNLCTSVKNLNPSWFIGS

SEQ ID NO: 45929 - protein, 514 aa, Shewanella sp. MR-4
MTTTKRPIALLILDGWGYRENTHMNAIYHANTPVLDRLNAQYAHGLISGSGLDVGLPDGQMGNSEVGHINLGSGRIVYQELTRISKAIADHEFEQNPALCDAVDVAVKAGGAVHIMGLLSPGGVHSHEEHIEAMCRMAVARGATKVYLHAFLDGRDTPPRSAKGSLSHFDDLFTTLGHGRIASIIGRYFAMDRDNRWDRVSQAYDLITQGKAKFQYDNAVTALEAAYERNENDEFVSSSAITDSEGKVASLNDGDALIFMNFRADRARQITRSFINADFDGFERAVTPKVNFVTLTEYAADIKAPIAYPSENLVNTLGEVLQNRGRTQLRISETEKYAHVTFFFNGGKEEPFNGEDRILINSPKVATYDLQPEMSSTELTDKLVAAIESAQYDVIICNYPNGDMVGHTGNFDAAVKACEAVDACIGRVVDALAKVGGECIITADHGNAEQMTDETTGQAHTAHTSELVPFVFVGRDATIDEGGKLSDVAPTILHLMGETIPAEMTGKPLIHVKE

SEQ ID NO: 45930 - protein, 285 aa, uncultured marine proteobacterium ANT8C10
MSIWNDLSWVEGMRTPGLSLFFENVSLLGYPIFLILFISFGYFFWSPSRFSRIAMLLFISGLINSFLKDFFQDSRPLIELMLDPKVGTSYGWPSGHAQIAVTLWGLLAYELKEKWATIGATLLILLIAFSRMYLGVHDLGDVVSGLIIGSIILGIWHFAVIHKVYESLSAKSWIAVIALFQLIIYYFYPVHEGHEASVWFLGVMMGWYVGFSDIHFNPGHVKKFFLSLVSIVIVFIAMVSITELEASIQVTGLLGVVYSYMLGLLFSILVTWIIPRFWRFLNLAS

SEQ ID NO: 45931 - protein, 82 aa, Helianthus annuus
SLEIDELARFAVDEHNKKQNALLEFGKVVNTKEQVVAGKMYYITLEATNGGVKKTYEAKVWVKPWENFKELQEFKPVDAATS

SEQ ID NO: 45932 - protein, 800 aa, Delphinium 'MagicFountains dark blue'
MEMLGKRSNYSLLSQFPDDDTHHHQPPYHHSNFPYESHSADGKKNKGKLDWDGDHRHQLGGGRIAGFAPSIGLQRQSSGSSFAESSISGDYGVPTNDPEVFGCFQDEMLQSGELAAARGREAAASSSTKSWAQQTEESYQLQLALALRLSSDATCADDPNFLDTLPDESNRSSLVSAEVLSHRFWVNGCLSYFDRIPDGFYLINGMDPYVWTICTDMQKNGRVPSIESLKAMHPGDNSLVEVVLIDNHTDYRLKELHSRVISLSQSCNSSNELVEQLGRLVCIHMGGAASPDESDLAPRWKECSEVLKDCLDSVVIPVGSISIGLCRHRALLFKVLADIIDLPCRIAKGCKFCRTADASSCVVRVGLDREYLVDLIEKPGCLYEPDSLLNGPSSILIPSPLRLPNFNPVERTEDSKSLAKKYLMDCQSLNLVFSDAPAGLSDNMQHQTDPSFEHLDGTHADMVNLMSVSGSADSSVSLPPKVAQSEEHGWQRVRPTHTSRDPGSQVVPSTEFSFDVEDLDIPWDNLIIKEKIGAGSFGTVHRADWNGSEVAVKILMEQDYHATCFKEFIREVALMKRLRHPNIVLFMGAVTRRPHLSIVTEYLARGSLYRLLHKSDPREIPDEFRRISMAYDVAKGMNYLHRRNPPIVHRDLKSPNLLVDNMYTVKVCDFWLSRLKANTYLSAKSAAGTPEWMAPEVLRDEHQTEKCDGYSFGVILWELMTLQKPWNNLNQAQVVAAVGFKHKRLPIPSSLDPDIAVLIEACWSKDPSKRPSFSSIMEYLQSLVAPPTPQPAHSAFSTLT

SEQ ID NO: 45933 - protein, 222 aa, Glycine max
MTSIHLINTLAAPLRSFSPPSLFPQCHSPLRSSAAPKRRRFANSSGFRLASSQTVNSVPRGNGTYTVADFMTKKQDLHVVKTTTTVDEALEALVNYRISGLPVIDEVWNLVGVVSDYDLLAIDSISGGPQSDANLFPNVDSTWKTFNELQKLLSKTNGQVVGDLMTPTPLVVHESTSLEEAARLLLETKYRRLPVVDDDGKLVGLITRGNIVKAALLSKRAG

SEQ ID NO: 45934 - protein, 501 aa, Azoarcus sp. EbN1
MDVTPLLARLGVAMDELECGELPVRSPIDAAVIARLAPHSCAHAGVALDRAQQAFFAWRDVPPPRRGDMVRQYGNLLRRHKADLGELVSIEAGKIRQEGLGEVQEMIDICDFAVGLSRQLHGLTIASERPGHRMMEQWHPAGVVGVVSAFNFPVAVWAWNAALAWVCGDSVVWKPSPRTPLTALACAALFDSLRSEFDELPPGLLEVLVGGNELASLLADDRRVAVLSATGSTAMGKALAPRVAARLGRSILELGGNNAAIICPTADLALAERAILFAAAGTAGQRCTSLRRLIVHESIADALLERLRAAWGRITVGNPLDPATLVGPLIEAAAGAKMDRALAEARAAGGTVWGGEAIRVPGCEGACYRRPALVEMPGQTALVKEETFAPILYVLRYRTLDEAIALHNDVPQGLASSIFTRDLTESERFLSATGSDCGIANVNIGPSGAEIGGAFGGEKDTGGGRESGSDAWKAYMRRATCTINYSGALPLAQGIHFGLDA

SEQ ID NO: 45935 - protein, 656 aa, Mycoplasma penetrans HF-2
MDYSKYINSIRLLSLNAIKKAKQGHVGMSMSAATITYTLFTKHINISSVDPKWINRDRFILSAGHGSLSIYSILHFSGLISLEEFKKFKNNSEIVPGHPEYLKNNFIDASTGPLGQGIGMAVGNAIAQKYIVNKFKSISDLFDHYVYALVGDGDIQEGISYESMSLAGKLKLNKLIVLHDSNDYQLDSSVETVFNEDLQKRMESMGWFYLKVNNEVDEIDLAISLAKKQDKPTYIEVKTLIGYGTKNINSNKSHSMSLSEDDIEYAKTIFDLKNEEFSFGQNIYDHFKTEVLNRNRKYEKWLNKFKEYERENNSDFIKFNNYLKRNYKIEEILKNIKFSKTSVATRNYVKDLMDCLKNHNSDFIIAGCADLEAATNIKINDSDFNYDYSSNNIKYGIREFAMGAITNGILLHSCLKTISGTFLVFSDYLKSAIRLGTLMSLPNFYIFTHDSYQVGGDGPTHQPIEQLAMLRSIPRVNVFRPCDETEFLAASYKALKSTSETNILVLTRQPLKSKINTSLKGTINDGGYVLESDQNPDITIAGCGSEIDLLFDVKQDLNDLNYKVKIVSIPSLNIFLNNKESKIKEILNSKYGLFTIEPSSDAYWYKLSSYVKSHIHFEAKEYGKSMDGDALYKEKGFNKDNIKNLILRKLIKYDNN

SEQ ID NO: 45936 - protein, 389 aa, Xanthomonas oryzae pv. oryzae KACC10331
MGAHRMNDTVKPGFKPKKSVALSGTAAGNTALCTVGRSGNDLHYRGYDILDLATTSEFEEIAYLLVHGKLPNSGELRGYKAKLRSLRGVPAAVKAALEQLPPSAHPMDVMRTGVSVLGCLQPEKDDHNHPGARDIADKLMASLGSMLLYWYHYSHNGKRIDVETDDDSIGGHFLHLLHGFAPKDAWVRAMHTSLILYAEHEFNASTFASRVIAGTGSDMYSAIAGGIGALRGPKHGGANEVAFEVQKRYDTPDEAEADIKARVERKEVVIGFGHPVYTLSDPRNKVIKDVARELSDEQGSRKMYDIAERLESVMWDIKKMFPNLDWFSAVSYHMMGVPTAMFTPLFVLARTAGWSAHIIEQRVDGKIIRPSANYTGPEDQVFVPLDQRR

SEQ ID NO: 45937 - protein, 287 aa, Zea mays
MYPYRMSNVAIGYLNLATLLASIPVIGAGLWLAKGSATPTCSSILQAPLLAVGFAVLLVSLAGFVGACFHVAWALWLYLAAVMLLIAFLLGLTVFGFAVTAGGGGEQVYGRPYREYRVADYSPWLQRHVRDARYWRPALACVVGSRACPKIHNWTPMDYLQHDLTPIQSGCCKPPTACQYSGGVAVGAQDEDCYRWNNAPGVLCYQCDSCKAGVMEQVRQDWHKIAVLNVVVLVALVCICSCGCCAFRNARRSLSEYPYGVNQMSKIDPRWDYYWWRWWRGRREQLY

SEQ ID NO: 45938 - protein, 344 aa, Shewanella oneidensis MR-1
MAVFNHVSFDEHEQVVFCHDKESGLKAIIAIHNTNLGPAVGGCRMWNYQSDDEALTDVLRLSRGMTYKNALAGLTMGGGKSVIIADPKRPDREALFRAFGRFINSLGGRYYSAEDVGTTTADIMIAHQETPYMAGLEGKSGDPSPFTALGTYLGIKAAVKHKLDLDSLKGLKIAVQGVGHVGYYLCKHLHEEGAQLIVTDIHQASLDKVATDFGATVVAPQDIYAQDVDVYAPCALGATLNDVTLPLLKAKIVAGCANNQLAEVRHGEQLKEMGILYAPDYVINAGGIINVSFEKDYDAAKSEAKVREIYNTLLKIFAKADAENRTTGAVADEMARAIYQAAKA

SEQ ID NO: 45939 - protein, 377 aa, Ostreococcus tauri
MSACISASVTRARTARAPAARRAASKARASPRAVAARAGGVGTPYTTWILQQEMQENIDGELAVVLSSIGLACKQIASLVQRAGLAGMTGLAGEQNVQGEDQKKLDVISNDVFCNVLRQSGRTGVIASEEEDVPVAVEETYGGNYVVVFDPLDGSSNIDAAVSTGSIWGIYESDSSCIPDFGSDDSAKVEEKCVMNVCQPGSNLLCAGYCMYSSSTILVITIGQGVFGFTLDPTVGEFIMSHENIKVPDSGKIYSFNEGNYAMWSDGLKKYMDSLKTGGKDGGKPYSARYIGSLVGDFHRTILYGGIYGYPGDAKNPNGKLRLLYECAPMSMIAEQAGGKGSTGVARVLDIVPEKVHQRVPFFVGSKNEVAYLESFM

SEQ ID NO: 45940 - protein, 316 aa, Oceanicola granulosus HTCC2516
MSAASTVPVIDLAAYRAAGEAERAAIAAEVDRACRETGFLAIAGHGVPEDEIAAVRAAVRGFFDGPAEAKEAVRPAKGQPYGYLGLGAEALARSRGEETPPDLKESFNGGPLTRPEGESDPDALAFCYAPTPFPDQPGFRAAWEAYYARMETLAAQIMELFAAALDLPADYFAPYIDAPISALRALNYPAAERPPEAGQQRAGAHTDYGSLTILLPDPGSRGLEILTPGGEWRGVAPPEGAFVINIGDLMELWTGGRWRSTLHRVVVPPEAALERRGSLAFFHQPNWHAEIAPLEGGGASVTSGPYLMAKFAAATA

SEQ ID NO: 45941 - protein, 581 aa, Haloarcula marismortui ATCC 43049
MSKTVSERAKSVFLSRRAGPAAAGPTSKEYVSGVAVPWVASMTDATPPDDRQNPTTPEEPETAGFVEYGIDDKPPRKQAILLGVQHYLTMIGASVAIPLGLAGAMGMFEAAPDQVGRLIGTFFVVSGIATLAQTTLGNRYPIVQGGTFSMLAPGLAIIGVLAQQGADWQTMLVELQGAVIVAGIVEVVIGYSGLMGKLKRYVGPIVIAPVIALIGLALFNVPQIANPNFGSPGTGQNWWLLGLTMLSIIACSQYLDRRHRAFKLFPVLLGILFAWTVAALLSVTGVFAAGSVSYVSLGSVTSAPLVQPIYPFQWGLPQFTPGFIVGMFAGMLASVVESFGDYHSVARIAGRGAPNSSRINDGIGMEGVGNVFAGIMGTGNGCTSYTENVGAIAITGVASRYVVQIGAAVMILVGYFGPAGQLFATIPSPIIGGLYIVMFGQIAAVGLSQLKYVDLDANRNVFIVGFALFAGLAVPEYMSQVGQGMDVGGATALQQGLAAVPVLGSVLGTDVVATTLFVMGGTGMVVGGIVAFVLDNTVPGTREERGLAAWAALTEDDSEYVSALDRIRGRGGDRPSAVSDD

SEQ ID NO: 45942 - protein, 141 aa, Acidobacteria bacterium Ellin345
MKTLQRTLSIIKPDAVEKNAEGDIISILLNNNFRILGIKMLHLTKNQAEGFYAVHANKPFFHSLTDFMASGPIVVMCLEKENAIADYRKLMGATNPANAEEGTIRKKWAASIEKNAVHGSDADDTARFELSYFFAGYELAR

SEQ ID NO: 45943 - protein, 720 aa, Oryza sativa (indica cultivar-group)
MVRQAPADLSAEQLVGLLRPLTPRLYSIASSQAENENEVHITVGVVRYDIDGRARSGGASGFLADRLEEDGDVRVFIEHNDNFRLPANPETPVIMIGPGTGIAPFRAFMQQRDADGAGGKNWLFFGNPHFTEDFLYQVEWQRYVKDGLLTRIDLAWARKCGAGFRKARTFTSAAMPIAWRKTWNTHYWNWWPEHGGMDTEQADEFLSELRLERPYSARCLLMSDKHPGPLVVEGKLADAERMKKESNFLRGTIAEDLNDGLTGGFNGDNFLLIRFHGMYQQDDRDIRAERAEQKLEPRHAMMLRCRLPGGVISPQQWLGIDKFAQESTLYGSIRITNRQTFQFHGILKGNVKPVHQLLNRLGLDALATANDVNRNVLCTSNPVESELHQEAYEWAKKISEHLLPRTRAYAEVWLDQEKVATTDEEPILGPTYLPRKFKTTVVIPPQNDVDLHANDMNFVAIAENGKLVGFNLLVGGGLSIEHGNKKTYARQSSEFGYIPLEHTLAVAEAVVTTQRDWGNRTDRKNAKTKYTLERVGVDVFRAEVEKRAGITFAPIRPYEFTGRGDRIGWVKGIDDQWHLTLFIENGRLLDYPGRPLKTGMAEIAKIHKGDFRLTANQNVIIAGVPESEKAKIDALARDHGLIDDQISEQRKNSMACVSFPTCPLAMAEAERFLPQFVTKVEGIMHRHGMGDEHIVLRITGCPNGCGRALLAELGLVPADC

SEQ ID NO: 45944 - protein, 220 aa, Xylella fastidiosa Dixon
MHSLERLLQNNRNWCERINQEDPEFFARLSKQQSPEYLWIGCSDSRVPANQIIDMAPGEVFVHRNVANVVVHTDLNCLSVIQFAIDVLKVKHILVVGHYGCGGVLASLTRARLGLVDNWIRHVTDVAEKHNPYLETLGALPDQHARLCELNVLEQVMNVCSTSIVRDAWSRTQPLSVHGWVYSLSNGLVHDLGIDVDRFEMLPSCYADALARIQADRLVR

SEQ ID NO: 45945 - protein, 184 aa, Pisum sativum
MGSKLLVLFVFVMLFALSSAIPNKRKPYKPCKNLVFYFHDILYNGKNAANATSAIVAAPEGVSLTKLAPQSHFGNIIVFDDPITLSHSLSSKQVGRAQGFYIYDTKNTYTSWLSFTFVLNSTHHQGTITFAGADPIVAKTRDISVTGGTGDFFMHRGIATITTDAFEGEAYFRLGVYIKFFECW

SEQ ID NO: 45946 - protein, 212 aa, Oryza sativa (japonica cultivar-group)
MEMRVPAAVTGGCGCGVDGGGGCCRGGGKLADWEEGKDDEMKSVVVKGWTRMAQVVPLHDNASAEDDDDDEEDDDEDDDDDDDEDDEEEAAPPYVMAVDDSSVDRAVITALLRRSKYRVTAVDSGKRALEILGSEPNVSMIITDYWMPEMTGYDLLKKIKESSELKQIPVVIMSSENVPTRISRCLEEGAEDFLLKPVRPADISRITSRMLQ

SEQ ID NO: 45947 - protein, 149 aa, Zea mays
  misc_feature (41)..(41): Xaa can be any naturally occurring amino acid
  misc_feature (59)..(60): Xaa can be any naturally occurring amino acid
  misc_feature (62)..(62): Xaa can be any naturally occurring amino acid
MEQTFIMIKPDGVQRGLIGDIISRFERKGFYRKGMKCMNVXRSFAQEHYAGGGGNAWVXXVXERVISGPVVAMVWEGKDVVLTGRRIIGATRPWEAAPGTIRGDYAVEVGRNVIHGSDSVENGKKEIALWFPEGVAQWKSNLHPWIYEA

SEQ ID NO: 45948 - protein, 406 aa, Glycine max
MESRVLSRAGTLFSLPHLRKLPREVGAGPSLVAVKAVGSVADGGNLIWGRQLRPELCSPALKKEAVLLRPCLAAASSPAEGSDSAGEAKVAPAGFFEKYPALVTGFFFFTWYFLNVIFNILNKKIYNYFPYPYFVSVIHLFVGVAYCLVSWAVGLPKRAPIDSNLLKLLIPVAVCHALGHVTSNVSFAAVAVSFTHTIKALEPFFNAAASQFILGQSIPITLWLSLAPVVIGVSMASLTELSFNWVGFISAMISNISFTYRSIYSKKAMTDMDSTNIYAYISIIALIVCIPPAVILEGPTLLKHGFNDAIAKVGLVKFVSDLFWVGMFYHLYNQVATNTLERVAPLTHAVGNVLKRVFVIGFSIIVFGNKISTQTGIGTAIAIAGVALYSFIKARMEEEKRQAKAA

SEQ ID NO: 45949 - protein, 364 aa, Mycoplasma penetrans HF-2
MKSINLPTSMKALVFVEKNKIQIVNKPIPTVGPNDALIKVTTTTICGTDIHIVKGEYPVKPGLTIGHEAVGILAAVGDEVTGFELGERVLAGAITPSGYTAACQSGQSSQDGIGTKYGYKPTAGWKFGNIMDGCQAEYVLVKNAMANLARVPNALTDEQVLMCPDIMSTGFSGPENANIKLGDYVGVIAQGPIGLCATTGAKLMGASIIIAIDGNDRRLEIAKELGATHTINFRNVDVVQEVNRITDGRMLDSAIECLGSQSTFEQGFRLLRAGGTLSSLGVYSSDIKLPLDALAAGLGDHKISFALCPGGSERMRRLMSLIENKRVDLRSLVTHTLPFDRIAEGYNIFANQKDGVLKVAIKVS

SEQ ID NO: 45950 - protein, 385 aa, Cyclamen persicum
AGGVAAGAALIFAAPAIAFAWWRRRKPQEYFYDVPAEEDPEVHLGQLKRFSLRELQVATDGFSNKNILGRGGFGKVYKGRLADGSLVAVKRLKEERTPGGELQFQTEVEMISMAVHRNLLRLRGFCMTPTERLLVYPYMANGSVASCLRERPPSAPPLDWPTRKRIALGSARGLSYLHDHCDPKIIHRDVKAANILLDGEFEAVVGDFGLAKLMDYKDTHVTTAVRGTIGHIAPEYLSTGKSSEKTDVFGYGIMLLELITGQRAFDLARLANDDDVMLLDWVKGLLKEKKLEMLVDPDLEKNYVEPEVEQLIQVALLCTQGSPVDRPKMSEVVRMLEGDGLAEKWDEWQKVEVLHEEVELAPHPNSDWIVDSTENLHALELSGPR

SEQ ID NO: 45951 - protein, 141 aa, Glycine max
MALRATQSTGRIAAAALRRVARPFSTDAVVESDYKRGEIGKVSGIPEEHLSRKVIIYSPARTATQQGSGKLGKWKINFLSTLKWENPLMGWTSTGDPYANVGDSALSFDSEDAAKSFAERHGWDYTVKKPKTPLLKPKSYS

SEQ ID NO: 45952 - protein, 153 aa, Gossypium barbadense
GDAMGMNMVSKGVQNVLDFLQTDFPDMDVIGISGNYCSDKKPAAVNWIEGRGKSVVCEATIKGDVVRKVLKTSVESLVELNMLKNLTGSAMAGALGGFNAHASNIVAAIYIATGQDPAQNVESSHCITMMEAVNDGKDLHVSVTMPSIEVGTV

SEQ ID NO: 45953 - protein, 153 aa, Gossypium barbadense
GDAMGMNMVSKGVQNVLDFLQTDFPDMDVIGISGNYCSDKKPAAVNWIEGRGKSVVCEATIKGDVVRKVLKTSVESLVELNMLKNLTGSAMAGALGGFNAHASNIVAAIYIATGQDPAQNVESSHCITMMEAVNDGKDLHISVTMPSIEVGTV

SEQ ID NO: 45954 - protein, 468 aa, Bartonella quintana str. Toulouse
MSYDVVVIGAGPGGYVAAIKAAQLGFKTAIIEKRMTLGGTCLNVGCIPSKALLHTSEVFAETQHGFEKLGISISKPKLNLEQMMAHKKAVVTANTSGISFLMKKNKIDTFFGTAKILSAGQIEVVARDGNKQTIATKNIVIATGSESSGIPGVNVKIDEKIIVSSTGALALEKVPMRMIVVGAGVIGSELGSVWSRLGSKVTIIEYLNKVLGSMDGEVSRQFQKLMEKQGIEYKTGTKVTAIMQSGSTAQVTFETIKGGASETLEADVVLIATGRFPYTEGLGLVEAGVKLDERGFIAIDANWQTNIPGIYAIGDVVKGPMLAHKAEEEGVAVAEILAGQKGHVNFDVIPSVVYTQPEIASVGKTEEELKAAGIDYNVGKFLFTANGRARAMQKSDGFVKILADKKTDRVLGGHILGFGASEMIHEIAVLMEFGGSSEDLGRCCHAHPTLSEAVREAALATFAKPLHI

SEQ ID NO: 45955 - protein, 789 aa, Shewanella oneidensis MR-1
MQQYVLWYQELGMGDVNLVGGKNASLGEMISNLANAGVQVPGGFATTSYAFNEFLEQSGVNQKIYDILATLDVDDVNALAKVGAQIRQWVIDTPFQPALEQAIREAYEKLAAETSDASFAVRSSATAEDMPDASFAGQQETFLNVKGFDSVLVAIKHVFASLFNDRAISYRVHQGYEHHGVALSAGVQRMVRSDKAASGVMFTMDTESGNNDVVFITSSFGLGEMVVQGAVNPDEFYVHKPILSQGHKAVVRRNIGSKLIQMVYSDDAAHGKQVKIEDVAADKRRQFSINDAEVMELAKQAMVIEKHYGRPMDIEWAKDGNDGKLYIVQARPETVRSREDVQLIERYHLKSRGAVISEGRAIGHKVGSGVAKVLTSIADMDQIQPGDVLVTDMTDPDWEPIMKRASAIVTNRGGRTCHAAIIARELGVPAVVGCGDVTDRIKNGQWVTVSCAEGDTGFIYEGKQEFEVVSNRVDALPALPMKIMMNVGNPDRAFDFARLPNEGVGLARLEFIINRMIGIHPKALLEFNQQDAALQEEINEMIAGYDSPVEFYIARLVEGIASIGSAFYPKKVIVRMSDFKSNEYANLVGGDRYEPEEENPMLGFRGASRYISESFRDCFALECEAIKRVRNEMGLKNVEVMIPFVRTVKEAEQVIELLKEQGLERGKDGLRVIMMCEVPSNALLADQFLEHFDGFSIGSNDLTQLTLGLDRDSGIISHLFDERNEAVKILLSMAIKAAKAKGAYIGICGQGPSDHADFAAWLVEQGIDTVSLNPDTVIDTWLYLAEAHA

SEQ ID NO: 45956 - protein, 621 aa, Listeria monocytogenes str. 4b F2365
MCGFVGCVHDRITEITGADKETFRQMNSMITHRGPDDEGYFTDDHVQFGFRRLSIIDVENGHQPLTYENERYWIIFNGEVYNYVELREQLVAEGMTFETESDTEVIIATYAKYKEKTAERLRGMFGFVIWDKQEELVYGARDPFGIKPFFYAEEDGKLFMGSEKKSILHALKEKELDEVSLQNYMTYQFVPEPDSLTKNVKRLEPGHQFTKKIGQPMEITTYWKASFAPVTKSEDAWIKEVRDVMYDSVKMHMRSDVPVGSFLSGGIDSSIIAAIAKEYHPAIKTFSVGFERDGFSEIDVAKETADKLGVENISYVISPEEYMKELPKIVWHMDDPLADPAAIPLYFLSREARKQVTVALSGEGADELFGGYNIYNEPNSLAMFNKMPSVFKSMLNSVARIMPEGMRGKSFLERGTTPMEERYIGNAKMFTEKEKQILLPKYQAGHDYTNITDPFYAETTNYHPVERMQYIDIHTWLRGDILLKADRMTMANSLEVRVPFLDKEVYNVARNIPDTMKTTNGTTKYILRKAAATFVPEHVLNRRKLGFPVPIRHWLKDEMNAWVKNIIKESPTDHLINKQYVLGLLDDHCAGKFDYSRKIWTVVIFMIWYDVYVADKYDFGK

SEQ ID NO: 45957 - protein, 560 aa, Haloarcula marismortui ATCC 43049
MSLEKPSRDTALDVGVTEDGLDYDALADLLGGHVLDREEHVNAEGFVIRPDEVQEVLSTLKEEAGFDHCACVTAQEYDDRYESIYHLRKYNDPTQELSIVVPSPKDDPHNESAARVYDTADWHEREAYDLVGIDYDDHPDLRRILLPETWQGHPLSQDYNQDQPQIVSLREHANPLKDDKRSEDDPDTMFVNIGPHHPATHGVLHVETVLDGEQIADLEPDIGYLHRCEEQMCQQGTYRHQIMPYPDRWDYISAGILNEWAYARAAEDLADIDVPEYAQVIRTMSAEMCRIASHELALATFALDVFGDFTAVFQYGIRDREIVQNLLEDLTGQRLMFNYLRLGGVAWDLPEPREEYFEKIRDFLDDLPHKLEEIHDLVTGNEIFQMRCVDTGVLSPDQVKQYGATGPVARGSGVDYDIRRDDPYGYYDELDWNVVTEQGGDNFSRVLVRLREVEESARIIEQCVDLLEQWPEDDREIQANVPRTLRPDPDKEIYRSVEGAKGELGIYIRSDGTDKPARFKIRSPCFSNLQTLPEMSQGEYIPDMIASLGSLDIVLGEVDR

SEQ ID NO: 45958 - protein, 153 aa, Haloarcula marismortui ATCC 43049
MIGILKSMATTMKHALDGETFTVEYPDVAPEVSPRFRGVHKWSQERCIWCRQCENVCPNNTIQIVMDEQRNGEQYNLHIGQCIYCRLCEEVCPTDAILLTQNFEFTADTKDEFAYDKEQLKNVPWYKDIDPLESREPDRGAWIGEGDGEVDYQ

SEQ ID NO: 45959 - protein, 482 aa, Debaryomyces hansenii CBS767
MLRVKNISNSVRLASRARHGSLSSRAFSNFSRLNAAVNDESNVKPFKHALGRDAQRYSDEPGTFGKTTFTESMDEVDMTWGRDDDPKHVEKQNTKIRHFTINFGPQHPAAHGVLRLILELHGEEIVRADPHVGLLHRGTEKLIESKTYMQAIPYFDRLDYVSMMTNELVFALAVEKLLNIEVPLRAKYIRTLFGEITRILNHCMSVLSHIMDVGGLTPFLWGFEEREKLMEFYERVSGARLHSNYVRPGGVSQDMPVGLLDDIYMWATQFGDRIDETEELITDNRIWAARTKDVGVVTAEDALNYSLSGVMLRGSGIPYDIRKAQPYDAYELVDFDVAVGMNGDCYDRYLIRMAEFRQSLRIIYQCINDMPNGPIKTEDFKVSAPPRSMMKEDMEALIHHFLLYTKGYAVPQGETYTAIEAPKGEMAVYVVSDGSERPYRCKIRAPGFAHLGAFDHISRGNLLADAVAIIGTMDLVFGEVDR

SEQ ID NO: 45960 - protein, 603 aa, Xylella fastidiosa Dixon
MTVIEIKVPDIGDYSKVPVIEVLVTVGDHVVKNQGILTLESDKATLEVPSMNNGVVKELKVNVGDLLSQGDVILLLETEDTTAPPSPSNAATSDTTSPPPPSPQPAASKPTAPDQQHSDIKCRMVVLGAGPGGYTAAFRAADLGLDTVLVERYPNLGGVCLNVGCIPSKALLHAAAVIDEAAHASTFGIDFGKPKITLDTLREYKQNVVNKLTAGLAVMAKQRKVRTVTGIAHFVSPNTLDITAADGSTQRLHFQQCIIATGSHPVKLPNFPWDDPRIMDSTDALELAEVPKKLLVVGGGIIGLEMATVYNALGSHVTIVEFMDQIIPGTDKDLVKPLADRMKKQGIEIHLNTKASHVKADKKGITVSFEAPTQGTQPALKTSTYDRVLVAVGRTPTGNNISAEKAGVNVTERGFIPVDRQMRSNVPHIFAIGDIVGNPMLAHKATHEGKLAAEVAAAETESGKHREWVARVIPSVAYTNPEIAWIGMTETEAKAKGLNIGVAKFPWVASGRAIGIGRTEGFTKLIFDEDTHRIIGGAIVGVHAGDLLAEIGLAIEMGAEAEDISHTIHAHPTLSESIAMSAEVYDGTITDLYLPKKSATSAK

SEQ ID NO: 45961 - protein, 287 aa, Solibacter usitatus Ellin6076
MERFASGWKQNYYGKGDVIVYRLNRDGVVPQGCCPVFGANVKMLLYGDAFWPTYTTGDNTNLVATDSMKNFIQRETCNFTGYDLESYCDFLARKFMATYPHTAGIQLSARQAPYSGVAEGKVAFAPSGPDVATACVELRRNGEALESVEASSGIHGFRLLRLGGSAFQGFLRDQYTTLPDIHNRPLHMWLDLEWHYIAPEAALTGGEVTAQVRRLVHEGFHSFESGSIQQVIYQLGTKMLADIPTISEVRLEANNRTWDTIVEQGDRLGVYTDARPPYGCLGLTLRR

SEQ ID NO: 45962 - protein, 457 aa, uncultured marine proteobacterium ANT8C10
MEFNSHEELVAASTKAAQKWRLVPAPQRGEFIRQFGNELRNQKTELAKVITKEARKIVSEAEGEVQEAIDMCDFATGLSRQLYGLTMPSERPDHRLQELWQPIGVVGCITAFNFPMAVFAWNFCLASVCGNSIIWKPSPHSNGCSDALKKAWDEVAGEHKDLVLLLKGGNEEASALCKDTNIPLISATGSTQMGKELAPIVSARLGRTLLELGGNNAAIICPTADLDLTVKGITFSACGTTGQRCTSLRRAFVHEDIYEEFMQKLHAYYATLKIGNPSDSSNQIGPLISERSYNDMQRVLESISNKDVTVHGGQRLEVGDPEEFYVMPAIVEVSQIEDEMLNETFAPILYVKKFTDLTNAIEMQNNVKQGLSSSIFTNDMRESELFLSSEGSDCGIANVNIGTSGAEIGGAFGGEKDTGGGRESGSDAWKAYMRRVTATINYGEDLPLAQGVEFDES

SEQ ID NO: 45963 - protein, 384 aa, Marinobacter sp. ELB17
MSATTNIAITPGDGIGPEVVNQAVNCLALLRQRFKLDLDWHQFPWPSHHWHQQHGESMPADALEQLGAFDAILLGALGDPGPVTDHNRYLLSDSVSLAPLLQIRKGFDQWACERPARLLPGARQYLADDRARDIDMLVIRENSEGEYVSQGGRLRQGTPHEVATQIEVFTHFASERIIRYGFEQARARAIHRKQHDETRQFQTLDGRVCDSQVCLVTKRNALRYWGDLYTEVFERMSLEYPDVATHHELVDAACMKFVQSPWAFDVVVASNLQGDILTDLAAVLSGGLGVAPSCNLNPTDPTMPSMFEPTHGSAPDIAGQGLADPTAMLFTTARMLDWLAHKDPTMAAAGHALFEATAADLAQHGGKRRSTAEIGAAVCARLNA

SEQ ID NO: 45964 - protein, 367 aa, Azotobacter vinelandii
MPLFNFRGTQRMWYDGFLDPTPWQLIMVTLLITHLTVVSVTVYLHRYSAHRALELHPAVKHAFRFWLWLTTGMNTREWTAVHRKNHACCETPEDPHSPRYKGLANVLWRGAELYKAEAGNTETLRIYGKNCPDDWIERHVYSRFPNGGAMLMLLIDLALFGAFGLSVWAVQMLWIPFWAAGVVNGLGHAVGYRNFECRDAATNLVPWGILIGGEELHNNHHTYPGSAKLSVRPWEFDMGWAWIRLLVLLGLAEVKRTVPVAHRVADKRHLDMDTARAILNNRFQIMAHYRSRVIAPQVRMEAARAEASVRHLFHRDKGLLARESSLLEARQQARIQSLLEQSQTLRVVYERRLALQQVLDPDQRQRA

SEQ ID NO: 45965 - protein, 118 aa, Arabidopsis thaliana
MRGVTETDKLANGIFHLVCLADLEFDYINPYDSASRINSVVLPEFIVQGVLCVFYLLTGHWFMTLLCLPYLYYNFHLYSKRQHLVDVTEIFNLLNWEKKKRLFKLAYIVLNLFLTIFW

SEQ ID NO: 45966 - protein, 129 aa, Gossypium barbadense
AHASNIVAAIYIATGQDPAQNVKSSHCITMMEAVNDGKDLHVSVTMPSIEVGTVGGGTQLASQSACLNLLGVKGASKETPGANSRTLATIVASAVLAGELSLMSAISAGQLVRSHMKYNRSSKDVSKAT

SEQ ID NO: 45967 - protein, 478 aa, Mycoplasma penetrans HF-2
MENTFYKGSAYINGKFVDSEKTIPVISTIDGSTIGSVAALSKKDIDMAFEGAHLAFNLWRNLTPEMRIKKIKEFAEYFIAEKEFLATLMSYEIGKSYNDALKEVERSYENIFETIEVYEKEFVNPSVIGPEVNKIKGKTGYFYNVPVGVVLAIAPFNYPINLGLAKIIPTLLVGNTIVFKPATQGSLVSSQLAKYFDQANFIAGVFNLVTGKGSEIGDYILENKRIQGATFTGSSDIGFKLASKLPMKPLVLELGGKDAAIVTNNADVELAAKEIIKGAFGYSGQRCTAIKRVLVTKEIADDLLIHLIKEAQKLKVGNPLNNPDITPLIDRKAVDFNIDLIDDAINHGANLVYGGNIEGYNLLRHTILDNVSTKSKLAWEEPFGPVLPIIRVSTINEAIAIANASEYGLQGSVFTKDLEEARTIAKYLDTGTVNINRGSSRGPDIFPFIGIKKSGFGVQGIRDSLKAMTRVKGIVENE

SEQ ID NO: 45968 - protein, 470 aa, Thermobifida fusca YX
MASLPSVSYSITVRLEIDGRASAVSSLTNAVERVGGAVTALDVNSSGRERLRIDVTCAARDTNHAQAIVEALDAVEGVTVHKVSDRTFLMHLGGKIEMRSKVPLRNRDELSMAYTPGVARVSAAIAANPEDARRLTVKRNSVAVVTDGSAVLGLGNIGPEAALPVMEGKAALFKRFADIDAWPIALDTQDTDEIVRAVQLIAPGFGGINLEDISAPRCFEVEARLRELLDIPVFHDDQHGTAIVVLAALKNALRVVGKELGSVRIAMSGAGAAGTAILKLLLHAGAKDVVVCDVHGAVHQGRGDLDANLRWIAEHTNPDGYAGDLAGAVRGADVFIGVSAPNLLSGEEIAEMNEDAIIFALANPEPEVDPEIAALHAAVVATGRSDYPNQINNVLVFPGFFRGLLDAQSHRVTPDMMLAAASALAAVVTEEELSPHYIIPSVFHPGLAQRVAEAVREVALREGGVERHEN

SEQ ID NO: 45969 - protein, 226 aa, Arabidopsis thaliana
MTSGGGYGDPSQKIDYVFKVVLIGDSAVGKSQILARYARDEFSLDSKATIGVEFQTRTLVIDHKSVKAQIWDTAGQERYRAVTSAYYRGAVGAMLVYDITRRQTFDHIPRWLEELRAHADKNIVIILIGNKSDLVDQRAIPTEDAKEFAEKEGLFFLETSAFNATNVESAFSTVLTEIFNIVNKKSLAASEDQENGNPGSLAGKKIDIVPGPGQVIPNKSNMCCNS

SEQ ID NO: 45970 - protein, 948 aa, Rhodopseudomonas palustris CGA009
MALVHETDFGTPPSLSENMVTLTIDGRSVSVPEGTSIMRAAMEIGTAIPKLCATDMVDAFGSCRLCLVEIDGRSGTPASCTTPVADGLVVHTQTERLKQIRKGVMELYISDHPLDCLTCSANGDCELQDMAGAVGLRDVRYGYSGEKHPNPGLDESNPYFTYDASKCIVCSRCVRACEEVQGTFALTIAGRGFDSVVSPGMQESFLGSECVSCGACVQACPTATLNEKSVIEIGTPERSVVTTCAYCGVGCTFKAEMRGEELVRMVPYKDGKANRGHSCVKGRFAWGYANHKERILKPMIRGKITEPWREVSWDEAFAYAASELKRIQAKYGRDSVGGITSSRCTNEETFLVQKLIRAGFGNNNVDTCARVCHSPTGYGLSTAFGTSAGTQDFDSVEHADVVMIIGANPTDGHPVFGSRLKKRLRQGAKLIVVDPRRIDLVRSAHVEAAQHLPLKPGTNVAVLTALAHVIVTEGLANEAFVRERCDWSEYEHWAAFVSDEKHSPEATAAFTGVDPQAVREAARLYATGGNGAIYYGLGVTEHSQGSTTVMAIANLAMATGNLGRPGVGVNPLRGQNNVQGSCDMGSFPHELPGYRHISTDAVRESFEALWNVKLDNEPGLRIPNMLDAAVEGSFKALYVQGEDILQSDPNTKHVAAGLEAMECVIVHDLFLNETANYAHIFLPGSTFLEKNGTFTNAERRIQRVRKVMTPKNGLEDWEVTLRLAEAVGYKMNYTHPSQIMDEIAALTPTFTGVSYDRLEELGSIQWPCNERAPEGTPVMHIDHFVRGKGKFVITEYVATDERTGPRFPLLLTTGRILSQYNVGAQTRRTANTVWHDEDRLEIHPHDAEQRGVRDGDWVRLASRAGETTLRALITDRVAPGVVYTTFHHPDTQANVVTTEYSDWATNCPEYKVTAVQIAPSNGPSEWQRSYEQQAAAARRIAVPAEAAE

SEQ ID NO: 45971 - protein, 108 aa, Triticum aestivum
  misc_feature (68)..(68): Xaa can be any naturally occurring amino acid
MAEPPPPPSQSPAQTPPPTQQQTPAANARDGMMACVAALEAALLPCLPARELQAVDRSLQSSHQRDYXMEEELKTKSELIAKHKSLIEGWQKELKDQLGKHNTELERV

SEQ ID NO: 45972 - protein, 486 aa, Oryza sativa
  misc_feature (252)..(252): Xaa can be any naturally occurring amino acid
MGKKHAAAGSGGGWLAAVRKVFRPSKDAADKKGGGGGDREEEAAAEAAPEVLLLEHFPAGGTSPSAEGTGNDQGGTVVGKGEGEEEDGEDGYGEVERARALAAAAEAAVAAAEAAARVVRMSALRRASREERAAVRIQAFYRGYLARRALRALRGLVRLQALVRGHQVRRQVHLTMRCMQALVRAQARVRARRLITDHIHAGVAPLRLPPLPPATAAATYSSRRREGGYSWHPLRNNSYHAQLGERDESDDXVDGDGGKVGEHARQQQQRQRGNDVRSRSPFRSWDGSSRTPEEDRAEGARRHDAAARRERARAYAYGYQQQRQWQEKAGGFQWLDRWMAAQAQQHAPEPDKSRRRAALTAAADGTTMPERTVEMDTTSYRSPLNSHSAAVQGRPPAVPGYMAATQAARARARTAPPATPAHARSRSGAVLAGDTSSSGQSGSGSGGGGAHVQKPCAVYSPESRGTGDWTPPRLAVSSRATRLVYA

SEQ ID NO: 45973 - protein, 141 aa, Zea mays
  misc_feature (133)..(133): Xaa can be any naturally occurring amino acid
RERESASDLGQSVSVLGVSFSYPRPRRVCAWPPPRQLRPACACSAGAGISICCLPIDGSRASDFGLMKIDDTGRVISFSEKPKGDELKAMQVDTTVLGLSKEEAENKPYIASMGIYIFKKDILLNLLRWRFPXANDFGEFH

SEQ ID NO: 45974 - protein, 304 aa, Oceanicola granulosus HTCC2516
MILACGEALIDMLPRTTESGEDTYLPAPGGAVFNTAVALGRLGAPASFFSGLSSDFFGDMLRASLAESGVDTTLAPVSDRPTTLAFVKLVNGQASYLFYDENTAGRMLEEDDLPETDARALFFGGISLMVEPCGSAYEALMRRAAPDCVTMIDPNIRPQFIRNESAYRARIGRMIAAADIVKVSDDDLRWLEGDGEIACLARRMLEQGPKLVLVTRGGDGVTGYTRAHTIDQPAVPTQVVDTVGAGDTFNAGILASLHARGALTKYRMETLDEETLAAALALGARAAAVTVSRAGANPPWASEL

SEQ ID NO: 45975 - protein, 154 aa, Triticum aestivum
  misc_feature (48)..(48): Xaa can be any naturally occurring amino acid
  misc_feature (101)..(101): Xaa can be any naturally occurring amino acid
  misc_feature (112)..(112): Xaa can be any naturally occurring amino acid
MAEQTFIMIKPDGVQRGLIGEVISRFEKKGFYLKGLKLQNVEKSFAEXQHYSDLSSKPFFAGLVEYIVSGPVVAMVWEGKSVVATGRKIIWAPPTPWASEXPGTIRGDFAVXDIGRNVIHGSDSVESARKEIALWFPEGIAEWRSSQHNWIYEA

SEQ ID NO: 45976 - protein, 393 aa, Neisseria gonorrhoeae
MIIDVKVPMLSESVSEGTLLEWKKKVGDAVARDEILIDIETDKVVLEVPSPQAGVLVEIVAQDGETVVAGQVLARIDTAATVAAEAPAAAPAEAAPAAVPAAAQNNAAMPAAAKLAAETGVDVNVLQGSGRDGRVLKEDVQNAAAKPAAAVAPAVALPAGARPEERVPMSRLRARVAERLLASQQENAILTTFNEVNMKPIMDLRAKYKEKFEKEHGVKLGFMSFFVKAAVAALKKYPVVNASVDGKDIVYHGYFDIGIAIGSPRGLVVPILRDADQMSIADIEQAIVDYAKKAKDGKIAIEDLTGGTFSITNGGTFGSMMSTPIINPPQSAILGMHATKERAVVENGQVVVRPMMYLALSYDHRIIDGREAVLTLVAIKDALEDPVRLLLDL

SEQ ID NO: 45977 - protein, 355 aa, Synechocystis sp. PCC 6803
MGAMGVNFLAGDIGGTKTILALVTINESSPGLARPVTLFEQTYSSPAFPDLVPMVQQFRQEAAFVLGNPISVAKACFAIAGPVIDNTCRLTNLDWHLSGDRLAQELAIAQVDLINDFAAVGYGILGLGSEDLTVLQAAPVDPSGAIAILGAGTGLGQCYVIPQGQGRYRVFASEGAHGDFAPRSPLEWQLLEYLKKKYSLGRISIERVVSGMGIAMIYEFLRHQYPERESAQFSKLYQTWNREKDQETKTVDLAAAVSQAALEGTDVLADQAMELFLGAYGAEAGNLALKLLPRGGLYVAGGIAPKIIPLLEKGSFMQGFSDKGRMQSLMGTIPVQVVLNAKVGLIGAAVCAAQS

SEQ ID NO: 45978 - protein, 459 aa, Neisseria gonorrhoeae
MSQYDVVVIGAGPGGYVAAIRAAQLGFKTACVDAGVNKAGNAPALGGTCLNVGCIPSKALLQSSEHFHAAQHDFAEHGITVGDVKFDVAKMIERKDAIVTKLTGGVKFLFQKNKVTSLFGTASFAGKNGDAYQIEVDNKGEKTVIEAKHVIVATGSVPRPLPQVAIDNVNVLDNEGALNLTEVPAKLGVIGSGVIGLEMGSVWNRVGAEVTILEAAPTFLRAADQQIAKEAFKYFTKEQGLSIELGVKIGDIKSEGKGVSVAYETAAGEAKTEVFDKLIVAIGRIPNTKGLNAEAVGLEKDERGFIKVDGECRTNLPNVWAIGDVVRGPMLAHKASDEGVAVAERIAGQKPHIDFNNVPFVIYTDPEIAWVGKTEEQLKAEGVEYKKGTSGFGANGRALAMGKAKGTVKVLADAKTDRILGVHMIGPVVSELVTEGVTALELTKTGTALPRPGPKGTIP

SEQ ID NO: 45979 - protein, 302 aa, Zea mays
SGDSACSLPTRTVSAQCLEVIRSWTTKLAKRLNVCGLMNCQYAISTSGDVFLLEANPRASRTVPFVSKAIGHPLAKYASLIMSGVTLPELGFTKEVIPKHVSVKEAVLPFEKFQGCDILLGPEMRSTGEVMGIDYEFSGAFAKAQIAAGQKLPLSGTVFLSLNDLTKRHLAEIGSGFRELGFSIIATSGTAKVLQLEGVPVEPVLKIHEGRPNARDMLKNGQIQIMVITSSGDALDSKDGLQLRRLALAYKVPIITTVDGARASIDAIKSLKDKSIEILALQDYFQTADASADLQAAAQTTP

SEQ ID NO: 45980 - protein, 508 aa, Rhodopseudomonas palustris CGA009
MSFAYFDWIAHHAEVRPERIAVVDLASSRKISYRAMDERVDRLAAHLAALGVGRGDRVAVLALNAVETLEVQFACFRLGAIFVPLNVRLTVHELSYIVGDAAPRVLAHDDELAPMAKELKAACSVPHLLAFGAAYEAALAASPRLGASEPVTLDDVSTIMYTSGTTGKPKGAMITHGMTFINAVNLGIPAFISQRTVFLCVLPLFHTGGLNCYTNPVLHAGGTTLLMRAFDPGAALSIIGDPSVGLTHFFGVPSIYQFMCQHPAFAATDLSRLQIAGVGGAPMPVPLLKIWQERGCALVQGYGMTETSPAVLMLDADDAARKAGSAGKPVLHADLKIVGPDGDPVKPGEMGELWVKGPNITPGYWNRPDANRTSFTDGWLHTGDAARVDDEGFYYIVDRTKDMYISGGENVYPAEVEDVLYQLPEIAEAAVIGAPDPQWGETGVAVVALKPGQELSEAKLLAHCRERLARFKCPQRVSFVEALPRNATGKVHKPTLRERILVRETADA

SEQ ID NO: 45981 - protein, 237 aa, Glycine max
NKASFLLRNVLGKWSSKLFAIALLASGQSSTITGTYAGQYVMQGFLDLRLKSWIRNLLTRCLAIVPSLIVALIGGSAGAGELIIIASMILSFELPFALIPLLKFTSSKIKMGEHVNSITISAITWIIGSLIMGINIYYLLTSFVKLLLHVHLKIVTKVFLGILGFSGVTLYMGGIAYLVFRKNKKTTHFLAFRTSEEQQVANEQGDISMYNLPREDIVSMQLPQNSRSPTDIDREIS

SEQ ID NO: 45982 - protein, 293 aa, Bartonella henselae str. Houston-1
MVNLTIKREKKKIPRAFVVGTPIHHSKSPKIHNFWLKQYDLQGEYLAQEVTSEEFRDFLTSLKRRGFCGGNVTLPHKQEAFHLANYKDDVATMIGAVNTLWYEGDKLCGTNSDAYGFSANLDDSAPDWMGETALVFGAGGAARAILYALKKRGFERICLVNRTKQRAESLAEHFGKPVEVCDWYKAHEILYQADLIVNTTSVGMINSNEKESTSFFCDFHKTKTTALVTDIVYTPLVTPFLQRAKAHGLRTVDGLGMLLHQAVLGFERWFGIRPRVTKALRATILQDMGEKRG

SEQ ID NO: 45983 - protein, 307 aa, Nostoc sp. PCC 7120
MSIIVFGSINIDLVATAPKLPGAGETLLGEDFFKVPGGKGANQAVALARLGVPTQMVGRVGAQSFGAELMQNLQDAGVQTDNIFVDETASSGVAMITVAHNGENQIVVIPGANGRVNQVDVERLSRILPTATALLLQLEIPVPAVIAAAQAARSNNITVILDPAPAPSDLPTELYSFVDIITPNEVEAGQLVGFPVDGEDAARKAAGVLLQKGVKSAIVKLGAKGVVCATNKETFFVPAFSVDTLDTVAAGDAFNGGLATALYSGLSLHQAVIWGAAAGALAATKLGAQTSLPDKLTFEAFLKERVL

SEQ ID NO: 45984 - protein, 576 aa, Oryza sativa
MAVEGRRRVPLPLPPPTRRGKQQQQQGGERARRVQAGDALPLPIRHTNLIFSALFAASLAYLMRRWREKIRTSTPLHVVGLGEILAICGLVASLIYLLSFFGIAFVQSVVSNSDDEEEEEDFLIDSRAAGPVAAQATPPPAPAPCSLLGSACAAPKKMPEEDEEIVAEVVAGKIPSYVLETRLGDCRRAAGIRREAVRRTTGREIRGLPLDGFDYASILGQCCELPVGYVQLPVGVAGPLVLDGERFYVPMATTEGCLVASTNRGCKAIAESGGATSVVLQDGMTRAPVARFPSARRAAELKGFLENPANVDTLAMVFNRSSRFARLQRVKCAVAGRNLYMRFSCSTGDAMGMNMVSKGVQNVLDYLQDDFPDMDVISISGNFCSDKKSAAVNWIEGRGKSVVCEAVIKEEVVKKVLKTNVQSLVELNVIKNLAGSAVAGALGGFNAHASNIVTAIFIATGQDPAQNVESSQCITMLEAVNDGKDLHISVTMPSIEVGTVGGGTQLASQSACLDLLGVKGANRESPGSNARLLAAVVAGAVLAGELSLISAQAAGHLVQSHMKYNRSSKDMSKVAS

SEQ ID NO: 45985 - protein, 753 aa, Methanosarcina barkeri str. Fusaro
MASVETTERLGCSLGFFSTFAIGTGTMIGAGIFVLPGIALADAGSGAIISFLLGGLISIATAISMSELATGMPLAGGSYYYISRTMGAALGAIIGLGSWLALIFKGTFALIGLAEYAQIFYPLPLYFVAAATGVILLVINYRGAKSSGSLQNFIVIFLLVILALFIARVSFMVNPANLSPATSYGGTSIITTAGVIFISYLGLAEAAAVSEEVKNPSKTLPLAFIASAVVVTLFYVSTMAVVVGFSDPQVTGKSITPLADIAGLLAGESGRIAISLSALLATLSTANGAILSSSRFPFAMSRDALMPEWFVLIHQKFETPHNAILVTGIVMVLLLFLFDIEELARLGGAFNILIFILLNMAVIILRKRNLPGYEPTFRDPFFPYTQIFGIVGSIVLLPLLGGLPLLFTIMMIFAGIGWYSFYGRGKAVPEYNLFDLLENTVEKKEIEPVPLVKVLVPISNQKHERDLLKLADFMGSEIICLHVIEVPDQTNLKLAQEAYHEKKIEMDCRFKEEFENYPAILGHKREYIAAFDHNISNSILEQAEIEHADMIIMGWHEPKRFEYSHGVTNQVLLSSKSPIALLKGHLPDSINKILVGYNGKENSIYGLSLAEKLAVNTGAGIEIISIISPDEAQENRQKITDELESLVKKISSIPVSFRVLEKYSIEDALLEASNNNDLTIIGDSSERFKISLLGTLSQRIAKHSKKPIVVVKKSKPISKESFNYLVKKHARKIYARLRGKEVKLNSDKSAVLA

SEQ ID NO: 45986 - protein, 198 aa, Zea mays
MQGLTPTYKLSSISVVILLLVLTGGGGVAHGRKKKLVSSYDEPCQQMTVYYHDILYDGTNTANATSAVAAQPTLLSRSVSVNDTYFGEVVVFNDAVTAGRALASEPVARAEGFYFYDRKESLSAWFAFSLVFNSTAHRGTLNLMGPDTIAAKTRDISVVGGTGDFFMARGIATLRTDTFQGSYYFRLQMDIKLYECYV

SEQ ID NO: 45987 - protein, 290 aa, Lactobacillus sakei subsp. sakei 23K
MISGYTALYGLIAHPAQHSLSPFIHNTGFHQIQMDARYAVFDSQATPAAITSAIKTLGIRGVNLSMPYKQSLVPLVDNLTSTAKLVGAINTIKNEAGRLTATNTDGDGFWCALQKAHPQRRYRSVTILGAGGAALAVIEAAVRYGVQQVTVFKRANATYDSVIQRLAQISLASGLQIIVEPYDDQLALATALQNADCLINATNIGMTATPGNPLPINLLQYLPEDSLVADLIYAPRETAFLKTAQKAHYQIQNGLGMLIEQAALSFEFWTNESMATMPIYQHLTGGNDAS

SEQ ID NO: 45988 - protein, 511 aa, Aspergillus nidulans FGSC A4
MADLFVDLVAPNGTHYSQPTGLFINNAFVASSGQTITSLDPATDKPIATVHAASAEDVDRAVIAARAALVHPSWKKLPGTERGQLMARLADLMEKNKELFATIDAWDNVLSLTEKSGKPYHIALSEDLVEAIGTIRYYSGWADKTFGQTISTTPAKFAYTIRQPVGVVGQIIPWNYPLSMACWKLGPALACGNTVVLKPAEQTPLSVLVLGSLIKEAGFPPGVVNIVNGYGREAGAALAGHPLIDKIAFTGSTVTAREIMKLAAGTLKNITLETGGKSPLLVFPDADLEQAVKWSHFGIMSNQGQICTATSRIYVHQDIFQLFLSKFKAAVETTSKIGDQWDESTFQGPQITRAQYDRILSYIETAKKGGMAVVTGGSAHAPSSEKNKDGYFIQPTVFTGTDDSHAIVREEVFGPVVVILPFASEEEAIRRANDTTYGLGAAVFTCDLERAHRVAAEIEAGMVWVNSSQDCDPRVPFGGVKQSGIGRELGEAGLEAYTQVKAVHVNMGNKL

SEQ ID NO: 45989 - protein, 285 aa, uncultured marine gamma proteobacterium EBAC31A08
MSILQSFTFQELKNLLPNRAKDSHKGNFGKVLICAGSPGMGGAGILASEASLFCGSGLVTLVTDTSNVSPSLLRNPEVMAIGVDMVEGVDIDLKIKDHSVILYGPGIANTAFAKTILGKILKSANNSKIILDAGALHIVASSKSLIKKSNKTILMTPHPGEAAILLNISIEEVQRDRISAAKQIADTYGASIVILKGMGTVVFDSTNNKSFICACGGPELASGGTGDVLAGVLTALLAQGLDIRNASIIAVAVHSEAGLKFKVDIGEIGLNASSLIPIIRQLINR

SEQ ID NO: 45990 - protein, 182 aa, Wolinella succinogenes DSM 1740
MSVLDENQKQFLLDSIRNIPDFPKPGIQFKDITTLLNDPKAFGFLIDFLTDRYARFELDYVAGIESRGFIFGAALAAKLEVGFVPIRKKGKLPSTTIAEKYSLEYGFDEVEIHIDAFREKEGSRVLLIDDLIATGGTAEAAVKLIQSAKGHCVEACFLLNLEELGGAKKVSNLAPLYTLLDI

SEQ ID NO: 45991 - protein, 187 aa, Brassica napus
MPIDKIFKDDASEEKGERARMASFIGAMAIADLVKSTLGPKGMDKILQSTGRGHSVTVTNDGATILKSLHIDNPAAKVLVDISKVQDDEVGDGTTSVVVLAGELLREAEKLVTAKIHPMTIIAGYRMAAECARDALLKRVIDNKENAEKFRSDLMKIAMTTLCSKILSQDKEHFAEMAGDAVFRLKG

SEQ ID NO: 45992 - protein, 533 aa, Gibberella zeae PH-1
MGVVEALLEQVTLKTTLVILFVSYCIYSIICRIDEHRRIRRLGHYGPHMKTYAPWGLGIVARFVVSTVKHQNLATWRDDMFGAENSWTVETRLLGVRTIFTADPANLKAILATQFVDYGKGKPFHAEWKDFLGDSIFTTDGAPWHASRQLIRPQFTRDRVSDLHCFEAHMQTLFKAIANRGPLHGEDQPVPTEGLDGKVLDISDLFFRYTLDVATEFLLGWDVKSLTTPRQEFAEAFNDVQRIQNIVARTGKLRHIIPRYKFWKGLKTVNHFINFYIERALRLSPEELNSKTKDDHSYTFLHALAGFTRDRKVLRDQIIAVLLAGRDTTAATLSWTLYELGRYPNAVKRLRSEILSTLGSERTPTYDDLKSMSYLKAVLNETLRLYPAVPFNVRLALKDTTLPRGGGPDGSEPLPVLKDSPVGYSTLVMQRRSDLYPPISDTFADPQIFSPERWAHWHPKPHDYIPFNAGPRICIGQQFALTEMSYVLCRLFQKYERVESRMKDIDGGEPLLKADIVLSPGQGVNVAFWEAKK

SEQ ID NO: 45993 - protein, 624 aa, Synechococcus sp.
MSPTAAPQKLSKVEDLKARSQYLLEPILSQLQEESTHFNEDGIQILKFHGSYQQDNRDNRVKGQEKDFQFMLRLRSPGGYIPPQLYLTLDQLADDYGNGTLRATTRQAFQLHGILKRDLKTVIRRIVENLGSTISACGDVNRNVMAPPAPFRDRPEYEWARTYANNIADLLTPESGAYYELWLDGEKVLSGEPDPAVLAARRNPKGRVADSVEPLYSDRYLPRKFKIAVTVPGDNSIDLFTQDIGLVVIGNDRGELEGFNVYVGGGMGRTHNKEETFARLADPLGFVPAADIYAAVQAIVATQRDYGDRSNRRHARMKYLIHDWGIAKFKEAVESVFGKAIAPVRELPPFRYRDYLGWHEQGDGKWFLGLPITSGRIKDDGNWQLRSALREIVSRWQLPLLLTGSQDVLIYDVQPGDRAAIDKLLRDRGVHTVEAIDSLQRYAMACPALPTCGLAITESERALPGLLVRIRRLLEEQGLPDEHFVVRMTGCPNGCARPYMAELAFVGSAPNTYQLWLGGSPDQTRLARPFIDRLADGDVETQLRPLFVFFKQSRQAGESFGDFCDRVGFDALRQFSESYQHEAAKPGYRVGLRADVHGRLKAEADKRGVSLTDLACEAIAAYLR

SEQ ID NO: 45994 - protein, 245 aa, Arabidopsis thaliana
WAEGKTNQLTLLMNRDNWENRQILSGRCKANNGTWFGITKGGRVAFLVNTSLLLDRVKSYSGSELYPVRFLEGNMSPEQFANEVKVHEKETNERHAYSLVVADMTSSSMVHILKPSDTKSDVVIETVPFGVHTLSSYEGLDSTDSARDLLLRRLFTQMVGNLGNVQQRQMEEIAGRFMYDAQAGRDAVFYHSRDEHPNGKLGTQRFGTTSTTALVVKRTREVMLFEKYMEQNGAWNTNNFAFNIQ

SEQ ID NO: 45995 - protein, 191 aa, Arabidopsis thaliana
MDHTLCKQVVQPVTRKVKKHGKDEFDRIKQAEKKKRRLEKALATSAAIRAELEKKKQKRLEEQQRLDEEGAAIAEAVALHVLLGEDSDDSSRVKFGEETGFGMDLFRDERTNYVPRQSCASYAVQGIGFVSNGYGLGDSNWSVSYKPFMKDVWDNNMVISADLIAAQAVSSLQISEDADRNAYVFETMFGG

SEQ ID NO: 45996 - protein, 418 aa, Bradyrhizobium japonicum USDA 110
MALRRRPPNRRCLVSEPLVIVGNGMAAARLVDELAKTSLGRYAVAVIGDEPRLAYNRVLLSSVLAGETGSHEIELRPADWWRHRGVTVRYGYRVTEIDTGRRELKIEGEESMEYSKLVLATGSTPLRLNVPGADLAGVHTFRDTRDVDLLLTLAAAKKRVVVVGGGLLGLEAAYGLAKAGAPVTLLHLMDRLMERQLDGPAADLLKTLVERKGIRILLNASTKCIHGDGHVEAVELADGSRIEADAVIFAAGIRPNIALAKDAGIAVNRGIVVNDVMQTASPDIFALGECAEHRGTCYGLVEPAYEQARVLARHLAGRPAAYQGSVVSTNLKVSGVSVFSAGDFIGGEGSESLVLSDRRRGTYKKLVIADGRLTGAVLIGDTVDALWYLELIRNRDKVAAIRTDMMFGRALARPSKAA

SEQ ID NO: 45997 - protein, 520 aa, Citrus sinensis
MASMASIGSLKVPSSPSTATTSSNSNNHSRRSVVKRLAFSSSQLSGDKIFSKAVTGDRRSERRPIVVSPQAVSDSKNSQTCLDPEASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEFLVLAGDHLYRMDYERFIQAHRETDADITVAALPMDEKRATAFGLMKIDEEGRIIEFSEKPKGEQLKAMKVDTTILGLDDERAKEMPYIASMGIYVISKDVMLNLLRDKFPGANDFGSEVIPGATSIGMRVQAYLYDGYWEDIGTIEAFYNANLGITKKPIPDFSFYDRSAPIYTQPRYLPPSKMLDADVTDSVIGEGCVIKNCKIHHSVVGLRSCISEGAIIEDTLLMGADYYETDADRRFLAAKGSVPIGIGKNSHIKRAIIDKDARIGDNVKIVNSDSVQEAARETDGYFIKSGIVTIIKDALIPSGTII

SEQ ID NO: 45998 - protein, 457 aa, uncultured marine proteobacterium ANT32C12
MEFNSHEELVAASTKAAQKWRLVPAPQRGEFIRQFGNELRNQKTELAKVITKEARKIVSEAEGEVQEAIDMCDFATGLSRQLYGLTMPSERPDHRLQELWQPIGVVGCITAFNFPMAVFAWNFCLASVCGNSIIWKPSPHSNGCADALKKAWDEVAGEHKDLVLLLKGGNEEASALCKDTNIPLISATGSTQMGKELAPIVSARLGRTLLELGGNNAAIICPTADLDLTVKGITFSACGTTGQRCTSLRRAFVHEDIYEEFMQKLHAYYATLKIGNPSDSSNQIGPLISERSYNDMQRVLESISNKDVTVHGGQRLEVGDPEEFYVMPAIVEVSQIEDEMLNETFAPILYVKKFTDLTNAIEMQNNVKQGLSSSIFTNDMRESELFLSSEGSDCGIANVNIGTSGAEIGGAFGGEKDTGGGRESGSDAWKAYMRRVTATINYGEDLPLAQGVEFDES

SEQ ID NO: 45999 - protein, 357 aa, Xanthomonas oryzae pv. oryzae KACC10331
MSKQILILPGDGIGPEIMAEAVKVLQRIDTQHGLGFELVYDELGGAAYDKYGSPLADETLERARAADAVLLGAVGGPQWDTIDPSLRPERGLLKIRSQLGLFANLRPALLYPQLADASTLKPEVVAGLDLLILRELTGGIYFGQPRGNRTLDNGERQAYDTLPYSESEICRIAKAGFEMARLRGKKLCSVDKANVLASSQLWRAVVEEVAKDYPDIALSHMYVDNAAMQLVRAPKQFDVIVTDNMFGDILSDQASMLTGSIGMLPSASLDANSKGMYEPCHGSAPDIAGKGIANPLATILSVAMMLRYTFAQADAADAIERAVGKVLDQGLRTADIWSEGTTKVGTVAMGDAVVAAL

SEQ ID NO: 46000 - protein, 530 aa, Propionibacterium acnes KPA171202
MAPGGVVGHRLAFMEQLHDVVLVVDFGAQYAQLIARRVREANVYSEIVPHNMPVRDMLAKEPAAIILSGGPASVYVEGAPSVDPALFNAGVPVLGICYGFQAMAQALGGQVAHTGASEYGRTSLCITSAGQLLSRIPHTISVWMSHGDSVSRAPEGFSTLARTAGAPVAAFEDVERRLVGVQWHPEVHHTESGQTVLEHFLFDIAGCRPDWNASSIVGDQIAQIRGQVGDRRVICGLSGGVDSAVAAALVQRAVGDQLTCVFVDHGLLRQGEAEQVKNDFVAATGADLVVADESQRFLDALAGVTDPETKRKIIGREFIRTFEDVAKRLNADQPIDFLVQGTLYPDVVESGGGEGAANIKSHHNVGGLPDDFQFSLVEPLRTLFKDEVRAVGLELGLPEDIVWRQPFPGPGLAIRIIGEVTAERLEVLRTADAITREEMGAAGLDRKVWQCPVVLLSDVHSVGVQGDGRTYGSPIVLRPVTSEDAMTADWARIPYDVLEKISTRITNACPQINRVVLDITSKPPATIEWE

SEQ ID NO: 46001 - protein, 263 aa, Helicobacter pylori
MKLKSFGVFGNPIKHSKSPLIHNACFLTFQKELGFLGHYHPILLPLESHIKSEFLHLGLSGANVTLPFKERAFQICDKIKGIALECGAVNTLVVENDELVGYNTDALGFWLSLGGEGYQSALILGSGGSAKALACELQKQGLKVSVLNRSARGLDFFQRLGCDCFMDPPKSTFDLIINATSASLNNELPLNKEVLKGYFKEGKLAYDLAYGFLTPFLSLAKELETPFQDGKDMLIYQAALSFEKFSASQIPYPKAFEVMRSVF

SEQ ID NO: 46002 - protein, 474 aa, Arabidopsis thaliana
KKLSSESIGDSDLNPESVCTCFCPSPSRTHGHSRLISMDATHFVKTCSGNSISCLPDEVLGKILSFLPTKQAISTSVLSKKWTFMYILADSLDFDDSDSLHAEEGGEQVFPESFKSCVDRTLALQCDSSIKKFSLKCHIGVDDECQRACVGRWISNVVGRGVVELDLHIIGRGLHFLPPQLLASKTLVKLTLGYLNLGKLPSYVSLPSLKFLYIDTIFFEYEDFCYVLLAGCPVLEELSVHHKSYAFPHTIASPTVKKLSVDYDFHREEELSFDLPNLEYLHYSDFALYEYPQVNLQSLVEAKLELHPAEHVERPDITNLIMGIRNVEILHLSSVSVDVISSCCKYGLLLPVFNKLVNLSFGIKNKRGWKLLAKMLKQCPKLETLNILDLKGYRRDVSMRRNQVKFQILDYGTDEEFEQLKSFIGSKRNAEAVVDDGTRLQTKRGCNDASWSFTKSKLPFHCRTSHLVYSYYTM

SEQ ID NO: 46003 - protein, 408 aa, Bartonella henselae str. Houston-1
MAVSYDLRPIGTCPVRESDNIIVKERSKLSLIGLSQDEMAEALKAIGIPERQTRMRVRQLWHWLYVRGVSNFDEMLNISKPMQEIFKKHFSIARPEIAGEQISKDGTRKWLLRFPPRGAGRPVEIETVYIPEEGRGTLCLSSQVGCTLTCSFCYTGTQVLVRNLTAEEILAQLLVARDCLGDFPDRNTPDGAIVPVEGRKITNIVMMGMGEPLYNFEAVKKALLIASDGNGLSLSKRRITLSTSGVVPGMIRTGEEIGVMLAISLHAVNDTLRDMLVPINKKYPLALLMDACRQYPGLSNAKRITFEYVMLKDVNDSLDDAKRLVQLLKGIPAKINLIPFNPWPGSNYQCSDWEQIERFADVVNQAGYASPIRIPRGRDILAACGQLKSASERLRKSERLHLEHIVNS

SEQ ID NO: 46004 - protein, 901 aa, Bradyrhizobium japonicum USDA 110
MTAIDPKLRTTKTTCPYCGVGCGVLATPDGKGGAAIAGDPDHPANFGRLCSKGSALGETVGLEGRLLYPMIRCKGVLERVAWSDALDHVAHRMQHIAARDGADAVAFYLSGQLLTEDYYVANKLMKGFVGTANVDTNSRLCMSSSVAGHRRAFGADTVPGCYEDLDQADLLVFVGSNAAWCHPVLFQRMLKNRQERGARMIVIDPRRTDTASDVDLFLGLKPGTDTALFSGLFVHFADSGALDQAYIASNTSGFDDALVRARNIAGSVTATALATGLSEQDVATFFKMFRDTPRVVTLYSQGVNQSAQGTDKVNAILNCHLATGRIGKPGASPFSLTGQPNAMGGREVGGLANQLAAHMNFTPPDIDRVRRFWKAPRIATHEGLKAVQLFEAINRGEVKALWVMGTNPAVSLPDADFVREALKKLELFVVSENVLSNDTVEAGPHVLLPALAWGEKSGTVTNSERRISRQRSFLPAPGEARPDWWILSETAKRLGFGDSFDYKSAADIFREHAALSAFENDGSRDFDIGALTSLSNEAFDALKPVQWPVREGGAPGERFFASGGFFTNDGKGRFVAPEVPALRSETGASRPLRLNTGRIRDQWHTMTRTGLSQRLGAHLPEPFVEVHPDDAGKFGIAHDGYARITTDYGQCILKVVVSDRQQRGTLFVPIHWSAMNASHGRVGALVQSFTDPFSGQPESKATPAAIAPYEYVFRGFALSRKQLDLPPNLLWTRVTVNGGFGYLFADNADLSRWPAWLEGVAGEDVAEYRDFGGGVYRAASFAGDRIETCLFVGPAHDAGDWEVVKSLFVADQVTDDQRGMLLSGKSGEGAAATGPIVCACFGVGRGTICDTIASGARTTAEIGATLKAGTNCGSCIPELKRLIATTEVAPVKQVKIAGAAG

SEQ ID NO: 46005 - protein, 473 aa, Gibberella zeae PH-1
MPTVRATRTRNENDENSGTTRLTRAQAAALKVDELSMPAKAALQTKKSTANGTAAANTRKRAALGDVSNVGKADGVAGKKAKGLVSKAAQPTGIEKKTARPTRPALASQTANSKPAQSGSGTINNKRKVLTDTKPKAPVKKTEPTSKEPELTEENERSETPEEAEVEKPEVSVEKPEVQDAPFKYPPGVNNLDEEDLEDPLMVAEYANEIFEYLRDLECKSIPNPQYMSHQDDLEWKTRGILVDWLIEVHTRFHLLPETLFLAINVIDRFLSEKVVQLDRFQLVGITAMFIASKYEEVLSPHVENFKRIADDGFSEAEILSAERFVLSTLNYDLSYPNPMNFLRRVSKADNYDIQSRTIGKYLMEISLLDHRFMAYRPSHVAAGAMYLARLMLDRGEWDATLSYYAGYTEDEVEPVVHLMVDYLARPVVHEAFDKKYAAKKFLRASLLARQWAKKNAVLFGITDIELGLDQIS

SEQ ID NO: 46006 - protein, 293 aa, Hordeum vulgare
MASQKFPPQQQDCQPGKEHAMDPRPEAIIKNYKSANKLQGKVALVTGGDSGIGRAVCLCLALEGATVNFTYVKGHEDKDAEETLQALRDIKSRTGAGEPKALSGDLGYEENCRRVVEEVANAHGGRVDILVNNAAEQYVRPCITEITEQDLERVFRTNIFSYFLMTKFAVKHMGPGSSIINTTSVNAYKGNATLLDYTATKGAIVAFTRALSMQLAEKGIRVNGVAPGPIWTPLIPASFPEEKVKQFGSEVPMKRAGQPSEVAPSFVFLASEQDSSYISGQILHPNGGTIVNS

SEQ ID NO: 46007 - protein, 253 aa, Glycine max
MAANFWTSSHYKHLLDQEDVDVVNTLDKEKGITLEDFKLIKMHMANYILKLAQQVKVRQRVVATAVTYMRRVYTRKSMAEYDPRLVAPTCLYLASKAEESTVQARLLVFYIKKLYSDDKYRYEIKDILEMEMKILEALNYYLVVYHPYRSLVPLLQDAGLNDLNMTQLTWGLVNDTYKMDLILVHPPHLIALACIYIASVLREKDTTAWFEELRVDMNVVKNISMEILDFYESNRMFTDERINAALQKLSLRP

SEQ ID NO: 46008 - protein, 358 aa, Oryza sativa
  misc_feature (163)..(163): Xaa can be any naturally occurring amino acid
  misc_feature (225)..(225): Xaa can be any naturally occurring amino acid
  misc_feature (351)..(351): Xaa can be any naturally occurring amino acid
MAEVRTIGSLPVPNVQALAGTCNGSDEQIPERYIRTEATCEEVISNYHGDMAIPIIDLNKLLSPQSSEEECVKLRSACQYWGFFQLINHGVPEEVIENFRSNIIEFFSLPLDAKKEYSQLPNSLEGYGQTFVFSEDQKLDWGDMLYLQVHPTDSRDLRFWPVXPASFRQSLDQYSSETKSLSLCLFEFLAKAVGAEPESLLGIFEEQPRGMRMNYYPPCRQSDKXVIGLSPHTDVVGLTLLLQVNDVQGLQIKRDGKWFSVDALSGAFIVNIGDTLQILSNGKFKSVEHRAMIHPNKERISTALFHYPRDDLLLSPLPEFVKDGKVNYRSISYNDFMMQFFNQKRDGRNRXERLKLEQ

SEQ ID NO: 46009 - protein, 787 aa, Bradyrhizobium japonicum USDA 110
MPVDSARLETLTALSRKALWLSSWTIHHANHIRANADGLKVGGHQASSASLATIMSALYFHVLRPEDRVAVKPHASPVFHAIQYLFGRQSREKLENFRGFKGAQSYPSRTKDVDDVDFSTGSVGLGVAQTLFASLVQDYVKAHGWMKDRREGRMIALVGDAEMDEGNIFEALAEGWKHGLRNTWWVVDYNRQSLDAVVREGLWEKFETMFRNFGWDVVIVKYGRLMREAFAEPGGEALKRWIDNCPNALYAALCFQGGAAFRKHLHDEIGDQGPITKLIDKRSDEELLALMSNLGGHDMASMLEAFESIDHDRPVCFIAYTIKGVGLPFQGHKDNHAGLMTVAQMEKYRESQNIRPGYEWDKYEGLALAPAELDAFLARVPFNQDGRRLTAPVVEVPAQLAFKPAPQMSTQQGFGLVLNEIARGDSELARRIVTTSPDVTVSTNLGPWVNRRGLFANAEKADLFRSEKIPSTYNWDASPKGQHLELGIAEMNLFIMLSALGLSHQINGARLLPVGTLYDPFIERGLDALNYACYQDARFMVAATPSGITLAPEGGAHQSIATPLIGMAQDGLASFEPAFVDELAVIMGWGFNHMQRDPGEGGSVYLRLSTRSIEQAQRIMTPELQQGITDGAYWLRKPGPNAELVIAYTGAMAPEAIEATGFIGESRRDIGLLAITSADRLHAGWTAARKLRRDRRGVQHLSHIEKLLAPLPRDCGIVTVIDGHPSALGWLGSVRGHRVEALGVEQFGQTGSIADLYRHYGIDANAIIDAAESLTTGAPVLHRKMAV

SEQ ID NO: 46010 - protein, 503 aa, Bradyrhizobium japonicum USDA 110
MAGSIAGAFVQGCLPKRPHHAPKKRLTMVNRMQFYIDGAWVDPAVKKSTAVVNPATEEAMYEVALGSKADVDKAVAAAKRAFATFSQTSREERVALLTKIIEIYKGRLKEIGAAVSDEMGAPLPMAEKLQAGAGLGHLMTTLDVLKNYHFEEPVGTAMVLREPIGVVGMITPWNWPLNQIACKVAPALAAGCTMILKPSEFTPTSALIFAEILHEAGVPKGVFNLVNGLGPEVGAAMSEHPDIDMISFTGSTRAGIDVAKRAAPTVKRVSQELGGKSPNVILEGADLTKAVTGGVMHMFNNSGQSCNAPSRMIVPLSKMKEVAAIAKAVADKTKAGDPRAEGTTIGPVVNRGQWDKIQGLIKKGIDEGATLVAGGPGLPEGVNKGFYVRPTIFADVTPDMTIAREEIFGPVLTIIGAKNEADAVQIANDTPYGLAGYVSADTVESAKRVARQIRAGNVNLQGVPNDRTAPFGGYKQSGNGREWGKYGLEDFLEVKAVAGFNAA

SEQ ID NO: 46011 - protein, 298 aa, Pasteurella multocida subsp. multocida str. Pm70
MSANNYLFSGSIVAIVTPMDSSGEIDFVRLKSLVEHHIAAGTDAIVSVGTTGEAATLSIDENVKTILKTVEFADGRIPVIAGAGANATSEAIVMTKLLNDSGVAGCLSVVPYYNKPTQEGMYQHFKAIAECTDLPQILYNVPSRTGSDLLPETVARLAKINNIVAIKEATGDLSRVAKIKELAGEDFIFLSGDDATGLESIKLGGQGVISVTNNVAAADMAKMCHLALNGQFEEAEQINQRLMALHKNLFVESNPIPVKWAAYRLGLIDTPTLRLPLTTLSEHLQPKVEDALKIAGLL

SEQ ID NO: 46012 - protein, 390 aa, Nocardioides aromaticivorans
MRRHYEYLVVGGGVAGGRAVEALSKRADSVALVSAEHWRPYARPPLSKEALVEGRSIEDLCLRDSAWYDDNGAELWLGERVVGLDPTDSVVRLASGSEIGFDRLLLAPGVEPIRLPVPGSELAGVHYLRTYDDAVQLRHAVEVRGRPCRVVVVGGGFIGSELAASLGAMGALVTVVEATSQLMVQALGEEVGALLTRRHRQAGIDVRLDARVERLSGETTVQGVQLADGSELPCDLVVVGIGAKPRLEWLEGSGVELADGIVVDEHCRTSRENVFGAGDATVMYSPRLGRHRRVEHEANAQAQGVVAARNMLGGNAVHDPVDYCWSIQHDLDIWTLGETGRGGEVSVEIGDGGKHALATYRLAGNVVGVVGINRPDDLAPARELLTSLIA

SEQ ID NO: 46013 - protein, 350 aa, Synechocystis sp. PCC 6803
MAPSPAPLLSLSLPELTDWVQTTGQPAYRGKQIHQWLYQKGARSLTAMTDLPKVWREKNVHYPIGRSVIDHCAVAPDHTRKYLLRLADGLIIETVGIPSSKRLTVCVSSQVGCAMDCNFCATGKGGFIRNLESHEIVDQVLTVQEEFHERVSNVVFMGMGEPLLNLPQVVKAVECLNQVVGIGQRALTISTVGLPGKIRQLADRHLQVTFAVSLHAPNQTLRQSLIPSARHYPLEQLLADCRAYVETTGRRVTFEYVLLAGVNDQPVHAEELAQKLRGFQTHVNLIPYNPISEVDYQRPTEAQINQFAQVLSDHRIAVSVRYSRGVQADAACGQLRASRKEELAELTPMA

SEQ ID NO: 46014 - protein, 171 aa, Glycine max
MIRILQISILCFFLVAGISISSSEEEEETIYKILQDNGLPSGIFPKGVTEFTFDGETGRFSVYLNQSCDAKYETELRYDTNITGTLSSANVTDLSGISAQDLFLWFPVKGIRVDVPSSGLIYFDVGVVRKQYSLSVFETPRDCVAVRRENEVESSVLSLHRVDETLGRNVI

SEQ ID NO: 46015 - protein, 573 aa, Xanthomonas oryzae pv. oryzae KACC10331
MFGGEENPPLSVYDTSGPYTDPQVAIDLAVGLAPLRAHWIAERGDTVALDGLSSSFGRGREHDARLDAVRFPARRLPRVAREGANVTQMHYARRGIITPEMEYVAIRENQRLEAVTDASLRKQHPGEAFGASIQQRITPEFVREEIARGRAILPNNINHPESEPMIIGRNFLTKINANIGNSAVSSGIAEEVEKLVWSIRWGGDTVMDLSTGKHIHETREWIIRNSPVPIGTVPIYQALEKVDGRAEALTWEIFRDTLIEQAEQGVDYFTIHAGVLLRYVPLTAKRVTGIVSRGGSIMAKWCLAHHKENFLYTHFEDICQIMKAYDVAFSLGDGLRPGCIADANDAAQFGELETLGELTKLAWKHDVQTMIEGPGHVPMQLIKENMDKQLRECGEAPFYTLGPLTTDIAPGYDHITSAIGAAMIGWFGTAMLCYVTPKEHLGLPNRQDVRDGIMAYKIAAHAADLAKGHPGAQVRDNALSKARFEFRWDDQFHLGLDPEKAKEFHDETLPKDAHKLAHFCSMCGPHFCSMKITQDVRDYAAEHGMDDAQALSTGMQEKSAQFLAQGAQVYRPM

SEQ ID NO: 46016 - protein, 333 aa, Mycoplasma penetrans HF-2
MSNKTILVNNIEAVTNALELNMEKDPSIIVYGEDAGFEGGVFRATQGLQAKFGEKRVFDTPIAEAAIMGTAVGAALAGLKPVVEIQFSGFSFPAAQNLFTHAARYRNRSRGRFTCPLVVRMPMGGGVKALEHHSEALEAIFAHVPGVKVVMAATPYDAKGLLTAAINDPDPVVFFEPKRIYRAFKQEIPEGLYEVEIGKANIVIPGNDVTVVSYGANLHDCLAAVNQLKETNPNISVELIDLRTIKPWDRETVINSVKKTGRLMVVHEAVKSFSVSAEIIATVNEKAFYSLKAAPVRLTGWDITVPYALGEHLQMVSPERIAKEIISLASIKE

SEQ ID NO: 46017 - protein, 191 aa, Xanthomonas oryzae pv. oryzae KACC10331
MLKDRANQDRQYLTISIAGAVLFVLVGLFLSWYTAIGFALGAVLSGLAGYIGMNVSVRANVRTAEAARHGIGKAMDVAFRGGAITGMLVVGLGLLGVAGYFAALQAMGLPLEQNLHALVGLAFGSSLISIFARLGGGIFTKGADVRADLVGKVEAGIPEDDPRNPAVLPTTSATMSATAQAWPRIYSKPMQ

SEQ ID NO: 46018 - protein, 251 aa, Neisseria meningitidis serogroup B
MWDQKWVIGNWKMNGRLQNNNALMHRFRIHPTAERVLIGLAAPTVYLLQLHNAMQIVLNNRILTCAQDVSRFPNNGAYTGEVSAEMLADTGTDIVLIGHSERSLYFGEKNEIQRRKMENVLNVGLIPLLCVGESLEEREAGKEHEVIAHQLSILQGLDTKNIAVAYEPVWAIGTGKVATVEQIADMHAFIYKEILSLCGSDVKIRVLYGGSVKADNAADIFAVPYVDGALVGGASLSYDSFTAIISAAQNA

SEQ ID NO: 46019 - protein, 459 aa, Arabidopsis thaliana
MLKKTAPNSPKRRRCSSFAAVDLVGSANRTFMVSVSLPKELILEILKRLPAKSVKRFHCVSKQWASMLSCPHFRELFLTRSSSAQPRLLFAIEKHNQWSLFSLPQRLTPYEKSSSSSVVVTPEFHMKFPPDGMLIYPRHDRRFSFGYASGLMYFYGMWINEHDYDGVPVICNPLTGRYASLPFLERYRKAFSFFGFDPIEKQYKVLFMAYPSGPDHHTVLTFGTGEMSWRKIECSVKHDIVSDGICINGVMYYLGDTSEFMTAFVVVCFDVRSETFSFIYPGSYCEVINYKGKLGLVFCDDYTDDAIELRLWVLEDKEKIEWSKYAYKLKDEKFSAHYVSIVGVSAAGEIVLSMADFTSKQPFYVFYYNPERNTLQCTEIQGFEEHHGTFDRRSRVRVFVDDCSSFYRFADHVEYLNVDEPKLLKSKIYDGPNAKIEWEEEEEEDEDEDQEKEEEDQWS

SEQ ID NO: 46020 - protein, 528 aa, Bartonella henselae str. Houston-1
MVQISTYFQLIRTGWVLAREGVLSALPHDDLQGFPALCHRIASMLARRKTKKKRRSEKLSYAINRLGPSYIKLGQFLATRPDIVGRDIAEDLAQLQDRVQTFSCTAAIDQIESSLGRSINDLFANFYPPIAAASIAQVHPAEYYDEVGHKKKCAVKVIRPNIRTRFAKDLRSFYLIAHLQERYIPAARRLRPVCVVDTLAQTTRIEMDLRLEAAAISEMAENIQHDTGFRVPKIDWERTGRNVLTMEWIDGIRISEISALKEAGFDLQALAITLIQSFLRHTLRDGFFHADMHPGNLFVDPQGCIVAVDLGITGRLGKKEKHFLAEILYGFITRDYHRVARAHFEAGYVPPHHNIESFAQANRAIGEPIHGQSAQSISMAKLLTLLFEVTELFDMQTRPELLLLQKTMVVVEGVARNLDPNFNMWKASEPVVKEWISKNLGPVGIAKDFSEGAQALFSLVRNTPQLIQNFQRMEEDLNQMIKTGFNLSPTTLKKLAVEQSRSNRYGRYSLFIIALCCICLTFYLFHFF

SEQ ID NO: 46021 - protein, 412 aa, Oryza sativa (japonica cultivar-group)
MDRGVLHKSSALVGEMGEGHGWWSVNNLRPPFVEQLHNPASLFLPSSTTTSTTPSSSSSPLHSFSSLLLSNHYPLPSTATTSTAAAPWHDTGSRHGQHLQDSWNHILLGGLASGEEGYNKNWEGQVLFPTTPAAAAAEADHGSNSYNNIYSTTTTSHGSSTSDDASQLAVAARPSSSPWGGIHGHHPHHNALQQQASSPRSSCITSTTSLGSNGVLEFSNNTSPRECISTASGAAFKKARTQEPSPAQATVKVRKEKLGDRITALHQLVSPFGKTDTASVLLEAIGYIRFLHGQIEALSSPYLGNGGSSSNGGGGGGGGSNSKLQHQPEASRVQGERNSIFPEDPGQLLHDNAVKKRGQPDQDESCEEAKTMDLRSRGLCLVPVSCTVDVGVDAGPADYWAAPPAFGIGFGR

SEQ ID NO: 46022 - protein, 248 aa, Triticum aestivum
  misc_feature (94)..(94): Xaa can be any naturally occurring amino acid
  misc_feature (216)..(216): Xaa can be any naturally occurring amino acid
TSVVQKSRFLPVRNSRDIVDPRVRSTQRQLAMATSPSPKKVLLPIVAGTEPIEASIPIDILRRAGANVTVASAGDALLVEIMYGVKILADELLXDCAAASYDLIVLPGGVPGAANLGGRATLEGIVRKHVEKGGLFAAICAAPPLALASWGLLDGHKATGHPWFVEKFPPKVTAVDANVVVDGNAVTGTGPATSMEFAMALVGQLYGKEKAEQIAXPMLVRYKGGYSMKELTSVEWHCSGTPQVSSFQ

SEQ ID NO: 46023 - protein, 390 aa, Yarrowia lipolytica CLIB122
MSFLFNRNKQKPPQDVVRSLCDALPKLESPSGDKRKVTEEVSRNLQQMKLILTGDEDEDPQPALVAALASEMHQTELFTQLVTSLRALDFASRKDVVLIFNTLLRRRIGDRSPTVDYLVQHPRIFEILILSYDNHDSALTAGEILRDCNKWEQLSKIIIWSPQLWKFFEYVDHQIFQNATDAFGSLSDIVTVHQQVAGEFLAANKEKFIANINKLMQSSNYVTRRQSLKLMGQLIRQRANYPFMTTYVNEVENLKLIMMLLKDKSKNIVIEAFNIFKLFAANPKKPRPVADVLLKNKTKLIAFLTNLETDKKDDDEKDFVIKAISSLQPIVTPGSSPSPSPQSHSPTHTSGHHHQAHTQPGSGLSMLTPAPSLPPPVVHSEPVLRQNYPE

SEQ ID NO: 46024 - protein, 459 aa, Synechocystis sp. PCC 6803
MRTAWVAKRQGQTNVSQMHYARKGVITEEMDYVAKRENLPVELIKDEVARGRMIIPANINHTNLEPMAIGIASKCKVNANIGASPNSSNIDEEVEKLLLSVKYGADTVMDLSTGGGDLDVIRTAIINASPVPIGTVPIYQALESVHGSIENLTPDDFLHIIEKHAQQGVDYMTIHAGLLIEYLPLVKSRITGIVSRGGGIIAKWMLHHHKQNPLYTHFDEIIEIFKKYDVSFSLGDSLRPGCTHDASDDAQLSELKTLGQLTRRAWEHDVQVMVEGPGHVPIDQIEFNVKKQMEECSEAPFYVLGPLVTDIAPGYDHITSAIGAAIAGWHGTAMLCYVTPKEHLGLPNAEDVRNGLIAYKIAAHAADIARHRPGARDRDDELSKARYNFDWNRQFELSLDPERAKEYHDETLPADIYKTAEFCSMCGPKFCPMQTKVDAEMLEELEVFLAKDKEMVSQR

SEQ ID NO: 46025 - protein, 438 aa, Oryza sativa (indica cultivar-group)
MAAASPKKKEKKHSKKQEDTNVPEKKREVVHVTVDASLTGAAAAGAAPVVAYFPTGYDPLAAGGGRKGREAPRTRLFRHTKHPSRIELVVGAATGGGGGPDFVGRSYAGEAVLPQLTGYALGVLDKASGTLKVVPIAANKILRLEPHLEVQKLAHSQHSGAVGEAVSSAGDADLKVQDITKAFGTQKDKAKDIKWQSLNEQRNDPSAFMDLDLGNADTSVGANESQEPTVRNIPPYDPAADTSERAYLFDEIIPKSIRPHLVDIIGHFESGEISSKGYGSFVSNRVNKLQELQGEDKERLAWILSYITHLLSLLARNSSMSKRHRKENQATSGPVIPQYVYRKMVLMFTEPGSSALSTEKHELLINYILVLTLYADDFRSDPKDICEDLKMTRQMIKPYYDQLGCKSSSAGAFKSSVMTLPAPLKFPKEATRRKRRRF

SEQ ID NO: 46026 - protein, 346 aa, Lactobacillus sakei subsp. sakei 23K
MKAATFIEPGKMVITEAPKPTIEKKTDAVIRIIRACVCGSDLWWYRGLSKRESGSLVGHEAIGVVESVGEAVTDIKAGDFVIVPFTHGCGHCAACLAGFDGDCTNQEGGGNGGYQGEFLRYTNANWGLVKIPGQPADYSDEMLNNLLTLSDVMATGYHAAVSAEVKPGDTVVVMGDGAVGLCGVIGAKLLGAEQIIAMSRHEDRQKLALEFGATDIVAERGDEAVAKVMALTDNAGANAVLECVGTEQSVATAVAVAGAGAVIGRVGIPQKAEMNTNVLFRKNIGLRGGIAAVTTHDKARLLDAVLKGEINPGKVFTQRFNLDDIQAAYEAMDQRQAIKSLLVISD

SEQ ID NO: 46027 - protein, 523 aa, Medicago truncatula
MNLQLKSSCCGCGVTTGLYGSNCKHMTLCSTCGKTMAKNRSKCSTCGTTLTRLIREYNVHASSATDKKYFLGRFMNGLPDFSKKKSAKNKWSLKKDGLKGRQVTDSTREKYKNRPWFLEDETGQSQFQGHLEGSQSATYYLLMKGKKYNFNKVAQYKQLTLEEAEEKMNNRKKTADGYQRWMMKAANNGPAAFGEHWKLDDKESNAGGGRSRKKTGDDDDEGPSSDKGEEDEDEEVDKKNRHGLNKKSGYDDDEGPRGGDLDDDDDDDYDVEKGDDWEHEEIFTDDDEAPGNDPEEREDLDPEIPAPLEIKQDDDDDEEEDEDNDEGGGLSKPGKELKKLLGRTGGPSESDEEDADDDDVDDEDGVPAITATKQKEPKEEPIDSSPSKPTATGPARGTPTSKGKRKENEEAKSSISVPTKKLKTENAPKSSGKDVNGSTSKSNGPPRGTPPQSSNAASGPVTEEEIRAVLMQSTPLTIKELAAKFKARLKCEEPILKTRLDRFNYRLELDIDTVQKKEKHIPC

SEQ ID NO: 46028 - protein, 485 aa, Medicago truncatula
MPNRNPTVVYPPGAPRRSPRLVLLHENNNPTTPKPNSTNKSSTQSRSKTVRVRKSPNLSHEVPSRRRSPRFSNKNDVKVSEFGSCDEGVVVEGGRKRRRKRGGHGIEEGGKKEEIEGGEEEGKRKHDGCEIVEDLRKEEVECGVKRKRKRVGGEVAEGWTKEQELALRTAYFTAKPSPHFWKNVSKLCCRCDAAHNDKQGITAGLTASSRCDVAHNDKDGIAAGLTVVELHRVPGKSKQDCFDRVHHDFHTPPQCQPRSRAKAIDSSPLHRFSISASKLLIPTGKKAGKSNILKPKSIVAQKSIENLLQRHLKVDQNHKGDIFSVLEPNIDFSTNAILPSEELCTPKQQKENQGFLQICNERSSSSSIHKKSLSRFSGSSGVKDLASPPVLKQVKNKVQHEKYVNQLRFRDLRRRAASTWTNKSVAGEGKGIRKTDVVKAAKVALVSEARDAINKFQQSQINFMGDTCSSDDDNDDDIGVEGESP

SEQ ID NO: 46029 - protein, 255 aa, Gibberella zeae PH-1
MTAFELHLYRGLEPTEPNFIMGHEFTGTVVELGSAVKSVEIGDKIVSPFTASCGLCYYCENGGSARCVNSQPLGSPNLDGAQAEYVRVPFADGTVAKASADIHDQALILMADIFPTGYFGVKSGVEMMPNLDVHDSTIVVIGCGPVGLCAVVAAAALKPKHLFAVDSVSSRLDQAAKLGAEPLNFMSDKTGMHDRIKAATNGRGADIVVEVVGLSPALRTAFDLVRPFGAISSIGVHNAEIPWSGNDAYKWGDAQ

SEQ ID NO: 46030 - protein, 536 aa, Medicago truncatula
MDLQLKSSCSGCGETTGLYGSNCKHLTICAPCGKTMAENRSKCSTCGALLTRLIREYNVRASSANDKNYFIGRFMTGLPDFSKKKSAENKWSLQKDGLKGRQVTDATREKYKNRPWLLEDETGQSQFQGHLEGSQSATYYLLMKEKKEFVAIPAGSWYNFNKVAQYKQLTLEEAEEKMKNRKKTADGYQRWMMKAANNGPAAFGEHGKLDDKESNAGGGRGRKKTGDDEDEGPSSDKGEEDEDEEVDRKKRPNKKNTFDDDEEGPRGGDHDEDDYDVEKGDDWEHEEIFTDDDEAVGNDPEEREDLAPEVPAPPEIKQDDEEEEEDEDNEEGGGLSKSGKELKKLLGRTGGLSESDDDDDDDDDDIDDEDGVPAVTATKQKEPKEEPVDNSPSKPTATGPARGTPTSKSSKAKRKANEEAKPSISVPPKKVKTENEPKSSAKDVNGSSSKSNAPPRGTPPPSSNSGSSNAASGPVTEEEIKAVLLQRTPLTTQELVAKFRARLRCKEDKEAFANILKRISKIQKTNGSSYVILREK

SEQ ID NO: 46031 - protein, 418 aa, Xanthomonas oryzae pv. oryzae KACC10331
MITGNVLYAQSGGVTAVINATAAGVIAEARARKIKVLAARNGILGALREDLIDTSKESAAAIAALAQTPGGAFGSCRYKLKSLEEDSAKYERLLDVLRAHDVRWFLYNGGNDSADTAWKVSQLAKAYGYPLHCIGVPKTIDNDLAVTDTCPGFGSAAKYTAVSVREAALDVAAMADTSTKVFIYEAMGRHAGWLAAAAGLAGQGPDDAPQIILLPERAYDQTAFLAKVKQVVDKVGWCVVVASEGIQNAHGKFVADAGGAADSFGHAQLGGVAAFLAAQVKQELGYKVHWTLPDYLQRSARHLASKTDWEQAQAVGKAAVQYALKGMNAVIPVIERVSDTPYRWKIVPAPLHKVANHEKKMPPSFLRKDGFGITERARRYFAPLIKGEAPLAYGSDGLPTYVTLKNVAVAKKLPAWEG

SEQ ID NO: 46032 - protein, 692 aa, Arabidopsis thaliana
  misc_feature (448)..(448): Xaa can be any naturally occurring amino acid
MVSPLTLFLILFFFFLSSALSSSSSELDILLDIKSSLDPEKRFLTSWTPDADPCSSGSFDGVACDGNRRVANISLQGMGLTGTIPPSIGLLTSLTGLYLHFNSLTGHIPKDISNLPLLTDLYLNVNNLSGEIPPLIGNLDNLQVIQLCYNKLSGSIPTQFGSLKKITVLALQYNQLSGAIPASLGDIDTLTRLDLSFNNLFGPVPVKLAGAPLLEVLDIRNNSFSGFVPSALKRLNNGFQYSNNHGLCGDGFTDLKACTGLNGPNPNRPDPTNPTNFTTVDVKPESADLQRSNCSNNNGGCSSKSLKSSPLGIVMGLIGSILAVAIFGGSTFTWYRRRKQKIGSSLDAMDGRISTEYNFKEVSRRKSSSPLISLEYASGWDPLGRGQSSNNNSALSQEVFESFMFNLEEIERATQSFSEINLLGKSNVSSVYKGILRDGSVAAIKCIXAKSSCKSDESEFLKGLKMLTLLKHENLARLRGFCCSKGRGECFLIYEFVPNGNLLQYLDVKDETGEVLEWATRVSIINGIARGIVYLHGENGNKPAIVHQNLSAEKILIDHWYNPSLADSGLHKLFTDDIVFSKLKASAAMGYLAPEYITTGRFTDKSDVYAFGMILLQILSGKSKISHLMILQAVESGRLNEDFMDPNLRKNFPEVEAAQLARLGLLCTHESSNQRPSMEDVIQELNNLAADY

SEQ ID NO: 46033 - protein, 459 aa, Rhodopseudomonas palustris CGA009
MSIQVADSSLVARLSPPKPSALAHVPGDEGWPIIGRTLAVLADPKGEVEKMARTYGPVYRSRVLGETSITLLGPEANELVLFDNTKLFSSTHGWGPILGRLFPRGLMMLDFDEHRLHRRTLSVAFKAGPMQSYLAELNAGIAHRVAEWRARPGEMLCYPAMKQLTLDLAATSFLGTAIGAETEEVNRAFIDMVAASVAPIRKPWPGTAMARGVKGRQRIVAYFAEQIPIRRAKGGDDLFSQLCRATHDDGALLSNQAIIDHMSFLMMAAHDTLTSSLTSFVAALAAHPEWQQKLREEIAGLGLKPGEPISFEQLDALPLTEMAFKEAMRLRPPVPSLPRRATRAFSFKGYTIPAGTMVAVNPLFTHHMPEIWPNPDQFDPLRFTDEASRGRHRFAWIPYGGGAHMCLGLNFAYMQAKCFAVHLLQHLDLSLPPNYQASWQMWPIPKPKDGLRVNVAPLN

SEQ ID NO: 46034 - protein, 175 aa, Glycine max
MGTASSMLTQYDIEEVQEHCNNLFSQQEIVSLYQRFCQLDRNAKGFISADEFLSVPEFAMNPLSQRLLKMVDGLNFKDFVAFLSAFSAKASAQQKIELIFKVYDSDRNGKVSFKDMLEVLKDLSGPFMSDDQREEVLSQVLREAGYTKDSYLTLDDFIKVLGQSDLKMDVEVPVD

SEQ ID NO: 46035 - protein, 175 aa, Triticum aestivum
MAPPVMASSATSVAPFRGVKSTAGLPVSRRSNGASLGSVSNVGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 46036 - protein, 388 aa, Yarrowia lipolytica CLIB122
MLRNNLRSLSRAFSTSSMRLGAGMDASKLQITKTKSPKEKQAPKDLIFGHTFTDHMLTVEWTAKDGWAAPQITPYGPLELDPSAVVLHYAFECFEGLKAYKDESGNVRLFRVDKNMHRMNTSAERICLPEFDGAEAAKLIGQLAKLDSAWIPEGRGYSMYLRPSLIGTTAALGVGTPDKALFYVIASPVGPYYPTGFKAVKLEATDYAVRAWPGGVGNKKLGANYAPCIKPQQQAASRGYQQNLWLFGDEGNITEVGTMNAFFVFERNGKKELVTAPLDGTILEGVTRDSILELARERLPSADWIVSERYCTIKEVAEAAEKGELVEAFGAGTAAVVSPIKEIGWGEKTINIPLQPGKEAGKLTETVNEWIGDIQYGKDEYKGWSKVV

SEQ ID NO: 46037 - protein, 406 aa, Bradyrhizobium japonicum USDA 110
MTGGPVIIVGAGHGGYQVAASLRQAGFSDRVCLINDEAHLPYQRPPLSKAYIKGSAGPESLMFRPEKFYADQKIELIAGRAVSIDRAGRRLHLASGEMLDYGHLVLATGARNRLLDLPNANLPDVKYLRILDDSEALRKIMPSRTRVVVIGAGFIGLEFAATARIKGLEVDVLELAPRVMARAVTSEVSAYFQARHREAGIRIHLGVQATSIEAEDGRVTGVSLSDGRHLPADLVVVGVGVLPNIELAAEAGLPVAAGIIVDEYLSTADPDISAIGDCALFASPRFGGSLRLESVQNATDHARCLAARLTGDRKPYDSHPWFWSDQGDDKLQIAGLTTGYDRVVLRGDPAKKAFSAFCYRGDKLVGIESINRAGDHMFGRRLQGMDRSITPEQAADESFDLKSALA

SEQ ID NO: 46038 - protein, 127 aa, Brassica napus
AKENLSAKKKSRLNLKQVVLKEVHETELFKHISKFLSSVGYEDSMTFAAAKACCQGAEILSGCSSIEFCCRKVKCVNGAVEVEGTVVTGVVVRDGSEQNVDLLVPSTQTDCEYGPEATYPAGNDLFT

SEQ ID NO: 46039 - protein, 167 aa, Morus indica
MFPMITGFMNYGQQTVRAARYIGQSFMITLSHVNRLPITIQYPYEKVIAAERFRGRIHFEFDKCIACEVCVRVCPIDLPVVDWKLETDIRKKQLLNYSIDFGICIFCGNCVEYCPTNCLSMTEEYELSTYDRHELNYNQIALGRLPMSVIDDYTIRTILNSPQIKNK

SEQ ID NO: 46040 - protein, 393 aa, Morus indica
MNIPAPRKDLMIVNMGPHHPSMHGVLRLIVTLDGEDVIDCEPILGYLHRGMEKIAENRTIIQYLPYVTRWDYLATMFTEAITINGPELLGNIQVPKRASYIRAIMLELSRIASHLLWLGPFLADIGAQTPFFYIFRERELVYDLFEAATGMRMMHNFFRIGGVAADLPHGWIDKCLDFCDYFLIGVTEYQKLITRNPIFLERVEGVGVIGREEVINWGLSGPMLRASGIQWDLRKVDHYECYDEFDWEVQWQKEGDSLARYLVRIGEMTESIKIIQQALEGIPGGPYENLEIRYFDRERNPEWNDFDYRFISKKPSPTFELPKQELYVRVEAPKGELGIFLIGDQSGFPWRWKIRPPGFINLQILPQLVKRMKLADIMTILGSIDIIMGEVDR

SEQ ID NO: 46041 - protein, 107 aa, Prunus persica
QNINWDLRTASVFCATWDADKPLSWRSKYGWTAFCGPVGPTGQDSCGKCLLVTNTGTGAKVTVRIVDQCSNGGLDLDVNVFNQIDTNGQGNAQGHLIVNYDFVDCGD

SEQ ID NO: 46042 - protein, 818 aa, Synechocystis sp. PCC 6803
MVSSVVEKTSVAHKETALILWFEEVGTHDVGLVGGKNSSLGEMIQQLTNKGVNVPSGFATTAYAYRYFIQEAGLEQKLRDLFTDLDVNDMANLQERGHLARQLILDTPFPQNLQTAIAEAYGAMCERYGQKMGRTGVDVAVRSSATAEDLPEASFAGQQETYLNVHSLSCVLESCHKCFASLFTDRAISYRHHNGFDHFAVALSVGVQKMVRSDLATSGVMFSIDTETGFKNAALITAAYGLGENVVQGAVNPDEYFVFKPTLKEGFKPILEKRLGSKAIKMVYDVGGSKLTKNVEVAEPEREKYCINDEEILQLARWACIIEDHYSGVRGVYTPMDIEWAKDGQTGELFIVQARPETVQSQKSANVIKTYELKDHSQVLATGRSVGAAIGQGKAQVIRNVSQINQFRPGEVLITNRTDPDWEPIMKQASAIVTNQGGKTCHAAIIAREMGIPAIVGCGDATDTIKTGEDVTICCSEGDEGSVYSGILNYEVHETELSNLPRTKTQILMNVGNPEQAFGFASYPADGVGLARLEFIIANHIKAHPLALMKFDELEDPLAKAEIAELTKLYAGDRPRFFVDKLAHGIAMIAAAFYPKPVVVRMSDFKSNEYANLLGGRQFEPKEENPMIGWRGASRYYDPNYREAYALECQALKRVRDEMGLTNVIPMIPFCRTPDEGRKVIAEMAKHGLKQGKNGLEIYVMCELPSNVILADEFSEVFDGFSIGSNDLTQLTLGLDRDSSLVAHLFDERNLGVKRMVKMAIETAKANGRKIGICGQAPSDYPEFAEFLVELGIDSISLNPDSVLKTVLRIAEVEKALG

SEQ ID NO: 46043 - protein, 394 aa, Oryza sativa (indica cultivar-group)
MDYFRSCWGPRSPAGHRVRGSDVAGRQDGLLWYKDAGQLVTGEFSMAVVQANNLLEDQSQVESGALSMAEPGPQGTFIGVYDGHGGPETARFINDHMFHHLRRFATEHKCMSTDVIRKAFQATEEGFLSLVSKQWSLKPQIAAVGSCCLVGVICSGTLYVANLGDSRAVLGRFVKSTGEVVATQLSSEHNACYEEVRQELQASHPDDPQIVVLKHNVWRVKGLIQISRSIGDVYLKRPEYNREPLHSKFRLRETFKRPILSSEPAIAVHQIQPNDHFVIFASDGLWEHLSNQEAVDLVQNNPRNGIARRLVKVAMQEAAKKREMRYSDLKKIDRGVRRHFHDDITVIVVFLDSNAISKANWSRGPSVSLRGGGVTLPANSLAPFSAPTVLSSTY

SEQ ID NO: 46044 - protein, 713 aa, Mycoplasma penetrans HF-2
MRINNMTTTNIKKRFLFLTGLLKQNNFSADQIKLVKKAFEFANLKHGSQIRKSGEPYMIHPLETAIYLAEWKMDVSTIITGLLHDVLEDTDCTREDMEKRFGKTILEMVETVTKVSKVSQETRSKETYDKENSEYIIRVIMSVSSNLRSVIVKIADRMHNMETINHLKKEKQIRIASETFNIYANIAGRLGLYHQKTRLLDLSFQVLEPEKYESIKNMIDTSLKNCRESLNNVSQQIKDILTSKGIDFTVVERIKGIYSTYKKIEKGIDIKNIHDLFALRIITNREDIECYRILGLIHINFTFLPQTFKDYISSPKLNLYQSLHTTITFRKVLLEIQIRNSAMDKTANFGVAAHWLYKQNEEDIKEVTSELMFDILNNSDKEISKKIKNIQLTKIYDVLLLNNNKWYVVNEGSTVLDLACRYKPEKIFYLKTVFKEGVPVDLNYNPIKDDVLSFEYNDGHEVLAHHSWEEYVTFEDAKKIFRSLATDNDEPNKLVRELKNALKDKLESAKEIKRRLAFLNFNTLESYLEFYKNFSNKEIVYGFLSKTRKWKKYYLELSKGISKYELLLYNIKDKNIFNCKKAIFTECCTKLPGMDIIGVLNKGVLFIHRFDCERVSDKSKKFILEWDLDKATELTRSYPATLIININSKIFKINPIIHFITSKGFEIDSFDSSLKEDNKVLTFKLQVNKINNLNLLITELTYKFEQISSVKFK

SEQ ID NO: 46045 - protein, 465 aa, Mycobacterium avium 104
MTSHYDVVVLGAGPGGYVAAIRAAQLGLSTAIVEPKYWGGVCLNVGCIPSKALLRNAELAHIFTKEAKTFGINGEATFDYGAAFDRSRKVAEGRVAGVHFLMKKNKITEIHGYGRFTDPHTLAVELNDGGTETVTFDNAIIATGSSTRLVPGTSLSANVVTYEEQILSRELPESIIIAGAGAIGMEFGYVLHNYGVEVTIVEFLPRALPNEDADVSKEIEKQFKKLGVKILTGTKVESISDDGSQVTVVVSKDGNSQELKAAKVLQAIGFAPNVEGYGLEAAGVALTDRKAIGITDYMRTNIEHIYAIGDVTGKLQLAHVAEAQGVVAAETIAGAETLALGDYRMMPRATFCQPNVASFGLTEQQARDEGHDVVVAKFPFTANGKAHGVGDPSGFVKLIADAKYGELLGGHLVGHDVSELLPELTLAQKWDLTATELARNVHTHPTMSEALQECFHGLTGHMINF

SEQ ID NO: 46046 - protein, 481 aa, Propionibacterium acnes KPA171202
MASVCTAEATRAAEQRWFDAHPGQDLMDIAAQAVARKAQELLLGGAVDEIMPDWAASQCVLVLVGGGNNGGDGLFAAAALAQRGWRVELAQVMGQPHEAGMAAALDAGCIRVSLGEVTSHSYDLAIDAVLGIGGRPGIPQSLERIDTWLRARQIPVLAVDLPSGLDANSGEVESCVHAAYTITFSSLKWCHIAHPAARYCGELEVHDIGLDFVDDDGECLDDVDEYCDLAEMASLWPVPGALDDKYSRGVVGIDTGSEKFPGAAVLGVLGALRTGPGMVRFSGPSAIMAFILSRAPSVVIGEGRVQSWVIGSGWGTHDGNADRFIQRAAEGVPMVIDADALALLPAELPEGCLLTPHAGELARMLRIERSQVVADPRGSVVRAAQRFGATVLLKGSIQWVARPDGGVRAALPGPAWTAQAGSGDVLAGMCGTLMAAGLPADDAALCAAGMQATTAISMPGPYAPDQIAELLPGTVTTVLSR

SEQ ID NO: 46047 - protein, 90 aa, Oryza sativa
VLDNGGSNRHRKVLLDNIQGITKPAIRRLARRGGVKRIFALIYEETRGVLKIFLENVIRDAVTYTEHARRKIVTAMDVAYSFNARPYSLR

SEQ ID NO: 46048 - protein, 380 aa, Triticum aestivum
GADSSSVAAIVGSMCQLVIKDIDKGDEQVKADAMRIGQYRDGEFPTDSRELAKRLFYTVYMGTENSSEDTRSRAKRLAEEIGSFHFDVPIDSVVSAFLSLFERLTGKRPRYKVDGGSHTENLGLQNIQARIRMVLAFMMASLMPWVHNKSGFYLVLGSSNVDEGLRGYLTKYDCSSADINPIGSVSKQDLRAFLRWAAVHLQYSSLAEVEAAPPTAELEPIRTDYSQLDEVDMGMTYEELSIYGRLRKIFRCGPVSMFQNLCHRWCGRLSPSEVADKVKHFFKYYAINRHKMTVLTPSYHAESYSPEDNRFDLRQFLYNSTWPYQFRKIDQLVQDIDKDGKWVEDRRADSQLRQRGAARPAQGGGMGVVAAGSANPSVGL

SEQ ID NO: 46049 - protein, 221 aa, Rhodopseudomonas palustris CGA009
MAGGLGLLAAASLPLAAQAQAQANAPGDTPDAALDKLMQGNERYIAGQMRERDFSAGRAARAESQAPFAAILGCADSRVAPELAFDQGPGSLFVVRVAGNFVTPDGLASLEYGAAVLGTKVIMVLGHSNCGAVNATVAALQKGNDLPGHIGDLVRAMKPGIEPVLQKKEEDLRHQAVIANVRANVRQLQESKPILAEMVNSKKLRVVGGVYDLASGKVELV

SEQ ID NO: 46050 - protein, 461 aa, Burkholderia pseudomallei K96243
MATDQDNDGLKRGLKNRHIQLIALGGAIGTGLFLGIAQTIRMAGPSVLLGYALAGVVAFFIMRQLGEMVVDEPVAGSFSYFASKYCGHFTGFLSGWNYWVLYVLVSMAELSAVGIYVQYWWPGVPTWISALVFFVVINAVNLASVKSYGETEFWFSIVKVAAIIGMIGFGGYLLLSGHAGPDAGVANLWRHGGFFPNGIGGLAMAMAVIMFSFGGLELVGITAAEADDPSHSIPRATNQVIYRILIFYIGALGVLLSLYPWQKVVTGGSPFVLIFHALSSDIAASVLNVVVLTAALSVYNSCVYCNSRMLYGLAQQGNAPQALARVNRRGIPIAALGVSAFATALCVVINYFMPGKAFELLMGLVVSAIIINWAMISVIHLRFRQAKRAAGETTRFRSLGYPLTNYFCLAFMAAILVVMFRTPELRLSVYLIPVWLVVLALGYRFRQRGAGYALGGGVSAR

SEQ ID NO: 46051 - protein, 389 aa, Arabidopsis thaliana
MGWWRKKKKPKSEIASERGAKLLKDLIECCDGKSNPIKFFSADEIRKATNNFGVSNLVSELSHDFDYKWYSGKNENHDMILVRKAFSQSVYYKDTFFRDIAVSSMVSGHKNFLKLIGYCLEFEEPVMVYHGVKKHYHLESSEQPWKRRMKIAEDIATALAYLHTAFPRPFVYRCLSLTNILLDEDGVAKLMDFSFCVSIPEGETFVQVDYIAGTVDYLKPNYLKHGVVSEETDVFAVGHSMQMLLMGEKIFDRIMRRPFPTSKFMEEPKMDEIADPEMGEISEEELCQMKAFLLLSLRCTGHVGEVPTMVEVAKELKSIQRCLHNDTFSPSVETQFDSHQDISSSVILSNQTKDTRALLRCIACHVFDEMFQWVMMNWFRFFRRNRRIC

SEQ ID NO: 46052 - protein, 187 aa, Aspergillus oryzae
MATGPATQSLKCVVTGDGAVGKTCLLISYTTNAFPGEYIPTVFDNYTASVMVDGRPISLGLWDTAGQEDYDRLRPLSYPQTDVFLICFSIWFPEIEHHAPNVPIILVGTKLDLRDDPATTDALRQRKMEPVSYEQALAVAKEIRAHKYLECSALTQRNLKSVFDEAIRAVLNPRPAAKPKKSKCLIL

SEQ ID NO: 46053 - protein, 326 aa, Triticum aestivum
  misc_feature (184)..(184): Xaa can be any naturally occurring amino acid
  misc_feature (230)..(230): Xaa can be any naturally occurring amino acid
MAAQPAERSFDVIVVGAGIMGSCAAHAAASRGARVLLLEQFDLLHQRGSSHGESRTIRATYPQPHYPPMVRLSRRLWDDAQRDSGYAVLTPTPHLDLGPRDDPAFLASVANGGATVLAPAAADAPRPAWAEAFRVPDGWAAASSELGGVMKATKAVAMFQALAAKLGAVVRDRAEVVDVARQGXMRTTTIVVKNSYRGRSFQGAQVNHQGWAAWTNQPGQGSGTGADLPXQPLHTLICYWKVKPGHERELTTEAGFPTFASYGVPYIYSTPSMEYPGLIKIAMHGGPPCDPDRRDWAIGPRAKMGWWSPWHGGLQVIPGHLEDRGR

SEQ ID NO: 46054 - protein, 518 aa, Oryza sativa (indica cultivar-group)
MAFIPPRDLVVVLPFLALLLPLYIYLRYSRSAKANPSLPTEWPLVGMLPSLVANIHNLFDYATALLAASGNSFEARGPPMSGLRFFVTCDPDNVRHIFINNFANYPKGEEFASFFDVMGDSFFNADGESWRRQRARVQHVMSNPRLLASMAACCRGKVEKGLLPILDRMASAGAPFDLQRLLTRFAFDVTAMAVFGVDTCRLSIDMPPLDVANAMDAVMEVGFFRHTVPVSCWKLMRSLRIGPERKLTAAQRLLRRFVAEMIEKRRVAGGACKATDDEQGGVPPPADIVSSYINDPEYVDEDGNPREFMYATFINYMVAGRDTVGTALSWLFFNLTEHPRVVARIREELEPIASSKAGGGGMVVFDPEETKPLVYLQAALFESMRLYPPGPIERKATLADDVLPSGHTVRAGDNILIPVYSMGRMASVWGKDSGEYRPERWVTEDGKLRHVPAHRFMPFNAGPRLCLGKDISVLQMKSVAAAVAWNFDLEVVAGHAVEPKVSIVMQIKNGLMVKVKKR

SEQ ID NO: 46055 - protein, 498 aa, Arabidopsis thaliana
MEKGEDSSTFKMGNSAQERSLPYVPDCYVVPPSSKPCDSNSGIVPTIDVSRLKGGDDERRGVIQELSLACQHLGFFQIVNHGINQNILDDALEVANSFFELPAKEKKQFMSNDVYAPVRYSTSLKDGLDTIQFWRIFLKHYAHPLHRWIHLWPENPPGYREKMGKFCEEVRKLSIELMGAITESLGLGRDYLSSRMDENGMQVMTVNCYPPCPDPETALGLPPHSDYSCITLLLQNLDGLKIFDPMAHGGSGRWVGVPQVTGVLKVRFNCTGLDVHIGDHVEVLSNGLYKSIVHKVTLNEEKTRISLASLHSLGMDDKMSVPRELVNDENPVRYKESSFNDFLDFLVKNDISQGDRSASWNRVTEDYSVPWSAPKGLWKGLDEDEPAPYDPTGQEMTKKEKSRTKFAENAVHIIPFVLLACALVLWFFSNPDVGVKGDSIAARIEGLTIEGDIDNDSDGTQTGFLGAATEIHKNYFHSVLTPFFLINLLQLGGQRFDV

SEQ ID NO: 46056 - protein, 557 aa, Lactobacillus sakei subsp. sakei 23K
MSDIQIAQANEATEMKSITAIAEQIGLQATDIEQYGPYKAKLNFQAINRLKEKEDGKLVLVTSINPTPAGEGKSTVTVGLGDALRQLDQSAVIALREPSLGPVMGMKGGATGGGYAQVVPMADINLHFTGDMHALTATVNTLAALIDNHLQQGNVLNIDPRRIIWKRALDINDRALRQVVIGLGGPVQGMPRQDGFDITVASELMAILCLATDITDLKNRISKIVIGYNYDREPVTVGDLEVTGAIAMLLKDALKPNMVQTLEHTPALVHGGPFANIAHGCNSILATQTALKLGDIAITEAGFGADLGAEKFLDIKVPQLGKTPDTIVIVATIRALKYNGGVALADLTTENLDALKAGFSNLAKHIANMQRYGVPVVVSVNEFTSDTAAEVQLLQDLCQAMKVTAVPTSVWANGGQGGIELAKAVLAALQQPKAFKPLYDPQADIKSKLTTVVTEIYGGRDVVFEGKAINQLKQIEKNGWAHLPVCIAKTQYSLSDDPKALGAPSDFTIHVRELIPKLGAGFIVAMTGAVLTMPGLPKKPAALNMDVTADGQISGLF

SEQ ID NO: 46057 - protein, 111 aa, Triticum aestivum
  misc_feature (75)..(75): Xaa can be any naturally occurring amino acid
  misc_feature (86)..(87): Xaa can be any naturally occurring amino acid
  misc_feature (97)..(97): Xaa can be any naturally occurring amino acid
MEPASASLVSLRASTATSRSCFSCQQRATPRTRMLPAMASKSGAKLVASGCKTCRGKGAVECEGCKGTGRTRRIXNIFERLKCFDXXRGFGMRKCPXCGRGGLTPEQRGER

SEQ ID NO: 46058 - protein, 402 aa, Oryza sativa (japonica cultivar-group)
MPFQLKNGHHHHGAMEGKPPVTPMQQQQQHAPPPRVSRFRRLLVRVSASERLAGDGKERGEKEAEKVSASAAGGEVEAGSVGLDRMVLSFMEDSAAVERPQRGRCNCFNGSNYEESDDEEGFFLPSDHSSASAPAAAGDALESLKGLVQSASVAERNLLADASRIAERCCKGSKGKAECRRAVADGLRALGYDAAVCRSRWEKTSSYPAGEHEYIDAVVGEEVRLIVEVDFRSEFEVARSTKAYRAALQALPPLFVGTPDRLGQIVAVVAEAARQSLKKKGLHFPPWRKPEYMRAKWLSPHVRSGDKAAAAAKTVTSTTSATATPVSAASFSGAFELLFDRKQSGEIPAAEKITVVVSPSPWRPTEEASKKKPPPSPSPPQLWQQHQQPPKAKVVTGLAAVL

SEQ ID NO: 46059 - protein, 579 aa, Mycoplasma penetrans HF-2
MMKDKKYKGIGASDGIATAKAFLLDKPIFKIDDSKISNVDQEISKVNAAIEASIKNIEHVKTIAIDKIGAEKAMVFDAHAQIANDPELKNEIISIIKDQKVNGAYAIDVVFKKTHDLFANMEDDYFKQRASDVEDVRTKILSFFLNIELPDLLAIKSEVIIVADDLTPSETALLDKKYVKGFATNIGGRTSHAAIMARTMEIPAVLGLKDITNAVDKNSMIALDGSTGDLVIEPSDLSVWNKKKEIFLKEKEELKKYINVKAKTLDGVEVDVVANIGKPEDADNLDSYGAEGIGLVRSEFLYMENSKWPTEEEQFNAYKYILEKQKNKLVIIRTLDIGGDKKLNYYQFPHEMNPFLGYRAIRFCLNNPEIFKTQIRALLRASAFGRMGIMFPMIATVDEFLKAKNIVEETKKELTKEKIAFDSKVLVGMMVEIPSSAFLTDKFAKYADFFSIGTNDLVQYTFAVDRMSENVSYLYQPNNPALLRAIKATIEGAAVHKKFVGMCGEMAGDIRSIPILLGLGGKGLDEFSMSASSILRSKKVIASLKHSECVELANKAIDCDTAEEVNNLVENFLQKKNLI

SEQ ID NO: 46060 - protein, 144 aa, Brassica napus
MALDQTTNPPIMESKTRHPLHQIADTPTHKLLLKQWLKEEELILNRVSHKESQIDSVRREITQLYIFFFLFHSISLLLLFHASSSSSLSACKRSWIPSLCSLVSSLGLIWAVRYKSEVESHLEKLLEREKEDAKLLRKCVEELK

SEQ ID NO: 46061 - protein, 381 aa, Bartonella henselae str. Houston-1
MKVDYYEILGVTRECDDKKLKSAFRKLAMQYHPDRNAGDKEAERKFKEIGEAYEVLKDPQKRAAYDRFGHAAFENNNNGGGSPFSGFSAGGFADIFEDFFGEIMGGGHRKRSDGRERGADLSYNMEVTLEEAFSGKTAQINIPSSVVCDACEGSGAKKGSKPQTCGTCHGAGRVRAAQGFFSIERTCPVCHGRGETIKDPCPKCQGTRRVEKNRSLSVNIPAGIEDSTRIRLSGEGDAGIRGGPSGDLYIFLSVKPHEFFQREGADLHCRVPISMVTAALGGEFEVSDLDGIKARVKIPEGTQNGRQFRLKGKGMPMLRRQQVRGDLYIHITIETPQKLTQEQRELLQKFEKLSNHENSPQSHGFFSRMKEFFENISGKNE

SEQ ID NO: 46062 - protein, 426 aa, Triticum aestivum
MAAAASSLARRAVSCRRLLLSRAFAAAAARPAKRVLVPVAAGTEPVEAAATADVLNRAGARVTVATVAFAPAGDEGLLVEAAYGVKLVADARVADLEGEAFDLIALPGGMPGSTNLRECKVLEKMVKMHAEKGELYGAICAAPAVTLAHWGMLKGLKATCYPSFMEKFTAEVIPVNSRVVVDRNVVTSQGPGTAIEFALALVEQLYDKEKMEEVAGPLYVRPQHGAEYTSEELNSVEWKCSGTPQVLVPVANGSEEIEALNLIDVLRRAGANVTVASVEDTLQIVTRRHKFNLIADMMLDEAAKMEFDLIVMPGGLSGAQKFASTDKLVDLLKKQAGSGKPYGAICASPAHVLEPHGLLKGKKATAFPPMAHLLTDQSLCENRVVIDGNLITSRAPGTATEFALAIVEKLFGREKAVSIAKEFVFM

SEQ ID NO: 46063 - protein, 402 aa, Bradyrhizobium japonicum USDA 110
MPIREVDMARKRIGILTGGGDVAGLNAVIKSVTYRGSEDDIEVVGLRRGWEALTHLNLDDPNSRSHYVIPLNRENTRTIDRRGGTVLHSSRVNPSKIQKLPGHLVGNEVPVSLSTNGGIATKTWDLTSRVLANLSGLGIEHLIAIGGDDTLSYAAKLNELGVKIIAIPKTMDNDVRNTEYCIGFSTAITRASDAIQRQRTTVGSHERIGIFRVFGRDAGFTALYTAYATSIRCLIPEHKVDLDKLIQLLIEDKRANPSNYALIVLSEGAQWEGYKLREYGEPDAYGHRKKANVAESLADEIKQRTGEETITSDLTYDLRSGDPDFIDKLVALTFGNMAYDAMLESKTGLMSALVEGRYDLVPIPDAKLGPRKLDVASSYNTERYRPIYANKQGLPIFLNRAS

SEQ ID NO: 46064 - protein, 390 aa, Methanosarcina acetivorans C2A
MRKESYEFPLEDFIPREDFNKIKKFSRDKETPFLVIDLQKIERSYEELVEHMPFAKIHYAVKANPMDRVVLALKDKGSNFDVATIYELDQVLRLGVEPERISYGNTIKKEKDIAYAYEKGVRLFVTDSESDLKKLSREAPGSRVFFRILTESDGADWPLSRKFGSHPDLIYKLILKAEKLGLEPYGLSFHVGSQQRDIGQWDNAISKCKYLFEAAAEKGIQLKMINLGGGFPAKYQAQANDLETYAREIRRFLHDDFGEELPEILIEPGRSLVADAGIIVSEVVMISKKARFNQYKWVYLDIGKFGGLIETLDECIKYPIFCDKKGCAEEVILAGPTCDSMDILYEHHKYSFPHTMREGNRAYIFTTGAYTQSYCSVNFNGFPPLKAYLI

SEQ ID NO: 46065 - protein, 670 aa, Aspergillus oryzae
MASMTSFARALRSTPTTHTTTCSILRSHLRPRSLPRSVSPRSARFVHPGAYQPFVPPSPSELGKPAPAKTYDRSRKWLRRLVYLSLATGVVYAIDTQFYASSLTRTARTFTLGLIVALDYKINFRPNPLLASSINHLHTRNAERLSDLLRHNGGLYLKIGQAVAMQSAILPPEFQKMFSRMFDDAPQNDWKDVEKVIREDFGKSPEEVFGVSFTGDPTKGVMERKARASASVAQVHWARLADGREVAVKVQKREIAQQIQWDLWAFKVVTWVYSRVFDIPFYSLVPYVSERLFLETDFENEADNSEHMARLVAGESRLRNRVYIPKVYRELSSKRVMTAEWIEGVRLWDKDAITRSWRGGWHQGSPGCHGTPMDPPQSDSTSTKVSRNPNATQLKPERDHWRGWNGRGGLGLSLKEVMTTMIDLFSAQMFLWGILHCDPHPGNIFVRRKPSGQPELVLIDHGLYIHMDTDFRHQYARFWKSLLTFDNAAIRDIVKQWGVTNPDIFASVTLMRPYQGGDLSTQQHFEGLSKKDRAQRHYEAQQAARKGIRQILGDESKWPKELIFIGRNLRIVQANNQFLGSPVNRIKITGTWASRALVESPDLPLNEKIQNYGRHILFRLVLFTSDIYFYFTKIRQFLRLGGGMEDSLEAQMQSMAKDMGVDLQQNVFEG

SEQ ID NO: 46066 - protein, 264 aa, Chlamydomonas reinhardtii
MGCGASVPQNGGGAPVTRVMPAPAQPVSEAQSAISFQPSRSNRSSLEKINSLTDRASPEQVLQNLLDGNMRFLDGAVAHPHQDFSRVQAIKAKQKPLAAILGCADSRVPAEIVFDQGFGDVFVCRVAGNIATPEEIASLEYAVLDLGVKVVMVLGHTRCGAVKAALSGKAFPGFIDTLVDHLDVAISRVNSMSAKAHQAIKDGDVDMLDRVVKENVKYQVQRCQRSVIIQEGLQKGNLLLAGAVYDLDTGKVHVSVTKGGSSAE

SEQ ID NO: 46067 - protein, 404 aa, Bradyrhizobium japonicum USDA 110
MSSSVIDYLATETRLGAHNYEPIGVVLSRGEGVWVWDTDGNRYLDCLSAYSAVSQGHCHPKILAAMVEQAHRLTLTSRAFHNDQLAPFYEEIAALTGSHKVLPMNSGAEAVESAIKSVRKWGYEVKGVPDDQAEIIVCADNFHGRTLGIVGFSTDPETRGHFGPFAPGFRIIPFGDAAALEQAITPNTVAFLVEPIQGEAGVIIPPAGYFTKVRELCTANNVMLVLDEIQTGLGRTGKLLAEQHEGIEADVTLLGKALAGGFYPVSAVLSNNEVLGTLRPGQHGSTFGGNPLACAVARAAMRVLVEEGMIENAARQGARLLEGLKDIRANTVREVRGRGLMLAVELHPEAGRARRYCEALQGKGILAKDTHGHTIRIAPPLVITSDEVDWALEQFATTLTQDFS

SEQ ID NO: 46068 - protein, 551 aa, Pseudomonas syringae pv. syringae B728a
MTDHEDPSRDRLKHHFAQRVIHQARQILETWQRLQKAEWSVGDMAELKESTQRLSRFAERFEQAEHSALAQEISQALDAVEANRGRLNSRVITDLNRLMQRLSRTGLRHGDRFEQTALPPLRKPVYIVLQDHERAERLAKQLEFFGLAALSLHNVAEFQRAMAQRHPAAIVMDVDFSGPGKGLELASQAQEGLEQKLPLLFFSLNETDTPTRLAAVRAGGEEFLTGALEASSLLEKIEVLTCVAQYEPYKVLIIDDSRAQALHTERVLNAAGIVTRVLLDPIQAMSELAEFQPDLIILDMYMPGCTGTELAKVIRHNDRYVSVPIIYLSAEDDQDKQLDAMSEGGDDFLTKPIKPRHLITTVRNRAARARSLKARMVRDSLTGLYNHTHILQLLEDCSFRSRREDKPLCFAMLDIDHFKKVNDSHGHPMGDRVIKSLALFLKQRLRKTDFIGRYGGEEFAIVMPDTDIQSAHRVLDDIRHRFAEIHYPAQPADLFCTFSAGVVSLGAHDDSLSLASQADTALYCAKHAGRNRVHSVLVDVPYHVVLNGIEA

SEQ ID NO: 46069 - protein, 434 aa, Lactobacillus sakei subsp. sakei 23K
MTKSTYRNPDAVLDVNERPTTGKWIGLSIQHMFAMFGSTVLVPILVGLNPGIALFSSGVGTLMYLLITKGKIPAYMGSSFSFIVPMLALMKTTGYPGIAQGTMAVGAVYLIVSVLVSLIGSGWIDKALPPIVVGPIVMVIGLSLAGTAAKQATINAAGNYDLKFFAVAILTLLITIAFNMYLKGFMSLIPVLLGIVSGYIIAVLFGIVDFQPVLNAPWFKVPDFQVPFVTYKPGLYWGAILSMAPIAFVTMTEHMGHIMVLNKLTKRNFFKNPGLHRTLAGDGTASIIAAFVGGPPVTSYGENIGVLAITKVHSVWVLGGAAFFAIIFGFIGKLSALIQSIPAPVIGGISFLLFGVIASSGLRVLIDNQVDFDKKRNLMIGSSILVIGIGNAYLQLGQYQFSGLAIATVLGIAMNLILPQKSKSEIELEAQQND

SEQ ID NO: 46070 - protein, 513 aa, Oryza sativa (indica cultivar-group)
MAFSSILQLTLCFLCFSVFYYYHIKSKRKNPAIPVCWPLVGMLPDLLVNRHQLHDWITSFLTASQLNFRFIGPTMSSNMRFFFTCDPANVRHIFTSNFANYPKGPDFAEIFDDTLGDGIFNVDGDSWRRQRAKTQLLMYNHRFQSFVSRCSSDKVENALLPLLSHFAGTGERCNLQDVFMRLTFDMSTMLASGEDPGCLAISLPMPKVPFVRAVDYTTRVLLVRHIIPLSLWKLARRLGVGFERKMAEALRTINQFIYETIVKRRAKKATEGIEDSEDLLSSYLKDDDENADTFLRDTTMTLIAAGRDTIGSALSWFFYLLTKNPHVASKILEELDSVERATTTPDGMVTFDPDELKSLVYLHAAVCESLRLYPPVPLDHKGVVAADVMPSGHKVRPGDKIVVSIYAMGRTESVWGSDCMEFRPERWISDHGKLRYVPSYKFTPFITGPRTCLGKDMALVQLKVVAATVVKNFEAEAVPGHIVEPKLSMVLHMKNGLMVRVKRSLLGPSSVHV

SEQ ID NO: 46071 - protein, 507 aa, Oryza sativa (indica cultivar-group)
MAFASILQLALCFLCFSIFSYNHIKSKRKNTAIPVCWPLIGMLPDLLANRHRIHDWITSLLTASQLNFRFTGPPSSNMRLFITCDPANVRHVFTSNFSNYPKGPDFTEIFDIFGDGIFNVDGDSWRRQRAKAQLLTCRPRFRAFVSRCSRAKVEKALLPLLAHFAATGESCNLQDVFMRLTFDTTTMVVSGADTGCLAISLPEVAFARAMDDATRVLLVRHIVPLSWWKLVRRLGIGYERTMAEALRACDHFVNETIEKRRAEKAKGEADGSADLLSSYINDDDEEENASSSFLRDTTMNLISAGRDASAMALSWFFYLLTKNPCVVSKILEELDSVNGITTPDGMVTFDPDELRPLVYLHAALSETLRLYPPVPLEHKGVLAADALPSGHDVRPGDKIVVSLFAMARMEAVWGSDCREFRPERWISKDGKLRYVPSYKFMTFSSGPRTCLGKDMAFVQLKAVAAAVVKNFEIEAMPGHVVEPALSIVLHMKNGLMVRVKRRHVLNN

SEQ ID NO: 46072 - protein, 508 aa, Oryza sativa (indica cultivar-group)
MAVSSFSFLELLLSFLCFGFFYYYHVKSKQKNPVIPLQWPLVGMLPALLANCNHLHEWITSVLTVTPLNFRFIGPPSSDMRLFITSDPANIRHVFNTNFSNYPKGREFQEIFDILGDGIFSADGESWRRQRTKAQMLMSSPRFRAFVARYSRDKVEKALLPLLAHVAGTGDACNLQDVFLRLTFDTTTTLVFGVDPGSVAIDLPEVPFARAMDDAMTVLLLRHIVPLSWWRLARRLGIGYERKMPVAWRTMDRFVADTIAKRRAEKARTGIDDSADLLSSYINDDEEDAGTVDAFLRDTTINLMLAGRDTTGSALSWFFYLLTKNPRVLHKLLQELDSVKSTTTADGMVIFDPDETGRLVYLHAALCESLRLYPPVPMEHKGPAAADVLPSGHEVRPGDKIVVSLYAMGRMESVWGSDCMEFRPERWISDDGKLRYVPSYKFMSFNSGPRTCLGKDMAFVQLKTAAAAVMKNFEIEAVAGHVVEPKLSIILHMKNGFMVTVKRRLAVC

SEQ ID NO: 46073 - protein, 1060 aa, Lactobacillus sakei subsp. sakei 23K
MPKRTDIRKILVIGSGPIVIGQAAEFDYSGTQACLALKEEGYQVVLINSNPATIMTDKTVADTVYIEPITLDFVTQILRKELPDAILPTLGGQTGLNMALELANCGILAELNIELLGTKLSAIDQAEDRELFKNLMNQLNEPIPESAIAHSLDDAQEFVKQNGFPVIIRPAFTLGGTGGGIAENAGQLKTIVKNGIALSPVGQVLVEQSIAGYKEIEFEVMRDRNDNALVVCNMENFDPVGIHTGDSIVFAPVQTLSDREVQMLRDASLKIIRALKIEGGCNVQLALDPNSERYFIIEVNPRVSRSSALASKATGYPIAKMAAKIAVGLTLDEIYNPITGTTYAQFEPMLDYVVAKIPRWPFDKFNKGDRQLGTQMKATGEVMAIGRNIEESLLKAVRSLEIGTAHLELDGLTSVSDNDLVQRIIHPQDDRLFYLAEALRRGYLIQELAELTKIDLFFLDKISHIVELEEQLRSEKGDVELLEIVKKNGFSDEKIAKTWQITPIQVRQMRQESGIQPVYKMVDTCAAEFESQTPYYYTTYEQENESLVSAKPSILVIGSGPIRIGQGVEFDYATVHCVQAIQKAGYEAIIMNSNPETVSTDFSISDKLYFEPLTLEDVLNVVELEKPEGVIVQFGGQTAINLAAPLEENGVKILGTSVANLDRAEDRDLFDQLIQELNIPQPVGKTATNAPDALTIATEIGYPVLIRPSFVLGGRAMEIVHTPEDLTHYMQEAVKVSDEHPVLIDRYLMGKECEVDAICDGQEVLIPGIMEHIERAGVHSGDSMAVYPPQNLTEDQKAAIIDYTTKLCLALDCHGLLNIQFIIQNDEVYVIEVNPRASRTVPFLSKVTQIPMAQLATQLILGSTLAELKSPTGLLPAGPLIHVKAPVFSFSKLTRVDSLLGPEMKSTGEVMGTDVTMQKALYKAFEASGMHLPSHGNVLMTVTNQDKAQALALAERFREVGYQIIATPGTTQQFKAAGIPVQQVDKINATSGDLLDKIKAGHIQLVINTTGLNEAPQVAKDSIVIRQTAIEHGIPLLTSLDTTDAILTVLESQSLLTKPL

SEQ ID NO: 46074 - protein, 532 aa, Oryza sativa (indica cultivar-group)
MDMLLCFVEIFSILCCCIIYYYHLQTKKASASEPTEWPVLGHLFGMFANIHRFHDWATDILAGGWHNFEARAGLTGIRFFITCDPSNVRHIFTSNFANYPKGDEYAEIFDVLGNGIFNADGESWRSQRAKAQMLMAGARFRAFAARSSRDKAEKSLLPLLAHAADTGARCDLHDLFLRLTFDVTCTLVFGVDTGCLSAGLPVIPFARAMDDVLETLFLRHIIPMSCWKLMYRLEVGTERKMAVARRTIDRFVAETIAKRRADMIRQGTSNSDDLLSSFISHDDDDTSNGNDVVDETDEFLRDTTVNLLLAGRDTTGAALSWFFYILSKNPRVEQKLLEELAPIAAQKGGDGGGMVIFDASELKNLVYLQAALSECLRLYPSVPFEHKAVAADDVLPSGHEMKAGDKVLVFSYSMGRMEGVWGKDCTEFLPERWITSEGKLRYEPSYKFFSFNAGPRTCLGKELAFVQLKTVAAAVMWNFAVEVVPGHAVEPKLSIILHMKNGLAVTVKRRATMASCQLVHESLAISHGWFRS

SEQ ID NO: 46075 - protein, 361 aa, Solibacter usitatus Ellin6076
MAQNTSYKLLAAATLLATGLVLTNLPGEQAAAGRAARLSTNRSPVAPADAQIQAAINEAYARYRSDTSGKNADYIPYLAQVDSKLFGIAAVTTDGRVFTAGDVDFSFSMQSISKVFTLALAMEELGADKVFERIGAEPTGRPFNSVTAVEDMPGHTANPFVNAGAIATTSLVSGSDPNAKWDKILAFYNKVAGEKLKLIDDVYKSEAATNMHNKAIATLLASYERMYSDPLEATDIYTRQCSVGVTAKELAVMGATLADQGRNPITGIQVIKPENVPHILAVMSMAGLYDGSGGWAWKVGLPAKSGVGGGILAIVPGKGAIVGFAPRLDKAGNSVKAQKSIAYVADKLDINLYSPGSVGLK

SEQ ID NO: 46076 - protein, 341 aa, Gibberella zeae PH-1
MSGISFKSFVQSQYTPIPLPNHDFTGQTILITGASRGLGLEAASHFYRLNASKIILAVRDARKGPECIAFVRQYNPSSNTTVECWELDLTNVETIRQFVAKAKNLARLDAVILNAGMATMSFQAIDGMEKTLATNVTGTFLLAIGLLPALRLSGLRNNIRPRMVLVSSQGHEAAAFAERDADDIFAALNDADKTDMTDRYDTSKLIQLLAFYALKDTVDKSWPDSITFTAVDPGLCDTDLTRDIPLLIRIIHRIMKMLLARTAEVGGRCLVLGAADDEHSHGAYFKDGVIGSPPVAVTDPEGVELKNRVFSQLKSLLYSVDPQIMDACPVMESDEEAIRLN

SEQ ID NO: 46077 - protein, 253 aa, Propionibacterium acnes KPA171202
MTGLLAGRTALVTGGTAGIGRGIAEVLALHGARVAVTGVTEERCAQAREDGLDVYQLDVRDKKACIRVVNDVAAECGGLSVLVANAGVYPQVRLADLDDDQIDFIFDVNVKGMMHVVQAATPALRESGRGRIVVTSSITGNITGYPGWSHYGATKAAQMGFIRSAAMELAGDKITINAVMPGNIMTPGLKALGDDYLAEMAKSVPLGMLGEAKDIGEAVAYLASDGARYVTGQSIVVDGGQVLPEGPEALAEM

SEQ ID NO: 46078 - protein, 155 aa, Zea mays
FGDPGSREDRRFIYPSIPPNPPSGSGSFSVPLWEKKFCTDACAIPWAKLCETKRLMSLYKSVVDWDDSAALEAFNNAKARFCAVYHGQCYDIPLPDPNMFIDIINPDEYVDPELVADLEKSRHSVPRKDNGVPDVWDSFIFSDKPVPVTGWGDTE

SEQ ID NO: 46079 - protein, 542 aa, Oryza sativa (japonica cultivar-group)
MGNQCQNGTLGSDYHNRFPREHAVGYVQGDSYLDLKKFDDTWPEVNNFKPTAASILRRGLDPTSINVLGRKTADLREHYIIGRKLGQGQFGTTYLCTEINTGCEYACKTIPKRKLITKEDVEDVRREIQIMHHLSGHKNVVAIKDVYEDGQAVHIVMELCAGGELFDRIQEKGHYSERKAAELIRIIVSIVAMCHSLGVMHRDLKPENFLLLDKDDDLSIKAIDFGLSVFFKPGQVFTELVGSPYYVAPEVLHKRYGPESDVWSAGVILYVLLSGVPPFWAETQQGIFDAVLKGHIDFQSDPWPKISDSAKDLIRKMLSHCPSERLKAHEVLRHPWICENGVATDQALDPSVISRLKQFSAMNKLKKLALRVIAERLSEEEIAGLREMFKAVDTKNRGVITFGELREGLRRFGAEFKDTEIGDIMEAAHNDNNVTIHYEEFIAATLPLNKIEREEHLLAAFTYFDKDGSGYITVDKLQRACGEHNMEDSLLEEIISEVDQNNDGQIDYAEFVAMMQGSNVGLGWQTMESSLNVALRDAPQVH

SEQ ID NO: 46080 - protein, 187 aa, Arabidopsis thaliana
MTWSVFRSINTPTLDLSTALRSTRTPLVAAGVGCATFAGVSLFRMSSRSPPFASLSVSASSVKKEVVSTEKAPAALGPYSQAIKANNLVFLSGVLGLIPETGKFVSESVEDQTEQVLKNMGEILKASGADYSSVVKTTIMLADLADFKTVNEIYAKYFPAPSPARSTYQVAALPLNAKIEIECIATL

SEQ ID NO: 46081 - protein, 148 aa, Brassica napus
  misc_feature (106)..(106): Xaa can be any naturally occurring amino acid
MASSMLSSAAVVTSPAQATMVAPFTGLKSSAAFPVTRKANNDITSIASNGGRVSCMKVWPPVGKKKFETLSYLPDLTEVELGKEVDYLLRNKWIPCVEFELEHGVXYREHGKHPPGYYRWPVTGTMGKLPLVRDAPDSAPGVERNPQP

SEQ ID NO: 46082 - protein, 300 aa, Pseudomonas syringae pv. syringae B728a
MIRVIFLTLMTGAVLAALSGCSPLKLLNTLNPSGPVDHVYNLAYGPDPRNTLDVYTPKAKPAKAPVVVFFYGGSWNSGSKADYAFVGEALAARGMVVIIADYRLYPQVRYPSFLEDSAKALAWAHKHANTYGGDPSRLYVMGHSAGAYNAAMLALDPRWLAREGLSPSILSGWIGLAGPYDFLPIENPDVKPVFFFPNSPLDSQPINHVTSSAPPALLMASHTDSLVNPKRNTGGLARALREAGVPVRDLYFSRTNHGTLVGAFARLLSGLAPVVDEVDMFVRHTPQTASEKNATGPKAQ

SEQ ID NO: 46083 - protein, 551 aa, Ralstonia eutropha JMP134
MEQVEHNADGLERSPVNFVPLTPISFLRRTAEVYPERTAIAYGERRTSWRAMLDRSRRLASALVAAGVRTGDTVAVMAANTPEMLEMHFGVPMSGAMLNTLNVRLDAAAIAFMLRHADAKVLVTDTEYADVVQAALALLDDKPLVIDIIDPAVEGGRRLAEIEYEGFLAGGDPHWEGGEPVDEWQAIALNYTSGTTGNPKGVVYHHRGAYLAALSNMLDWGMPRHAVFLWTLPLFHCNGWCFAWTLAANAGTSICLRRVDAAAVLDAIREHQVTHYCGAPIVHAMLAHAPEAWKAGIDHPVHGLIGGAPPPMPVIEGLLRMGIRITQIYGLTEVYGPAAVCVEQPEWDDLGIDALAERKGRQGVRYTAQEGMAVLDPETLVPVPWDAKTIGEVMFRGNMTMKGYLKNPEATAEAFAGGWFHSGDLAVVCPDGYVQIRDRSKDVIISGGENINSLEVEEVLYRHPAVRVAAVVAQPDERWGETPCAFVEVVDGARVGERELIEHCRAHLAHFKAPKKVVIGHLPRTSTGKIQKFLLRQRASSGAPWPGHIPA

SEQ ID NO: 46084 - protein, 511 aa, Oryza sativa (indica cultivar-group)
MAAIGNMNLFDLFFVLQLLLSGVCVLVICYRYQRLKSMKKCSLGVVQWPIVGVLPAIVANMHRLLDGVTFLLATSQLNFQCRFWLAGFRFFVTCDPDNVRHIFTSNFDNYPKGDAQMLMTTPRFRAFVARSSLDKVEKGLLPFLAHVADARKTCDLQDVFTRWSLDATCHLVFGVDPGCLDIGLPEVPFARAMDDVLRTIFLRHTMPVSFWKTMRWLGIGHEKRNAAARRTVESFVASAIAKHRADDESKSRQGGGGGGDKQSVADLLSSFLCDDEIAGSADADVYIRDMAMNLLVAGRDTTSSALSWFFYLLSTNPRVEQKLLQELAPIASRKPQLQQGRLFPGNGGMVTFDASEVRNLLYLHAALCEAMRLYPPVPLEHKAAVADDVLPSGHEVMAGDKVLVFYYSMGRMKRVWGKDCREFRPERWITEDGKLRYVPSNKFVAFNSGPRTCLGKEMALVQMKVTAAAMAWNFAVEVVPGHVVEPRLSVILHMKNGLLVRVKRREPVMNT

SEQ ID NO: 46085 - protein, 152 aa, Kluyveromyces lactis NRRL Y-1140
MSNTERTFIAIKPDGVQRGLISKILARFEDRGYKLVGIKLVTPTEALLKEHYADLVSKPFFPSLLSYMTSGPVLATVWEGKDVVKQGRAILGATNPLQSAPGTIRGDFAIEVGRNVCHGSDSVESAEKEIGLWFKKEELIDYKLNQLSWIYE

SEQ ID NO: 46086 - protein, 233 aa, Hevea brasiliensis
MLTGTLKWRATYKPEEIRWHEISHEVEKGKVFRANFHDRYGRTVLIMRPEMQNTTSAVDNIRHLAYVIENSILNLAEGQEQMSWLIDFTGLSLSNSMSIGTGVDIIKILQNHYPERLAVAFVYNPPRIFEAFWKAVKCVLNSKTSEKVKFVYPNNKESEEVMRHFFDVDNLPGEFGGKATMKYDHEEFSRLMAQDDVKTAKYWGFDEKPTHIANAQLRPQLAPEPTPFAPPAS

SEQ ID NO: 46087 - protein, 361 aa, Medicago truncatula
MGLIDSDPPFEETYKNLFNKDQNIINDELMVDNECELPVIDLSRLNDDDEVAREECKSMIANASQEWGFLQVVNHGISSDILTRLRCEQKKVFKEPFDKKTKEDKFLNFSAGSYRWGTPTATCIKQLSWSEAFHIPLTDILGSNTHLSFFGINSIRTGVKYGSKRTIVNYRRSHFASSIIEQFATTVSNLAQILANILAEKLGHQSSFFKENCLPNTCYLRLNRYPPCPIDFRIHGLMPHTDSDFLTILYQDQVGGLQLVKDGKWVAVKPNPDALIINIGDLFQAWSNGVYKSVEHRVVTNPRVERFSVAYFLCPSNDTMIESCKEPSIYRKFSFKEYRQQVRDDVQKLGSKIGLPRFIIN

SEQ ID NO: 46088 - protein, 654 aa, Cryptococcus neoformans var. neoformans B-3501A
MEDVKMSGPVGVGVPMGVVEPREKELPREPGSAAMGGRSRSGTGRSSKDKKSMFGFVSDLLGKDKPPVISKPYDPVHVTHVGFDFQTGKYTGMPPKWQQVLDDNGITQDEQERNPNGVMAVVQYLKHQDEGEDEEEEVWAKMKNAQPPAFPPPSAAPSQPTTPGGGVGSREMSREPSNEALGAAGTQVVDFTCPRMAPAPPTKPSLNRMLSERHAPASHRPAELTTPAPLAAAPRVTQAYSSALSHSPHLPPPHPTSSAPPTAPAPHLDRSYSQRAPVSGTKTKVLDRANTTRSPGSSAGIAQGAGTGTGLTKSQSQSGHKSRDPSREPKDSASSSGGLSRNQTTTRQQQGATPRRREKEKKENEEVIRQLRMICTPGDPNLVYKNFRKIGQGASGGVYTAIDRQTLPVAIKQMNLEKQPKQDLIINEILVMRESAHPNIVNFKDSYLWQGDLWVVMEYMEGGSLTDVVTAHCMSEAQIASVSREVCEGLRHLHSKGVIHRDIKSDNILLSLNGDVKLTDFGFCARIADPTTTKRTTMVGTPYWMAPEVVLRKEYGPNVDIWSLGILAIEMLEGEPPYLTENPVRALYLIATNGTPKIKDWDKLSTVFRDYFKVTLQVDPAKRPTAAAILKHEFFKHTAPLISLAPMIRSSRKS

SEQ ID NO: 46089 - protein, 375 aa, Xylella fastidiosa Ann-1
MTPIVFIDRDGTLIEEPPDFQIDAYEKLRLVNGVIPALLKLRDAGYHFVIVTNQDGLGSPTYPQASFDGPNALMLQIFSSQGIVFRDVLIDRSWPADNAPTRKPGIGLMVAYLQDRDIDWARSAMVGDRPTDLQFAENLNIRGFQLRTPQFGGDWDWDGIAHTLADAPRRAVVQRHTKETNIRVEIDLDGVPQARITTGLPFFDHMLEQIAKHAGISLHISAVGDLHIDEHHTIEDTGLALGQAVRQALGDKRGIGRYGFDPPQLPWQVSGAAAHGGFTLPMDETQASAVLDFSGRPYFVFEGTFVRERVGDMPTELVPHFFRSLCDASGMNLHLSVHGDNDHHKVEACFKALARALRQALQRHGHVLPSTKGAL

SEQ ID NO: 46090 - protein, 253 aa, Gibberella zeae PH-1
MPTITEITSITEWEQLLGSVPPTTLVIVSFHAPWAAPCAQMATVLSTLASEYPDTEPPTTKWVSINAEELSDLSETYDVTAVPFLVLLRNGQVVETVSGSSAVKVRTAIETQAKQSGENAAASGPNGVAADDAVVEEEQDPEKKKEELFKRLGDLVKAAPVMLFMKGTPSSPQCGFSRQLVGLLRDNSVKYGFFNILADDEVRQGLKEFADWPTYPQLWIDGELVGGLDIVKEEMSNDAEFLTKYSVSAPAAP

SEQ ID NO: 46091 - protein, 447 aa, Xanthomonas axonopodis pv. citri str. 306
MPPLLRTPATVSVAPTQRDALGASLAASRAFPQVTRDFKAFLDAQAQLSYATRGAAAKVSDPTAFAEMQRYLFNRYNGLTVLRSVQQDGKVFDCIPSAQQPALRDGSTPAAPPSLSSNKGTVAPVNLGQRCDTGSVPFERIGLAEMSKHANLRSFLRGTTPRAIAPRQADAVPAVQEAAPVTHYYSSVFLDTAGTSVTGAGADINLWAPTLRSTNEKQTISQIWIVGESASEQVQTLEVGWEIQPDAGWGNKPIVFIYSTQDGYVTTGCHNLDCSDFVQTSTRHVLGAQPAAGFSIAGGKQTMLGVEFQKNTDGNWWLRLDGEWIGYYKASLYSGDLANGRVAYVSAGGEVSTNSGVASTRMGSGQFAAAGYRQAAFQANHFYRDAAMVTHPVQRLSSLSVEHPSCYTLAMAGYSYPYALDAGVTRTGLSPEMQNGGFYFGGPGCER

SEQ ID NO: 46092 - protein, 515 aa, Oryza sativa (japonica cultivar-group)
MASSGFSWTLPDHPKLPKGKTVALVVLDGWGEANADKYNCIHVAQTPVMDSLKNGAPERWRLVKAHGTAVGLPSEDDMGNSEVGHNALGAGRIFAQGAKLVDLALASGKIYDGEGFNYIKECFDKGTLHLIGLLSDGGVHSRLDQVQLLLKGASERGAKRIRVHILTDGRDVLDGSSVGFVETLESDLSQLRDKGIDARIASGGGRILSLKNAQNDWDVVKRGWDAQVLGEAPYKFQNAVEAVKTLRAETKASDQYLPPFVIVDESGKSVGPVVDGDAVVTFNFRADRMVMLAKALEYADFDKFDRVRVPKIRETVKFGHVTFFWNGNRSGYFDETKEEYVEIPSDIGITFNVKPNMKALEIAEKARDAILSGKFDQVRVNLPNGDMVGHTGDIEATVVACKAADEAVKIILDAIEQVGGIYLVTADHGNAEDMVKRNKSGQPLLDKNGGIQILTSHTLQPVPVAIGGPGLHPGVKFRSDIQTPGLANVAATVMNFHGFEAPADYEPTLIEVVDN

SEQ ID NO: 46093 - protein, 206 aa, Xylella fastidiosa Ann-1
MCNEPATSDVALPDLDWAKGDGLLPVIVQDADTLRVLMLGYMNSQALEVTQRSRLVTFYSRSKQRLWTKGERSGHVLHVVAIDADCDADTLLVQARPRGPTCHLGRTSCFPAAPGQFLGALDALVAERERERPQDSYTTALFEQGVRRIAQKVGEEGVETALAGVVQADDALLDESADLLYHLIVLLRARGLSLADAVTVLEARHR

SEQ ID NO: 46094 - protein, 432 aa, Oryza sativa
MIWWNIMSRSKCDKAINHISTLHKQIRSRSRVAISLIAVTISLIAVIHIGSGLLVPMKASLVVLAAAVAAAAALLVSLDPRSDDVPVLEIRERDVELITVDAGGAVGPESIVFGDAGEGPYTSVSDGRVLKWLPPPERRWVEHSSAVIEPHMLDSCRGSKDTKREQECGRPLGLKFNSKTGELYVADAYLGLRVVSPGENVSRPLVPKRTGSPFSFSNGVEIDHETGVIYFTETSTRFQRREFLNIVITGDNTGRLLKYDPKENKVEVLVDGLRFPNGLAMSIDGSYLLLAETTTGKILRYWIKTPKASTIEEVAQLPGFPDNIKMSPRGGFWVGLHAKRGKIAEWSISYPWLRKLILKLPAQRIQRITSFLTGFGRQVIALRLSEDGKTIEAMSVHGDVRKLFKSISEVEEKDGNLWIGSVLSPFHGLYRI

SEQ ID NO: 46095 - protein, 174 aa, Glycine max
  misc_feature (140)..(140): Xaa can be any naturally occurring amino acid
  misc_feature (154)..(154): Xaa can be any naturally occurring amino acid
MICSLAVTTANRAGAGMVAPFTGLNSMAGLPTTKTNTDITFIACIGGIEQCMQVWPPLGKKKLETLSYLPYLDDAQLAKEVKYLLRKGWIPCLEFNLDHSSVYREHNTSPRYYDRRYCTMSNLTMLGCTDASHVLNELHXAKTAYPNGSVRIIXFDNATQVQCITFIVYNTPAY

SEQ ID NO: 46096 - protein, 428 aa, Methylobacillus flagellatus KT
MSRNQQLFEQSQTLIPGGVNSPVRAFGSVGGTPVFFKRGLGARLWDEDGKEYIDYVGSWGPMILGHAQPDVIAAVQATAANSLSFGAPTALELEMAQLITQLVPSMEQVRLVSSGTEATMSAIRLARGFTSRSKILKFEGCYHGHADSLLVKAGSGALTFGQPSSAGVPPELAAHTLTLPYNDVQALEHLFEELGKEIACVILEPVAGNMNLVRPTPEFLGALRSLCTHSGTLLIFDEVMTGFRVALGGAQQLFGIKPDLTTLGKVIGGGLPVGAFGGRADVMAFLAPLGPVYQAGTLSGNPVAVAAGLATLKQLQRPGFHEELALKTRQLTDGLARAARDAGVTFSAQSVGGMFGLYFSAECPASFAEVMQSDKQAFNRFFHGMLEAGVYLAPSAFEAGFVSIAHSEADISQTIVSAQGVFSRINDQ

SEQ ID NO: 46097 - protein, 298 aa, Aspergillus oryzae
MADIDITETQFKLPDGLSVYQKTWAPSSAAPVARLVHFHGFSDHINNTFDLFPSLARRGIFCTGIDQRGWGQSVKTKADRGNTGPTAAILADFAAFIEVQLEAKPSVPVFVMGHSMGGGLVATLASTPKYQGLVSRLGGIMLEAPFIGLDAEQEPSIITVVLGRLAGKLLPRFQITQPMKVETIVRDPAVQQLLKNDPLNPCVGTLEMFANMLDRAADLTSGKLKLNDGVRSVYVAHGTGDQVTSHDASKRWFDAQTGKVADRKFKSYEGWSHVLHADLPENRQEFADDIAEWILARV

SEQ ID NO: 46098 - protein, 224 aa, Triticum aestivum
PAGSRKKKTPGESVYGEKRISVDEVVKNDDGTTTTTKIEYRMWNPFRSKLCAAIAGGADEIYIKPGSRVLYLGGASGTSVSHVADIVGPTGYVYAVEFSSRSGRDLITMASKRPNVVPIVEDARQPARYRMIVPMVDVIFADVAQPDQARIVAMNANWFLKVNGGVLISIKANCIDSTAPAAEVFAAEVQKMRAESIKPKFQLTLEPFERDHCLVAGEYLRYKS

SEQ ID NO: 46099 - protein, 297 aa, Vibrio vulnificus YJ016
MREKDMLSGSIVALLTPFKADGEVDFDGLQKLVEYHIAAGTNGIVAVGTTGESSTLTVEEHVKVVNKTVEFVNGRIPVIAGTGANATHESVTFSRLLNDSGIDACLSVTPYYNKPTQEGLFQHYKAIAEVSNVPQILYNVPGRTAVDLLPETVARLAELENIVALKDATGDLNRVAIHRELCGEDFILLSGDDATGLDFVKLGGQGVISVTNNIAAKDMADMFRLALEGRFEEAEVINQRLMPLHKNLFIESSPIPVKWAATQLGLIECGHLRLPLTELSEKCHPIVAQAMTDAGIY

SEQ ID NO: 46100 - protein, 748 aa, Salmonella typhimurium LT2
MLTRLREIVEKVASAPRLNEALNILVTDICLAMDTEVCSVYLADHDRRCYYLMATRGLKKPRGRTVALAFDEGIVGLVGRLAEPINLADAQKHPSFKYIPSVKEERFRAFLGVPIIQRRQLLGVLVVQQRELRQYDESEESFLVTLATQMAAILSQSQVTALFGQYRQTRIRALPAAPGVAIATGWQDATMPLMEQVYEASTLDTSLERERLTGALEEAANEFRRYSKRFAAGAQKETAAIFDLYSHLLSDARLRRELFAEVDKGAVAEWAVKKIIEKFAEQFAALTDNYLKERAGDLRTLGQRLLFHLDDSVQGPNAWPERFILVADELSATTLAELPQDRLAGVVVRDGAANSHAAIMVRALGIPTVMGADIQPSVLHRRTLVVDGYRGELLVDPEPVLIQEYQRLISEEIELSRLAEDDVNLPAQLKSGERVKVMLNAGLSPEHEEKLGSRIDGIGLYRTEIPFMLQSGFPSEEEQVAQYQGMLQMFNDKPVTLRTLDVGADKQLPYMPISEENPCLGWRGIRITLDQPEIFLIQVRAMLRANAATGNLSILLPMVTSIDEVDEARRLIERAGREVEEMIGYAIPKPRIGIMLEVPSMVFMLPHLANRIDFISVGTNDLTQYILAVDRNNTRVASIYDSLHPAMLRALSMIAQEAEKHGLDLRLCGEMAGDPMCVAILIGLGYRHLSMNGRSVARVKYLLRHIDFEDAQTLARRSLEAQMATEVRHQVAAFMERRGMGGLIRGGL

SEQ ID NO: 46101 - protein, 315 aa, Yarrowia lipolytica CLIB122
MCILLATQGHPDYPLILLSNRDEYLSRPTAEAFFWDDNVLGPLDLAREEQGTWIGCNKQGKIAVILNYQEKRDKDAIGDISRGKFPKEFLLSNESPEEFTKNFKRRYPEDKLQAAGGFSFLFGQVDLNGKTQFSIISNRGGDHEWVARDPEDQTIGISNSLFCNPWPKCALGIERLDEVVKESVESGSSRKELVDSLFDVLSHDTFDPGAKKGASEQEIHHALRQSVFIPVIAAAGYQEGQDWNVTHPFGKHYGTRTQTIIMVGKDGQLRYFEKTLHTKDTDEKEEHPLVEHVFEINKENKSGGGGSGGWRCLLS

SEQ ID NO: 46102 - protein, 449 aa, Clostridium symbiosum
SKYVDRVIAEVEKKYADEPEFVQTVEEVLSSLGPVVDAHPEYEEVALLERMVIPERVIEFRVPWEDDNGKVHVNTGYRVQFNGAIGPYKGGLRFAPSVNLSIMKFLGFEQAFKDSLTTLPMGGAKGGSDFDPNGKSDREVMRFCQAFMTELYRHIGPDIDVPAGDLGVGAREIGYMYGQYRKIVGGFYNGVLTGKARSFGGSLVRPEATGYGSVYYVEAVMKHENDTLVGKTVALAGFGNVAWGAAKKLAELGAKAVTLSGPDGYIYDPEGITTEEKINYMLEMRASGRNKVQDYADKFGVQFFPGEKPWGQKVDIIMPCATQNDVDLEQAKKIVANNVKYYIEVANMPTTNEALRFLMQQPNMVVAPSKAVNAGGVLVSGFEMSQNSERLSWTAEEVDSKLHQVMTDIHDGSAAAAERYGLGYNLVAGANIVGFQKIADAMMAQGIAW

SEQ ID NO: 46103 - protein, 103 aa, Zea mays
  misc_feature (53)..(53): Xaa can be any naturally occurring amino acid
MYGPGKPGKGMGKGGVKRHRKVLRDNMQGITNPPIRRLASTGGVKRFSGLIYXKARGVLKIFLENVIRDAVTYTEHGPRKTVPAMDVVYALKPQGRTLCGFGG

SEQ ID NO: 46104 - protein, 365 aa, Arabidopsis thaliana
MERLLQPSSSSSSISPSKFPSRTSPFLPRLRSSGLSFVSTHRPESRRVSSISCNSSQIPSLYTPIGSNTTNNSFNGSPKSDESKPNPGFLTRIATSASEQRKTLSTGTVILISAVAVLLLNPLLAPPAFASFQTAAKSGWLTSAWTGFLAGCLHTLSGPDHLAALAPLSIGRSKMESAAVGALWGCGHDAGQVIFGLLFLLLKDRLHIEVLQTWGTRIVGLTLVIIGAMGIKEASEIPEPCVALETDISMVSTEKEALPLPKKKKIGFATFATGVVHGLQPDALMIVLPALALPSRLAGSAFLIMFLVGTVIAMGSYTAFIGSCSEALKEKVPRITEKLTWVSSLVAIGLGLGIVISPFFGFSLY

SEQ ID NO: 46105 - protein, 356 aa, Medicago truncatula
MRKLEFKSTIFIFLFIIYGVISTPPADPIQCSSNNTNCTITNSNGVFPDRSICRASEVMYPTTEAELISIVALASKNNRKVKVATRFSHSIPKLACPDDNGLLISTKNLNRVLKVDVKLLRMTVESGVTLREIISEAARFEMALPNTPYWWGLTIGGLISTGAHGSTLWGKGSAVHEYVTHIRIVSPAGCEDGYAKVRNLNESHQDLNAARVSLGVLGVISQVTLQLEPLFKRSLTYLTKNDSDLGDELITFGKKHEFADVTWYPSQQKVLYRIDDRVSSVNTFGNGLYDSIGLRSTPSSTLTLSRTTEELQEATHDTNGKCINGKLTTETLAGIAYGLSNNNGIFFLTHSIRVIV

SEQ ID NO: 46106 - protein, 295 aa, Medicago truncatula
MECLATLIVSRPVNRLSGQVRLLNRPGQAIGQAQACKFFRRPGLGLSKPGLAWPIPNPRTFIGYPVVGFNNRIQSSGTCLDSLDDQMSTACIWDSRIKGPFNYDTAFSIPLSIVKYFIEDVKKLVQLEPKALCGLDLYNGILMRYVTTSSAYLGKTEDAVEFDIIYYRSKDPLTPRLYEDIIEEIEQIGLFKYGGLPHWGKNRNIGFVGAIKKYNKANRFLKVKKKYDPKRLFSSDWTDQVLGLKEGVTILKDGCALEGLCICSKDSHCSPKKNYFCRPGRIYKDARVCRLHVKT

SEQ ID NO: 46107 - protein, 842 aa, Bradyrhizobium sp. BTAi1
MNEQVNLTNCDREPIHVPGSVQPFGFLLALVSDFTICMASENAPDYLGGDIGGLLQQPIAAVLSPAGVAAIRSRVDYLSGPDAVERIFGIDLLGKGRLFDLAIHFSGAYLVVEAEPSLIESGANSGELVRLMLGRIRKTTSMADLAQEAARQLKLLTGFDRVMVYRFHPDGSGEVIAEVAGPGLEPFLGLHYPASDIPRQARQLYQRNWLRIIADINAAPAPLLSTPVHNAGLLDLSMSVLRAVSPIHIEYLRNMGVAASMSVSILRDGKLWGLFACHHYAPHHLSFEKRTAAELFGQMYSWLLEARERETDIAYETRAHHIQERLIERAAAQAHSKRAILDFVADYRQMIECDGIAVWSDDEITLDGETPTEAEVQDLIGFINRTSPGRICASAEIAKIYAAGEAFRARAAGFLAIPISRTPRDCLIFFRREMLRSVNWAGDPHKTYSEGPLGARLTPRKSFELWQQTVAGQAKPWTAADLRIAESLRVTLLEVILQLSELAARERRGAQERQELMIAELNHRVRNILSLVRGLVAQSKDTANSVEEFAAILGGRIQALARAHDQITNLNWAPVALRHLLESEAGAYLGARAGRVRMEGPDVALDPKAFATLALVVHEMMTNSAKYGALADSTGQVQVIWRLDPGASLVIDWKESGGPPVQPPSRRGFGTTIIERSVPFDLKGDAEIRFDLLGVQARFVIPANFVQIVPAITGAPAHHHAKQEAARLSGTVLIVEDNLIIAMGAEVILLELGARHVETAASVNHALKAIERALPSFALLDINLGAESSLPVGYRLKELGVPFMFVTGYGERAPLPAELSDAPIVQKPYTRELIEKALSKFK

SEQ ID NO: 46108 - protein, 638 aa, Medicago truncatula
MFHYPIVFKFIQFFLVLYTLDFLSYLALADPPYEICSTRNIYANGSSFDNNLSNLLLSLPFNDSNSISKFGNTSSGIGLDRVYGLYMCLDFVSNETCLKCVTNAIADTVKLCPQSKEAVVYEEFCQVRYSNKNFIGSLNVNGNIGKDNVQNISEPVKFETSVNKLLNGLTKIASFNVSANMYATGEVPFEDKTIYALVQCTRDLAANDCSRCLLSAIGDIPGCCYASIGARVMSRSCYLRYEFYPFYLGEKEQTKSSTNLGGKNNSSKIWMITVIAVGVGLVIIIFICYLCFLRNRQSNKGNGKISKDFPFIDLASLRVATRNFTDSNKLGEGGFGPVYKGILSDGQEVAIKRLSICSEQGSEEFINEVMLILKLQHKNLVKLLGFCVDGEEKLLVYEYLPNGSLDVVLFEQHAQLDWTKRLDIINGIARGILYLHEDSRLQIIHRDLKASNVLLDNDMNPKISDFGMARIFAGSEGEANTTTIVGTYGYMAPEYAMEGLYSIKSDVFGFGVLLLEIITGIRNAGFCYSKTTPSLLAYAWHLWNDGKGLELRDPLLLCPGDQFLRYMNIGLLCVQEDAFDRPTMSSVVLMLMNESVMLGQPGKPPFSVGRLNFIDQNELDLEEEYSVNFLTVSDILPL

SEQ ID NO: 46109 - protein, 867 aa, Coccidioides immitis RS
MSLPFLISVDADSISSPSPSGLTLKQVSYFGCVLLKSPSLEQALSFINANFTTFEICVDATAIESVGDVVDILNAGASNVFVTLGQLTSLLKEQSVPSSRLVVSISSADEVAQLKTWILEDKERREICVHSAGSSPIDAILSELDDNSLVRTVYRSSIGETTQTNFLLNEQERVISIIPSTSLTVDDEGNSAVKLLVTGAIPDNNTGLYATIVTDERGVALGLVWSSEKSISEALKTGTGVYQSRKRGLWYKGQSSGDIQELVRVGLDCDSDCLIFVVKQKGRGFCHLGTASCFGSYTGLSRLQKTLQARRQDAPPGSYTSRLFNDAKLLDAKIMEEAEELCKASTKEETAFEAADLIYFALTKCISAGVSLEDVERNLDLKSMKVKRRKGDAKPDWAAKVGLAAPTGVQKTAGSVETDKPVDQRIRMKRYNTASASQKDIKDALQRPSQKSNEAIVGLVKPIIQDVRENGDAAVLKYTHKFEKATSLTSPVLRAPFSEDLMKLTPETKEAIDISFENIRRFHAAQKEDKPLQVETMPGVVCSRFVRPIERVGLYVPGGTAVLPSTALMLGVPAMVAGCKKIVLASPPRSDGSISPEIVYIAQKVGAESIVLAGGAQAVAAMAYGTESVTKVDKILGPGNQFVTAAKMLVSNDTSAGVSIDMPAGPSEVLAIADKHANPAFVASDLLSQAEHGVDSQVILIAVDLNDAELAAIEDELHRQASELPRVDIVRGSIEHSVTFVVRDIEEALALSNEYAPEHLILQIRDAANVVSMVENAGSVFIGEWTPESVGDYSAGVNHSLPTYGYAKQYSGVNLASFVKHITSSNLTAEGLRNVSQAVMQLASVEGLDAHRRAVSIRVDWMKQNKG

SEQ ID NO: 46110 - protein, 644 aa, Medicago truncatula
MSSTMIMLIIILMLHVVSCTDHLIIDTYCPDNFPFYTSNTSFHKNLKLLMETLSSNIAASNTSYFNNTSIGQGLDKVYGQALCRGDITNSTVCKECIEKASKDLMNRCKSEDAMVWYELCQVRYSFQMFFSDAVYTGKYPKQNDLEKRVSDPTSFQQVLTYLMNNLSNEAAFNPAKNMFATAEIEFSAKKERIYGLVECTKDVSETDCGSCLSSAVTELNACCSYREGGIIVSRNCNVRFDLFQFFNASSAASLLIFPTSKVLIGLCTACRRQKNDRDKDEERSERMLFQELSSPKNVAITQEGELISSDQLLFMTLATIKAGTDDFSNTNKLGQGGFGAVYKGVLPDGNEIAVKRLSKKSWQGIEEFKNEIILIAKLQHKNLVKLLGCVLEGEEKILVYEFMSNRSLDQFIFDPNKRPKLDWKTCYGIIGGIARGLLYLHEESRLKIIHRDLKPNNVLLDHELVAKISDFGMARMFSENQNTANTKRVVGTHGYMAPEYAMEGLFSVKSDVFSFGVIMLEIISGKRNGGFYLTELAPTLLAYAWKLWNEGKGLEFADPILLESCLDYESEVLRCIHIGLLCVQEDPQHRPTMSNVVVLLGSESMVLPQPRQPAFSSGKMIRVDPSASTNCSLNDSIWSNISPR

SEQ ID NO: 46111 - protein, 301 aa, Capsicum chinense
MEIPVIDFSKLEGDERSATMGLLRQACEKWGFFMIENHGIDIYLMDNVKQLVNQHYEANMKKRFYESEVSISLQKKENISNTDWESTFFVWHRPSSNIYEIQGLSKELCKAVDAYIDQLIELAENLSELMCENLGLEKSYIKEAFSRSKGPSVGTKVAIYPQCPRPDLVRGLREHTDAGGIILLLQDEQVPGLEFFKDGHWVDIPPSKNNRLFVNIGDQIEILSNGMYKSIQHRVMAEKDGNRLSIAPFYNPNGEAIISPAPKLLYPSHLRFHDYLNLYSKTKFAEKGPRFEYAKTLANGH

SEQ ID NO: 46112 - protein, 277 aa, Oryza sativa (japonica cultivar-group)
MAAASRARRWSLAGKTALVTGGTKGIGRAIVEELAGFGVRVHTCSRHDADLQDCLRRWNAAGEGGGAAALVTGSVCDVSVRGDREALVAAARAALGGRLDMLVNNAGQVVVGPAAETAPEEYARLMATNLESCFHLAQLAHHLLRDAAAGGGAAASVVNISSTAAFYAAPHLAVYSATKGGMNQLTRCLAAEWARDGVRVNAVAPGATRTDICDTSGVALGEKTRRRLADAGAMDRVPIRRIGEPEEVAAAVVFLCMPAASYITGQVICVDGGRTLL

SEQ ID NO: 46113 - protein, 657 aa, Medicago truncatula
MITTSSKQIWSYVVSILYLTLLATEASPTYLGSYCNDNTTYTPNSTLSTNLNVLLNSLSTNSSQQQDGYYMTIMGFGTTNAVNGIFLCRGDVNTTTCQNCVTDAATQIKRRCTNQTEAIIWYEECLLRYTNKFFRYYSIEPRLNPKNGKNVSGVDFERFNETVFGLLNELVVTAANSRTAKKFGTGEVEVTRSMKVYGSGQCSTDLTSSQCEICLRNAIGTLPKCCSGREGASALLASCIVRYQLYPFYNLYGSSSSSSGRNGVGTKAIVIIISLAIVPVLLFFIGCYYKRRRSRQRRRTMLRENFGDELKTLDSLQFKFSTIEAATNKFSSENEIGKGGFGIVYKGVLSDGQQIAVKKLSRSSGQGSIEFQNEILLIAKLQHRNLVTLLGFCLEEREKMLIYEYVPNKSLDYFLFDSKKHRVLHWFERYKIIGGIARGILYLHEYSRLKVIHRDLKPSNVLLDDKMNPKISDFGLARIVAIDQEQGSSTNRIVGTYGYMSPEYAMHGQFSEKSDVFSFGVIILEIVSGKRNSRPIQSHDFEDILRTAWRLWRNQTPLEMLDPILKDMFSHSEVIKCIQLGLLCVQENPDDRPTMAQAVSYLSSLLVELPLPLEPAFSMDRDMKLNIPTTESSSGQFISNSTASSINDLTKSQFFPR

SEQ ID NO: 46114 - protein, 478 aa, Xylella fastidiosa Ann-1
MFKQLWATKLSQPSQDSAEGLSLQRVLGVWGLTALGIGAVIGGGIFVITGQAAANHAGPAIMLSFALAAICCTFCALAYAEFAAMVPVSGSAYTYTYATFGELAAWFIGWMLVLEYGVSAAAVAVSWSGYFLSLLQHLGIHLPAALVNAPLDGTLHATGAIANLPAATIVLLLTWLCYFGIRKSSKINIAMVALKSGLILLIIGVGWKYVNPDYWQPFIPTNQGPGKYGWNGVLHGASMVFFAYIGFEAVSVAAQESHRPQRDLPISMMSALAICTVLYIMMAAVMTGLVPYTQLGTDEPVVTAVAAHPQLGWLRVVVEIGALVGLSSVVLVMLIGQPRIFMIMAGDGLLPPIFSTIHSKHRTPHINTVITGLGIALLAALLAAVFPLDVLGELTSMGTLIAFTAVCAGVLILRCTRPDLPRPFRMPAAWLFCSAGVLSCITLLSAMTRHNWMLMSVWTVLGFSLYFSYGYHHSKLHQ

SEQ ID NO: 46115 - protein, 496 aa, Xylella fastidiosa Ann-1
MTHATIYQGEERRMLKKHLFIVKPIEPTNHTGTGKGGTQLKRSLTAGQLVMLGIGAVIGAGIFVLSGHAAAEYAGPAVVLSYILAGIACALAGLCYAEFAAMLPVSGSAYSYAYATLGEFTAWFIGWNLILEYMFSASTVAVGWSGYLNSFLSSFGYGLPASLSSAPLDVVDGRLIYSGGLINLPAVAIVAAISGLCYVGITQSAFVNSITVAIKVSVIVLFIAFAARYVNPDNWVPFVPDNVAPGKYGIEGVIRGAAVVFFSYIGFDAVSTTAGEAKNPQRDMPIGILGSLAICTVIYIAFSGVLTGLMHYSQLDTPKPVATALETYPTLSWLKHVVEIGAIAGLSSTMLMMLMAQPRIFYAMSQDGLLPKLLSKVHPKFQTPHVGTLIVGACACALAGLFPISLLGDLVSMGTLLAFATVCIGIVVLRRTRPDLPRPFRVPMYWVIAPTGAAACLYLFWQPFTEHWPLMVGWTVLGLVMYGLYGYHHSKLRHGG

SEQ ID NO: 46116 - protein, 234 aa, Glycine max
MPTVSVGRDRLFAALGKTYTQEEFEDLCFSFGIELDDVTTEKAIVRKEKHLEEEEADEDEEVIYKIEVPANRYDLLCLEGLAQALRVFCEFQEIPTYKLSKISKDAMLKMHVKPETSLIRPYVVCAVLRGITFDKARYNSFIDLQDKLHQNICRRRTLVAIGTHDLDTLEGPFTYEALPPSSITFTPLKQERNFRADDLMEFYKSDLKLKKFLHIIEDSPVFPVICRNSKKEIQ

SEQ ID NO: 46117 - protein, 187 aa, Triticum aestivum
AYLGDSIEQVCTKKQAGTGPEFPGYRRPPRPPFPLCDPPNPKHRSRPHSFLLQRQELDNHRRFSRARPMASLSVATLPQLAGAPAAAAAKKRSGVTYVEGMNAYSGLKGLNKVTMLGVRKSADYKFARIVASLSPAGKRRGGSFGAQCNAAGEIFQIAVVMNALTLVGVAVGFVLLRAEAAFEESEE

SEQ ID NO: 46118 - protein, 459 aa, Gibberella zeae PH-1
MSTLEELDDLDRRDKEDKKRDGDDKNQKKPTDGDADMKDAEEEDDDILDEEILGLSTQDIQTRKRLLENDSRIMKSELSRLSHEKAAMGEKIKENLDKIANNRQLPYLVGNVVELLDLDPTAESSEEGANIDLDATRVGKSAVIKTSTRQTIFLPLIGLVDADTLKPGDLIGVNKDSYLILDTLPAEYDSRVKAMEVDEKPTEQYTDVGGLDKQIEELVEAIVWPMKEAERFKKIGIKAPKGALMYGPPGTGKTLLARACAAQTDATFLKLAGPQLVQMFIGDGAKLVRDCFALAKEKAPAIIFIDELDAVGTKRFDSEKSGDREVQRTMLELLNQLDGFASDDRIKVLAATNRVDVLDPALLRSGRLDRKIEFPLPNEEARAQILKIHSRKMRVDPGVNWGELARSTDEFGGAMLKAVCVEAGMIALRSGKNKIGHEHYVDAIAEVQAKKKDTVNFYA

SEQ ID NO: 46119 - protein, 461 aa, Burkholderia pseudomallei K96243
MTSRDERLHRGLEERHINLMALGATIGVGLFLGSATAIRAAGPAILLTYILGGVAIFLIMRALGEMAIDNPVAGAFSRYARDYIGPLAGYLTGWTYWFMWIVTCMAEITAVGVYMHMWFPDVPNWIWTFAALIVMGAVNFIAVKLYGEFEFWFALIKIVTIVLMIAGGALMIVAGVGNGGVPTGVSNLWAHGGFLPNGWPGVVDALPIVMFAYLGVEMLGLTAGEARNPEKSLAKAVNSVFWRVVIFYVGALFVIMSVYPWNQIGTQGSPFVMTFSRLGIPAAAGIINFVVLTAALSSCNSGIFSTARMLFNLAEQGQAPERLASVNRRGVPVHGVLISVALLFVGVVLNYFAPQKVFVWLTSVSTFGAIWTWCVILIAQLRFRRRVSAERLARLPLRVPCYPLSSFVALAFLAFVVVLMAFSPDTRVALVIGPLWIAALTVYYYASQAGRRSPLGAPTDG

SEQ ID NO: 46120 - protein, 150 aa, Glycine max
REDDRRAWILDEYSEFHGHSPAVVTGKPVELGGSLGRDAATGRGVLFATEALLKEHGMSVSGQRFIIQGFGNVGSWAAQLISEKGGKVVAVSDITGAIKNTNGLDIPSLLKHSREHRGVKGFHGGDAIDPNSILVEDCDVLVPAALWGVI

SEQ ID NO: 46121 - protein, 637 aa, Arabidopsis thaliana
MVLPLFRRAAIARTSSLLRARLFAPASEFHSRFSNGLYHLDDKISSSNGVRSASIDLITRMDDSSPKPILRFGVQNFSSTGPISQTVLAMPALSPTMSHGNVVKWMKKEGDKVEVGDVLCEIETDKATVEFESQEEGFLAKILVTEGSKDIPVNEPIAIMVEEEDDIKNVPATIEGGRDGKEETSAHQVMKPDESTQQKSSIQPDASDLPPHVVLEMPALSPTMNQGNIAKWWKKEGDKIEVGDVIGEIETDKATLEFESLEEGYLAKILIPEGSKDVAVGKPIALIVEDAESIEAIKSSSAGSSEVDTVKEVPDSVVDKPTERKAGFTKISPAAKLLILEHGLEASSIEASGPYGTLLKSDVVAAIASGKASKSSASTKKKQPSKETPSKSSSTSKPSVTQSDNNYEDFPNSQIRKIIAKRLLESKQKIPHLYLQSDVVLDPLLAFRKELQENHGVKVSVNDIVIKAVAVALRNVRQANAFWDAEKGDIVMCDSVDISIAVATEKGLMTPIIKNADQKSISAISLEVKELAQKARSGKLAPHEFQGGTFSISNLGMYPVDNFCAIINPPQAGILAVGRGNKVVEPVIGLDGIEKPSVVTKMNVTLSADHRIFDGQVGASFMSELRSNFEDVRRLLL

SEQ ID NO: 46122 - protein, 1078 aa, Bradyrhizobium japonicum USDA 110
MSSKNRLDPIPQPPTKPVVGNMLSLDSAAPVQHLTRLAKELGPIFWLDMMGSPIVVVSGHDLVDELSDEKRFDKTVRGALRRVRAVGGDGLFTADTREPNWSKAHNILLQPFGNRAMQSYHPSMVDIAEQLVQKWERLNADDEIDVVHDMTALTLDTIGLCGFDYRFNSFYRRDYHPFVESLVRSLETIMMTRGLPFEQIWMQKRRKTLAEDVAFMNKMVDEIIAERRKSAEGIDDKKDMLAAMMTGVDRSTGEQLDDVNIRYQINTFLIAGHETTSGLLSYTLYALLKHPDILKKAYDEVDRVFGPDVNAKPTYQQVTQLTYITQILKEALRLWPPAPAYGISPLADETIGGGKYKLRKGTFITILVTALHRDPSVWGPNPDAFDPENFSREAEAKRPINAWKPFGNGQRACIGRGFAMHEAALALGMILQRFKLIDHQRYQMHLKETLTMKPEGFKIKVRPRADRERGAYGGPVAAVSSAPRAPRQPTARPGHNTPMLVLYGSNLGTAEELATRMADLAEINGFAVHLGALDEYVGKLPQEGGVLIICASYNGAPPDNATQFVKWLGSDLPKDAFANVRYAVFGCGNSDWAATYQSVPRFIDEQLSGHGARAVYPRGEGDARSDLDGQFQKWFPAAAQVATKEFGIDWNFTRTAEDDPLYAIEPVAVTAVNTIVAQGGAVAMKVLVNDELQNKSGSNPSERSTRHIEVQLPSNITYRVGDHLSVVPRNDPTLVDSVARRFGFLPADQIRLQVAEGRRAQLPVGEAVSVGRLLSEFVELQQVATRKQIQIMAEHTRCPVTKPKLLAFVGEEAEPAERYRTEILAMRKSVYDLLLEYPACELPFHVYLEMLSLLAPRYYSISSSPSVDPARCSITVGVVEGPAASGRGVYKGICSNYLANRRASDAIYATVRETKAGFRLPDDSSVPIIMIGPGTGLAPFRGFLQERAARKAKGASLGPAMLFFGCRHPDQDFLYADELKALAASGVTELFTAFSRADGPKTYVQHVLAAQKDKVWPLIEQGAIIYVCGDGGQMEPDVKAALVAIRHEKSGSDTATAARWIEEMGATNRYVLDVWAGG

SEQ ID NO: 46123 - protein, 420 aa, Salmonella typhimurium LT2
MSLPHYHAETDLNAENLLRLPAEFGCPVWVYDAHIIRRQIAALQQFDVVRFAQKACSNIHILRLMRALGVKVDSVSLGEIERALAAGYDPQTCPDDIVFTADVIDAATLARVSELHIPVNAGSVDMLTQLGQVSPGHRVWLRVNPGFGHGHSQKTNTGGENSKHGIWHSDLPAALAVMQKYRLKLVGIHMHIGSGVDYGHLEQVCGAMVRQVLECGQDVEAISAGGGLSIPYREGEEPVDTRHYYGLWNAAREQIARHLGHAVKLEIEPGRFLVAQSGVLVTQVRSVKQMGSRHFVLVDAGFNDLMRPAMYGSYHRISALAADGRALENGPWVETVVAGPLCESGDVFTQQEGGMVETRALPAVIPGDYLVLHDTGAYGASMSSNYNSRPLLPEVLFDNGQARLIRRRQTIEELLALEML

SEQ ID NO: 46124 - protein, 486 aa, Zea mays
  misc_feature (235)..(235): Xaa can be any naturally occurring amino acid
MAKIRAAGLLKTQGLIAGQWVDAYDGKTIEVQNPATGEVLANVSFMGSRETSDAIASAHSTFYSWSKLSASERGKALRKWYDLIISHKEELALLMTLEQGKPMKEALGEVNYGASFIEYFAEEAKRIYGDIIPPTLSDRRLLVLKQPVGVVGAITPWNFPLAMITRKVGPALACGCTVVVKPSELTPLTSLAAADLALQAGIPAGALNVVMGNAPEIGDALLQSTQVRKITFTGXSTAVGKKLMAESANTVKKVSLELGGNAPCIVFDDADIDVAVKGSLAAKFRNSGQTCVCANRILVQEGIYEKFASAFIKAVQSLKVGNGLEESTSQGPLINEAAVQKVEKFINDATSKGANVMLGGKRHSLGMSFYEPTVVGNVSNDMLLFREEVFGPVAPLIPFKTEEEAVHMANDTNAGLAAYIFTKSIPRSWRVSESLEYGLVGVNEGIISTEVAPFGGVKQSGLGREGSKYGVDEYLELKYICMGNLG

SEQ ID NO: 46125 - protein, 472 aa, Salmonella typhimurium LT2
MVSINHDSALTPRSLRDTRRMNMFVSVSAAVAGLLFGLDIGVIAGALPFITDHFVLTSRLQEWVVSSMMLGAAIGALFNGWLSFRLGRKYSLMAGAILFVLGSLGSAFASSVEVLIGARVILGVAVGIASYTAPLYLSEMASENVRGKMISMYQLMVTLGIVLAFLSDTAFSYSGNWRAMLGVLALPAVLLIILVVFLPNSPRWLAQKGRHIEAEEVLRMLRDTSEKARDELNEIRESLKLKQGGWALFKANRNVRRAVFLGMLLQAMQQFTGMNIIMYYAPRIFKMAGFTTTEQQMIATLVVGLTFMFATFIAVFTVDKAGRKPALKIGFSVMALGTLVLGYCLMQFDNGTASSGLSWLSVGMTMMCIAGYAMSAAPVVWILCSEIQPLKCRDFGITCSTTTNWVSNMIIGATFLTLLDSIGAAGTFWLYTALNIAFIGITFWLIPETKNVTLEHIERKLMAGEKLRNIGV

SEQ ID NO: 46126 - protein, 1542 aa, Candida glabrata CBS 138
MNTPDDSSVSSVDSHQPYMGFDDNVEKRIRELARSLTQQSLTSSNRSVNKEAPADGSAPLDRVSTRASSIFSADFKGVNPVFSDEEEDDYDARLDPNSDEFSSKAWVQNMAKITTGDPEFYKPYSIGCCWKDLSASGESADVSYQSTFLNLPVKLLNAVWRKARPARESDTFRILKPMDGLLKPGELLVVLGRPGSGCTTLLKSISSTTHGFQISKDSVISYNGLTPNEIKKHYRGEVVYNAEADIHLPHLTVYQTLVTVARLKTPQNRVKGVTREDFANHVTDVAMATYGLSHTRDTKVGNDLVRGVSGGERKRVSIAEVWICGSKFQCWDNATRGLDSATALEFVRALKTQAHIAKNVATVAIYQCSQDAYNLFNKVSVLYEGYQIYFGDAQHAKVYFQKMGYFCPKRQTIPDFLTSITSPAERRINKEYLDKGIKVPQTPLDMVEYWHNSEEYKQLREEIDETLAHQSEDDKEEIKEAHIAKQSKRARPSSPYVVSYMMQVKYILIRNFWRIKNSASVTLFQVFGNSAMAFILGSMFYKIQKGSSADTFYFRGAAMFFAILFNAFSSLLEIFSLYEARPITEKHRTYSLYHPSADAFASVISEIPPKIVTAILFNIIFYFLVNFRRDAGRFFFYFLINVIAVFAMSHLFRCVGSLTKTLQEAMVPASMLLLALSMYTGFAIPRTKMLGWSKWIWYINPLAYLFESLMVNEFHDRRFPCNTYIPRGGAYNDVTGTERVCASVGARPGNDYVLGDDFLKESYDYENKHKWRGFGVGMAYVIFFFFVYLILCEFNEGAKQKGEMLVFPHSVVKRMKKEGKIRDKTKMHTDKNDIENNSESITSNATNEKNMLQDTYDENADSESITSGSRGGSPQVGLSKSEAIFHWQNLCYDVPIKTEVRRILNNVDGWVKPGTLTALMGASGAGKTTLLDCLAERTTMGVITGDVMVNGRPRDTSFSRSIGYCQQQDLHLKTATVRESLRFSAYLRQPSSVSIEEKNEYVEAVIKILEMETYADAVVGVPGEGLNVEQRKRLTIGVELAAKPKLLVFLDEPTSGLDSQTAWATCQLMKKLANHGQAILCTIHQPSAMLMQEFDRLLFLQKGGQTVYFGDLGKGCKTMIKYFEDHGAHKCPPDANPAEWMLEVVGAAPGSHANQDYHEVWRNSEQFKQVKQELEQMEKELSQKELDNDEDANKEFATSLWYQFQLVCVRLFQQYWRTPDYLWSKYILTIFNQLFIGFTFFKADHTLQGLQNQMLSIFMYTVIFNPLLQQYLPTFVQQRDLYEARERPSRTFSWKAFILAQIVVEVPWNIVAGTLAYCIYYYSVGFYANASQAHQLHERGALFWLFSIAFYVYVGSLGLFVISFNEVAETAAHIGSLMFTMALSFCGVMATPDAMPRFWIFMYRVSPLTYLIDALLSTGVANVDIRCSNTELVTFTPPQGLTCGQYMTPYLNVAGTGYLTDPSATDECHFCQFSYTNDFLATVSSKYYRRWRNYGIFICFIVFDYVAGIFLYWLARVPKTNGKIAKNGKTAKVNFIRRLIPF

SEQ ID NO: 46127 - protein, 650 aa, Medicago truncatula
MATLAKLLSSICVCVIVMLTTKAVEATPTYTATHCTNTTTYAPNSTFQTNLDILLYYFSNNISQSNGYFLGITGFNSVNAVGGLFLCRGDVATTVCNQCLTTAIKEIRQHCPNQTEALIWYDECLVHYTNRYFAVDKIDPRVNLNDGNIVSSVDLGRFNQSLHGLLNDLATEASGSSESKKFAAGEVVVTESMTVYGLMQCTNDLTNSECGTCLKNAIGTIPNGKQGARALLPSCNVRYQLYPFFTSSSPSSSGGMKLGPGTIAVVVVVPIFFLIILFLGCYYFKRRSKKKILLPSIMENFGDEFPTLESLQFNLATLEAATNQFSLANKIGSGGFGEVYKGVLLDSRQIAVKKLSKTSGQGTIEFKNEIVLIAKLQHRNLVTLYGFCSEEQEKMLVYEYVLNKSLDYFLFDPHKERVLSWRERYNIIGGIARGIHYLHDQSRLKVIHRDLKPSNILLDKNMNPKISDFGMAKMIDIDEHQGNTKRIAGTYGYMSSEYAMHGHYSEKSDVFSFGVIIIEIISAKRNALSLHSLDFDDLLSYAWKNWRDEKSLEILDSNIEKSYSYIEVIRCIQIGLLCVQQNPDDRPTMERIVSYLSNVSVELPLPQEPGGFMGNRTNQIPRDNISDQRNNSNTTGSSVNDITMNNSFPR

SEQ ID NO: 46128 - protein, 534 aa, Bradyrhizobium sp. BTAi1
MSIVRIFGKDTVPCSAETVGAKAANLARMAALGLPVPPAFVLPVDLCADIIANQADAEQRLRDGLRSGIRFLEQATGRVFGDHRQPLLVSVRSGAARSMPGMLDTVLNVGCTSAAARGLIRSTGRPRLAFDCRRRLIESFSETVLGLEATRLTALCRDLVTQEGVATDRELDSEAIARLAADEQALVETGSDGWLEDAEGQLHAAARAVYQSWASERAQTYRKLQNLEHLPGTAVTVQAMVFGNGGLASGAGVAFSRDPSTGAKLPMIDLVLDAQGEDVVSGRRTPDSEETIARALPNLRTELVAVLRRLETEFGDVQDVEFTVEDGRLWILQTRAAKRTPRAALKIAVDLVHERVISPQQALQRLEEIDLEQLVETSLVAAGEPAATGIAASGGIAAGRAAFDSESAKRLADSGEPVILMRPDTSTADIAGFAAAAGVVTTVGARTAHAALVARQLGRPCIVGCPALTVSGGAERALLGTTAIARGDWVTIDGDQGRVYCGRLEIVTARPDAELAEVAAWRRGDLQPVRRLSA

SEQ ID NO: 46129 - protein, 93 aa, Zea mays
MPGSHGRPLAIDGLGRPPPVDPFQGLKCTASLPDSARSFISLGNVSNGGRILCMQVWPDYGTKKFQTLSYLPQLTTEDLLKQMDSLLCNRWIP

SEQ ID NO: 46130 - protein, 1357 aa, Pseudomonas putida KT2440
MPGQPAPFCVFHRSPPMANSEVRSVCPYCGVGCGIVMSVADGKVGKISGDKLHPSNFGRLCTKGLTAHQPLSASGRMADAYLRQQRSQPPVRTSMDQAIAATAERLRGIIDQHGPDAVALYVSGQMSLEAQYLANKLAKGFIRTRHIESNSRLCMASASSGYKLSLGADGPPGSYQDFEHADVFLVIGANMADCHPILFLRLLDRVKAGAKLIVVDPRRSATADKADLFLQVRPGSDMALLNGLLHLLHRNGHTNPDFIARHTEGWDEMPAFLDDYTPERVAAITGLAEADIIKAAEWIGSANNWMSCWTMGLNQSIHGTWHSNAICNLHLATGAICRPGSGPFSLTGQPNAMGGRDMGYMGPGLPGQRSALVEDDRAFVERQWQLPPGSLRSEGGEGTVALFGQMKAGEVKACWVICSNPVASVANRQQVIDGLRKAELVITQDAFLDTETNRYADILLPAALWAEGEGVMINSERNLTLMPRAVEPPGQSLPDWQIIARVACAMGYADAFDYPNAEAVYEEIRRFHNPSTGYDLRGIGYAELRTQPRQWPCAPGSEQHRSPLRYLNDGSSQALLLDARGRRPALAFPTASGKAHFFARPWLPAAEVPDDDYPMVLNTGRVQHQWHTLTKTGKVPALNKLEPGPYLEIHPEDAARLGVAEKDQVAVRSRRGQAVLPARISDRVMPGNCFAPFHWNDLIGEQLAINAATCDAVDPLSLQPAFKHCAVALERVAGERIDALDLNTATVEPVRMPTATLSRLLGLHTLPVPVLAEEERHYLQGFLLGLDQARAEGVPRLPASAPLAASRRLFVDGLLAGLFAQPATAPIAAQAAPWHQVLWASQTGNGEQLAERCAARLRGAGLNVQLSCLEAVSPSQLQGAASVVLIASTFGDGDAPDSGAAFWQALQGEEGAHCAGLPYAVLALGDSSYDQFCGFGRKLDQRLAELGGHRLLARVDCEPDFDEAFAGWLEALLPALGTAAAPSPASEPAPVSAFSKQQPWMATVLENRLLNGPGASKETRQLVFDLGGSGFSYAAGDALGVWPRNCPALVEELLTLMQLDGQAMVELKGHSTMPLAEALRAHLEIAKVTAQQLQAFASNAPDLQRLLQPECKAELQDWLWGRQLVDVLRAFPQQLPLASWLELLKPLQPRLYSISSSPLAHPGQVHLTVSTVRYGERKGVCSSFLADRAQVQKVAIFPQVSKHFRLPEDDSVPVIMVGPGTGIAPFRAFLEEREARGAKGDNWLFFGEQYAATDFYYQEQLQAWQAAGHLRLDTAFSRDQVEKIYVQQRMLEQGALLWQWLEAGAYFYVCGDAQRMARDVDAALRVIVAEHGRMDAAAAAAYVEGLSKARRYRRDVY

SEQ ID NO: 46131 - protein, 154 aa, Heliobacillus mobilis
MAINLLDRYNPEELNAKLGTTVEVVGEGVSRALVVTKENLIPVMEKLCKSPEWAFDMLSDISSVDRKEAGLEVVYQLFSIKHKYDLRVKSIIPRDEAQVPTVTSIWPGANFMEREVYDLMGVAFPGHPNMTRLLLPEEFEGHPLRKDFKLQPRA

SEQ ID NO: 46132 - protein, 402 aa, Arabidopsis thaliana
MLTERGRRISGFNGSFEFSNRKFRGYGFVDRSQGFHERSPSRSCSVSKILRITPPTSSPPSSASTCAGYIEHRVSKFDTLAGIAIKYGVEKVLFQVADITKLNGLVTDLQMFALESLRIPLPGRHPPSPCLSNGSLNHGEDWSEQASSSASNGNHQDVFDSFQSLRLNHSEKKISPAMNSLQGYYGLKPKNRRASEGFGMAVYKNEASQLQDNDQYLTPFPATSTPLSHHRKSRSLVDAVIAEVNQSPNPSKAGGGEVNSTDKPMRRRQKSEADFSSRAPELLLKEENRSSSGAFSAIAGKNLALRSKASSRANLSAETRHLNSIPINLMDAPVGDSFSSVRKSVSASSLQEPNCNSNGSSLWPTSKWTLKPELLTQVAMASSIFDGLPKPLTGRRNKKAVD

SEQ ID NO: 46133 - protein, 364 aa, Heliobacillus mobilis
MQTQKYELNMGPQHPSTHGVLRILLELDGEIVVKATPIIGYLHRGIEKICENKTYVQTIPFTDRMDYLAAMGNNLGISQAIEKLMGVTVPERAEYIRVIMAELSRIASHMICIGSLVMDIGGVTGFTFCIRDREEILELFNRACGARMTFNYIRVGGVSQDLPEGWVDACWKFVNNFDKVMETYNNLIVGNEIVQLRLKDIAILSAERAIAMSATGAVLRASGVDYDVRKADPYGIYDRFDFDVPLGQKGDNWDRFMLRFYEMEQSVRIIKQALEQMPEGPVMARSRKVIKPPAGEVYHRVENAKGEIGFYVVSDGTTKPYRWHARRAAMVNLQLLDELCHGNKLGDVVAILGTLDPVLGEVDC

SEQ ID NO: 46134 - protein, 147 aa, Heliobacillus mobilis
MQGIGLLKGMFVTIQEFFRKPVTEEYPDVMPDLGDRFRGGTIKLKTSKCISCGICMNSCPNGSIKLTSVRDENNKRHLSTYVHDSGLCLYCNLCIESCPVKCIDWTNEFAFSGYSREDLIFDCIDLAKKRGYDVPEVKATPEAGEKG

SEQ ID NO: 46135 - protein, 506 aa, Triticum aestivum
MAAPPAIPRRGLFIGGGWREPTLGRRIPVINPATEDTIGDIPAATAEDVELAVAAARSAFLLDGGSRWARASGATRAKYLNAIATKIKEKISYLALLETVDSGKPKDEAVADMDDVAACFEFYAGLAEALDGKQHAPISLPMEEFKTYVLKEPIGVVGLITPWNYPLLMATWKVAPALAAGCTAVLKPSELASLTCLELGAICEEVGLPSGVLNIITGLGPDAGAPIASHPHVDKIAFTGSTATGKTIMTAAAQMVKPVSLELGGKSPLVIFDDVADIDKAVEWAMFGCFFNSGQVCSATSRLLLHEKIAERFLDRLVEWAKNIKISDPLEEGCRLGSVISKGQYEKIKKFISTARSEGATILHGGDRPKHLGKGFFIEPTIITDVSTSMQIWREEVFGPVICVKVFKTESEAVELANDTHYGLAGGVISDDLQRCERIAKVIHSGIVWINCSQPTLVQAPWGGNKRSGFGRELGEWGLENYLSVKQVTRYCKDELYGWYQRPSKL

SEQ ID NO: 46136 - protein, 376 aa, Petunia integrifolia subsp. inflata
MKELPQDVVIYILVMLPVKSLLRFKCSCKTFCNIIKSSTFVNLHLNHTTKVKDELVLLKRSFKTDEYNFYKSILSFFSSKEDYDFMPMSPDVEIPHLTTTSARVFHQLIGPCNGLIALTDSLTTIVFNPATRKYRLIPPCPFGIPRGFRRSISGIGFGFDSDVNDYKVVRLSEVYKEPCDKEMKVDIYDFSVDSWRELLGQEVPIVYWLPCADILFKRNFHWFAFADDVVILCFDMNTEKFHNMGMPDACHFDDGKCYGLVILCKCMSLICYPDPMPSSPTEKLTDIWIMKEYGEKESWIKRCSIRLLPESPLAVWNDEILLLQSKMGHLIAYDHNSDEVKELDLHGLPTSLRVIIYRESLTPIPRSKDSIELEQF

SEQ ID NO: 46137 - protein, 422 aa, Wolinella succinogenes DSM 1740
MGTVTFTNNETGEKFEFEILNPTRGPQLVDFSKFYETTGMFTFDPGYGSTANCKSEISFVDGKKGELVYYGHPIEELVEKYKFVDVIKLLIGNGYIFPTKEESDQFERELVRRSYIHEGLRKIIDAFPDGAHPMANLSSSVSALSTFYYDHIDMEYEAEYQTMARRIIAKTPTLAAFAYRSSVGSPFVYPDADRGYVENFLYMLRAYPHGKLKEEISPIEVSALDTIFMLHADHGQNASTATVRNVASTGVHPYAALSAGLSALWGKAHGGANESVMDQLEMIGDVKNVDRYIAKAKDKNDSFRLMGFGHRVYKSYDPRARILRKLKDDLDQKGVKMNQRLVEIAEKIEEVATQDEYFLSRSLYPNVDFYSGIILTALKIPKSMFTPIFAIGRMPGWCGQVLELLQEPNVKITRPRQMYVGK

SEQ ID NO: 46138 - protein, 568 aa, Xanthomonas axonopodis pv. citri str. 306
MSHSVEDIKSESRRLRGSLEQSLADAVTGALREDDQTLIKYHGSYQQDDRDIRDERRRQKLEPAYQFMIRTRTPGGVITPTQWLALDGIATRYANHSLRITTRQAFQFHGVIKRELKATMQAINATLIDTLAACGDVNRNVQVAANPLLSQAHATLYADAARVSEHLLPNTRAYYEIWLDEERVSGSGSEDEPIYGERYLPRKFKIGFAAPPLNDVDVFANDLGFIAILRDGQLLGYNVSIGGGMGASHGDAETWPRVANVIGFVTREQLLDIATAVVTTQRDFGNRAVRKRARFKYTIDDHGLDTIVAEIARRAGFALQPAQPFAFDHNGDRYGWVEGEDGLWHLTLSLPAGRIADTDTAAHLSGLRAIAQLNVGEFRMTPNQNLVIAGVLASERARVDALVAHYGLDAGNQSATALARGAMACVALPTCGLAMAEAERYLPDFGAALQPLLQQHGLAETPIVLRLSGCPNGCSRPYLAEIALVGKAPGRYNLMLGGDRRGQRLNTLYRENITEPEILAALEPLLARYAAERDHANDEGFGDFLHRAGVIALPPYPTHRRLDLELLA

SEQ ID NO: 46139 - protein, 376 aa, Petunia integrifolia subsp. inflata
MKELPQDVVIYILVMLPVKSLLRFKCSCKTFCNIIKSSTFIYLHLNHTTNVKDELVLLKRSFKTDDYNFYKSILSFLSSKEGYDFKSISPDVEIPHLTTTSACVFHQLIGPCNGLIALTDSLTTIVFNPATRKYRLIPPCPFGIPRGFRRSISGIGFGFDSDANDYKVVRLSEVYKEPCDKEMKVDIYDFSVDSWRELLGQEVPIVYWLPCAEILYKRNFHWFAFADDVVILCFDMNTEKFHNLGMPDACHFDDGKCYGLVILCKCMTLICYPDPMPSSPTEKLTDIWIMKEYGEKESWIKRCSIRLLPESPLAVWMDEILLLQSKIGHLIAYDHNSDEVKELDLHGLPTSLRVIIYRESLTLIPRSKDSIDLEQF

SEQ ID NO: 46140 - protein, 571 aa, Candida albicans
MPEDYEKYRMGSSNESHQKLVQPISSSISKSNKKTKHQTDFVQDSDIIEASSINDEFGEVKRDLKARHVSMIAIGGTIGTGLFISTGSLLHTTGPVMSLISFLFVTTICFSVTQSLGEMATYIPISGSFAQFVTRWVSKSCGAANGWLYWFSWAVTFGLELSVVGQVIQFWTDAVPLAAWISIFFVILTIFNFFPVKFYGEVEFWIASIKIIAVFGWIIYAFIMVCGAGKTGPVGFRYWRNGYAWGDGILVNNNGKYVAAFVSGLINSIFTFQGSELVAVTAGEASPRALRSAIRKVMFRILVFYVLCMLFMGLLVPYNDPKLTQDGGFTRNSPFLIAMENSGTKVLPHIFNAVIVTTIISAGNSNIYSGSRILYGLAQAGVAPKFFLRTNKGGVPFFAVAFTAAFGALGYLACSSQGNKAFTWLLNITATAGLISWGFISVSHIRFMKTLQRRGISRDTLPFKAFFMPFSAYYGMVVCFIVVLIQGFTVFWDFNASDFFTAYISVILFVVLWVGFHFFFYGFGKDSFKMSNILVPLDECDIDSGVRDINDAEFDIPPPKNAWDKFWANVA

SEQ ID NO: 46141 - protein, 669 aa, Synechococcus sp. RS9917
MVAAPASLDTLCINSIRMLAVDAVNKSKSGHPGLPMGAAPMGYTLWDKFLKHNPKNPLWFNRDRFVLSAGHGCMLLYALLHLTGYDSVTIDDIKQFRQWGSKTPGHPETFETPGVEVTTGPLGAGISNAVGLAIAEAHLAAKFNKPDAKVVDHYTYVIMGDGCNQEGVSSEACSLAGHLKLGKLIALYDDNHITIDGRTDVSFTEDVLKRYEAYGWHVQHVADGNTDVNAIAHAIEAAKAVTDKPSIIKVTTTIGYGSPNKSDTAGVHGAPLGEEEAELTRKQLGWNHGPFEVPQEAYDQYRQAIERGASLEAEWNQALASYRSKYPSEAAEFERMLRGELPQGWDKDLPSYTPNDKGLATRKHSQICLGALGPNLPELIGGSADLTHSNYTDIAGETGSFQPESPEKRYLHFGVREHAMAAILNGIAYHNSGLIPYGGTFLVFADYMRGSMRLSALSELGVIYVLTHDSIGVGEDGPTHQPIETIPSLRAMPNLLVFRPGDGNETSGAYKLAIQNRKRPSALCLSRQAMANQANSSIDKVAHGGYILEDCAGTPELILIGTGTELDLCVQAAKQLTAEGHKVRVVSMPCVELFDEQSDAYKEEVLPSAVRKRIVVEAAEAFGWHRFVGLDGATVTMDRFGASAPGGTCMEKFGFTVENVVAKAKALLA

SEQ ID NO: 46142 - protein, 465 aa, Candida albicans
MFPNSPDAFHQVRMMQSLIKASNFKLQSMEFRCHSNNVCEYQMEMLHHLLSVEAKTLPSLSLIEQQPEIKLGMRPLLLDFLMEVITILNLSRSTFPLTVNLIDRYCSTRIVKKQHYQLLGLTSLWISCKNLDSKFKVPTLNDLRKICVDSYYKELFVEMEKHILKSLEWVVNAPTFDAFIDLYSNLLISNSSNFEVANIIKKSSHKIKLFSNYIGELFQFYPNIYYDYTSSQIALIAILITVLTLKIPVDLISLLNFYNGLVKTEMFKSNVEQGAEDQFEEILSVDSFKSLFNKSFFKNLIKIIDNPPSSLKIKYFAENGKYSVLMKQLVTTASNTLKCILDPVPTTPKANSFVKHQQQQHHYHPRPPMSINTSMIPLTPVSNSTSPNRFSPDQIFSENESTPGIAFGTMTPDSQSTSPGEKRSYECIDELEIGTSTIAGYTLKNHDTLKRSKSANYGTLFYLQQ

SEQ ID NO: 46143 - protein, 379 aa, Petunia integrifolia subsp. inflata
MKELPQDVVIYIFVMLPVKSLLRFKCTCKTFYHIIKSSTFINLHLNHTTNFNDELVLLKRSFETDEYNFYKSILSFLFAKEDYDFKPISPDVEIPHLTTTAACICHRLIGPCNGLIVLTDSLTTIVFNPATLKYRLIPPCPFGIPRGFRRSISGIGFGFDSDANDYKVVRLSEVYKEPCDKEMKVDIYDFSVDSWRELLGQDVPFVFWFPCAEILYKRNFHWFAFADDVVILCFDMNTEKFHNMGMPDACHFDDGKSYGLVILFKCMTLICYPDPMPSSPTEKLTDIWIMKEYGEKESWIKRCSIRLLPESPLAVWKDEILLLHSKMGHLIAYDLNSNEVQELDLHGYPESLRIIIYRESLTAIPRNNDCIELQNFRCN

SEQ ID NO: 46144 - protein, 466 aa, Synechococcus sp. RS9917
MRASWVTARRGQANVSQMHYARQGVVTEEMAHVAKRENLPESLVMEEVARGRMIIPANINHTNLEPMAIGIASSCKVNANIGASPNASDVDQEVEKLQLAVKYGADTVMDLSTGGVNLDEVRTAIINASPVPIGTVPVYQALESVHGSIEKLDEDDFLHIIEKHCQQGVDYQTIHAGLLIEHLPKVKGRLTGIVSRGGGILAQWMLYHHRQNPLYTRFDDICEIFKRYDCSFSLGDSLRPGCQHDASDAAQLAELKTLGDLTRRAWKHDVQVMVEGPGHVPMDQIEFNVKKQMEECNEAPFYVLGPLVTDIAPGYDHITSAIGAAMAGWHGTAMLCYVTPKEHLGLPNAEDVREGLIAYKIAAHAADIARHRPGARDRDDELSRARYNFDWNKQFELSLDPERARQYHDETLPADIYKQAEFCSMCGPKHCPMQTKITDADIEGLEEALKAKGGAELAGVKMDKAE

SEQ ID NO: 46145 - protein, 698 aa, Candida albicans
MTSLQQQQQQQRVKYGPPHHIKRRPYHPILESLEFQTNQHLIQEYSLDIVNTLSQLESLTLVNPAMIDLQPEIQWFMRPFLLDFLIELHSSFKLQPTTLFLCLNIIDRYCAKRIVFKRHYQLVGCTALWIASKYEDKKLRVPTLKELTIMCRNAYDEEMFVQMEMHILSTLDWSIGHPTLEDCLQLAIDLNNLSNNTTNDIENKSVRPNRKSSISSAVTAVARFLCELSLYDKYFLSVPPSLIAITANLLSCSMLQIPHASITLKNLIEQEIINPQQKKQKKAFSSNSSRTTTASYTHQNQLDVRHSSFDEDIDLDSGDEGDDDEDYIDEFYETNNYDDTNATTFDESINKSTTINDENQPPQIHTPFLSGLDEDSILSIKKICLMLIIQLSKVTEVLSKKYENLGVIQVINNFHSNYKFIIQSIYENQELLLNTINDSTNNNEIDYKLIQSSEILLQFPKFDEYLTEDEDENVSTDDEANSQPQGYDGSGSDGNNQLFTPKSPNAFSSNSSLTLNNHPQSMVPVTPPSATSQYSLFSNKNNRTHESTSGLNSTCNTPTHISISSFAPPQPPPGSILKPKLTSINSTNSLKIKKLTSNSNSSNINIHHGHHNTKQEKRYSHISIGSNSSSKYDGFSPIKSISTNGSLITNNGSFTNIVNNTNSSSPLMNQQQQYYHQQQHQQQVTQSSLYQHHHQYHQ

SEQ ID NO: 46146 - protein, 267 aa, Thermoanaerobacter tengcongensis MB4
MEKGKETKDILVVDDSVLIRLMVKDILGGEGYNVVAAATSEEAVRKIKSRKELFDLIIVDINLPDQNGFEFIRNLKSEEKYRHIPVIILSIDATVPSIKRAVEAGAVDYLVKPFKAEELVKRVVKLVGSVKKEDRYPELKDLLKKEVNRARRSNTNLSLILAHCEGKIAGEISKIAGKIRSKLRDIDAVFEINENTLALVLPVTGREGAEVVVKKIQGELRGSWRYAISIYPDNGKDEEELIGFAKESLMKEESNSSQEDDKEKEEK

SEQ ID NO: 46147 - protein, 119 aa, Glycine max
MEIESVKCECCGLKEDCTQDYISEVKSKFEGFGSWGLCSEAVRDEVSHGGKKASAMDEAVKAHMSFCRKFKSNPAVRVAEGMRQMLRRRSDLSSSPSSSKKYTRSSSTSQVGDSSSFHL

SEQ ID NO: 46148 - protein, 175 aa, Triticum aestivum
MPPPVRASSPTSVGLFGGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVKFIPFHPPGCEESGKA

SEQ ID NO: 46149 - protein, 350 aa, Ustilago maydis 521
MSTSAAPGKLATTLGANVSSLASKVRSTSSTQQSLMQSVKRIIPPLSSAKHKGQAGRIGIVGGSRDYTGAPFFASMSSMRFGCDMSYTICTPEAGNVIKTYSPDLIVNRLLDASVEWSQVERSVDELFARFHAVVIGPGLGRDEFMQKCAKLCIGLARKHDMYLVVDADGLWLLQNEPDLIKGYKKAILTPNVAEFGRLCDTLGIDCKQEPDSAAKKLAQALEGPTVLEKGPVDRITNGKEVLYVDLQGGLKRCGGQGDVLAGCLGTLAGWAKIYQDENPTLPARSTTTDGDLIAEDRLLLLAGYAASVTARTCSRLAFAKSKRAMLADDLLPEVGRAYEELWGDVQALL

SEQ ID NO: 46150 - protein, 421 aa, Bradyrhizobium sp. BTAi1
MPSEPSMMLMFWSSTRWWISAPSSSAPTAETSTISLVRTNSFNRYVSVQDSVTAGWGWVKVPCPPLPPAAAVSIVGHRIAKLETSVAVIVPFESPSGASIDGLVGLVAADMERVNATILSRTGSDVTMIPEVANHLISSGGKRLRPMLTLAMAHLTGYAGDGHVKLAAAVEFMHTATLLHDDVVDESEMRRGKLSARMLWGNEASVLVGDFLLGQAFRMMVEVGSLRALDILSAAAATIAEGEVMQLAAAKNTATTEDEYLAVIRGKTAELFAAACEVGPVLADRPKAEQTASRSFGMNLGIAFQLVDDVLDYGGKAAKLGKNVGDDFREGKITLPVVLAFRRGSDSERAFWIKSLERGEISDSDLDHAIGLMNKHRALEDTISRAHHYGAMAVDALALFPASPMKTALEQVVAFCLARSH

SEQ ID NO: 46151 - protein, 1480 aa, Medicago truncatula
MDSNLSRSISRSLSRSSWKMEEVFASGRYSRRTSQVDEDEEALKWAAIEKLPTYDRLRTSIMQTFTEGDQPQPGNRQQHKEVDVTKLDMNERQQIIDKIFKVAEEDNEKYLRKFRNRIDKVGIRLPTVEVRFKNLTVEADSFVGSRALPTLPNTALNILESLIGLFGFNTTKRTKLTILKNASGIVKPSRMALLLGPPSSGKTTLLLALAGKLDSELRVQGDITYNGHRLNEFVPRKTSAYISQNDVHVGEMTVKETLDFSARCQGVGTRYDLLSELARREKEAGIFPEAELDLFMKATAVKGTESSLITDYTLKILGLDICKDTIVGDEMNRGVSGGQKKRVTTGEMIVGPTKTLFMDEISTGLDSSTTFQIVKCLQQIVHLTEGTILMSLLQPAPETFDLFDDIILISEGQVVYQGPREHIVEFFESCGFRCPERKGTADFLQEVTSRKDQEQYWADKNRPYRYVSVSEFANKFKRFHVGVRLEQELSVPFDKSSAHKAALVYSKNSVPTGDIFKACWDKEWLLIKRNSFVYIFKTAQICIIAIIAATVFLRTEMKRDTEDDAALYVGAILFAMIMNMFNGFAELALTIQRLPVFYKQRDHLFHPAWTYTVPNFLLRLPISMFESLAWMVVTYYTIGFAPEASRFFKQFLLVFLIQQMAAGMFRFIAGTCRTMIIANTGGALMLLVVFLLGGFILPKRSIPDWWVWANWVSPLTYAYHALVVNEMYAPRWMHPNTSGDKTTTLGLAVLKNFDVYANENWYWIGAGALAVLIVFYNVLFTLTLMYLSPFGNKQAIISEEDATELEGEGDVNEPRLVRPPSNRESMLRSLSKADGNNSREVAMQRMSSQNPNGLRNADADTGNAPRRGMILPFQPLAMSFESVNYFVDMPAEMKEQGVTEDRLQLLREVTGSFRPGVLTALMGVSGAGKTTLMDVLAGRKTGGYIEGDVRISGYPKNQETFARVSGYCEQTDIHSPQVTIRESLMYSAFLRLPKEVGNEEKIQFVEQVMDLVELQSLKDAIVGLPGVTGLSTEQRKRLTIAVELVANPSIIFMDEPTSGLDARAAAIVMRTVRNTVDTGRTVVCTIHQPSIDIFEAFDELILMKRGGQLIYGGPLGRNSHKIIEYFEEIPGVPKIKEMYNPATWMLEVSSVAAEVRLGMDFAEYYKSSALFQRSKALVKELSTPPPGSSDLFFATKYSQSTFGQFTSCLWKQWLTYWRSPDYNLVRYFFSLACALMIGTVFWKVGENKESSTDLTLVIGAMYAAVIFVGINNCQTVQPVVAIERTVFYRERAAGMYAPLPYALAQVLIEVPFVLFQACYYSLIVYAMVSFEWKLEKFFWFVFVSFFSFLYFTYYGMMTVSITPNHQVASIFAAAFYGLFNLFSGFFIPRPKIPGWWVWYYWICPVAWTVYGLIVSQYHDIDDPINVLGATQNFTVKGYIEHHYGFKPDFMGPVAGVLVGFTCFFAFIFAFCIKALNFQSR

SEQ ID NO: 46152 - protein, 263 aa, Arabidopsis thaliana
MATSLQTKYTLNPITNNIPRSHRPSFLRVTSTTNSQPNHEMKLVVEQRLVNPPLSNDPTLQSTWTHRLWVAAGCTTVFVSFSKSIIGAFGSHLWLEPSLAGFAGYILADLGSGVYHWATDNYGDESTPLVGIHIEDSQDHHKCPWTITKRQFANNLHFMARGTTLIVLPLDLAFDDHVLFHAWAHGTKSKLPPLVVGLQDIGLLVSRIHHMNHHRAPYNNNYCVVSGVWNKVLDESNVFKAMEMVLYIQLGVRPRSWTEPNYE

SEQ ID NO: 46153 - protein, 534 aa, Zea mays
PQPVSSLDRSASSMPPAQAPSSGGAAWRQLLLLLTVLPLTLAALAFVLQWRGGGGVDDPTTRWPSHAFPGMAEPTPPSLPSSDCADVLVGSSAPSFPYIRGWSFPSDSGAAMGSVEEHLQPKVCVQTSTSAGLEQILPWLFYHKVVGVAQFLLFVEGKAAKPNVAGVLESIPGVKVVYRTKDLEERQARSRIWNETWLSGFFYKPCNYELFVKQSLNMEMAIVMARDGGMDWIIHLDTDELLYPGGAAEYSVRRLLAEVPRDVDMVIFPNYESSVEHDNIKDPFSEVSMFKRNYDHLPKDTYFGMYKEATRGNPNYFLTYGNGKSAARIQDHLRPNGAHRWHNYAKSPNEIKLEEAAVLHYTYTKFSDLTSRRDRCGCKPTKEDVKRCFMLDFDRAAFIIASTASEEEMLRWYNERVVWTDKQLNLKLLRKGVLTRIYTPMTIVQSLRESGVFTSAIAAGQPAVNAKLSPKETNAQSQNVTASGNMTRVVRSTDSKASGRKILQAVDLAFSDTNVTAVPPLSPPSLDEHRHHSE

SEQ ID NO: 46154 - protein, 379 aa, Petunia integrifolia subsp. inflata
MKELPQDVVIYIFVMLPVKSLLRFKCTCKTFCHIIKSSTFINLHLNHTTNFNDELVLLKRSFETDEYKFYKSILSFLFAKEDYDFKPISPDVEIPHLTTTAACVCHRLIGPCNGLIVLTDSLTTIVFNPATLKYRLIPPCPFGIPRGFRRSISGIGFGFDSDANDYKVVRLSEVYKEPCDKEMKVDIYDFSVDSWRELLGQDVPFVFWFPCAEILYKRNFHWFAFADVVVILCFDMNTEKFHNMGMPDACHFDDGKCYGLVILFKCMTLICYPDPKPSSPTEKLTDIWIMKEYGEKESWMKRCSIRLLPESPLAVWKDEILLLHSKMGHLMAYDLNSNEVQELDLHGYPESLRIIIYRESLTAIPRNNDCIELQNFRCN

SEQ ID NO: 46155 - protein, 394 aa, Heliobacillus mobilis
MNKKTIKDIDVKAKRVLVRVDFNVPVNDAGVITDDTRIRAALPTIQYLIQAGAKVILASHFGRPKGKVNDKYRLTPIAGHLSELLNRSVKKLDDCIGPDVEAAVKEAQPGDVILLENVRFYPEEEKNDPEFSRKLASLADVYVNDAFGTAHRAHASTAGVAAYLPAVAGFLMDKEISIMGKALAQPERPFVAVMGGAKVADKIAVIENLLNKVDTLIIGGGMANTFFYAMNLEVGKSLCEKDKADTARELLQKAEKAGVKMMLPVDVVIADTLAANVPTEVVPVNAIPADKSALDIGPESVKQFAQALSASKMVLWNGPMGAFEVEPFDRGTMGVAQAMVNVQGTTIIGGGDSVAAVEKAGLAEKMTHVSTGGGASLEFLEGRELPGVAALLDA

SEQ ID NO: 46156 - protein, 379 aa, Petunia integrifolia subsp. inflata
MKELPQDVVIYIFVMLPVKSLLRSKCTCKTFCHIIKSSTFINLHLNHTTNFNDELVLLKRSFETDEYNFYKSILSFLFAKKDYDFKPISPDVKIPHLTTTAACICHRLIGPCNGLIVLTDSLTTIVFNPATLKYRLIPPCPFGIPRGFRRSISGIGFGFDSDANDYKVVRLSEVYKGTCDKKMKVDIYDFSVDSWRELLGQDVPFVFWFPCAEILYKRNFHWFAFADDVVILCFDMNTEKFHNMGMPDACHFDDGKSYGLVILFKCMTLICYPDPMPSSPTEKLTDIWIMKEYGEKESWIKRCSIRLLPESPLAVWKDEILLLHSKMGHLIAYDLNSNEVQELDLHGYPESLRIIIYRESLTAIPRNNDCIELQNFRCN

SEQ ID NO: 46157 - protein, 435 aa, Oryza sativa (indica cultivar-group)
MFGTPSSSPLFGTPSTTPAFGAPSSTPAFGTPSTTPDFGTPSSTPAFGAPSSTPSFGTPSTAPAFGTPSSTPAFGAPSSTPAFGAPSSTPAFGTPSSTPAFGVAPSPSPSPFGFQQQMTPSPSPFGFAGGGGGQITTQMAPVAPLPLSPSDRDIQAIVDAYKEDPGNPRYAFRHLLFSVTEPSQRVKPVAASDIMWAEAMGKLEGMDSSDRERLWPQLVQGFKDLSYRLKVFFHLNSFPTQLLDQTLISFCGSIIVLINRLMVVKLDCFKVSVQYLYIEVGLCMLQDGVLVSDSDRLSMTRDNVKKIMRIVEALENRGYRIPLTKEEADLYERLAVIAKQLKGPTGDLHKRVYNLLSTSRLLASAGGTAGPIYIPSSAKVDEQSVAELLEALQQQTEAVAKLGNVMKRDTRDLEIILSEDTDMAEDSVGRRALKM

SEQ ID NO: 46158 - protein, 335 aa, Heliobacillus mobilis
MAVRIGINGFGRIGRLATRVALANPEVEIVAINDLTDAKTNAHLFKYDSVHGTYPGQVTVGEDNIEIDGRPIKVFAQKDPAAIPWGDVGVDIVIESTGLFVDGQKAAAHFQGGAKKVIISAPAKNEDITIVMGVNEKEYDGSKHKIISNASCTTNCLAPVAKVLNDEFGIIKGLMTTVHSYTNDQKILDQTHKDLRRARAAAMSIVPTSTGAAKAIGKVIPALDGKLNGFSMRVPTPNVSVVDLVVDVKKKTTIKEVNDALKAAAEGPLQGILGYNELPLVSRDYNGTHLSSVVDGLSTMVLDGDMVKIIAWYDNEYGYSVRLIDLALYVASKGL

SEQ ID NO: 46159 - protein, 334 aa, Xanthomonas axonopodis pv. citri str. 306
MSIEQLAETAQAMVAPGKGIIAIDESTSTIAKRFASVGIENIEENRRAYRELLLTTPKLSDYISGAILFDETIRQKTKDGVPFAEYMTAHGIIPGIKVDKGAQPLAGMPGELVTEGLDGLRARLEEYYTLGARFAKWRAVINIGEDIPSGTCIEANSHALARYAALCQEQGLVPMVEPEVIMDGSHDIETCYEVTEATLRSLFGALYEQNVVLEGTILKASMVISGKSCEEQASIEEVAESTVMCLKSTVPAILPGIVFLSGGQTDEQSTAHLNEMHQLGNLPWPLSFSYGRAMQQAALKLWAKDMTGNFAKAQQVIYERAKENGLAALGKWKG

SEQ ID NO: 46160 - protein, 791 aa, Cryptococcus neoformans var. neoformans B-3501A
MPINPLEAEAYELPPLSQAAISPAEQYFEDLVAEEESAKLLDTEGQLKQDDEDELVDDSALYMRRTQDEEVIGRGSKVEELIARTVPSHDDPTLPTLTLRVIFLGSSFCILGACASQIFYFKSNAPSFSSYFVVLATYPLGHLLANERLVPRGNKIFGWEINPGRFSIKEAILISVLSSSGASSAYAADILAIMDLYFDTPLSPLPSILLLLTTQCIGFGLAGMLQNLLVNPPAMYWPSTLVTVQLFTTLYSTTSSTLSLTQQQLTLTRLRVFLVIFLAIFLYQFLPFLFFPTLTSVSLLCLVNNRSWWMRTLGSAYQGLGIMDFSFDWSSIGSSGPLYTPYWALGNYFGGLVGMLWIILPLLLMLNFWDARSFPSPVSAGLFNATFQKFDVASILKPDLSLDEAAWEEKKPLLLTPYLISALTYGLSFAALSSVLVHVWLWHRDEIKQGNSMMFTINLCDHTYQCLRYGMWVFWLLILVLQASVLPSFRITIILIESKVILVKTTSLQMPIWALVLAMAIATIFLVPVGIIAAVSNTQIGLNVLTEFVAGILMPGKPIGNVTFKCYGYMAMSQALALTADLKLGWYTSIPPREMFTCQIIGTVLGALTNYATLVSVMAAKRPYLNGSLTDPTGQWTGRAPSIFYSASIIWGAVAPARFFSGGYEVLYLGFLVGALVPVGFWLAHKKWPGYKLNKVVFPIICSGATVVPQYPSNIILTSLLTAVLVNSWFAKRHPKLHRQYVYVASSALDAGTSITALAIYVLFGGVFWSWNGWEWWGNSGVDSEHCVPGS

SEQ ID NO: 46161 - protein, 122 aa, Gracilaria tenuistipitata var. liui
MYLKKHYKNLITHEIEEEFKKNDIPILDIGDSIKMSILIHEGNKQRIQNVEGVIIAKHKSQLSTTITVRKIVQNIGVERIYLIHSPLIKNIKIVRKAKVRRAKLYYLRLRSGKATRLKTKFN

SEQ ID NO: 46162 - protein, 201 aa, Oryza barthii
GVLPSDQEIAVKRLSQSSRQGIEELKNELVLVAKLQHKNLVRLLGVCLEEHEKLLVYEYMPNKSLDTILFDPDRSNVLDWWKRLKIVNAIARGLQYLHEDSQLKIIHRDLKASNVLLDSDFNPKISDFGLARLFGNDQSQDVTNRVVGTYGYMAPEYAMRGHYSIKSDVFSFGVLILEIVTGRKNNVSYDSEQSVDLLTLV

SEQ ID NO: 46163 - protein, 236 aa, Brassica napus
RFVQASALVSQPALYSKDLLREHTIGPAMVHPSETVKGSLWHDLQDPGVKRALFVRVGLQILQQFSGINGVLYYTPQILEQAGVGILLSNLGISSSSSSLLISALTTFVMLPAIAVAMRLMDLSGRRTLLLTTIPILIASLIVLVISNLVHMNSIVHAVLSTVSVVLYFCFFVMGFGPTPNILCSEIFPTRVRGICIAICALTFWICDIIVTYSLPVLLKSIGLAGVFGMYAVVCC

SEQ ID NO: 46164 - protein, 201 aa, Oryza barthii
GVLPSDQEIAVKRLSQSSQQGIEELKNELVLVAKLQHKNLVRLLGVCLEEHEKLLVYEYMPNKSLDTILFDPDRSNVLDWWKRLKIVNGIARGLQYLHEDSQLKIIHRDLKASNVLLDSDFNPKISDFGLARLFGNDQSQDVTNRVVGTYGYMAPEYAMRGHYSIKSDVFSFGVLILEIVMGRKNNVSYDSEQSVDLLSLV

SEQ ID NO: 46165 - protein, 533 aa, Ustilago maydis
MSIANASSSTASHDLDAADADPCPSACTSVSALCNMSTLPSPRPFGYRPTYVPAMVASGVSAVTVTTNSHRPPSKSHSISSVDSLASVSSNAPSTPTHDADDVRFEMAVIPKLVRASADAYLDRVGKPLPPSPAPQIVATSATTKTNAQAARSVAAAAAAAAAAAAVPPSHSALRNENHKNAISFRVGSKYKVCEIIGEGAYGVVCSAIHRATGQKVAIKKIQPFEHQMFALRTLRELKLLRFFQECDVSENIISILDIIKPSTYEAFTEVYLVQELMETDLHRVIRTQELSDDHCQYFTYQTLRALKPMHCADVIHRDLKPSNVLLNANCDLKVCDFGLARSVLTADQDTGFMTEYVATRWYRAPEIMLTFKQYTKAIDAWAVGCILAEMLTGRPLFPGRDYHQQLSLILDVLGTPTLEEFQNINSRRSRDYIRSMPFRKRREFRTLFPKASPEAIDFLQKTLTFDPRNRLTVEECLQHPYLSAYHDPDDEPGAPRLDPDFFYFDMQKESITKEDLRKELWYQVQEFQPLLR

SEQ ID NO: 46166 - protein, 201 aa, Oryza meridionalis
GVLPSDQEIAVKRLSQSSRQGIEELKNELVLVAKLQHKNLVRLLGVCLEEHEKLLVYEYMPNKSLDTILFDPDRSNVLDWWKRLKIVNGIARGLQYLHEDSQLKIIHRDLKASNVLLDSDFNPKISDFGLARLFGNDQSQDVTNRVVGTYGYMAPEYAMRGHYSIKSDVFSFGVLILEIVTGRKNNVSYDSEQSVDLLSLV

SEQ ID NO: 46167 - protein, 500 aa, Burkholderia pseudomallei K96243
MTQTDLVAVADTVRAFTEREFGVFIDGAMRAAHSPRRLDVFDPATGARLSRVPDADAHDVDAAVASAQRAFDARAWSGLRPAERERILLKLADVLEAHAEELAQLETLNQGKSILVSRGVEVGATIEYVRYMAGWATKITGQTLDVSIPFPPGARYTAYTRKEPVGVVAAIVPWNFPLMIAVWKLVPALAAGCTVVLKPSPETPLTALRLAELALEAGVPAGVFNVVTGARACGAALASHPAVRKISFTGSTATGKLVGAAAVQNMTRFSLELGGKNPIVMLEDVDVDAALGGVAAGAFFNQGQVCAAASRIYVHRSRFRRLAEGLAGVASAMRLGPGLDPAAQINPLVSAHHRDTVARHIDAARREGLTFLAGGTRADDLPGYFVRPAVIADAAHDSAIVRDEVFGPVVVVLPFDDPAEAVRLANASPYGLAASLWSNDLKAVMDLVPQIEAGTVWVNCHIPLDPSMPFGGYKQSGIGREFGQYAIEGFTETKSVCIAH

SEQ ID NO: 46168 - protein, 449 aa, Burkholderia pseudomallei K96243
MSYNDSRFWHPMLHPNDMKRREPIRIVRGDGCHVYDERGRQLVDGVAGLWNVNVGHNRAEVKEAIVRQLDELEYFQLFDGITHPRAEELSSKLIDMMEPEGMRRVLYSSGGSDSVETALKIARQYWKVRGQADRTKFISLKQGYHGTHFGGASVNGNTVFRRNYEPNLPGCFHVETPWLYRNPFTQDPEALGRICAELLEREILFQSPDTVAAFIAEPIQGAGGVIVPPANYWPLVREVCDRYGVLLIADEVVTGFGRSGSLFGSRGWGVKPDIMCLAKGISSGYVPLGATAVNARIEDAFAANADFGGAIMHGYTYSGHPVACAAALASLDIVLREDLPANAAKQGAHLIEALRPFVERFDALGEVRGKGLMVALDLVADKATRAPIDPMSGYANAVAEVARENGVLVRPVGTKIILSPPLVIQREQIDRIVAGLEAGFAATPFPGGR

SEQ ID NO: 46169 - protein, 579 aa, Yarrowia lipolytica CLIB122
MATEHVEHAENAKQSPQPSFSGSESGRIGRYQIIKTLGEGSFGKVKLAYHLATHEKVALKIINRKTLAKSDMQGRVEREISYLRLLRHPHIIKLYDVIKSKDEIIMVIEFAGKELFDYIVQRGKMPEDEARRFFQQIISAVEYCHRHKIVHRDLKPENLLLDENLNVKIADFGLSNIMTDGNFLKTSCGSPNYAAPEVISGKLYAGPEVDVWSCGVILYVMLCGRLPFDDEFIPNLFKKISNGVYTIPPYLSAGAKHLLQQMLVVNPLNRITVQGIMEDPWFKQGIAEYLVPRDLKPDQVEIDDKVVGALSDTMGYDRDQVYEALKAPKSDGTEIRDAYDLMKENRQQLEKDSTVFDKVDESGKPKHQFSRKNPPALTFDSHHMPTIVDHSDLRTPNTTIAVLPSSLPAYHRANMMAHGPATLRKLNPISSRKSKTRWHFGIRSKSYPLDVMGELYRALKNLGAEWAKPSENDLWTIRVRWRYTPEKDESDSTTKPDSGLLKMQIQLYLLEQNSYLVDFKFDGWECETESGEIKTRDVAQVSNSKSANETFTFSAYPFLHLATRLIMELAVSSQKESEK

SEQ ID NO: 46170 - protein, 201 aa, Oryza meridionalis
GVLPSDQEIAVKRLSQSSRQGIEELKNELVLVAKLQHKNLVRLLGVCLEEHEKLLVYEYMPNKSLDTILFDPDRSNVLDWWKRLKIVNGIARGLQYLHEDSQLKIIHRDLKASNVLLDSDFNPKISDFGLARLFGNDQSQDITNRVVGTYGYMAPEYAMHGHYSIKSDVFSFGVLILEIVTGRKNNVSYDSEQSVDLLSLV

SEQ ID NO: 46171 - protein, 232 aa, Triticum aestivum
  misc_feature (183)..(183): Xaa can be any naturally occurring amino acid
TSRSGMAGGDEGSLVPREVPGSYGMPFVSAIRDRLDFYYFQGQDKYFESRVERYGSTVVRINVPPGPFMARDPRVVAVLDAKSFPVLFDVDKVEKKNLFTGTYMPSTSLTGGFRVCSYLDPSEPTHAKVKQLLFSLLASRKDAFIPAFRSHFSSLLATVESQLVLGGKANFNTLNDATSFEFXGDAYFGVLPSPSDLRTPGPAKAPKWLIFQVHPLVTARLPMILQDPSLPG

SEQ ID NO: 46172 - protein, 630 aa, Mesorhizobium loti MAFF303099
MCGIFGIVLKNEGTPVCAAAVERCADALAHRGPDASGLYINQSVAFAHRRLSIVDAHSRANQPYRDANTGVVVTYNGEIFNYREIRTELRDMGFFFSTVSDTEVLILSYIAWGKSFLNRLDGIFAFALFDPRNSLVLIARDRLGVKPLYYTICDVGLLFASQPNALIRWPGVMRGPDMIGALSFLSYRAVVGARTLFAGISKLEPGHLLEIRNGRHTSERWWNLSERISRCKPDYSDIRRLLGSAVERQLVADVPVAALLSGGLDSSILAYEASARSQIRPICYTGKVETADYDETAYAMEVAAEFGLTHRVVPIGEPSDIYAVSELVRLRGHPLGMHNEIAMFTLAKAISKEHKVVLTGEGADEIFAGYSRLFRTPYDYNRSKIIAALPRALAQVARRRLGLDVHGSQLQFFLARYSYFPTDEIRSLVIDGRVRREHEMALFDHFSTQFAEAGGDFFSKISYVLVSTHLPALLEMVDNTTMAAGLEARVPYTDHQLVTAAMAMPGSQRLRWRSPIASVQALWHPVASFSERLDVSKFPLRREYRSVLPRSVLSRKKMGFPLPLGQWAVGEGATEYRRLLFDKDSPLGDLFDPAALRRWFEAGRRNPSDSFGRKFWLLANLGIFFKEVFS

SEQ ID NO: 46173 - protein, 184 aa, Arabidopsis thaliana
MGGLKRRISIEKIQKKESRAVCFSKRRTGLYSKAAELLCLLSSDSQVAILTTPCSSNSHVSFYSFGHSSVDSVVSAFLKDQGLVRKENLGDHQEDVKINNDIKIKNLVSHETLNLQLSSATFGVPDDDRLKEETEMVVFDDQILAIFESNDKPTGNLEDQEIDLDQFLDFDQLIDFEGLIDGDY

SEQ ID NO: 46174 - protein, 807 aa, Arabidopsis thaliana
MNSFPNDDLVYEILLRLPAKSVARCSCVSKLRRSILSRQDFTELFLTKSSARPRLLFGVKRANGEGLFFSSTQPRNSYEKSSLVVAADFHTKFSEVISREICSYASGLIYLSDMRISVNDEDVVRAICNPITGNYLGFDPIDKQFKVLFMAYPSGPDDHKILTLGTRRMRWRKIHCPLTHDPFCEGICINGVLYYLAIQIDEPLGKLGGIDWKHGNANGSRTFELSMWVLEDVEKHEWSKYDCTFLEYEVMFYNISLAVGMTATCEIVLSEKFASKSFYVFYFNPERETLQRVEIQGLENHCRVYTITDHVEDLNVNDAKQLNVRQIKPKEEEAETHILKMVTWRKTPNEGKVGVINLTHAYERVFPLQLRMTVLEDFEKQEWSTYVYTLMAENIVVKYVSVVGMTATGDIVLVKTNACKPFYVFYFNPGRNTLLSVEIQGVGEDHKCLNFHTVCAFVDHAAKKILVALDQKRKATSAPKVFLAVKSEKNPEEEVEIHCATETVANILVNEFDEPILGVELLLLSLASESLGKSSLVVAADFHMKFSKDISPNSCSYASSLIYFPIIQISKEWDDEVRAICNPSTRQYAILPPDLRTTYQNFGPLLGFDPIGKQFKVLVFNCRVGNELVYHILTLGTENVRWREIICPFTYEPRWKRSICINGILYYLAVNSNVSSSVINYKLINYKGKLGLVDLEKDYDAGYLLGADENKVFNNNLSVVGATASGTLSEVLKSKVLEKRKNGLTIIQFINYFVDHVEDLRFDGMKTTYVAPSLSPPEQSTSSSSEDPCSLGTRSFRSRFESINKLI

SEQ ID NO: 46175 - protein, 170 aa, Desulfitobacterium hafniense DCB-2
MDFDKYIRVIDDFPKPGISFKDITTLLKDGEAYRAAVDAIVERVRESQPDLIVGPEARGFLLGAPVAYALGIGFVPVRKPGKLPGKTVSETYELEYGSDTLEVHADAIQPGQRIAIVDDLLATGGTTSATARLIEKTGAQVAGMSFLIELGFLEGRKRLEGYEVFSLIKY

SEQ ID NO: 46176 - protein, 987 aa, Bradyrhizobium sp. BTAi1
MAKAVAKSKKVAAKSKPSKPGKAKAAPLAPPRKALKTAPKPAAKAPAKVAAKAAPKAPVKTAPKKPAKTVAKPVGKPAKASAAKPAAKSAATAIKPNKWVYTFGDGKAEGKAGLRDLLGGKGANLAEMANLGLPVPPGFTIPTSVCTYFYANDKTYPKELQAQVDKALDYIGKLTDKTFGDPENPLLVSVRSGARASMPGMMDTVLNLGLNDQTVEALASLSGDRRFAFDSYRRFITMYSDVVLGFEHHHFEDILDSFKDSQGYQLDTDLSSEDWEMLVGKYKEAVATETGKEFPQDPHDQLWGAIGAVFSSWMNARAVTYRKLHDIPESWGTAVNVQAMVFGNMGDTSATGVAFTRNPSTGESKLYGEFLINAQGEDVVAGIRTPQDITEDARIESGSDRASMEVAMPEAFKELTRIYTLLEKHYRDMQDMEFTVERGKLWMLQTRSGKRTAKAALRIAVELANEGLISENDAVLRVDPASLDQLLHPTIDPAAKRDVVATGLPASPGAASGEIVFSSDEATKLQADGRKVILVRIETSPEDIHGMHAAEGILTTRGGMTSHAAVVARGMGKPCVSGCGTIRVDYGRGTMSIGGRTFKTGDVITIDGSVGQVLAGRMPMIEPELSGEFGTLMGWADAVRETGVRVNADTPEDARTAIKFGAEGIGLCRTEHMFFEETRIRTVREMILSEEEQERRAALAKLLPMQRADFVELFEIMKGLPVTIRLLDPPLHEFLPHTQAEVEEVARAMNTDPRRLADRARELSEFNPMLGFRGCRLAIAYPEIAEMQARAIFEAAVEAEKRTGEAVGLEVMVPLIATKAEFDLVKARIDAMAQAVIRETGAKLEYQVGTMIELPRAALMAGQIAEAAEFFSFGTNDLTQTTYGISRDDAGSFLGAYVAKGILEIDPFISIDRDGVGELVKIGVERGRATRPNLKVGICGEHGGDPASVAFCHKIGMNYVSCSPYRVPIARLAAAQSALGKEIASQA

SEQ ID NO: 46177 - protein, 283 aa, Methanothermobacter thermautotrophicus str. Delta H
MKIEGTVVAMVTPFTEDDVVDEAGLRENINYLIENGVDGLLVAGTTGESATITHEEQRRMIDILVDEVNGRVRTVAGAGSNSSREAMGLVEYAEDAGADAALVITPYYNKPQPHGLIEHYTMLEEAADIPLIIYNVPSRTGTDIDVDTVAELAKLDGIIGIKEASPDLDKVSMLRSRLMDLGLDDFTVLSGNDNLTLPMISMGAEGVISVVANVDPARMSRLVNEALSGDFESAMKTHYELYSLMKVLFIESNPVPVKEALNMMGKARGSCEDAPGTPAGCKP

SEQ ID NO: 46178 - protein, 391 aa, Xanthomonas axonopodis pv. citri str. 306
MSIVRMTDLDLSGKRVLIRQDLNVPIDNGQITSEQRITASVPTIKLALEKGAAVMVTSHLGRPKEGSWTEEDSLAPVATRLAALLGVDVPLVRDWVDGVEVAPGQVVLLENCRMNVGEGKDDETLARKYAALCDVFVMDAFGTAHRAQASTHGVIRFAPVAAGGPLLMAELDALAKALDNPAKPLLAIVAGSKVSTKLELLSNLVNKVDQLIVGGGIANTFIAAAGHAVGKSLNEPDLIPTANRIVADAKARGAEIPLPTDVVVAKQFLPDAQASVKSLDAVDADDLILDIGPQTAQRYAELIASAGTVVWNGPVGVFEFESFSHGTETLARAIASSKAFSIAGGGDTLAAVDKYDIAQDVTYISTGGGAFLEFLEGKTLPAVAALQARGQ

SEQ ID NO: 46179 - protein, 333 aa, Xanthomonas axonopodis pv. citri str. 306
MAIKVGINGFGRIGRNVLRSAVQNFANDIEIVAINDLLEPDYLAYMLQYDSVHGRFKADVSVDGNTLIVNGKKIRLTQERDPANLKWDAVGADVVIESTGLFLTKETAQKHIDAGAKKVILSAPSKDDTPMFVYGVNDKTYKGEAIISNASCTTNCLAPLAKVINDKWGIKRGLMTTVHAATATQKTVDGPSNKDWRGGRGILENIIPSSTGAAKAVGVVIPELNKKLTGMSFRVPTSDVSVVDLTVELEKPATYAEICAEVKAQSEGALKGVLGYTEDKVVATDFRGETCTSVFDADAGIALDSTFVKLVSWYDNEWGYSNKCLEMVRVVAK

SEQ ID NO: 46180 - protein, 201 aa, Oryza longistaminata
GVLPSDQEIAVKRLSQSSRQGIEELKNELVLVAKLQHKNLVRLLGVCLEEHEKLLVYEYMPNKSLDTILFDPDSSNVLDWWKRLKIVNGIARGLQYLHEDSQLKIIHRDLKASNVLLDSDFNPKISDFGLARLFGNDQSQDVTNRVVGTYGYMAPEYAMRGHYSIKSDVFSFGVLILEIVTGRKNNVSYDSEQSVDLLTLV

SEQ ID NO: 46181 - protein, 400 aa, Marchantia polymorpha
MSVASVSASVAKASQVSGKDFSGLKSTSVATFGKRSDDLLTRVAAQSAVAVSGAQKRAVVEAKVKVAINGFGRIGRNFIRCWHGRKDSPLEVVVINDTGGVKQASHLLKYDSMLGIFDAYVKAVGDDAISVDGKIIKIVSDRNPLNLPWGEMGVDLVIEGTGVFVDKEGAGKHLQAGAKKVLITAPGKGPIPTYVIGVNEELYDPSEQIISNASCTTNCLAPFVKVLDEKFGIIKGTMTTTHSYTGDQRLLDASHRDLRRARAAALNIVPTSTGAAKAVALVLPNLKGKLNGIALRVPTPNVSVVDLVVQVEKKTFAEEVNAAFREAANGDMKGILAVCDEPLVSVDFRCTDVSSTVDSSLTMVMGDDMVKVVAWYDNEWGYSQRVVDLANLVAEKWTGA

SEQ ID NO: 46182 - protein, 202 aa, Prunus mume
LTHEIRGTLDRHTILKTTLVELGRTLALEECALWMPTRTGLELQLSYTLRQQNPVGYTVPIHLPVINQVFSSNRALKISPNSPVARMRPLAGKHMPGEVVAVRVPLLHLSNFQINDWPELSTKRYALMVLMLPSDSARQWHVHELELVEVVADQVAVALSHAAILEESMRARDLLMEQNIALDLARREAETAIRARNDFLAV

SEQ ID NO: 46183 - protein, 574 aa, Candida albicans SC5314
MFTRSLIKGGGRLATTRSLVNNSTSLVLKNQFKKYSTSTPPKVAKSKSSTIGKIFRYTFYTAVISVIGSAGLIGYKIYEESQPVDQVKQTPLFPNGEKKKTLVILGSGWGAISLLKNLDTTLYNVVIVSPRNYFLFTPLLPSVPTGTVELRSIIEPVRSVTRRCPGQVIYLEAEATNINPKTNELTLKQSTTVVSGHSGKDTSSSKSTVAEYTGVEEITTTLNYDYLVVGVGAQPSTFGIPGVAENSTFLKEVSDASAIRRKLMDVIEAANILPKDDPERKRLLSIVVCGGGPTGVEAAGEIQDYIDQDLKKWVPEVADELKVSLVEALPNVLNTFNKKLIDYTKEVFKDTNINLMTNTMIKKVNDKSLIANHKNPDGSTESIEIPYGLLIWATGNAPRDFTRDLIAKVDEQKNARRGLLVDERLKVDGTDNIFALGDCTFTKYPPTAQVAFQEGEYLANYFDKLHAVESLKYTIANPTPKDNVEKLSRKLARLEKNLPHFIYNYQGSLAYIGSEKAVADLVWGDWSNISSGGNLTFLFWRSAYIYMCLSVKNQVLVVLDWAKVYFFGRDCSKE

SEQ ID NO: 46184 - protein, 202 aa, Prunus mume
LTHEIRSTLDRHTILKTTLVELGRTLGLQECALWMPSRAGMNLQLSHTLNYQIQVGSTVPINLPVVNEVFTSSRAIRIPYTCPLARIRPLVGRYVPPEVVALRVPLLNLSNFQINDWPDLSAKSYAIMVLILPTDSTRKWRDHELELVDVVADQVAVALSHAAILEESMRARDQLMEQNIALDLARREAEMAIHARNDFLAV

SEQ ID NO: 46185 - protein, 318 aa, Spirogyra sp.
KVGINGFGRIGRNFIRCWHGRDDSPLEVIAINDTGGVKQAAHLLKYDSMLGIFNADVKIADDNSISVDGKIIKVVSDRNPLNLPWGEMGIDLVIEGTGVFIDGPGAGKHIEAGAKKVLITAPGKGPIPTYVVGVNADKYVHSEPIISNASCTTNCLAPFVKILEEKFGIIKGTMTTTHSYTGDQRLLDASHRDLRRARAAALNIVPTSTGAAKAVSLVLPSLKGKLNGIALRVPTPNVSVVDLVIQTEKKTFAEEVNAAFREAAAGPMKGVLAVCDEPLVSIDFRCSDVSCTIDSSLTMVMGDDMVKVVAWYDNELGY

SEQ ID NO: 46186 - protein, 201 aa, Oryza nivara
GVLPSDQEIAVKRLSQSSRQGIEELKNELVLVAKLQHKNLVRLLGVCLEEHEKLLVYEYMPNKSLDTILFDPDRSNVLDWWKRLKIVNGIARGLQYLHEDSQLKIIHRDLKASNVLLDSDFNPKISDFGLARLFGNDQSQDVTNRVIGTYGYMAPEYAMRGHYSIKSDVFSFGVLILEIVTGRKNNVSYDSEQSVDLLSLV

SEQ ID NO: 46187 - protein, 111 aa, Rickettsia conorii str. Malish 7
MSLKMLENKNFKFIENEIKNNKVVLFMKGIKKSPACGFSGTVVAILNKLGVEFRDINVLFDAELREDLKKFSDWPTFPQLYINGELVGGCDIARELYQSGELEKMLKAYTR

SEQ ID NO: 46188 - protein, 318 aa, Sphagnum cuspidatum
  misc_feature (313)..(313): Xaa can be any naturally occurring amino acid
KVGINGFGRIGRNFIRCWHGRKDSPLEIVVINDTGGLKQASHLLKYDSMLGTFAADVKVDGNDSISVDGKTIKVVSDRNPLNLPWGELGIDLVIEGTGVFVDKEGAGKHLKAGAKKVLITAPGKGAIPTYVVGVNADEYNHGDEIISNASCTTNCLAPFVKVLDEKFGIIKGTMTTTHSYTGDQRLLDASHRDLRRARAAALNIVPTSTGAAKAVALVLPNLKGKLNGIALRVPTPNVSVVDLVVQVEKKTFAEEVNAAFRDASAGPLKGILAVCDEPLVSVDFRCSDVSSTIDSSLTMVMGDDMVKVVAWYXNEWGY

SEQ ID NO: 46189 - protein, 283 aa, Sphagnum cuspidatum
  misc_feature (279)..(279): Xaa can be any naturally occurring amino acid
GVKQASHLLKYDSMLGTFNADVKVDGNDGISVDGKIIKVVSDRNPLNLPWGELGIDLVIEGTGVFVDKEGAGKHLQAGAKKVLITAPGKGAIPTYVVGVNEEQYSHRDEIISNASCTTNCLAPFVKVLDEKFGIIKGTMTTTHSYTGDQRLLDASHRDLRRARAAALNIVPTSTGAAKAVALVLPNLKGKLNGIALRVPTPNVSVVDLVVQVEKKTFAEEVNAAFRDASAGALKGILAVCDEPLVSVDFRCSDVSSTVDSSLTMVMGDDMVKVVAWYDXEWGY

SEQ ID NO: 46190 - protein, 179 aa, Oryza sativa (japonica cultivar-group)
MSSLCQPPPCRTILVVNRAAQAAPITSPQARSTGWASSNGGERRHTRAGTPRRGGWHGTCAVMALERILADIRAQAASPTCPTRCSSTTSSASSPSQSWPRPALSTLWRPGSWRPSARHNFRVLFVCGCRDLGEALRRIREGAAIIRTKGEAPLTWPTQGRKGCGDGEKRDERAGPSVF

SEQ ID NO: 46191 - protein, 359 aa, Glycine max
MGDIDPAFIQSTEHRPIAKVVEVREIPVIDLSEGRKELLISEIGKACEEWGFFQVINHGVPFEISREVEIVSKKFFETSLEEKKKVKRDEFNAMGYHDGEHTKNVRDWKEVFDYLVENTAQVPSSHEPNDLDLRTLTNQWPQNSPHFRETLQEYAREVEKLAYKLLELISQSLGLAADKFHGCFKNQLSMVRLNYYPACPFPDLALGVGRHKDSSALTVLAQDDVGGLQVKRKSDGEWIPVKPTPNAFIINVGDIVQVWSNDKYESVEHRVVVNTEKERFSIPFFFFPAHHVMVKPAEELVNEQNPARYREYKYGKFFANRNRSDFKKRDVENIQIHHFRILDEAFGLASSISSISEHN

SEQ ID NO: 46192 - protein, 470 aa, Lactobacillus plantarum WCFS1
MKIVIVGCTHAGTAAAAQILKDHPEATVTIYERDDNISFLSCGIYLYLGGKVNHLEDMFYSSPETLAKLGAMVRTKHNVLKIDAQSKTLQVVDMTTGKVFGDTYDKLIMTTGSNVAVPPIFGIDESKVLLCKTYSQAQEIYQTAQDNQRIAIIGAGYIGTELSESYANTHHEVTLFQSHDQILNNYISKEISDQAVQLLKDHGVNVLLNHQVTAFTGNDDGELVIETNQGDFNADLAIVGTGFVPNTELLRGQVEMDKHGAIIINDYVQTSDPDIYAAGDSCVVNFNPTGRSAYTPLATNAVRQGALAGANVFGNQQRYMGTQATSAMQLFDHTLATTGLTLAMAKLNHIPAERVTYEGNWRPAYMPSTAKLTIELIYNPENRKILGAQFLSAHEVAQSANALSIAIQNGNTIDDLAFVDMLFSPNFDEPFNYLNLVAQQAIEQERQAGRNHPRITAYGDWAKQNDKDLQ

SEQ ID NO: 46193 - protein, 133 aa, Moorella thermoacetica ATCC 39073
MTGKKVVATNQAPAAIGPYSQAIKIGNLIFTSGQIPLDPASGRIVDGGAAEQTARVMANLQAVLAAAGAGLEDIVKTTVYIKDMNDFSAINEVYGRYFTKEPPARSCVEVARLPKDVLVEIEAVAVVGNNGGR

SEQ ID NO: 46194 - protein, 516 aa, Glycine max
MAEDDGYTKDGTVDYCGNPANKKETGTWKACPYILGNECCERLAYYGMSTNLVLYFKNRLNQHSATASKNVSNWSGTCYITPLIGAYLADSYLGRYWTIAVFSIIYAIGMTLLTLSASVPGIKPTCHGHGDENCRATTLESAVCFLALYLIALGTGGIKPCVSSYGADQFDDTDSAEKERKSSFFNWFYFSINIGALIASSLLVWIQDNVGWGWGFGIPAVAMAIAVVSFFSGTRLYRNQKPGGSAITRICQVVVASIRKYNVEVPADESLLYETAETESAIKGSRKLDHTDELRFFDKATVLARSDKVKESTNPWRLCTVTQVEELKSILRLLPVWATGIIFSTVYGQMSTLFVLQGQTMDTRVGNSTFKIPPASLSIFDTLSVIFWVPVYDRIIVPIARKFTGYKNGLTQLQRMGIGLFISIFSMIDNAGLEWGFGIPAVAMAIAVVSFFSGTRLYRNQKPGGSAITRICQVVMASIRKYNVEVPADESLLYETAETESAIKGSRKLDHTNELR

SEQ ID NO: 46195 - protein, 348 aa, Synechococcus sp. RS9917
MADPSPQVLCLGEALVDRLGPPGGDPLSAAPEQCDDRLGGAPANVACALARLGTAAGFIGRLGDDAIGASFREVLVDRGVDLRGLQWDAARPTRVVLVRRHLDGERVFQGFAGDRGQGFADQALEPEALALAWPPLAAAVRWLLVGTIPLASEASAAALGSALALAKRDQVRIALDVNWRPTFWRADADPAAGPDAAALAAIAPLLEQAALLKLAREEAEWLFDTDDPVAVSARLPQRPDVVVTNGGDPVRWCIAGHNGAMPVLAPPRVVDTTGAGDAFTAGLLHQLVRLTPAVGHPLELSEAVVEQVVRFAAACGALVCAGAGGIDPQPSAAAVESFLAQAPVQASS

SEQ ID NO: 46196 - protein, 304 aa, Magnetospirillum magnetotacticum MS-1
MTIDTSHHDKILIVDFGSQVTQLIARRVREEGVYCEIVPFTKAEAAFDEHRPKGVILSGGPESVTTDLSPRAPQKIFESGVPVFGICYGQQTMAAQLGGQVEGGHHAEFGRAEVEILSDSPLFKGVWHVGEKYPVWMSHGDRVTKLPDGFTTIALSRNAPFAAVADEARHYYAVQFHPEVHHTPHGALLIRNFVRDIAGCSGDWTMGTYREEAIAKIREQVGSEKVICGLSGGVDSSVAAVLIHEAIGDQLTCVFVDHGLMRLGEGDEVVRLFRDHYNIPLVHVEAQDLFIGALEGVDDRRSSA

SEQ ID NO: 46197 - protein, 524 aa, Synechococcus sp. RS9917
MSASVTNVPPHQPDVLNGLPPVAVIGAGPGGLVAARWLLAKGFDCLLLESCAELGGQWNGANRRSATWPGLVTNTSRVMTAFSDLDHPEGTATYPSREQAQVYLQRYAERFDLLRRIRYGCEVTELDRDPSGQGWQLRWREKGVLLQARFQQVVVATGAQSCPSTPNLPGLESFSGRLGVHHTAHFRGAEGFRGASVLSVGCSISSLEIATALAQQGVEVHATYRRQRYVLPKLLAGVPNDHVMFTRSAALAAECLPIEAVAEALKAEVLRHAGSPEQWGARQPHANILQAGISGCQGFLPLVAEGRIQVHPWIEAIEGDSVVFQDGSRERFDALLLGTGFRFHLPFLSRDLCELINLQEKSMGLYAQTLHPQLPGLAFIGFYGLIGPYWPVLELQARWLAGCWGDATQLPDRETMQAAINAQAARPLPAEGVPMQGMALQFARLAGVEPTLSRWPELERALLFGPLSPASFRLEGPDALAEAPQRTLAAAACFGHQADTVLRPEEAGLRDALSQPAREAVPLP

SEQ ID NO: 46198 - protein, 491 aa, Candida albicans SC5314
MAPKLNNPNLFQNKPFINGQWYDSKSTSTFKVYDPATQELIIELPDQTPEEIDEAIAITHKAFQTYQRTPVYERAKWLRRMYELMIENLQDLATLITWENGKCLADALGEIKYAASYFEWFSEECKRNYGHTIQPSNQNNKVITYKQPVGPVGLLCPFNFPSAMGARKAAPALAAGCTCILKPDGQTPLSSLALAYLAQQAGFPDGCFNVVLTSVTNTPMCGLKFCQSPKLKKISFTGSTNVGKLLMQQSSSTLKKLSMELGGNAPIIVFNDCNLDLAVDQSITSKFRSLGQTCVCANRIYVEKGVYDEFCNKFVEKVNQFKIGNGFEPGVTHGCLINTKAIEKVEDHVQDAVEKGAKLIVEGGRLPQLGENFYSPSVVKDVTQDMKVVKEETFGPLAAIIPFDSKEQVLQWCNDTPYGLASYIFSENLNTVWYMSEFLENGMVSVNTGLFTDAALPFGGVKESGFGREGSLYGMDDYTVIKSITLGNVYN

SEQ ID NO: 46199 - protein, 373 aa, Zea mays
  misc_feature (145)..(145): Xaa can be any naturally occurring amino acid
  misc_feature (358)..(358): Xaa can be any naturally occurring amino acid
MSAPLLPLAAWLACLCLCIDQVGTSGGGPRRAPTEAKLKVAINGFGRIGRNFLRCWHGRGDDSPLDVIAINDTGGVKQASHLLKYDSTLGIFDADVEPVGDNAISVDGKVIKVVSDRNPSNLPWGELGVDLVIEGTGIFIDREGXGQAGAKKVLITAPGKGDIPTYVVGINADQYNPDEPIISNASCTTNCLTPFVKVLDQKFGIIKGTMTTTHSYTGGQRLLDASHRDLRRARAAALNIVPTSTGAAKAVVLVLPNLNGKLNGITLRVPTPNVSVVDLVVQVSRKTLAEEVNQAFRDAAANELQGILEVCDVPLVSVDFRCSDVSSTIDASLTIVMGDDMVKVISWYDNEWGYSESXQRVIDLADICANQWK

SEQ ID NO: 46200 - protein, 1318 aa, Yersinia pestis biovar Microtus str. 91001
MGVKLDEATRDRIKSAAQRIDRTPHWLIKQAIFNYLEKLESNSELPELATTSSLSLQDTEDAIPQLTENTHQPFLDFAEHVLPQSVTRAAITAAYRRPETEAIPMLLEQARLPADLAQATHKLAYSIAEKLRNQKSAHGRAGMVQGLLQEFSLSSQEGVALMCLAEALLRIPDKPTRDALIRDKISNGNWHSHLGRSPSMFVNAATWGLLFTGRLVSTHNEAKLSGSLNRIIGKGGEPLIRKGVDMAMRLMGEQFVTGETISEALANARKLEDKGFRYSYDMLGEAALTEADAQAYLLSYQQAIHAIGKASNGRGIYEGPGISIKLSALHPRYSRAQYERVMDELYPRLLSLTLQARQYDIGINIDAEEADRLEISLDLLERLCFEPQLAGWNGIGFVIQAYQKRCPSTIDAVIDMAQRSRRRLMIRLVKGAYWDSEIKRAQIDGLEGYPVYTRKVYTDVSYLACARKLLAVPNLIYPQFATHNAHTLSAIYHLAGQNYYPGQYEFQCLHGMGEPLYEQVVGKVAEGKLNRPCRIYAPVGTHETLLAYLVRRLLENGANTSFVNRIADATLPLDELVADPVSAVEAMAAAEGQLGLPHPRIPLPRELFGKDRANSSGVDLANEHRLASLSSALLASASQVWRAEPVIDAEQDNGDALPVINPAEPADVVGYVREATEGEVSRALDAAARAGAIWFATPPAERAAILIRAAELMENQMQTLMGILVREAGKTFSNAIAEVREAVDFLHYYAGIVRDNFANDSHRPLGPVVCISPWNFPLAIFTGQVAAALAAGNSVLAKPAEQTPLIAAQAVRILLDAGIPQGVLQLLPGRGDSVGALLVNDARVRAVMFTGSTEVATILQRSIAGRLDPQGRPTPLIAETGGLNAMIVDSSALTEQVVTDVVASAFDSAGQRCSALRILCIQDDVAEHTLQMLRGAMAECRMGNPERLSTDIGPVIDAEAKTGIERHIQAMRAKGRKVYQAARTNSLDEKEWQRGTFIKPTLIELDSFDELQKEVFGPVLHVVRFQRQHLNELVDQINASGYGLTLGIHTRIDETIARVTEKAKVGNLYVNRNMVGAVVGVQPFGGEGLSGTGPKAGGPLYLYRLLSSRPDDALANTLAHQDGEQQQNVAGREALLTAHRAFTQWATEQQHDSLATLCQRYASLAQGGTVRLLPGPTGERNTYALLPRERVLCLADTESDTLTQLAAVLATGSQVLWPENDVQKALLPQLPTEVQSRITLTHDWQTANITFDAVIYHGDADQLRTLCEQVAQIDGPIVSVQGFARGETNILLERLLIEHSLSVNTAAAGGNASLMTIG

SEQ ID NO: 46201 - protein, 421 aa, Azoarcus sp. BH72
MSPTQPFNLLYAQAGGVTAVINASAAAVIEAAREHPQAIGTVYGARNGILGVLSETLVDTTPLTPAELAQLALTPGGAFGSCRFDLDPAEANPAQYDRLFEVFASYRIGAFLYNGGNGSMDIVARVAAAARARAYPLCCIGVPKTVDNDLEGTDCSPGFGSAAKYLATAMRESGLDLAAMSSRRGRVFVMEVMGRNAGWLAAATALAARNEDEPPHIVLLPEVAFDEEAFLARVKAVVERLGYCAVTVAEGIRRADGTLVMEQSHDALGHVQLGGAGQCVARLVSARFDYKHHWAIPDYLQRAAGHWRSATDVAQARAVGRAAVAYALAGQDGVMPAIRRLADEPYRWDVQPVRVEEIANLERRVPPHFIAADGLHVTAAAKAALAPLIEGELPVPTHAGLPDYFQLQLAPQPRRLPAWTR

SEQ ID NO: 46202 - protein, 864 aa, Zea mays
MLSGIIDGLTGANKHARLKGTVVLMRKNVLDLNDFGATVVDSISEFLGKGVTCQLISSTLVDANNGNRGRVGAEANLEQWLTSLPSLTTGESKFGVTFDWEVEKLGVPGAVVVKNNHAAEFFLKTITLDDVPGRGAVTFVANSWVYPAGKYRYNRVFFSNDTYLPSQMPAALKPYRDDELRNLRGDDQQGPYQEHDRVYRYDVYNDLGEPDGGNPRPILGGSADHPYPRRCRTGRKPTKTDPNSDSRLSLVEQIYVPRDERFGHLKMSDFLGYSIKAITQGIIPAVRTYVDTTPGEFDSFQDIINLYEGGIKLPKIQALEDMRKLFPLQLVKDLLPAGGDYLLKLPIPQIIQEDKNAWRTDEEFAREVLAGVNPMVITRLTEFPPKSTLDPSKYGDHTSTITAEHIEKNLEGLTVQQALDGNRLYILDHHDRFMPFLIDVNNLEGNFIYATRTLFFLRGDGRLAPLAIELSEPYIDGDLTVAKSKVYTPASSGVEAWVWQLAKAYVAVNDSGWHQLVSHWLNTHAVMEPFVIATNRQLSVTHPVHKLLSSHFRDTMTINALARQTLINGGGIFEMTVFPGKYALGMSSVVYKSWNFTEQGLPADLVKRGVAVADPSSPYKVRLLIEDYPYASDGLAIWHAIEQWVGEYLAIYYPDDGALRGDEELQAWWKEVREVGHGDHKDAPWWPKMQAVSELASACTTIIWIASALHAAVNFGQYPYAGYLPNRPTVSRRRMPEPGSKEYEELERDPERGFIHTITSQIQTIIGISLIEILSKHSSDEVYLGQRDTPEWTSDARALAAFKRFSDALVKIEGKVVGENRDPQLRNRNGPAEFPYMLLYPNTSDHSGAAAGLTAKGIPNSISI

SEQ ID NO: 46203 - protein, 452 aa, Lactobacillus plantarum WCFS1
MKVAIIGCTHAGIAAMKQILKYYPGTEITVYERHADISYMSCGTYLHLGGTIHNLDQALYANPSEFSEQGVQMRMQYDVINVNADKHTILAQNLQTKELQTDHYDKLVMATGSITAIPAIPGVENPKVMLCKTCEQAQQLYEAAKHAHHIAIVGGGYSGVELAEGYVKSGHTVTLFQRGPHLINEYLDPQISEKIEDLLTTKGIQVRTNAQVTAFSDTADNRLRVATADSEEIFDMAVICPGVIPQSELLAGQVNRTKQGAIVTDRYMGTSNPDIFAAGDVTEVNFNPTKEHAYMPLVSHAIRQGALAGINIFDKRLGAIGTQATTGMLIFDQTVACAGLTLTAAKAANFDAQAAFYEGNYRPDFMPTTAKVMIELVYDQQTRKVLGGQLMSAHEVSQSANTLSVVIHNGNTIDELAFMDMLFSPNFDEPFNYLNLVAQAAVDQEHGYRRNN

SEQ ID NO: 46204 - protein, 372 aa, Escherichia coli CFT073
MKYDLIIIGSGSVGAAAGYYATRAGLNVLMTDAHMPPHQHGSHHGDTRLIRHAYGEGEKYVPLVLRAQMLWDELSRHNEDDPIFVRSGVINLGPADSAFLANVAHSAEQWQLNVEKLDAQGIMARWPEIRVPDNYIGLFETDSGFLRSELAIKTWIQLAKEAGCAQLFNCPVTAIRHDDDGVTIETADGEYQAKKAIVCAGTWVKDLLPELPVQPVRKVFAWYQADGRYSVKNKFPAFTGELPNGDQYYGFPAENDALKIGKHNGGQVIHSADERVPFAEVVSDGSEAFPFLRNVLPGIGCCLYGAACTYDNSPDEDFIIDTLPAHDNTLLITGLSGHGFKFASVLGEIAADFAQDKKSDFDLTPFRLSRFQ

SEQ ID NO: 46205 - protein, 330 aa, Kluyveromyces lactis NRRL Y-1140
MLGLKSHHKELIKLSRNCVPKLTPQLYKGQCGKICVVGGCEEYTGAPYFSAHAASIFGSDLVYLLCEKRAGLPIKGYSPNLMVHPYLGDTYSSTHGFQFEFEKVASVVQRCHVLVVGPGLGRDEQIMQEVLQLVEEAPSLGDDNDRCLVLDADGLFLLASENHTERMQKALKGYGDNRVVITPNAVELKRIMNALNVDSVEKVSEKLGCITVAKGQNDIIVNSQGERWENDVQGSMKRCGGQGDTLTGIIATMFGFSRAVHDFKLETIVEEGNGENLPWSKMAMLSCFIGSTATRMASRAAYDKVGRQLQTTDMNNMVGEVFNELYPPSQ

SEQ ID NO: 46206 - protein, 162 aa, Oryza sativa (indica cultivar-group)
MPVAAAMLSTAIRKMFDKYPSIDHGGVIELPHQISSGIFPKVKEYCTKHAKVDDKGNPTVSTNTGAAAAASSSSTDDEEEDLKNWDKEFVNMEVKPLHDLLLVAHLLDIKGLFDITCRKVADMLKGKTSEEMRQILNIRNDFTEEEDKAIKEQNPWVFPDPE

SEQ ID NO: 46207 - protein, 192 aa, Oryza sativa (indica cultivar-group)
MISVECSDGKTFDMPLAAAMLSTVIRNSCKIVDDESDSDKPSGDGEITMVKLPHQVPSTIFPEVKKYCMKHAKVDEKGNSTATVFTNTGAAAASSSSTSVPDDDPTATEEEVLKNWDKEFVNVDQWPLYNLLIAAHFLDIQGLFDIASQKVADMLKGKNSQEMRDTLNIANDFTADEQQAIRALNPWAFPNP

SEQ ID NO: 46208 - protein, 182 aa, Chlorella vulgaris
EASGDAVVGIVTERDYLTKVVVKDQSSKDLAVSQIMTDKSKLMTATPQQSVVDVMKLMTENNFRHVPVVHEGKYLGMVSIRDVVHVVVEEHKEEVGPPARVHPGILLSRHAATRGCPKGEWQYASQINPFIGVPCMSCKSPCWGWCHCAILPGKQTGQVQMMNRLSQESLTCASSDESRLGA

SEQ ID NO: 46209 - protein, 541 aa, Oryza sativa (indica cultivar-group)
MSAAHLLRHSRKLRSLHNALDCERSGLVRYFSTASGSFPTKGNGAEKRIGGARFPQRKQPGKELETSKLSLGLNGSYTCRRSPNNFIPNTITGLNGSLSCGQIASARSFSSSADLPPHQEIGMPSLSPTMTEGNIARWLKKEGDKVSPGEVLCEVETDKATVEMECMEEGYLAKIIHGDGSKEIKVGEIIAVTVEEEGDIKKFKDYKPSTLAAPVAPSELKAQSELTEPKVEEREPSKASEPKAPRTEEPSRSGDRIFSSPLARKLAEDNNVPLSNVKGTGPDGRILKADIEDYLAKGCRKEALAAPGLSYTDVPNAQIRKVTANRLLSSKQTIPHYYLTVDTRVDNLIKLRGELNPLQESSGGKKISINDLVIKAAALALRKVPQCNSSWMNDFIRQYHNVNINVAVQTEHGLFVPVIRDADKKGLGMIAEEVKQLAQRARDNSLKPDDYEGGTFTISNLGGPFGIKQFCAIINPPQSAILAIGSAERRVIPGSANGQYEFGSFMSATMSCDHRVIDGAIGAEFLKAFKGYIENPTSMLL

SEQ ID NO: 46210 - protein, 666 aa, Xanthomonas axonopodis pv. citri str. 306
MTQPTRRQLANAIRFLAADAVEAAKSGHPGMPMGMADIAEVLWNDFYRHNPNNPQWFNRDRFVLSNGHGSMLQYALLHLSGYDLPIEQLKQFRQLHSKTAGHPERSETPGVETTTGPLGQGFANAVGFALAEKLLAQRYNRPELEIVDHRTWVFMGDGCLMEGISHEAASLAGTWGLGKLVAFWDNNQISIDGNTAGWFSDDTPARFEAYGWHVIRDVDGHDADKIKAAIETALENTDKPTLICCRTKIGFGAPTKAGKESSHGAPLGKDELEGARKALEWPYGPFEIPEEIYAGWRAGGTGTLRQAEWEQLFDKYAKQYGAQADELTRRSHGELPADFIAKADAYIAKAQEEGQTIASRKASQLAIEAFAPLLPELIGGSADLAHSNLTLWKASKSVATDDPDANYVYYGVREFGMTAIANGLALHGGFIPFDATFLVFSDYARNGVRMSALNPAHAIHVYTHDSIGLGEDGPTHQPVEHLASLRYIPNNDVWRPGDAVESAVSWKAAITRKDGPSCLIFSRQNLQHQPRSAEQLKLIERGGYVLADAEGGTPDVILIATGSEVGLAVEAKKTLDAAGLKTRVVSMPSTDVFDRQDAAYRESVLPNAVRKRVAVEAGVTGFWRKYVGLDGDVVGMDTFGASAPADQLYAYFKITAEHVVAAAKAL

SEQ ID NO: 46211 - protein, 201 aa, Oryza rufipogon
GVLPSDQEIAVKRLSQSSRQGIEELKNELVLVAKLQHKNLVRLLGVCLEEHEKLLVYEYMPNKSLDTILFDPDRSNVLDWWKRLKIVNAIARGLQYLHEDSQLKIIHRDLKASNVLLDSDFNPKISDFGLARLFGNDQSQDVTNRVVGTYGYMAPEYAMRGHYSIKSDVFSFGVPILEIVTGRKNNVSYDSEQSVDLLTLV

SEQ ID NO: 46212 - protein, 418 aa, Cryptococcus neoformans var. neoformans B-3501A
MSPYRLIEYDVGQPLYGVGFSNSVSHPHRVALTSLVTGPTNKLYIADLSHPPDTQPSSPYYPQANNGSSGPSHPPPAYRQLTSTNINLPATKVGWEPEGSVRVDQGGRGELVATTGESLHLWEVAKGWTEGSGHVGHNGWGNERYTLKSRSILSNTKGAHGSLPPVTSFSWNNKSPNKIVTCSIDTTATLWDINTAQAMTQLIAHDRAVYDLCWLPDSSDIFVSVGADGSLRAFDLRQLEHSTILYESSRDAPLARIAFSKKEQHMLACFGLDDSKILILDMRSPGKPVAELIGHQAPLGAIAWGSGGTRGRRESTGGGWLASCGDDSQLLLYDLTAPLPTSRSSSRSNFRNSNATSPYVFSPSATPSSQRTPSPADAVEMMPAKGWTARGEINNLAFTNDGDWVGCVTGTTLKVLHV

SEQ ID NO: 46213 - protein, 489 aa, Bacillus cereus ATCC 10987
MPQDRKAEVQKHAYERKEIMPDNSQSLPRHMQKELPHEFSVNPLFAREGESVVPRFHISDEGMLPETAYQIVHDEITLDGNARLNLATFVSTWMEPAAEQLYAKSFDKNMIDKDEYPQTAEIEERCVRILANLWHSPSPLTTMGVSTTGSSEACMLGGLALKRRWQNARKSEGKPLDRPNIVFSSAVQVVWEKFANYWEVEPRYVKVSPEHPQLDPQGVLAAVDENTIGVVPILGETYTGLYEPVAEIAKALDDLQARTGLDIPMHVDAASGGFIAPFLQPDLVWDFQLPRVKSINVSGHKYGLVYPGLGWIIWREAEDLPEDLIFRVSYLGGNMPTFALNFSRPGAQVLLQYYNYLRLGKSGYYDIQRASQKVALFLSKAIQKMEPFELLSDGSDIPVFAWRLKEGYTSNWNLYDLSRQLRVFGWQVPAYPLPPDMESVTIMRVVVRNGFSMDLAHLFLRNLKQTVAFLDSLDGPMPHDTKCNNGFHH

SEQ ID NO: 46214 - protein, 205 aa, Pseudomonas syringae pv. syringae B728a
MNSQPLRVGIGGPVGSGKTALTLALCLALRDRYNLAVVTNDIYTREDADFLVRNEALAPERIIGVETGGCPHTAIREDASINLEAVDQLNRRFEGLDLIIVESGGDNLSATFSPELSDLTIYVIDVSAGDKLPRKGGPGICKSDLLVINKIDLAPLVGASLEMMDSDTRRMRGEKPFVFSNQKTGQGLEQIIAFIERQGLLTAAA

SEQ ID NO: 46215 - protein, 480 aa, Pseudomonas syringae pv. phaseolicola 1448A
MQLKDSTLFRQQAYINGQWLDADGGQSIKVNNPANNEILGTVPKMGAAETRRAIEAADKALPAWRALTAKERGNKLRRWFELMIENQDDLGLLMTLEQGKPLAEAKGEITYAASFIEWFAEEAKRVYGDVIPGHQPDKRLIVLKQPIGVTAAITPWNFPAAMITRKAGPALAAGCTMVLKPASQTPFSALALAELAERAGIPAGVFSVVTGSAGDIGAELTGNPIVSKLSFTGSTDIGRQLMAECAKDIKKVSLELGGNAPFIVFDDADLDKAVEGAMISKYRNNGQTCVCANRIYVQDAVYDAFAEKLKAAVGKLKIGNGLEDGVTTGPLIDDKAVAKVKEHIADAVSKGATVLTGGNSLEGSFFEPTILVNVSKDAAVAREETFGPLAPLFRFKDEAEVIAMANDTEFGLASYFYAQNMSRVFRVAEALEYGMVGINTGLISNELAPFGGIKSSGLGREGSKYGIEDYLEIKYLCLSV

SEQ ID NO: 46216 - protein, 135 aa, Saccharomyces cerevisiae
ARTKQTARKSTGGKAPRKQLASKAARKSAPSTGGVKKPHRYKPGTVALREIRRFQKSTELLIRKLPFQRLVREIAQDFKTDLRFQSSAIGALQESVEAYLVSLFEDTNLAAIHAKRVTIQKKEIKLARRLRGERS

SEQ ID NO: 46217 - protein, 102 aa, Saccharomyces cerevisiae
SGRGKGGKGLGKGGAKRHRKILRDNIQGITKPAIRRLARRGGVKRISGLIYEEVRAVLKSFLESVIRDSVTYTEHAKRKTVTSLDVVYALKRQGRTLYGFGG

SEQ ID NO: 46218 - protein, 174 aa, Glycine max
VFVCLKCCGVHRSLGSQISKVLSVTLDEWSSDEIDAMIEVGGNSSANSIYEAYFPEGFTKPGPDATHDQRVKFIRLKYEHQEFLQPSLRIVSGKSNPPKSISKGIMDSFRITSDSQHMEGMVEFIGMLKVKVIKGTDLAIRDMMTSDPYVIFKLGQQTVQTTVIKSNLNPVWNE

SEQ ID NO: 46219 - protein, 595 aa, Pseudomonas putida KT2440
MCGLAGELRFTPIDQAPRPADLAAVERITHHLAPRGPDAWGFHSQGPIALGHRRLKIMDLSDGSAQPMVDNTLGLSLAFNGAIYNFPELREELQALGYSFWSDGDTEVLLKGYHAWGAALLPKLNGMFALAIWERDNQRLFLARDRLGVKPLYLSRNGERLRFASTLPALLKGGDIDPMLDPVALNHYLNFHAVVPAPRTLLANVQKLEPGTWMRIDRHGEVERQVWWQLHYGPHPDERELDLEGWTTRVLDATRDAVAIRQRAAVDVGVLLSGGVDSSLLVGLLREVGVDDLSTFSIGFEDAGGERGDEFQYSDLIAKHYGTRHHQLRIAEHEIIDQLPAAFRAMSEPMVSHDCIAFYLLSREVAKHCKGVQSGQGADELFAGYHWYPQVDGADDAYAAYREAFFDRSHAEYRDTVQAPWLLETDAAGDFVREHFARPGAPAAVDKALRLDSTVMLVDDPVKRVDNMTMAWGLEARTPFLDYRLVELSARIPARFKLPDGGKQVLKQAARRVIPHEVIDRKKGYFPVPGLKHLEGATLGWVRELLTDPSQDRGLFNPTMLDRLLSNPHGQLTPLRGSKLWQLAALNLWLSEQGI

SEQ ID NO: 46220 - protein, 741 aa, Spinacia oleracea
MAASSSLSTLSHHQTLLSHPKTHLPTTPASSLLVPTTSSKVNGVLLKSTSSSRRLRVGSASAVVRAAAVEALESTDIDQLVEKSVNTIRFLAIDAVEKANSGHPGLPMGCAPMGHILYDEIMRYNPKNPYWFNRDRFVLSAGHGCMLQYALLHLAGYDSVLEEDLKTFRQWGSRIPGHPENFETPGVEVTTGPLGQGIANAVGLALAEKHLAARFNKPDAEIVDHYTYVILGDGCQMEGIAQEACSLAGHWGLGKLIAFYDDNHISIDGDTAIAFTESVDLRFEALGWHVIWVKNGNTGYDEIRAAIKEAKTVTDKPTLIKVTTTIGFGSPNKSNSYSVHGSALGSKEVEATRQNLGWPYEPFHVPEEVKKHWSRHTPEGASLEAEWNTKFAEYEKKYPEDATEFKSITTGEFPAGWEKALPTYTPETPGDATRNLSQQCLNALAKVIPGLLGGSADLASSNMTLLKMFGDFRRTHRKKETFRFGVREHGMGAICNGICLHSPGFVPYCATFFVFTDYMRGAMRISALSEAGVIYVMTHDSIGLGEDGPTHQPIEALSKFPAMPNILMLRPADGNETAGSYKVAVENRKTPSILALSRKKLPNLPGTSIEGVEKGGYTITDNSSGNKPDVILIGTGSELEIAAKAGDELRKEGKAVRVVSFVSWELFEKQSDEYKESVLPSDVTARVSIEAGSTFGWHKIVGSKGKAIGIDKFGASAPAGKIYQEYGITVEAVVEAAKSVC

SEQ ID NO: 46221 - protein, 490 aa, Avena strigosa
MDLLADAKPQWLLAGAALLLATLAFLKVLFGSGGGGKRAPPTIPGAPVVGGLLRFLKGPIPLIRAEYARLGSVFTVPILTRRITFLIGPEVSGHFFKGNESEMSQQEVYRFNVPTFGPGVVFDVDYLVRQEQFRFFTEALKSNKLRSYVDMMVAEAEDYFSTWGESGTVDLKYELEHLIILTASRCLLGREVREKLFDDVSALFHDLDNGMQPISVIFPYLPIPAHRKRDQARARLAEIFATIIKSRKASGQSEEDMLQCFIDSKYRNGRPTTEIEVTGLLIAALFAGQHTSSITSTWTGAYLLKFQQYFAEAVEEQKRVMKRHGDKIDHDILAEMDVLYRCIKEALRLHPPLIMLLRQSHTDFSVTTREGKEYDIPKGHIVATSPSFANRLPHIFKNPDSYDPDRFAPGREEDKAAGAFSYISFGGGRHGCLGEPFAYLQIKAIWTHLLRNFEFELVSPFPENDWNAMVVGIKGEVMVNYKRRKLVVDN

SEQ ID NO: 46222 - protein, 405 aa, Xanthomonas campestris pv. vesicatoria str. 85-10
MSRIVNEVVIPSVLQDGSVRPPESRKQNLLDLDREGLERFFADTLGEARYRAHQVMKWIHHRYVTDFDQMTDLCKALRAKLHQHAEVLVPNVVFDKPSADGTHKWLLAMGADGKNAIETVYIPDKGRGTLCVSSQVGCGLNCTFCSTATQGFNRNLTTAEIIGQVWVAARHLGNVPHQQRRLTNVVMMGMGEPLMNFDNVVRAMSVMRDDLGYGLASKRVTLSTSGLVPMIDRLSTESDVSLAVSLHAANDTLRESLVPLNKKYPIAELMESCARYLRGSKKRDSVTFEYTLMKGINDQPEHARQLARLMRQFDNAVQSKDAGKVNLIPFNPFPGTRYERSGETEIRAFQKILLDAQVLTMVRRTRGDDIDAACGQLKGQVMDRTRRQAEFRRTLEGQADRDAAA

SEQ ID NO: 46223 - protein, 490 aa, Avena strigosa
MDLLADAKPQWLLAGAALLLATLALLKVLFGSGGGGKRAPPTIPGAPVVGGLLRFLKGPIPLIRAEYARLGSVFTVPILTRRITFLIGPEVSGHFFKGNESEMSQQEVYRFNVPTFGPGVVFDVDYLVRQEQFRFFTEALKSNKLRSYVDMMVAEAEDYFSTWGESGTVDLKYELEHLIILTASRCLLGREVREKLFDDVSALFHDLDNGMQPISVIFPYLPIPAHRKRDQARARLAEIFATIIKSRKASGQSEEDMLQCFIDSKYRNGRPTTEIEVTGLLIAALFAGQHTSSITSTWTGAYLLKFQQYFAEAVEEQKGVMKRHGDKIDHDILAEMDVLYRCIKEALRLHPPLIMLLRQSHTDFSVTTREGKEYDIPKGHIVATSPSFANRLPHIFKNPDSYDPDRFAPGREEDKAAGAFSYISFGGGRHGCLGEPFAYLQIKAIWTHLLRNFEFELVSPFPENDWNAMVVGIKGEVMVNYKRRKLVVDN

SEQ ID NO: 46224 - protein, 213 aa, Cenarchaeum symbiosum
MDISVKQMYNIEENGHAMGFLKKFMMENAGAAAARLLDERLEGAPRVLAFAGMGNNGGDALVAARHLAGRGADVTVVLLGNPDGIRTEEARWNWSILEKMPSIKLVSGGSFDASVSPDAIIDGILGTGITGEIREPYLSAIKFINGIQCTKMAIDAPSGLDPQTGEAADPCVKVDFTVTFHRMKEGIPKRKDLTGDVTVQKIGIPPEAEKGVL

SEQ ID NO: 46225 - protein, 159 aa, Oryza sativa
MDSEHWISRLAAAKRFYAAQLGHADRAGMEEVDMDEEVRPEFACPYCYEDHDVVSLCAHLEEEHPFEPHAAPCPICSDKIAKDMRYHITVQHGYLFKNRRRLRRFVIPGSQALSLLSRDLREAHLQVLLGRGGHRSNNRRKTKNNLGDPFCHRWLNFQF

SEQ ID NO: 46226 - protein, 130 aa, Agaricus bisporus
MVRISVLNDCLKSICNASRRGKRQVIVRPSSKVVVKFLSVMQRHGYIGEFEIIDDHRGGKIIVQLNGRLNKTGVISPRFNVQHNRIEQWINYLLPSRGIGIIVLTTSSGILDHEEARRKNVGGKLLGYVY

SEQ ID NO: 46227 - protein, 788 aa, Cryptococcus neoformans var. neoformans B-3501A
MATNDAGASVMPVANVQINYEEESAKIEDFLARYVAGPRPRRDQSALPADDDSAAEDASEDEDDLADGMGGLNVQGAGRTKFKYLRMLREVANRRREDIVIDLKDLKRHSNDLSLLHNIQNNTRRYIQLFSDVIDKIMPPPDNEVDYTDDVLDLIMQQRREMNAQVEAGERNADAGMFPPELMRRYNVYFRPLRSDDVLAVRAVRGAHLGKLITVRGIVTRVSEVKPLLIVNAYTCDSCGNEIFQEITQKHFAPLTVCPSDVCVRNQTNGQLHMQTRASRFRPFQEVKIQEMADQVPVGHIPRSMTIHLYGALTRSVNPGDVVHIGGIFIPTPYTGMRALRAGLLQDTFLEAMHVHQLKKQYHAMESTPEIQEAIADLKSDPALYARLANSIAPEIYGHEDVKKALLLLLVGGVTNSRKDGMKIRGDINVCLMGDPGVAKSQLLKYITKVAPRGVYTTGRGSSGVGLTAAVMRDPVTDEMVLEGGALVLADNGICCIDEFDKMEESDRTAIHEVMEQQTISISKAGITTTLNARTSILAAANPLYGRYNPKISPVENINLPAALLSRFDVLFLILDSPTREDDERLAQHVCFVHMHNTHPELDFEPVEPTLMRHYIAECRKIEPRVPQALSEYIVSSYVQMRKQQQEDEAEEKSHSYVSARTLLAVLRLSQALARLRHDDIVQQGDVDEALRLMDVSKASLYEHSQQRNGEDQTSTSKIFRIIKDMAQRAADEDDDEEMGELAMMDVRNRVIAKGFTEMQLMETILEYENMDVLMRTANGSRLQFVTV

SEQ ID NO: 46228 - protein, 963 aa, Oryza sativa (indica cultivar-group)
MAAPPKAWKAEYAKSGRSSCKSCRSPIGKDQLRLGKMVQATQFDGFMPMWNHASCILRIDTLRWDDQEKIRNYVGSAPATASSAAAISDKCTIEVAKSARTSCRRKMFDDPEVLLVMHLANNVRVSSKLEGQGWYHASCFLEMSPAATVENFSGWEILSHEDKRAVLDLVKKDAPSSGQTSSKGSKRKNNQNDIHDCKAPKIIRSISEGTAQDKGKAVVSHDSNANSSDLQEKLKEQSDTLWKLKDELKKHVSTAELRNMLEANGQDTSGPERHLLDRCADGMLFGALGTCPVCSSFLYYHGGQYHCSGYVSEWSKCTYSTTEPVRSKKKWKIPDEMDNGYLTKWFKSQKAKKPERVLPPMSPEKSLCQSTQQNRSFLSEGLDKLRVSIVGQSKDVVDEWKQKLKDAGANFNATVTKDSSCLVLCSELESENAEVKKARRLKIPILREGYLGECIRKNRVLPFDLYKVEAALESSKGGTMTVKVKGRSAVHESSGLQDTGHILEDGKSIYNTTLNMSDLTREDNGSDCYVFRKWGRVGNEKIGGTKLEEMSKIDAIQEFRRLFLEKTGNPWEAWEQKTNFQKQPGKFYPLDIDYGVRQGPKRKDIDKMKSSLPPQLLELMNMLFNIETYRAAMLEFKINMSEMPLGKLSKENIQKGFEALTEIQNLLGNTNNQELAVRESLIVAASNRFFTLIPSIHPHVIQDEDDLMVKIYFLLSIVTLFRDPIDCNFGAMVQVKMLEALQDIEIASKLVGFDSDNDESLDDKYKKLRCAITPLPHDCEDYKLVEKYLLNTHAPTHKAYSTIQTIVSVFFCIGSRLTNYVGILSQGLRIAPPEAPVTGYMFGKGLYFADLVSKSAQYCYVDRKNPVGLMLLSEVALGDMYELKKATSMDKPPRGKHSTKGLGKTVPLESEFAKWRDDVVVPCGKPVPASIKTSELMYNEYIVYNTSQVKMQYLLKVRFHHKR

SEQ ID NO: 46229 - protein, 433 aa, Fusobacterium nucleatum subsp. vincentii ATCC 49256
MYKTQMEAAKKGILTKEMKSIAESESMDEKVLMERVAKGEIAIPANKNHSSLLAKGVGNGLSTKINVNLGISKDCPDVDKELEKVKVAIDMKADAIMDLSSFGKTEEFRKKLITMSTAMVGTVPVYDAIGFYDKELKDIKAEEFLDVVRKHAEDGVDFVTIHAGLNREAVNLFKRNERITNIVSRGGSLIYAWMELNNAENPFYENFDKLLDICEEYDMTISLGDALRSGCLNDATDACQIKELITLGELTKRAWKRNVQIIIEGPGHMAIDEIEANVKLEKKLCHNAPFYVLGPLVTDVAPGYDHITSAIGGAIAAAAGVDFLCYVTPAEHLRLPNLDDMKEGIIASRIAAHAADISKKVPNAIDWDNRMAKYRADIDWEGMFTEAIDEEKARRYRKESTPENEDTCTMCGKMCSMRTMKKVMSGEDVNILK

SEQ ID NO: 46230 - protein, 201 aa, Oryza rufipogon
GVLPSDQEIAVKRLSQSSRQGIEELKNELVLVAKLQHKNLVRLLGVCLEEHEKLLVYEYMPNKSLDTILFDPDRSNVLDRWKRLKIVNAIARGLQYLHEDSQLKIIHRDLKASNVLLDSDFNPKISDFGLARLFGNDQSQDVTNRVVGTYGYMAPEYAMRGHYSIKSDVFSFGVLILEIVTGRKNNVSYDSEQSVDLLTLV

SEQ ID NO: 46231 - protein, 514 aa, Triticum aestivum
MEAIAGDVHAHGYGWAGVWSAAASLIFLWSMVQQHLPAQLEEYLAALSRRLQAAITPYVTISIDEHVPASFGRSEAYLAAEAYLSATCASAARRLRADLAADSDRMSVAVDDHEEVADDFRGAKLWWRKTKTLPRGNVISWSAHEEERRTYCLTFHRRHRGLVDALYLPHVLAEGRAATVRNRQRRLFTNNPSSDWSGYDARVWSHVKLEHPSTFATLGMHPDKKRDIIDDLDMFRDGKDYYASVGKAWKRGYLLFGPPGTGKSTMIAAMAKYLDYDVYDLELTSVKNNTELRRLFIETKGKSIIVVEDIDCSLDLTGKRKKKKKKPNKKKSKSGDKKKKAPPAPGAGKDEENKVTLSGLLNFIDGLWSACGGERIIVFTTNHKEKLDPALIRRGRMDVHIEMSYCCFESFKVLAKNYLHVDDHELFHEIRQLLGAVNMTPADVAENLMPKSKKKDVDTSLARLVKALKEAKEEALAKALAGAEHEEGAEDDDEEEDDSSSSSEEEENGKKKEE

SEQ ID NO: 46232 - protein, 497 aa, Staphylococcus xylosus
MELVKNLSRRQFIDGEWVESSNKETRKIINPFNQEVIFEVAEGTADDSERAILAARRAFEDGEWANETSENRGKKVRAISDLIVKHREELAKLETLDTGKTLEESYADMDDIANVFNFFAGLADKDGGEIIDSPIPNTESKVIKEPIGVVTQITPWNYPLLQASWKIAPALASGCSLVMKPSEITPLTTIRVFELMEEVGFPQGVINLVLGKGSEVGEPLSAHKEVDLVSFTGGIQTGKHIMKNAADHVTNIALELGGKNPNIIFDDADFDLAVDQALNGGFFHAGQVCSAGARIIVHNDIKEKFEAALIERIKNIKLGNGFDEDTEMGPVISAEHREKIENYMEVAKSENATIAIGGKRPEREDLQDGFFFEPTVITDCDTSMRIVQEEVFGPVVTIESFTTEAEAIKLANDSIYGLAGGVFTNDVGKAQRIANKLKMGTVWINDFHPYFAQAPWGGYKQSGIGRELGKAGLAEYQEEKHILRNTNPEPVNWFGKA

SEQ ID NO: 46233 - protein, 240 aa, Ehrlichia chaffeensis str. Arkansas
MSLLIVANWKMYGDFLTFSSFTKELSANLVNVKADVEVVLCPPFIACSKIVDCAPNIKLGAQNCFYESEGKYTGEVSAKMLYSCGCSYVIVGHYERRSIFYESDYCVQLKAKSAIDAGLIPIICIGETLLDRENGMLKNALLDQCYNSFPKHGEFVIAYEPVWAIGSNTIPSIDMITESLDIIRSYDSKSNIIYGGAVNQSNIKDVIAINQLSGVLVGSASLKVSSFCDIIYGAVNVRQN

SEQ ID NO: 46234 - protein, 533 aa, Oryza sativa
  misc_feature (35)..(35): Xaa can be any naturally occurring amino acid
  misc_feature (58)..(58): Xaa can be any naturally occurring amino acid
MEAVGVAPAPAGVPEKKLLEVKESRKAAPAAPSTXSMAAKWAMKKKLVGGDAGYVLEXDVPHLTDYLPELPTYPNPLQDNPAYSVVKQYFVNTDDTVTQKIVVHKTSARGTHFRRAGPRQRVYFQSDEVNAAIVTCGGLCPGLNTVIRELVCGLYDMYGVTSVVGIEGGYKGFYSRNTVALTPKSVNDIHKRGGTVLGTSRGGHDTGKIVDSIKDRGINQVYIIGGDGTQKGASVIYEEVRRRGLKCSVVGVPKTIDNDIAVIDKSFGFDTAVEEAQRAINAAHVEAESAENGIGVVKLMGRNSGFIAMYATLASRDVDCCLIPESPFYLEGKGGLLEFIEKRLKDNGHMVIVVAEGAGQDLIAKSMNFVDTQDASGNKLLLDVGLWLSQKIKDHFKKKRNFPITLKYIDPTYMIRAVRSNASDNVYCTLLAHSALHGAMAGYTGFTVAPVNGRHAYIPFYRITEKQNKVVITDRMWARVLCSTNQPCFLSHEDVEHLKHDDDEHHLHNTQLLEGESSPVKDSSKCNGTAAPV

SEQ ID NO: 46235 - protein, 218 aa, Triticum aestivum
  misc_feature (7)..(7): Xaa can be any naturally occurring amino acid
RGSFIPXRGTQFVSCGSDGLVKLWTIKTNECIATYDKHDGKVWALAVGKKTEMLATGGTDSDLNLWHDCTMEDKQEDFLKKEEEVLRGQELENAVSDSDYTRAIQLAFELRRPRRLLELFSQLCRKADPEDPIEKALLGLPKKGLRVLLEYIREWNTKPKFCHVAQFVLFRVLRSLPPTDILEIKGISELLEGLIPYSQRHFSRVDRLVRSTFLLDYT

SEQ ID NO: 46236 - protein, 657 aa, Rhizobium leguminosarum bv. viciae 3841
MTSPEQHDRMANAIRFLAMDAVEKANSGHPGMPMGMADVATVLFTKYLKFDPKKPHWPNRDRFVLSAGHGSMLLYSLLYLTGYPDMTIEDLKQFRQLGSKTAGHPEYGHATGIETTTGPLGQGIANSVGMAIAERKLREEFGSDLQDHYTYAICGDGCLMEGISHEAIALAGHLKLNKLILFWDNNSITIDGAVSLSDSTDQIARFKAVHWNTIEIDGHDQAAIAAAIEAAHKSDRPTFIACKTIIGFGAPNKQGTHKVHGNPLGAEEIAATRKALNWEAEAFVIPSDVLDSWRVAGARSVELVKAWEDGLAKAPAKAEFTRRMAGELPEGFDAAISTYKKKLAETKPTVATRKASEDALEVINGFLPETLGGSADLTPSNNTKTSQMHSITPTDFAGRYMHWGIREHGMASAMNGIALHGGLIPYSGGFLIFSDYCRPPIRLASLMGIRVIHVLTHDSIGVGEDGPTHQPVEQLAGLRAIPNLMVFRPADATETAECWQIAIKTHNRPSGLALTRQNLLAARTEYSEKNLCEQGAYVLAGNADAKVTIFASGSEVEIAVAARTALEAKGVTVRVVSVPCTELFFEQPEAYRKGILGNSPVKIAVEAAVREGWDAFIGPEGTFIGMKSFGASGPVKEVYKHFGITADAVVAAAEAKL

SEQ ID NO: 46237 - protein, 336 aa, Rhizobium leguminosarum bv. viciae 3841
MTVKVAINGFGRIGRNVLRAIVESGRTDIEVVAINDLGPVETNAHLLRYDSIHGRFPATVKVEGDTIIVGNGKPIKVTAIKDPATLPHRELGVDIAMECTGIFTARDKAAAHLTAGAKRVIVSAPADGADLTVVFGVNHDQLTKEHLVISNASCTTNCLVPVVKVLDDAVGIDHGFMTTIHSYTGDQPTLDTMHKDLYRARAAALSMIPTSTGAAKAVGLVLPHLKGKLDGTSIRVPTPNVSVVDFKFVAKKATTVGEINEAVMAAANGKLKGILGYTDEPLVSRDFNHDSHSSILATDQTKVMEGNFVRVLSWYDNEWGFSSRMSDTAVAFAKLI

SEQ ID NO: 46238 - protein, 109 aa, Glycine max
MKRAFSVDTAEDNKNNRNTKKTKLDSEEEEEHGTRGGSVYLDDNVLFEVLKHVDARSLAMAGCVSKQWQKAARDERLWELICTKQWANTGCGEQQLRSVVLALGGFRRL

SEQ ID NO: 46239 - protein, 663 aa, Salmonella typhimurium LT2
MSSRKELANAIRALSMDAVQKAKSGHPGAPMGMADIAEVLWRDFLNHNPTNPSWADRDRFVLSNGHGSMLIYSLLHLTGYDLPMSELQNFRQLHSKTPGHPEVGYTAGVETTTGPLGQGIANAVGMAIAEKTLAAQFNRPGHDIVDHFTYVFMGDGCMMEGISHEVCSLAGTLKLGKLIAFYDDNGISIDGHVEGWFTDDTAKRFEAYGWHVIRGIDGHDADAIKRATEEARAVTDKPSLLMCKTIIGFGSPNKQGTHDSHGAPLGDAEIALTREQLGWKYAPFEIPSEIYAQWDAKEAGQAKESAWNEKFAAYEKAFPQEAAEFTRRMKGDMPADFDAKANEFIAKLQANPSKIASRKASQNTIEAFGPLLPEFLGGSADLAPSNLTLWSGSKAINEDAAGNYIHYGVREFGMTAIANGIALHGGFLPYTSTFLMFVEYARNAVRMAALMKQRQVMVYTHDSIGLGEDGPTHQPVEQVASLRVTPNMSTWRPCDQVESAVAWKYGVERQDGPTALILSRQNLAQQERTEEQLANIARGGYVLKDCAGQPQIIFIATGSEVELAVAAYEKLTAEGVKARVVSMPSTDAFDKQDAAYRESVLPKAVSARVAIEAGIADYWFKYVGLNGAIVGMTTFGESAPAELLFEEFGFTVDNVIAKAKALL

SEQ ID NO: 46240 - protein, 531 aa, Zea mays
KADNNRYSTGEDRTLSESSPVISEPVLVNIHKNVAINGKAADASDRARQQDPQSQSVVESRSSAPAAQLGEDQAAAKAQAAFRGYLARRSFRALKGIVRLQALIRGYLVRRQAVSTLRATWLIVKFQALVRGRNVRLSGSRMQLNVKFGQSNFGGVRSSDAWKEKLSSNAYVRKLLSSPIVLEPLHFQYDKRDPNSTYNWFERWTIGCIWKPAFQPKRVADGKPLVKKASYAMETQSAKLKRNIRKGSAAIAGSFHTSGESDKVKRNPKNFSSFPADSVPDSQLSELEKVKRNLRKVTDSMAEASKISSSRVDSSKVCNSTAEVPKESNPVAEISKIRSLLNGISDHQDIQCENTRESSFPLGTQEDSDNDHLLRYSNMDSLDLVPGLKSDQEIQLDSVSIGENVDDPTVVAPAVEEMSPQNIDTEDNVLCKKEEARSKEEHLSNGSLRTSKRKSSFPNKSEYVENGTHATPVQPRQPSYMAATESAKAKLRAQNSPSLDSDSAAEKNGFTRRHSLPSSTKSRALKAEWKR

SEQ ID NO: 46241 - protein, 400 aa, Lactobacillus plantarum WCFS1
MAKLIVSDLDVKDKKVLIRVDFNVPIKDGKIGDDNRIVAALPTIKYVIEHDGKAILFSHLGRIKSEDDKKGLSLRPVAERLSNLLNKPVTFVPVTEGEQLETAINNMNDGDVLVVENTRFEDVVNGEQVKRESGNDPELGKYWASLGDVYVNDAFGTAHRSHASNVGIASNMDQVAAGFLMEKEIKFLGDAVDNPKHPFVAILGGAKVSDKIGVIDHLISKADKIIIGGGMTYTFYAAKGMGIGNSLVEKDKIELAKSIIEKAGDKLVLPSDSIVAEKFDNDVPSKVVEGSIPDGYMALDIGPKSIEEFEDVLRDAKTVVWNGPMGVFEMSNYAKGTLEIGKFLGTLSDATTIVGGGDSTAAVKQLGVGDKLTHISTGGGASLEYLEGKELPGIAAISEK

SEQ ID NO: 46242 - protein, 275 aa, Methanothermobacter thermautotrophicus str. Delta H
MRKIALKVAYIGTNYHGFQRQPDVPTVEGKLLEALEGAGIIEDPKRARFQIAGRTDRGVHALGNFVSFFTEEDIHVNQINDLLPRDIRVLAWASVMYPFKVRYPLERHYRYILHREESMDTYSMAEAAAHFRGTHDFSNFSRRSDRDPVRRINDVRISEVGDSIIIDVYGESFLWQMVRKMVRALLMVSEGELAPDDMAGLLDTDRRVFLEPMPPENLILMDLKYGVKIKLRHDEYAFKRFISLLEEEFKVYREMSMVRRAMSDHLRDLQEHELD

SEQ ID NO: 46243 - protein, 252 aa, Lactobacillus plantarum WCFS1
MRTPIIAGNWKMNKTASEALAFVNAVKDQLPDPSKVESVVAAPALFLQEMVEAAKGSDLKIAAENAYFEDAGAFTGETSPAALADLGVDYVVIGHSERRGYFHETDEDINKKAHAIFKNGMKPIICCGESLEQREAGEAESWVSGQIKAALKDLSADQVSSLVIAYEPIWAIGTGKTATSDQAEEICAVVRKTVADLYSQEVADKVRIQYGGSVKPANVNELMGKDDIDGGLVGGASLQPDSFLELVNYQNN

SEQ ID NO: 46244 - protein, 442 aa, Lactobacillus plantarum WCFS1 [sequence omitted]

SEQ ID NO: 46245 - protein, 223 aa, Pseudomonas putida KT2440
MRLRAVLFDMDGTLLDTAPDFIAICQAMLAERGLPAVDDNLIRGVISGGARAMVATAFAMDPEADGFEALRLEFLERYQRDCAVHSKLFEGMAELLADIEKGNLLWGVVTNKPVRFAEPIMQQLGLAERSALLICPDHVKNSKPDPEPLILACKTLNLDPASVLFVGDDLRDIESGRDAGTRTAAVRYGYIHPEDNPNNWGADVVVDHPLELRKVIDSALCGC

SEQ ID NO: 46246 - protein, 516 aa, Bradyrhizobium sp. BTAi1
MSTSPASSLSLAVETADILSALGVAPERLRGGARAARSPITGEVLGQVHDETQAGATEVIAQAHAAFLQWRLVPAPKRGELVRLLGEELRANKAALGRLVSIEAGKIVSEGLGEVQEMIDICDFAVGLSRQLYGLTIATERAEHRMMETWHPLGVTGIISAFNFPVAVWAWNAAIALVCGNSVVWKPSEKTPLTALATDALLARALARFRREGGEAPEGLAGLLIGGRAVGEMLVDDVRVPLVSATGSTAMGRVVGACLASRFARAILELGGNNAAIVAPSADLDLTLRAVAFAAMGTAGQRCTSLRRLFVHADIYEQLVPRLKQAYASVAIGNPLQPGTLIGPLIDRGAYDAMQDALSAARDQSGRVFGGERVAVVGCEGAYYVRPALVEISSQAGPVERETFAPILYVMPYRDLDAAIALHNAVPQGLSSSIFTNDLREAELFVSSRGSDCGIANVNIGPSGAEIGGAFGGEKETGGGRESGSDSWKAYMRRTTNTVNYGRSLPLAQGVKFDIG

SEQ ID NO: 46247 - protein, 389 aa, Xanthomonas campestris pv. vesicatoria str. 85-10
MRALCWNGINDLRVETVPDPVLVNPRDVILKVGLTTTCGSDLHFIDGYLPTMREGDVIGHEFMGTVVEVGNAVKNVRVGQRVVVPSFISCGGCWHCERKEFSLCDNTNPNWEMQEPLLGHATAGIYGYTHAFGGYAGSHATYIRVPHADVGCFEVPDGVSDEDALFLSDAGPTGFMGADFCNIQPGDTVAVWGCGGVGLMAQQSARILGAERVIGIDRLPERLAMARDVLGVEVIDYSAVDSVVDVLREMTGGRGPDACIDAVGMEAHGTGIGHTYDRVKQALHLHTDRGQALREAILACRKGGILSVLGVYGVMDKFPLGAVMNKGLTVRTAQQHGQRYVPRLLDLAQAGRLKSGFLLTHKMPLEDAVRGYDMFKHKHDGCVRAGFVP

SEQ ID NO: 46248 - protein, 321 aa, Cenarchaeum symbiosum
MSASEAAAINALLRQRLRGRPSRLYAAAAHLIEHGGKRFRPYMLIKSCQALGGKKSDAMPAATAIEMIHNFTLLHDDIMDNDSIRHGVPTVHKKFGVPVAILAGDVLFSKAYQVISGPRVPEKRAARLTSRLAAACVDVCEGQLYDMDMAEGAKLPTRSEYIMMIGKKTASLFGAACAMGAICSGADEKDARRFAAFGTGLGVAFQITDDLIGITGDPKVTKKPVGNDIREGKKSLPVLMALKKARGKDRAAIRAAFGNARATSVQLRAAVSAVKSLGIEDDVRREAGSYAKKASSALDRYPGRHRDDLLSLLDCVVWRRL

SEQ ID NO: 46249 - protein, 385 aa, Photobacterium profundum SS9
MNVQALPMHRFIDHHGNLVSQLPAWADQSILKGFYCDMVLTRTYDNKAVALQRTGKLGTYPSHLGAEAIGIAIGRALRADDVFIPYYRDMPAMWARGIAMEKNLQYWGGDERGSDFCVTNDQTSTNFTTPNNTTQSPAHSPNHSHCRDLPFCVPIATQCTHAVGVASALKIEGGHKAALVTCGDGATSKGDFLESINCAGTWNIPLVFVVNNNQWAISVPRRLQCGADFLSEKAKGAGIPGLTVDGNDIVAMFDAVQISLDRARKGKGATLIEAISYRLGDHTTADDASRYRSEDELHEAWGFEPISRLKTYLMRQSLWSEQDDKQWQEHCQEVVEQAVKRYLNIPVQAPETAFDFLYESLNTELHQQRDELINKAMRMQGGKHG

SEQ ID NO: 46250 - protein, 485 aa, Nostoc punctiforme PCC 73102
MNKAGNHLQQRYLEAFTTRYNERTKKSKQLAQTYRPIITSNMGPVGFSLSCKEMCYPITAKRSLGSRIWDVDGNEYIDFMMGLGVNLFGHNPPFIQAALKEQLEKGIQIGPQSELTGEVGELICELTGMERVAFSNTGTEAVMAAIRLARTATGRNKIVLFSGSYHGHFDGTLVEVETIDGIPHTVPITSGIPQNIVEDYLVLDYGNPQSLDAIRANKHELAAVLVEPVQSRRPDLQPKDFLLQLRQLTKELGIALIFDEVITGFRVHPGGAQAWFGVEADIATYGKIVGGGMPIGIIAGKATYMDRIDGGMWNYGDASQPQVETTYFAGTFRRHPLAMAAALAVLKHLKMQGSQLQQQLNQRMSQLVETLNAYFEEEEVPLRLRNFSSWFSPAFLENFSLLEYATPSELRELLYYHLLDKGVMLGGPGGYLSTAHTDEDINYIIQAFKDSVRELRKGGFLPPIAPQNLVKEFSLETREQIADVR

SEQ ID NO: 46251 - protein, 327 aa, Photobacterium profundum SS9
MADMTLLEAVNLALHHEMEHDPKVVVLGEDVGDNGGVFRATVGLKAKFGLKRVIDSPLAEALIGGVTVGMASQGLRPVAEFQFQGFVFPAMEHLMCHAARMRNRTRGRLICPAVFRAPFGGGIHAPEHHSESIEALFAHIPGFKVVIPSSPQRAYGLLLASIRCNDPVMFFEPKRIYRTVKSYVNDNGKALPLDTCFTLRKGRDLTLVTWGACVVESLQAASTLSSQGIEVEVIDLASIKPIDMATIIHSLEKTGRLLVVHEASKTCGVGAEILARTAEHAMCLLKAPPKRVTGMDTIMPYYRNEDFFMIQEEDIVIAARELVEGWK

SEQ ID NO: 46252 - protein, 562 aa, Gracilaria tenuistipitata var. liui
MLIADDLDQLLDILPNFIRHPLQIHPERKVLIEVVMDLGRKPEARFPKGPEYLSKRIITWQDLDYSIKRIGNFSADNRSGIERTLHRISSIKNRQGSTIGLTCRVGRAILGTISIIRDLLNTYPSILLLGKPGVGKTTVIREIARVLADEMEKRVVIIDTSNEIAGDGDVPHPAIGRARRMQVSKPELQHQVMIEAIENHMPEVIIIDEIGTELEALAARTIAERGVQLVGTAHGNYLDSLIKNPILSDLIGGIQYVTLGDDEAKRRGSQKSILERKASPAFQVAIEIHDRHSWIVHESVGRAVDQLLQGVNLWVQRRKLMPNGAIFVECEQYIPNAFISNISRFEPKVSIKNLKSHNTNIHSINIKSSFNYSQEKNINKLQEISAVPSFSKNIMKDISNIRVYLYYINSVQVEMIINTLHLPIILTKDIVQADVILSLRSGFKHNTKLKQVAKIRHITIYTICSSTSANIKRALTKIVNIDKVSNYNWNTICENSTVIELRILIETRIAIEKIVNGKKQSVELLSRNVNLRKLQHQLINFYNLRSRSFGEEPNRRLRIFPD

SEQ ID NO: 46253 - protein, 274 aa, Magnetospirillum magnetotacticum MS-1
MADDFNAEQKRYLEGFASGIAAARMTGGLALGHAPAGAPSEPTGPDAIHIKAQDRTVKNGGKLCDQEKWKRAENPFDGHNRLIAEATAGKAPKPEDNFRWRYHGLFWVAPTQTSYMCRLRIPNGILQHWQFAGIADLADKHGGPYSHVTTRANLQVREIAPEHGQAFLDGLVDLGLTARGSGADNIRNVTGSPTAGIDAQELLDTRPLAKSWHNWILNDRSLYGLPRKFNVAFEGGRVMPVLEETNDIGFQAVQCWKAPQSRGSGAPLAAHPGQ

SEQ ID NO: 46254 - protein, 433 aa, Arabidopsis thaliana
MRRRRCDLQPKRTRMCDLQPKRTSMCDLPPKLVGEKILTRIPITSLRAVRSTCKLWNALTKDRVLGKAAAQFLGFMTMDSKVCSVRFHLRRSKEEEEDTMDLSIKQVDLLNQVEISRVYHCDGLLLCVAKDNSRVVVWNPYLGQTRWIRPRTESNIGDSYALGYDINRNHKILRMVQTRNVSVYRYEIYDLRSNSWRVLEVTPNGEMDPNHPLYGVSVKGNTYFFAHEDSSSGEIDEDGDIIDLEDFLLCFDFTTETFGLRLPLPFHSTIDATVTLSCVRDQQLAVLYHNEGLHSDDRFTTVEFWVTTSIEPNSVSWSKFLTVDMRPLALTGVRFDNDMGATFFIDEDEKVAVVFDLDGYLSTESARYHTTFISGKDGFFKPVTLGVAPNVGEPCPRTGHIPTTYRPPLVCSSTYLPSLVQVNQQRKRKERHV

SEQ ID NO: 46255 - protein, 401 aa, Rhizobium leguminosarum bv. viciae 3841
MPSFKTLDDLSDIRGKRVLVRVDLNVPVKDGKVTDVTRIERVAPTILELSEKGAKVILLAHFGRPKDGPSSDLSLSLIAPSVEEVLDHAVLTASDCIGEAAASAVAAMNDGDILLLENTRFHKGEENNDSDFTKALAANGDIYVNDAFSAAHRAHASTEGLAHHLPAYAGRTMQAELEALEKGLGDPARPVVAIVGGAKVSTKIDLLMNLVKKVDALVIGGGMANTFIAARGTNVGKSLCEHDLAETAKQIMIEAATAGCAIILPEDGVIAREFKAGAANETVDINAIPADAMVLDVGPKSVEAINAWIERAATLVWNGPLGAFEIGPFDAATVAAAKYAAGRTIAGKLTSVAGGGDTVSALNHAGVADDFTYVSTAGGAFLEWMEGKELPGVAVLNAAAA

SEQ ID NO: 46256 - protein, 261 aa, Triticum aestivum
  misc_feature (96)..(96): Xaa can be any naturally occurring amino acid
  misc_feature (241)..(241): Xaa can be any naturally occurring amino acid
MLTLHTVRTSLPSPRRSSPRRHALHLSRRRFSICKSSSEDAGSDAPLPHGGDQRQQEVLAKIAMLQTQKVRITNFLDERSAYLTKFTKDADTEFDXLGQNAMKELDQIGDQIMERLDSKMQSYEETAEMQRQEIEMNERVLEDFEDWIEEEKNEGMFFKSLGKVKKPQNNEEIKVKARIEAQKVTEITKESAGSKARMNIYLALMAILSLTIANAVFATPEVEWRKVAALGLIFIGLVAQXVIYEQDISPPAADKNEKREE

SEQ ID NO: 46257 - protein, 330 aa, Cryptococcus neoformans var. neoformans B-3501A
MTVTINPAASLPIISLAEHNSVDSLARALYDSCTQEGFIYVCDHEIQQDLIDQAFAISANYFTHARPEDKVDLKTNLGYTAVRQESLDSTRPSSGDLKEFFHVADNHWRVRNGESPQELPEALESSRKALDDFIEQINGLADRILRGLSVALKLKPEFLTNQHRGELNRLRMLHYPPVEVEQNGINSDSNEIRAGAHTDYGSITILFQHIVSGLQVHRNGSWIDVAPRKGCVVINIGDALEFWSGGLFKSTLHRVVMPRSQAETASRYSIAYFVHADNASILEPFTDGIDEDALDEIIARKGLPRGTRRITGGDYVQARLAATYGMKVAA

SEQ ID NO: 46258 - protein, 332 aa, Rhizobium leguminosarum bv. viciae 3841
MQMVTGGRGLLAADESTSTIKKRFDAINLESTETSRRDYREMLFRSDEAMKKYISGVILFEETLFQKAADGTPFVDIIRAAGAIPGIKVDTGAKPMAKYPAETITEGLDGLGERLARYYEAGARFAKWRGVIAISSTLPTRGSVRANAQALARYAALCQEAGIVPIVEPECLMDGKPGDHNIDRCAEVTEFTLRIVFEELADARVNLEGMILKPNMVIDGRNARKASVAEVAERTVKVLKATVPPAVPGIAFLSGGQTTEEATAHLSAINAIGHLPWFVTFSYGRALQDSSLKAWNGKQENVAAGQREFTHRAEMNSLAAKGNWKKDLEKAA

SEQ ID NO: 46259 - protein, 348 aa, Sesamum indicum
MDLIHTFLNLIAPPFTFFFLLFFLPPFQIFKFFLSILGTLFSEDVAGKVVVITGASSGIGESLAYEYAKRGACLVLAARRERSLQEVAERARDLGSPDVVVVRADVSKAEDCRKVVDQTMNRFGRLDHLVNNAGIMSVSMLEEVEDITGYRETMDINFWGYVYMTRFAAPYLRNSRGRIVVLSSSSSWMPTPRMSFYNASKAAISQFFETLRVEFGPDIGITLVTPGFIESELTQGKFYNAGERVIDQDMRDVQVSTTPILRVESAARSIVRSAIRGERYVTEPAWFRVTYWWKLFCPEVMEWVFRLMYLASPGEPEKETFGKKVLDYTGVKSLLYPETVQVPEPKND

SEQ ID NO: 46260 - protein, 463 aa, Arabidopsis thaliana
MDFSGLFLTLSAAALFLCLLRFIAGVRRSSSTKLPLPPGTMGYPYVGETFQLYSQDPNVFFAAKQRRYGSVFKTHVLGCPCVMISSPEAAKFVLVTKSHLFKPTFPASKERMLGKQAIFFHQGDYHSKLRKLVLRAFMPDAIRNMVPHIESIAQESLNSWDGTQLNTYQEMKTYTFNVALISILGKDEVYYREDLKRCYYILEKGYNSMPINLPGTLFHKAMKARKELAQILANILSKRRQNPSSHTDLLGSFMEDKAGLTDEQIADNIIGVIFAARDTTASVLTWILKYLADNPTVLEAVTEEQMAIRKDKKEGESLTWEDTKKMPLTYRVIQETLRAATILSFTFREAVEDVEYEGYLIPKGWKVLPLFRNIHHNADIFSDPGKFDPSRFEVAPKPNTFMPFGSGIHSCPGNELAKLEISVLIHHLTTKYRWSIVGPSDGIQYGPFALPQNGLPIALERKP

SEQ ID NO: 46261 - protein, 374 aa, Zea mays
MAIPLVLVVLPLGLLFLLSGLIVNTIQAILFVTIRPFSKSLYRRINRFLAELLWLQLVWVVDWWAGVKVQLHADEETYRSMGKEHALVISNHRSDIDWLIGWILAQRSGCLGSTLAVMKKSSKFLPVIGWSMWFAEYLFLERSWAKDEKTLKWGLQRLKDFPRPFWLALFVEGTRFTPAKLLAAQEYAASQGLPAPRNVLIPRTKGFVSAVSIMRDFVPAIYDTTVIVPKDSPQPTMLRILKGQSSVIHVRMKRHAMSEMPKSDDDVSKWCKDIFVAKDALLDKHLATGTFDEEIRPIGRPVKSLLVTLFWSCLLLFGAIEFFKWTQLLSTWRGVAFTAAGMALVTGLMHVFIMFSQAERSSSAKAARNRVKKE

SEQ ID NO: 46262 - protein, 410 aa, Pseudomonas syringae pv. phaseolicola 1448A
MNAPLIIVGAGHAGGRAALTLRDQGYAGRLILIGSEPHVPYERPPLSKGVLRGSVDLAGCSLCADTRLTELGIEHLTDNPVKSLDTQGHRLQLADGDELPYSRLLLATGGRARCLAQIPRHLSNVFYLRTHDEALALRGALIHGSRLVIIGAGFIGLEVAATARALGCQVMLLEAGPRLAGRVLPEEVSRALLDLHRQHGVDVQLNVVLEGVQGNERAESVLLVDGWSVPCDAVVVGVGMQPNIELAVAAGLAVGQGIRVDDRLRTSAPDIFAAGDVCEYRLHPEGVYQRQETWRNAEAQGRHSALNMLGNDLPFQDVPGFWSDQYDWSVQTVGVTTQPLPSASRALACGGRLLFYLDAQQRLQGACGLALGDSVAKDIKLCERLIVARTPLSVTMLNDPECSLKQLLRL

SEQ ID NO: 46263 - protein, 131 aa, Triticum aestivum
  misc_feature (115)..(115): Xaa can be any naturally occurring amino acid
DVITMTRFVMEEGRRAKGTGEFTQLLNSLCTAVKAISTAVRKAGIANLYGIAGSTNVTGDQVKKLDILSNDLVINMLKSSFSTCVIVSEENKDAVIVEADRRGKYIVCIDPPGWXSNIDCPVSNWDIFGIL

SEQ ID NO: 46264 - protein, 291 aa, Desulfitobacterium hafniense DCB-2
MALNRIMTAMVTPFNDKMEVNYPEAEKLANYLIEHGNDGIVVCGTTGESPTVSAEEKIELFKTVKKAVGSRATVIAGIGSNTTDGSINLARQAEKTGVDGLMAVVPYYNKPSQEGLYQHFRAIAEAISLPLMVYNIPGRTSINLLPETVLRLSEIPNITSIKEAAGSMDQVSEMRRILPEDFLIYSGDDSLTLPMLSLGCDGIISVAAHVVGDEIKQLVDAWFNGEPQTALQWHLKLMPMFKGVFVTTNPVPVKYLLKKAGINAGGVKLPLVCAAPEEEAFLDDLYQKIKG

SEQ ID NO: 46265 - protein, 111 aa, Triticum aestivum
  misc_feature (26)..(26): Xaa can be any naturally occurring amino acid
  misc_feature (40)..(40): Xaa can be any naturally occurring amino acid
  misc_feature (68)..(68): Xaa can be any naturally occurring amino acid
SKAALRAGQSRSGHFVPIVRQQGEAXVLGHYTHWCGPCKXMAPKSREMSEKDHDVVFLKLDCNQDNSXLAKELGIRVVPTFKIFKDGKVAKEVTGAKIDELARAIEEVKSS

SEQ ID NO: 46266 - protein, 800 aa, Staphylococcus aureus subsp. aureus MRSA252
MLISNEWLKEYVTIDDSVSNLAERITRTGIEVDDLIDYTKDIKNLVVGFVKSKEKHPDADKLNVCQVDIGEDEPVQIVCGAPNVDAGQYVIVAKVGGRLPGGIKIKRAKLRGERSEGMICSLQEIGISSNYIPKSFESGIFVFSESQVPGTDALQALYLDDQVMEFDLTPNRADALSMIGTAYEVAALYNTKMTKPETTSNELELSANDELTVTIENEDKVPYYSARVVHDVTIEPSPIWMQVRLIKAGIRPINNVVDISNYVLLEYGQPLHMFDQDAIGSQQIVVRQANEGEKMTTLDDTERELLTSDIVITNGQTPIALAGVMGGDFSEVKEHTSNIVIEGAIFDPVSIRHTSRRLNLRSESSSRFEKGIATEFVDEAVDRACYLLQTYANGKVLKDRVSSGELGAFITPIDITADKINRTIGFDLSQNDIVTIFNQLGFDTEINDDVITVQVPSRRKDITIKEDLIEEVARIYGYDDIPSTLPVFEKVTSGQLTDRQYKTRMVKEVLEGAGLDQAITYSLVSKEDATAFAMQQRQTIDLLMPMSEAHASLRQSLLPHLIEAASYNVARKNKDVKLFEIGNVFFANGEGELPDQVEYLSGILTGDYVVNQWQGKKETVDFYLAKGVVDRVSEKLNLEFSYRRADIDGLHPGRTAEILLENKVIGFIGELHPTLAADNDLKRTYVFELNFDALMAVSVGYINYQPIPRFPGMSRDIALEVDQNIPAADLLSTIHAHGGNILKDTLVFDVYQGEHLEKGKKSIAIRLNYLDTEETLTDERVSKVQAEIEAALIEQGAVIR

SEQ ID NO: 46267 - protein, 152 aa, Candida glabrata CBS 138
MSFLKNLLFGGVKTSEDPTGITDSGSGNAKASQDVNEPIVEGRFTPRTLSKFNGHDDEKIFIAIRGKVYDCTAGRQFYGPSGPYSNFAGHDASRGLALNSFEMEVVPDWDKPMDDLKDLTPQQIDSLNEWEQHFANKYPVVGTLEAEPGVNV

SEQ ID NO: 46268 - protein, 545 aa, Xanthomonas campestris pv. vesicatoria str. 85-10
MTARRRAMALDRYPPAHAIGTASRRAARQATATQRDRFHPLPGRKSPQHGARIRLQSSTSSRFGHRHTMQTPSPSQTFPLDRSDAVCIIGAGPGGLSAARALKAQGLDYDQFERHGDLGGIWDVSNPGSPIYDSTHFISSRDLSAFIGHPMPRQYPDYPSHRQILAYLRSFAETFGLREKIQFDTAVLRIDKQADGRWQVTLADGSQRLYAAVICASGVNWDPSMPQLPGHFDGEIRHSVSFRHGDEFRGKRVLVLGAGNSGADIACEAAMHAQRAFLSVRRGYHFIPKHLMGIPVDQIAETGPHLPLWLARPIFSALLRLVNGDLARLGLPKPDHRLFESHPLLNAQLLHHLQHGNIAVKPDIDRLDGRHVVFKDGSREQIDLLLCATGYRWSCPYASDYFLWNGGRPQMYLSMFNRTHRNLFGIGYLETNSSAYKLFDTQAQMIASYLTAQRRDPASARRFDALIENDTPDLSGGIRFVASQRHAVYIEAHAFKRYLHQLRRRLGWGELGEHMYDALKLDAGGDPRMGTTATARLADSEVAHG

SEQ ID NO: 46269 - protein, 184 aa, Triticum aestivum
QAIYLPSTGLAPPVMASWATSVFPFQGVKSTPGLPVSRRSNGVSLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 46270 - protein, 542 aa, Medicago truncatula
MAHQEVNNGSNNRIVAVNVTPSSTPSYNHDDSSKQDQKPGWKKFLAYVGPGFLVSLAYLDPGNMETDLQAGANHGYELLWIILIGLIFACIIQSLAANLGVCTGKHLSEICKAEYPWFVKYCLWILAELAVIAADIPEVIGTAFALNILFHVPVWGGVLLTGCSTLLFLGLQRFGVRKLELLISILVFVMAACFFGELSYVKPPAKGVIEGMFVPKLNGNGAVGDAIALLGALIMPHNLFLHSALVLSRKIPGTKRGINDACRYFLIESGFALFVAFLINVAMISVTGTVCKADDISGENVDRCNDITLNSASFLLQNVLGRSSSTIYAIALLASGQSSAITGTYAGQFIMQGFLDLKMKKWIRNLVTRIVAIAPSLVVSIIGGSSGAGRLIIIASMILSFELPFALIPLLKFSSSRTKMGPHKNSIIIIIISWILGLGIIGINVYYLITAFVGWIIHNSLPKVANVFIGLIVFPLMALYIVSVIYLTFRKDTVVTFVEVKDDPSMQTHVEKGFVNDGQLELSYTPYREDLADITRPEGPRL

SEQ ID NO: 46271 - protein, 817 aa, Xanthomonas campestris pv. vesicatoria str. 85-10
MKQPRLVVIGNGMAGIRTVEELLKLMPGMYHITVFGAEPHPNYNRILLSPVLAGEQEFDDIVLNPLQWYQDNGIHLHLNKEVTRIDRVRRRVIAADGTQAEYDRLLIATGSVPFVLPIPGNDLKGVIGYRDIQDTRTMIDTARTKQHAVVIGGGLLGLEAANGLKLRGMEVTVVHLAGWLLERQLDPVAGNLLQQALRARGLHFKLSTATSALLGNAQGEVIGVKFADGSEIPADLVVMAAGIRPNTRLAEEAGIHCSRGIVVNDSLQSFDPRVYAVGECANHRGIAYGLVAPLFEQAKVCANHLAQFGIGIYRGSVASTKLKVTGIDLFSAGDFMGGDGCEEIVLSDPAGGVYKKLVIRDDVLVGACLYGDTSDGGWYFKLLKDGTPIQAQRDQLIFGESALGDAGTGGQDRASAMADSDEVCGCNGVCKGTIVKAISEQGLFTVDEVKKHTKAASSCGSCTGLVEQILMNCLGSNFQETPKTKAVCSCTDLSHGEVRRAIREHKLLTHAQAYAFMEWRTPNGCATCRPAINYYMLSTWPHEAIDDPQSRFINERAHANIQKDGTFSVIPQMKGGVTNASELRRIADVADKYAVPMVKVTGGQRIDLLGVKKEDLVDVWRDLGMPSGHAYGKSIRTVKTCVGSEFCRFGTQNSTQMGIDLETMLANMWSPHKVKLAVSGCPRNCAESGIKDVGIIAVDSGWEIHIGGNGGIKTEVARFLVKVATADEVREYTGAFLQLYREQAYYLDRTVHYIARVGLDYIRAQVVDDAANRRALYERLLYSLEGLVDPWKARIAGERRQEYQPLRVAAPAATVEQ

SEQ ID NO: 46272 - protein, 531 aa, Medicago truncatula
MANLIQQQQQQQQQQQHQVMETSSNHEETQKSGWRKFLPYIGPGFLVSLAYLDPGNMETDLQAGANHGYELLWLVLIGLIFALIIQSLAANLGVTTGKHLSEVCEVEYPLFVKYCLWLLAEVAVIAADIPEVIGTAFALNILFNIPLWAGVLLTGFSTLLLLSLQRFGVRKLELLITILVFVMAGCFFAEMSYVNPPASGVLKGMFVPKLAGEGAVADAIALLGALIMPHNLFLHSALVLSRKVPKSVRGINEACRYFLYESGFALFVAFLINVAMISVSGTVCSANDLSGDNVERCNDLTLNSASFLLKNVLGRSSSTIYAIALLASGQSSTITGTYAGQYIMQGFLDIRMKRWKRNLMTRCIAIAPSLAVAIIGGSSGSSRLIIIASMILSFELPFALIPLLKFSSSSTKMGPHKNSMIIITISWILGFGIISINVYYLSTAFVKWIIHSSLPKVANVFIGIIVFPLMAIYIASVIYLTFRKDTVEMFIETKNDTVMQNQVEKGIVDNGQLELSHVPYREDLADIPLPE

SEQ ID NO: 46273 - protein, 323 aa, Gracilaria tenuistipitata var. liui
MSISPKALTNIEQDLLILENNLKRMVGAKHPILYAAAEHLFKAGGKRIRPTIILLVALSTTQALHILPEHKRLAEITEIIHTASLVHDDVIDECEIRRGVNTVHNAFSTKVAVLAGDFLFAQSSWYLANLNNLEVVKTISKVITDFAEGEIRQGLTCFDETISMNNYIEKSFYKTASLIASSCKAAAILSDTTTNTQNQFYLYGKHLGLAFQIVDDILDIVGSTVSLGKPAGSDLKNGNLTAPLLFALEENSELYKLIAREFQHNKDIDKAIEIIKSTNGIQKSYDLAQEHMQASVQALKKIDNQVAQKNLTYINNYVMNRLC

SEQ ID NO: 46274 - protein, 388 aa, Mycobacterium avium subsp. paratuberculosis K-10
MTDRVSLRAGITPFYVMDVWLAAAERQRSHGDLVNLSAGQPSVGAPEPVRAAAAAAVHSNELGYSVSLGTPELRAAIAADYRRQHGLEVEPDAVVITTGSSGGFLLTFLACFDVGDRVALASPGYPCYRNILSALGCEVVEIPCGPQTRFQPTAAMLAELDPPVQGVIVASPANPTGTVIAPEELAAIASWCEASGARLVSDEVYHGLVYEGAPPTSCAWQTSRNAVVVNSFSKYYAMTGWRLGWLLVPVELRRAVECLTGNFTICPPVLSQLAAVAAFTPEATAEADGHLHHYAKNRALLLDGLRGIGITRLAPTDGAFYVYADVSDFTDNSMEFCSKLLEQTGVAIAPGIDFDTTRGNSFVRLSFAGPTTDIEEAVRRLGSWLRAR

SEQ ID NO: 46275 - protein, 341 aa, Gracilaria tenuistipitata var. liui
MKNKIILPSSVSSEYNINSNIVLHLYKDMLLGRCFEDMCAQMYYRGKMFGFVHLYNGQEAVSTGVIKVLQKDDYVCSTYRDHVHALSKGVPANLIMAELFGKETGCSRGRGGSMHIFSAAHNFLGGFAFIGEGIPISIGAAFQSVYRKQILNDLQPMRVTACFFGDGTSNNGQFFECLNMAVLWKLPIIFVVENNQWAIGMAHNRSTSFPEIHKKAEAFGLPGIEVDGMDVLAIREVAISAVDRARFGHGPTLIEALTYRFRGHSLADPDELRSVSEKEAWLARDPIKRLKNYISDNSLCSEKEVEDVNLAVKIEIDQAVEFAISSPEPNIKDLKKYLFSD

SEQ ID NO: 46276 - protein, 323 aa, Gracilaria tenuistipitata var. liui
MTEVLMFDALREATDEEMQNDSSVFILGEDVGHYGGSYKVTKDLHSKYGDLRVLDTPIAENSFMGMAIGAAITGLRPIVEGMNMSFLLLAFNQISNNAGMLRYTSGGNFQIPIVIRGPGGVGRQLGAEHSQRLEAYFQAIPGLKIVACSTPYNAKGLLKSAIRDNNPVIFFEHVLLYNLKDELPNDEYFLPLDKAELVRDGLDVTILTYSRMRHHVMQAVVDLVNDGYNPEVIDLISLKPLDITSIAQSLMKTHKLIIVEECMKTGGIGAEIIAQINDNYFDFLDAPIVRLSSQDIPTPYNGKLEKATVIYPQQIIEAVKSIV

SEQ ID NO: 46277 - protein, 244 aa, Tithonia rotundifolia
ANYGGDKQYGRETRHTGDYGNPIHSATGGQYDQEIRQTDEYGNPVRRTDEYGNPVHSATGGTMGDYGSTGLGQGTGGIGTGGYGTTGHQGLRTGLGHTTGGTDYTSGGRSTEQTGYQGLGTESAFGGTTGTFQNQPSATPVGGVGLSTGTGAGFRGTGIGTGVLHRSGSGSSSSSEDDGQGGRRKKKGVMQKIKEKLPGGHSQEEQYQSQTTTTAGGVGRAGYGETHEMKGMMEKIKEKLPGHH

SEQ ID NO: 46278 - protein, 438 aa, Bacillus anthracis str. A2012
  misc_feature (113)..(113): Xaa can be any naturally occurring amino acid
MYLHGTSRINGQGHLEIGGCDTTQLAKQYGTPLYVYDEESIRGKCRAFHRAFKESGFSYQVAYASKAFLCMEMCRVAREENMSLDVVSGGELYTALQAGFPASRIHFHGNNKXEEEIVMALQANIGCFVVDNFLELEILHDLAVQHGKFVNILIRVTPGVEAHTHEYITTGQDDSKFGFGVSNGQAMQAIELALQKSNYNVLGIHSHIGSQIFETAGFVRAIEVLHQFLEEVRERTNYVVKVLNVGGGFGIRYTESDTPLTLETYVRAVTSAVREQFTVCNYPLPEIWVEPGRSIVGDAGTTLYTVGSVKDIPGIRKYVSVDGGMTDNLRPALYNARYEAMLANRGNDENEETVSIAGKCCESGDMLIWDITLPKVASADLLAISCTGAYGYSMANNYNRIRRPAVVFVKGGTSQIVVERETYENIIGNDRIRIKELV

SEQ ID NO: 46279 - protein, 437 aa, Bordetella parapertussis 12822
MSNTYFPRWRLADDTVPGAVIAPDERLSWPKNIAMGAQHVVAMFGSTVLAPLLMGFDPNVAILMSGIGTLIFFLFVGGRVPSYLGSSFAFIGGVVAVTGYVAPGANANIGVALGAIIACGLVYALIGLVVWAASARGNGARWIEAMMPPVVTGAVVAVIGLNLAPIAAKGAMGSSGFEASMALMTILCVGGIAVYTRGMVQRLLILVGLVLACVIYAVCANGLGLGAPMDFAKVAAAPWFGLPSFAAPVFEPQAMGLIVPVAIILVAENLGHVKAVAAMTGQDLDRCVGRAFVGDGVATMVSGAVGGTGVTTYAENIGVMAVTRIYSTLVFVVAAVIALVLGFSPKFGALIQTIPGPVLGGMSVVVFGLIAIAGARIWVVNQVDFSDNRNLIVAAVTLVLGAGDFSVKLGDFSMNGIGTATFGAIILYALLGLARRR

SEQ ID NO: 46280 - protein, 362 aa, Triticum aestivum
  misc_feature (54)..(54): Xaa can be any naturally occurring amino acid
  misc_feature (112)..(112): Xaa can be any naturally occurring amino acid
MADSAGKRPPTPAPASGGGGMAWKLSLALFVLLAAFLYKQIQPPAPEIVGSPGXGPPVTASRTKLKDGRHLAYLESGVPKEKAKYKIIFVHGFDSCRYDVLQVSPELAQELXGIYLLSFDRPGYGESDPDPAPSEKSIALDIEELADNLQLGPKFHLIGFSMGGEIMWSCLKYIPHRLSGVAVLGPVGNYWWSGLPSNVSWDAWYQQLPQDQWAVWVSHHLPWLTYWWNTQKLFPASSVIAYNPALLSEEDAKLMEKFGMRTYMPMIRQQGEYYCLHRDMMVGFGKWGWSPLDLKDPFAGGEGKVHLWHGAEDRIVPVILSRYISERLPWVVYHELPKSGHLFPVAQEMADAIVKSLLLGEQ

SEQ ID NO: 46281 - protein, 422 aa, Candida glabrata CBS 138
MPCPKREMCQTEGGGRVLRVVLLCCCAVVRRCLCVFIGVSLEPQRSISPREKVWWSPHLFIYNHRQISEIAITATIITTTSIITTTTTTIITTTITTITMSGLAYLGVVVVSWVMSSFVTGRVMDVYQKPFLMTYINMSSLVLYLPLYFIWTPSHSPKDCDEESCLMEKHTYGTILQEPATNNNGRLILLTFLFAILWFLANFFTNSSLAYTSVASQTILSSTSSFFTMAIGALVGIELFTGRKLLGLFSSFIGVYLVTMSDFQLPSASTGRSFIGDGLALAGALVYGGYTTLFKSRERLVQKYNMNLVFGLIGLFTLCTCWPLYFVYNKYIQQEPLELPPTSAIYMLILFNCALSFISNFCWAKAVMTLKSPLVVTTGLTMSIPLAMLSDVLFNSQPFSWRYLVGAFYIVQGFIIIDGFSK

SEQ ID NO: 46282 - protein, 313 aa, Ustilago maydis 521
MEFVSQQFNSTVGSILNPTTTHLAADLYKNTDFASLNVLERAWANWYLYWGNPVLATGIMSFVLHELVYFGRAIPWIIIDSMPSMRKYKLQDEKIPTPEQQWKCTKYVLLSHFTVELPQIWSFHPICEYFGLATHDVPFPHWTKIAWQIGVFFLFEDAFHYWAHRALHWGPLYKHIHKKHHEYSAPFGLAAEYAHPLEVLILGMGTIGGPFALCAFTKDLHILTVYIWIVLRLFQAIDAHSGYDFPISLHNWVPFWAGADHHDYHHQAFVGCYSTSFRWWDHMLGTDLSYKRARARQAEKKREALQAAKAKAQ

SEQ ID NO: 46283 - protein, 915 aa, Xanthomonas campestris pv. vesicatoria str. 85-10
MHRITRSTCCYCGVGCGVLIHSEHAADSERIVGIEGDPLHPANFGRLCSKGLALPQTVASTQGRVLQPQLRRHRQAPRTAVGWEQALDHVAHKLAAIIQEHGPDAVGFYLSGQLLTEDYYVFNKLAKGLLGTNNIDTNSRLCMSSAVTGYKLALGADGPPTCYDDLELAHTVLFAGSNMAYAHPVLFRRLEEARARNPDIRWIVIDPRRTDTAAMADLHLAIEPGTDVALFNGMLHHLIWEGLVDARFVAAHTEEFDALKRMLREYTPRMSAEICGIAHEDLVQAAEWFGRSPAALSLYCMGLNQSVHGTDKNLALINLHLATGQIGKPGAGPFSLTGQPNAMGGREVGGMATMLAAHREIANADDRAELERLWGVPAGRISPTAGAPAVQLFERLRAGTLKAVWIVCTNPVHSMPEVAGIRAALENAELVIVQEAFSGTDTVPYADVLLPAASWGEKDGTVTNSERRITRVRKAVEAPGQARADWWIANEVARRLEARLAPARGPGLFAFKHPAQIFDEHRALTIGRDLDIGGLDYALLDHGPQQWPFPAGSTQGQARRYTGGVFAHANGRARFHATPYRKVAEATSARFPMRLLTGRLRDQWHGMSRTGRVAAAFAHSPEPALRMHPGDAQRRGLVAGELVQIASKRGALVLPLELSDELRSGTVFAPMHWSGQSLSSGGINEVSTPAVDARSQQPELKHTAVRVERITFGWHLLAARRGDALALQQALQPLLRDCGYASLRLHAEPSSGTRRRAAGDWVVLHAACERAPDASWMDRLVVALQLPAGADVLEYRDLRRGLMRRVGWRMQDGHHHIDGVLLTAAQPSDADRSLLATALAGEPWRGARLSVFAHTHSAPSDPIVCTCMHVSAAAIHAAIDDGADVAQLKQRLGCGTVCGSCVPQLTRLCRQTRLA

SEQ ID NO: 46284 - protein, 274 aa, Triticum aestivum
MAADTAYAKRVLLACNGGGDAVSRGVAVGLARHGCRLVLLGDEGALAATAEEARRCAAGGASAVAVVGLDLAACDEAAVGAAVEAAWRCFGHGGLDALVNCCSYEGEVQDCLSVTEDEYNKTMKVNAITPWLLIKAIAKRFRDAQSGGSVVCLTQIIGAERGLYPGAAAYGTSLGAVHQLVRLSAMELGKHKIRVNAVCRGLHLGDKFPVSVGEEKAEKATREVMPLRRWLDPEKDLASTVLYLVGDDSRFMTGTTIYVDGAQSIVRPRMRSFL

SEQ ID NO: 46285 - protein, 89 aa, Glycine max
  misc_feature (15)..(16): Xaa can be any naturally occurring amino acid
  misc_feature (21)..(21): Xaa can be any naturally occurring amino acid
  misc_feature (33)..(33): Xaa can be any naturally occurring amino acid
  misc_feature (76)..(76): Xaa can be any naturally occurring amino acid
ARGGGGGGGVGRRVXXNYAFXASEEEVIIKHRXLTRATSGEGEPPLRKRQRRGTTVGSERDKDEESNYNELEKRGXAGLRERRTFEIPL

SEQ ID NO: 46286 - protein, 302 aa, Synechococcus sp. RS9917
MSLAAALSPTPFGRLLTAMVTPFDAEGRVDLALAGRLARYLVEEGSDGLVVCGTTGESPTLSWQEQVQLLEAVRQAVGPGVKVLAGTGSNCTAEAVEATREAAAAGADGALVVVPYYNKPPQEGLEAHFRAVAEAAPQLPLMLYNIPGRTGCSMAPGTVARLMDCANVVSFKAASGSTDEVTQLRLACGARLAVYSGDDALTLPMLAVGAVGVVSVASHLVGRRIRAMIEAQLSGRNAEALGQHEQLLPLFRALFATTNPIPVKAALEASGWPVGAPRLPLVPLSAAMRDDLNQTLAALRQT

SEQ ID NO: 46287 - protein, 185 aa, Zea mays
LVEVYKQVRIGDPLEKGTLLGPLHTPASKENFLKGIQTIKSQGGKILFGGSAIESEGNFVQPTIVEITRSAPVVKEELFGPVLYVMKFQTLKEAIEINNSVPQGLSSSIFTKRPDIIFKWLGPHGSDCGIVNVNIPTNGAEIGGAFGGEKAAGGGREAGSDSWKQYMRRATWREVLEVVSHLFTP

SEQ ID NO: 46288 - protein, 379 aa, Pseudomonas syringae pv. phaseolicola 1448A
MKAIVYGGPRDVSVKNVPDAKIQKPTDALVRVTSTNICGSDLHMYEGRTSFETGRIFGHENLGQVIEVGAGVDRIKVGDWVCLPFNIGCGFCENCEKGLTGYCLTANPGSAGAAYGFADMGDHEGGQAELLRVPYADFNCLLLPEDAAEREEDYVMLSDIFPTGWHATELAGLLPGESVAIYGAGPVGLMAAHSAMIKGASQVFVVDNHPDRLALAAKMGATPINSLEQGAVDQILNLTNGKGTDRGCECVGYQCCDRHGHEANHVTMNNLVASTKATGGIGVVGVFVPQDPGAHNDLAKEGKMAFDFGSFWFKGQQIRTGQANVKAYNRRLAELIHHDRAKPSQIISHRLKLEEGPAAYQHFDARDEGWTKVVLKPSA

SEQ ID NO: 46289 - protein, 368 aa, Oryza sativa (japonica cultivar-group)
MDEKVKMESKLSSAAAFVEGGVQDACDDACSICLEAFCDNDPSTVTSCKHEYHLQCILEWCQRSSQCPMCWQPISMKDPMSQELLEAVEQERNIRANRLNTAAVFHHPVLGDFEVPVGADDAELEERIIQHLAAAAAMRRSHRHGRRDGHRSRSGSHSRPQIVVFSRNEAIPGGSLHASSGQDEDHEQSSDLGSAHPFAALAAVDQGHMSGGSQLYVGHSDQGASNPSLHDERAMSRYKDSITKSTRGWKERWFSRSNTISGLGTEVRREVNAGIAAVSRMMERLETKDDTGPSAVPAASACSPSDANNQRTDLALNEPTPCSLKNWIHCEDRKFAEAFASRSRDIRLVLADEPLHFFTLCNIYARLL

SEQ ID NO: 46290 - protein, 310 aa, Thermoplasma volcanium GSS1
MSFSDYISRIKDNIRNSIKGKAIIAVSGGQDSSLLSLLASEVLGNNLLCVFIDTGLLRKNETGRVKDFFEKHSMNYVIVDAADTFINNLKGVTDPEEKRKIIGKTFIDVLSEQAQNFGAEYLLQGTIAPDWIESGGQKRDTIKSHHNVGGLPKDMKLKLVEPLRDYYKDEIRGMSKELGLPTDIQPFPGPGLAVRIIGEVTKEKLDLLRAVTDIVERKISEAMPSESRPWQYFAVLLPVRTTGVHGDRRAYGLTVGIRMIETTDAMTGTFSKPSWDLLEDISNTITDEIPEINRVVYDITNKPPATIEWE

SEQ ID NO: 46291 - protein, 237 aa, Cenarchaeum symbiosum
MGAVVARALSSYHGIPIYPVNHAIGHIELGKLLTGAQDPLVLLVSGGHTMLLAFVGGRWRVFGETLDITLGQLLDQFGRSLGFPSPCGRQVEELAAESSEYTDLPYSVKGNDVSFSGLLSAAKTAARRGKETASYSLQETAFAMVAEAVERALSFTRKRELMVVGGVAANKRLAGMLEGACGRQRCRLFVVPPVYSGDCGAQIACTGLLEASIKDGAPLADTFVRQSWRLDTVDVGY

SEQ ID NO: 46292 - protein, 654 aa, Leptolyngbya boryana
MTDTLAAPTLNKFEKLKAEKDGLAVKAELEHFARLGWEAMDETDRDHRLKWLGVFFRPVTPGKFMLRMRVPNGIITSGQTRVLGEILQRYGDDGNADITTRQNFQLRGIRIEDLPEIFRKFDQAGLTSIQSGMDNVRNITGSPVAGIDADELIDTRGLVRKVQDMITNNGRGNSSFSNLPRKFNIAIAGCRDNSVHAEINDIAFVPAFKDGTLGFNILVGGFFSGKRCEAAIPLNAWVDPRDVVAVCEAILTVYRNLGLRANRQKARLMWLIDEMGLEPFREAVEKQLGYAFTPAAAKDEILWDKRDHIGIHAQKQPGLNYVGLHVPVGRLYAQDLFDLARIAEVYGSGEIRLTVEQNVIIPNVPDSRVSALLREPIVKRFSIEPQNLSRALVSCTGAQFCNFALIETKNRAVALMQELEQDLYCPRPVRIHWTGCPNSCGQPQVADIGLMGTKVRKDGKTVEGVDLYMGGKVGKHAELGTCVRKSIPCEDLKPILQEILIEQFGARLWSDLPESARPNPTALITLDRPTVETPNGKSTTVQELNAQEFDYVLSAPPVVKAPTEIAAPATIRFAQSGKEITCTQDDLILDIADQAEVAIESSCRSGTCGSCKCTLLEGEVSYDSEPDVLDEHDRASGQILTCIARPVGRILLDA

SEQ ID NO: 46293 - protein, 91 aa, Arabidopsis thaliana
  misc_feature (44)..(44): Xaa can be any naturally occurring amino acid
  misc_feature (52)..(52): Xaa can be any naturally occurring amino acid
MVLVLALGDLHVPHRAADLPPKFKSMLVPGKIQHIICTGNLCIXKEIHDYLXAICPGFAYRFGGGVFTEDGLKTLLFGIPRGFFGPGVPGF

SEQ ID NO: 46294 - protein, 536 aa, Oryza sativa (japonica cultivar-group)
MADMKQEEISHPPMDQLQGLEYCIDSNPSWGEAIALGFQHYILCLGTAVMIPTLLVPLMGGNAHDKAKVVQTMLFVTGINTMLQTLFGTRLPTIIGGSYAFVIPVISIIKDPSLAQITDDHTRFIMTMRAIQGALIISSCIQIILGYSQLWGICSRFFSPLGMVPVVALVGLGLFERGFPVIGRCVEIGLPMLVLFVALSQYLKHVQVRHFPILERFSVLISIALVWVYAHILTASGTYKHTSLLTQINCRTDRANLITSADWIDIPYPLQWGPPTFSADHAFGMMAAVVVSLIESAGAFKAAARLASATPPPPYVLSRGIGWQEYNAFALYVNNQGIGLLFDGLFGTGTGSTVSVENIGLLGSTRIGSRRVIQISAGFMIFFSILGRFGALFASIPFTMFAAIYCVMFGYVGAVGLSFMQFTNMNSMRSLFIIGVSLFLGISIPEYFFRYTMSALHGPAHTRAGWFNDYINTVFSSPPTVGLIVAVILDNTLEVRDAARDRGMPWWARFRTFRGDSRNEEFYTLPFNLNRFFPPS

SEQ ID NO: 46295 - protein, 175 aa, Triticum aestivum
MAPTVMASLATSVAPFQGLKSTAGLPVSRRSNGASLGSVSNGGRIRCMQVWPIEGFKKFETLSYLPPISTEALLKQVDYLIRSKWVPCLEFSKVGFIFREHNASPGYYDGRYWTMWKLPMFGCTDATQVINEVEEVKKEYPDAYVRIIGFDNMRQVQCVRFIAFKPPGCEESGKA

SEQ ID NO: 46296 - protein, 949 aa, Cryptococcus neoformans var. neoformans JEC21
MSGTHSRKSLKTSFRPSPRSIRPIYTGGPVLLTKDGQWIITTMGEEALVTEVQTGLAIARIRGDGTPITSLSLSYHTSPPTLITSHMSMTVRYYPLPESAPLSSTPKPPSLTYTRILNKAHSAPILVSKVSPDNTLLATGSSDGIVKVWDLAGGYVTHLFRGHGGPVSALHFNFPIISGEERRRMELLTGSTDSRVRVYDLRDANARVVGGGNAVKPKAVLEGHVSVVRGIDVTPDGKWAVTGGRDKVVLVWDMLSGETTALAKKGKGKATAGPKLVQTIIAQEQVESLGLLPQEEQVSGAAEGRWLCYTGGDKGLVRVWDVLKGTQVATMKGVEGVDETELDEDEQRGVLSVMYSPTSSSLVSIHADQNIIFHSLSTLLSTRQIIGFNDEIVDVAFLSHPSAPTTSPSSLPETPDIPHSHMAVATNSNLLRVYSTSSFNARLLPGHSDMILCLDISPDHQWLVTGSKDHTARVWAPTTCAEGDGYTWKCIAICEGHAESIGAVAFARKPSDNGHARFLFTASQDRTIKMWDLTPLSNSLSPSPIRPRSMATLRAHEKDINSLDIAPNDKFLVSGSQDKLVKLYAIDFNPPKVPGEGKGAEGGFKALGTCAGHRRGVWTVRFSRNDKVVASGSADRTVKLWSLDDFTCLKTFEGHTNSVLRVDFLSHGQQLVTSASDGLVKLWNIKEEECVKTLDNHEDKIWALAHSSDESTLLSAGADSLLTIWHDTSLLEQSEANATLIKSVQVEQDFINYVALKDYRRAILLALSMSQPGRLFNLFSTVVKGRQPDLTEEEQGITGSKEIDEIMKTLPGIELVRLLKFVRDWNANAKMAPVAQVILHAIFKLRSAEDILAAFEQANRLPKRSEEEEEDEDEDEEKEEGEEKKKKKKKERPSLGAPISIKDLLEGLIPYSERHFNRVDKLVQESYMLDYVLGEMEGGLFGEELMDLQ

SEQ ID NO: 46297 - protein, 231 aa, Oryza sativa (japonica cultivar-group)
MAEADGDRGVAAAAAAAAVVHDDVLESDEEDFTFAAAAAVTCVVGGGRIGAVVYPVFGRPRSPPPVQEVEEPDTATVRVPLGQLLLEERASAPPSGEQADEDGVLDGVPAETYCLWSPGSPAPAVSNSPARCQKSGSTGSVLRWRQRLIGRSHSDGKEKFVFLSSGSDVRSKGRTTTTSRGDAGGRGGGWRYYASGGGNGGGRRPSFLPYKQDLVGLFANAGAFRRSYHPF

SEQ ID NO: 46298 - protein, 249 aa, Brassica napus
MGYWNSKVVPRFKKIFEKSSVKKAAAAEACKTFDESKEAINKEIEEKSTELQPKVVETYEATSAEVKALVRDPKEAGLKKNSAAVLKYLEALVGIEFPGSTAVKEAASSFGAGYVSGPVTFIFEKVCVFLPEEVKTREVPVEEVKAEEPAKTEEPVKTEEPAKTEEPVKTEETSGEKEKEIVEETKKEEIVATSVVEEKKPEVEKEEEKKPVVEEVKKEEAAPAPAVVETPVTAPETTTPAPVAEPPKP

SEQ ID NO: 46299 - protein, 320 aa, Aspergillus oryzae
MTFHPDTLPNLKGKVFIVTGGNSGIGYYTVTHLAEHGAHVYLCARSLEKGTAAIANIKEMHPSANINLLQMDFMDLTSVVAAAKHFLTLETALHGLVNNAGIMATPFEITKDGHEAQWQTNYLAHWVLTEHFLPLMLLTAKGLYPGSVRIVNLTSSGHLGAPKGGINFKDLSLKDSGPWARYGQSKLANILHAKALHKAYGPGSPSARNGEGEIWVSSVHPGLVETNLATSVEDSGSGMTCVFSVLRMFGLMWSADKGSWTSLFCVASQDMKAEQSGTYLEIFRRFGEPRWQSDMANDWKLVKRLEEWTREVVRKEGWVL

SEQ ID NO: 46300 - protein, 305 aa, Oryza sativa
  misc_feature (28)..(28): Xaa can be any naturally occurring amino acid
  misc_feature (48)..(48): Xaa can be any naturally occurring amino acid
  misc_feature (216)..(216): Xaa can be any naturally occurring amino acid
  misc_feature (262)..(262): Xaa can be any naturally occurring amino acid
MVGRNPGRPRVCARSPAKDDGRMTLLCXPLVLRTVEAMQADAAAAAAXGADLVEIRLDFIEGFRPREHLPSLLRGCPIPALVTYRPNWEGGQYDGDDATRFEALRLAMELGVDYVDIELKVADKFISFISGSKPEKCKLIVSSHNYESTPSCEELADLVASDIADVSRMFQVMVHCQVPMIGLVMSEKGLMSRVLSPKVGGYLTFGTLDATKISAXPGQATVKELVGTFINIRGIGTDYKGPWAYWQPRLKQSKKPFWPNKXSQTMGYKGCYLPTLGRLTLVEFFRPIILFRRFPGFRWPLFLSK

SEQ ID NO: 46301 - protein, 160 aa, Brassica napus
MAASVDPLVVGRVIGDVLDMFIPTANMSVYFGPKHITNGCEIKPSAAVNPPKVMTDPDAPSPSEPNMREWVHWIVVDIPGGTNPSKGKEILPYMEPRPPVGIHRYIFVLFRQNSPVGMMVQQPPSRANFSTRMFAGHLDLGLPVATVYFNAQKEPASRRR

SEQ ID NO: 46302 - protein, 526 aa, Oryza sativa (japonica cultivar-group)
MASESESNGHHHAGDEARAENSGAGCLHGGDDGGGTPRTTPEIRYTKLFINGRFVDAASGKTFETRDPRTGDVIARVAEGDKEDVDLAVKAAREAFDHGEWPRMSGSERGRVMAKYAEVVERHADELAALESLDAGKPLAAARAVDVGECVGILRYFAGAADKIHGETLKMSRQLQGYTLREPLGVAGLIVPWNFPAIMFFSKVSPALAAGCTVVVKPAEQTPLSALFLAHLSKQAGVPDGVINVVTGFGPTAGAAISSHMDVDVVAFTGSTEVGRLIMEASAKSNLKPVALELGGKSPFIVFDDADLDKAVELAIGGNFFNKGEACVAGSRVFVQEGIYDRFEQKLADTMKSWVVGDPFDPRVNQGPQVDKAQYERVLGYIEQGKAEGATVLTGGKPCGKKGYYIEPTIFTNVKDDMVIAREEIFGPVMCLMKFKTVEEAIERANGTRYGLAAGLVTRDIDVANRMARSIRAGVVWVNCYFAMDRSCPFGGRKMSGFGKDDSMHALDKFLAVKSVVTPVHGSPWF

SEQ ID NO: 46303 - protein, 427 aa, Myxococcus xanthus DK 1622
MVPALSTVPFDPLSRLHLQPWSALAGLGPVAADAIAQVLAGSAAERVLDRTLRDRRSLTREQRLALKEAVFNVGLWRRRLGFLLGREDAAPLFLLHALMHGLAGVPAVESAALAGLGDGAPPPLVSAPPPTLALRASLPDWLADHFAREFGPEADDFCAHLNVPGPITLRANVLRTSREALAERLRSEGVETRPGPWSPLALHIEGPRPNLYGLRSLQEGLFEVQDEGSQLLGLLVEARPGETVLDLCAGAGGKTLQLGADMKDSGRLLAYDPDPERLDRLLQRSSRAHLTRVQVLRSLPESLDADRVLVDAPCSELGSLRRGPDQRFRIQPEVLTRFPALQQDILQRGARLVRPGGRLVYATCTVNRAENEDVVAAFLASRPDFRLVRPGAGWLSDACLRDGFLFVAPHRHGTDAFFAAVLERTAG

SEQ ID NO: 46304 - protein, 555 aa, Zea mays
LHAACLTMRTGGWRAASFIIVAEIGERFAFYAVASNLIIFLTGPLQEGIAAAAAATNVWNGTALMLPLLGGAIADLWLGRYLTIISASLLYTLGLGLLAVSTLVGHHCNAAATGDRCPAPPTIQVTLFYVSLYMVAVGEGGHKPCAHAFGADQFDQSDPGESVSRSSFFNWWYFGVCAGTAATLLVVSYVQESLGWHPGFAIPCAVMACTLVVFLLGTRTYRYTDTSGTRNLFAHAAEAFAGWRRRQRSRLRAAHRTSHQASHQGVVGVSAEEPPEASRRSRIDEEAQVVAATTAATNTAVVVSEAKDVLRLFPIWAMTLVYAVVYSQSMTFFTKQATTLDRRVGEVVKVPAAALLAFISITIMVLIPVYDGLIVPLSRRFTGRPSGITMLQRIGAGMLLSTVSTVIAALVEERRLRVAREAGLADEPRIQLPMSLWWMVPQYVVFGAADVFAMVGLQEFFYDQVPDRLRSVGLALYISIFGIGSFVSSALVSGIHRVTAARGQSWFSDNMNRGHLDYFYWLLAGLSALQFFAYVFFAWRYKYINRTLEPRTCDT

SEQ ID NO: 46305 - protein, 846 aa, Oryza sativa
MMHPSLLATTQWVTLSTLLSIAVAADNYFSSSSPIFLNCGASAMQLDSNNRSWDGDTSSTFAPSVKGLAARASYQDPSLPSLVPYMTSRIFISNYTYSFPVIPGRMFVRLHFYPVAYGNYASRDAYFGVTTNNLTLLDNFNASQTALAAKYAYILREFSLNVTSGSLDLTFFPSTQNGSYAFVNGIEIVPTPDIFTTLSPIPPTNGNPDPSDIDSMISFQTMYRLNVGGMTISPQGDSMFYRSWENDSPYIYGSAFGVTFSKDSNVTITYPSTMPNYIAPADVYGTARSMGPIAQINLHYSLTWILPVDAGFYYLLRFHFCEIEYPITKVNQRSFFIYINNQTVQEQMDVIVWSGGIGITTYTDYVIVTVGSGQMDLWVALHPDLSSGPEYYDAILNGLEVFKLQDIGKKSLAGLNPPLPPQPKSDVNPKGVSGGGKSKGAVPASIRGAMGSTATMLIACFSVCIICRLKKVAKHSFMTDKKCMTYRTEFYHSPSNLCRNFTFDEIQVATRNFDESLLLGRGGFGDVYRGEIDNNGENVAIKRSNPLSVQGVHEFQTEIELLSKLRYCHLVSLIGYCKEKNEMILVYEYMAQGTLREHLYNSNKPSLPWKQRLKICIGAARGLHYLHMGANQTIIHRDVKTANILLDDKWVAKVSDFGLSKANPDIDSTHVSTVVKGTFGYLDPEYYRRKQLTQKSDVYSFGVVLFEILCARPAVNIELPEEQASLRDWALSCQKKGMLGKIIDPHLHGEISPPCLRMFADCAKQCVADRSIDRPLMSDVLWSLEAALKLQENAENNKKFSEATTSSKRTPDLITIMGTDKPSTYSTMSITGQKIIFSDMMHPQGR

SEQ ID NO: 46306 - protein, 178 aa, Oryza sativa (indica cultivar-group)
MAKKLLAAAAALLLLLAAAAPALASSSSSPGSANLTATPTAYEMVERYGFPRGILPEGVESYVLRPDGSFEVRLSGDGNGGGDCEFRVGDGGAYLLRYGRRVAGVAMEGSIRSLEGVSVKVLFAWLGIGRVDRAGDDLRFFVGPLSAAFPLANFADCPRCRCGFDCDTAAAADVIAAS

SEQ ID NO: 46307 - protein, 153 aa, Oryza sativa (indica cultivar-group)
MAKLIFLLAMVPFASTLLVSIAGAADNSTSPSSPSADPTAYDMLQRFGFPVGILPQGVQGYKLGDDGSSFEVYLAGDCEFRAAKKYVLHYSSRVAGQIAAGSITSLEGVKVKEAFAWFRISEVDVDGDQIKLHVGLYTATVAADQLAVSPQCN

SEQ ID NO: 46308 - protein, 184 aa, Oryza sativa (indica cultivar-group)
MASINHHLLLAAAAAVLLLAAAATATASRVTVTSLANTTSSLVAALGSSGIIAGGRAANASANTTAAAEPTVYEMLGKYGFPPGILPAGAQGYTLDAGDGSFQVTLPGDCVVDVQGYKLRYRSNIYGNVRAGSIDGLDGVSVKIAIVWVGIHDVEADGGDVTFHAGAISKSSPADGFQTSPSCQ

SEQ ID NO: 46309 - protein, 377 aa, Musa acuminata
MADTDDIQPLVCDNGTGMVKAGFAGDDAPRAVFPSIVGRPRHTGVMVGMGQKDAYVGDEAQSKRGILTLKYPIEHGIVSNWDDMEKIWHHTFFNELRVAPEEHPILLTEAPLNPKANREKMTQIMFESFDVPAMYVAIQAVLSLYASGRTTGIVLDSGDGVSHTVPIYEGYALPHAILRLDLAGRDLTDSLMKILTERGYSFTTSAEREIVRDIKEKLAYVALDYEQELEAARTSSTVEKSYELPDGQVITIGAERFRCPEVLFQPSLIGMESAGIHETTYNSIMKCDVDIRRDLYGNIVLSGGSTMFPGIADRMSKEITALAPSSMKIKVVAPPERKYSVWIGGSILASLSTFQQMWISKAEYEESGPAIVHRKCF

SEQ ID NO: 46310 - protein, 338 aa, marine gamma proteobacterium HTCC2207
MTQMNTRVLLARRPAEHLVAADFEVDTQPLGTIEEGQFLIQNTYLSMDAGFRQWMNEGSGDNYLASMPLGEPVQSIIMGRIIESRHSGYPVGSTVMGRTSWEQYSIDDGTDFMAILDLDPDVEPYEYLASLGPSGMTAYFGLMDIGAPKSGDIFVINAAAGGIGSLAGQMAKAEGCTTVGIAGGPAKCAWLKDTLGYDHVIDYKSGESLDDQLLALAPEGADIMFDNVGGPMLGTMLGHLAENARVVLCGAVSQYEREGGHESVANMWELITKRAKAEGFMFSDYVDRYPEALDYITAMLKADALVSPVHISQGIESSGQAFIDMLDGNSTGKCLVKL

SEQ ID NO: 46311 - protein, 320 aa, Oryza sativa
MSGRRDDSAKMAKLKELLHRSENRICADCSAPDPKWASANIGVFICLKCSGVHRSLGTHISKVLSVTLDQWSDNEIDNVIEVGGNSHANAIYETFLPQNHSKPHPDSTQEEREKFIRSKYELQEFLEPSLRIVSHQSSDSGKHAGSGSHSVSSKSEVGMIEFIGILNVKVKGGTNLAIRDMSSSDPYVVLTLGQQKAQTSVIKANLNPVWNEELKLSVPQQYGPLKLQAFDHDMLSKDDLMGEAEIDLQPMINAAAAFGDPGLLGDRQIGRWLKSGDNALVRDSAVVVPGGEVRQELALKLQFTESGEVELEMQWFPLNM

SEQ ID NO: 46312 - protein, 248 aa, Oryza sativa (japonica cultivar-group)
MDRHHHHHHHHHHHMMSGGGQDPAAGDGGAGGATQDSFFLGPAAAAMFSGAGSSSSGAGTSAGGGGGGPSPSSSSPSLSRYESQKRRDWNTFGQYLRNHRPPLSLSRCSGAHVLEFLKYMDQFGKTKVHTPVCPFYGHPNPPAPCPCPLRQAWGSLDALIGRLRAAYEENGGTPEMNPFGARAVRLYLREVRETQARARGISYEKKKRKKPSSAGAGAGPSSEGSPPPPGGSASGGGDTSASPQFIIP

SEQ ID NO: 46313 - protein, 279 aa, Alteromonadales bacterium TW-7
MQLPTVDYKAPDAAAQFVESLRNTGFGVLKNHPIPQSLVESIYKNWQDFFNSEQKHDFLYSKETQDGYFPPSVSEVAKGFTVKDIKEYFHVYPKGRVPAELEADVREYYRLANEFAATLLSWVQAEAPADVRAKFSIDLKDMIADSDQTLLRILHYPPMTGDEEPGAIRAAAHGDINLLTVLPASNEPGLQVQKTDGGWLDVPCDFGSLIINIGDMLQEASGGYFPSTIHRVINPTGKASTKSRISLPLFLHPRPDVVLSERYTADSYLQERLRELGVK

SEQ ID NO: 46314 - protein, 330 aa, Flaveria bidentis
MSAASAFAMNAPSFVNASSLKKASTSARSGVLSARFTCNSSSSSSSSATPPSLIRNEPVFAAPAPIITPNWTEDGNESYEEAIDALKKTLIEKGELEPVAATRIDQITAQAAAPDTKAPFDPVERIKSGFVKFKTEKFVTNPALYDELAKGQSPKFMVFACSDSRVCPSHVLDFQPGEAFVVRNVANMVPPFDKTKYSGVGAAVEYAVLHLKVQEIFVIGHSRCGGIKGLMTFPDEGPHSTDFIEDWVKVCLPAKSKVVAEHNGTHLDDQCVLCEKEAVNVSLGNLLTYPFVRDGLRNKTLALKGGHYDFVNGTFELWALDFGLSSPTSV

SEQ ID NO: 46315 - protein, 416 aa, Streptococcus pneumoniae R6
MKTPFINREELEAIVAEFPTPFHLYDEKGIREKARAVNQAFSWNKGFKEYFAVKATPTPAILKILQEEGCGVDCSSYVELLMSHKLDFLGSEIMFSSNNTPDKEYAYARELGATINLDAFEDIEHLERVAGIPEIISCRYNPGGVFELGTDIMDNPGEAKFGMTKDQLFEAFAILKEKGAKTFGLHSFLASNTVTHLYYPELARQLFELAVEIKEKLGIWLDFINLSGGIGVNYRPDQEPNDIALIGEGVRKVYEEVLTSAGLGQVKIFTELGRFMLAPHGALVTRVTHKKETYRTYLGVDASAVNLMRPAMYGAYHHISNVTHPDGPAEAVDVVGSLCENNDKFAVNRELPHTEIGDLLVIHDTGAHGFSMGYQYNAKLRSAEILYTEEGKARQIRRAERPEDYFATLYGFDFEE

SEQ ID NO: 46316 - protein, 128 aa, Brassica napus
MLKGEAEPKQRKGWSNSLLEFRSGFGEKMKLVSKKRWKSLAPLNLKSKSVARFCFFSKLKSSNHGPDRAPVYLNVYDLTPINGYIYWAGLGIFHSGVEVHGVEYAFGAHDYATSGVFEVEPRQCPGFK

SEQ ID NO: 46317 - protein, 313 aa, Zea mays
MSPFYLARGASKLVRRITSETSVELKILSEKWRLLLAGVIFQYIHGLAAHGVHYLHRPGPTLQDLGFMILPELGKERGYISETLFTFIFLAFVLWTFHPFILQTKRFYTVLIWRRVLAFLCVSQFLRIITFYATQLPGPNYHCREGSHLARLPPPQNAAEVFLINFPRGVIYGCGDLIFSSHMIFTLVFVITYQKYGSMRFCKMLAWCVAIVQSLLIVSSRKHYSVDVVVAWYTVNLVVFFVDKKLTELPDRSVGSTSILPLSAKDKDTKLKEENTRLLNGNSMDSADRRPRTQMNGKQIDNESQVDSETVKA

SEQ ID NO: 46318 - protein, 393 aa, Cryptococcus neoformans var. neoformans JEC21
MPSRGRSTTPKSLTPDRSPARSYLSRSRSPSRSRSRSPLPRKASLRDADMDAPGDGLYKVIVVSGLSKNVMKGHLDEIFSEYGRITGIDLPLFKVSGLNKGKAAIEFDTPAAASKAVKCMDGGQLDGSFLNVQVSLSIKPMHELAADEQRQISEHPLPPPQAPSPRRRSPSRSRSRSPPPARRRRSLSRSRSPSPRKGDRVPSYGRRRSYSRSRSPPRHRGGRDSFPGRNGNGYGPGPSGGRGGGGGRGGFSRGGGPPPPGGRDNGWRRERSPPVPVRKWGERGAPRRPSPEYGRGARSASRSVSPRGPRGGVRSRSPVRRRASVSRSRSPVRRRSRSRARSYSRGRSVSMSRSRSRSPLPRKRYSLSRSRSRSSTRSMSIDRSRSGTRSPRK

SEQ ID NO: 46319 - protein, 120 aa, Rickettsia sibirica 246
MMYNKENVFAKIIGKNLPAEIIYEDEQILAFKDIAPVAPVHIIVIPKNEYIDYADFISKASIDEIKHFFAKLSDIANEAGLDKDGYRLITNKGEKSGQTIFHFHFHIIGGEKLIGLINND

SEQ ID NO: 46320 - protein, 474 aa, Novosphingobium aromaticivorans DSM 12444
MRERLQQYIDGKWVDSEGGKRHEVINPTTEEPCCVITLGTQADVDKAVAAAQRAFKTFSKTTREERLALLERIVEEYKKRVPDLAAAMAEEMGAPVSFASTAQVGAGIGAFLGTMAALRNFSFVEDNGAFKVAYEPIGVVGMITPWNWPLNQIALKVAPALAAGNTMILKPSEECPTNAAIFTEILDAAGVPPGVFNLIQGDGPGVGTAISSHPGIDMVSFTGSTRAGILVAKAAADTVKRVHQELGGKSPNVVLPDADFAKYLPSTASGPLVNSGQSCISPTRILVPREREAEAAAFVSAMYSATPVGDPMQEGAHIGPVVNKAQFDKIRGLIQSAIDEGAKLETGGPDLPANVNRGYYIKPTVFSGVTPDMRIAQEEIFGPVATIMAYDSLEEAIEIANDTAYGLSACITGDPAKAAEVAPELRAGMVAINNWGPTPGAPFGGYKQSGNGREGGLYGLKDFMEMKAISGLPA

SEQ ID NO: 46321 - protein, 505 aa, Oryza sativa (japonica cultivar-group)
MELTTISPVFLISLLGVPLLYLLWSKASKSPSGAPAAPPPPPGPTPFPVIGNIPDLLRGGELHRALTGLAASYGPVMSLRLGMASTVVLSSPDVAHEALHKKDGAISSRWVPDNANVLGHQDVSMAWLPSSSPLWKHMRTLASTLLFTSRRLGASRGIRERKARELVDYLGARSGRPVRVGLAVFGSVLNFMSNVFFSEDVVELGSETGQEFQQLIADSVAETAKPNISDFFPFLSALDLSRRRRAAAKNLKKFYDFFDDVIDRRLSSGEKPGDLLDSLLELHAKSQLERPLIRALMTDLFIAGSHTTTTTVEWAMAELLRNPSKMAKARAELGEAFGRGAVEEGELARLPYLNAVIKETLRLHPPAPLLLPHRVSSDSEPAGGVTLGGYSVPSGARVLINAWAIGRDPAAWSPEPDAFSPERFLGREADYWGRTLEFIPFGSGRRACPGIPLAVAVVPMVVAAMVHSLEWRLPEGMAPGDVDVGDRFGAVLELATPLWAVPVKV

SEQ ID NO: 46322 - protein, 235 aa, Rickettsia sibirica 246
MKDIEYWEKNFESCKYSDQLIERLLFLNTQVKQPIDIREVQKGIYYARKYHGEQMRQSGDPYYSHPIAVTIMVAEFVAKEVPKLFTFRMLQAALLHDTIEDTELTEEIISNIFDEEVARHVAGLTRIKPWGKISSEKSLILLIKQKRYDTALIKLFDRIHNLQTLEAKSPEKAHKIIKETLKSFLVLSEILEIPSVSELIYAECYKNNLKFNINSTFNKIINFDSFPFSQNKLLP

SEQ ID NO: 46323 - protein, 392 aa, Oryza sativa (japonica cultivar-group)
MIHLRRSFLSRLLHPPCPTPANPLPLHRLLSSAAAAAPIPPEPFAVEDYLVDSCGLTRARAKKASGKLSHLRSPSNPDAVLAFLSGLGLSRPDIAAVVVNDPLFICARVDKTLATRVAELTDLGLSRSQIARLIPVVRSLFRCKSLAPRLAFLLTVFGSFDRCLEVIKTNYGVLSSNVEAVIKPNLAVLKECGISIADRPSYAFASRVISRPTKHLEEAVVLANEFGAKQGTRVFTNAVMIFGILGQEKLAKKLEFFKKLGWSQDDLSLAVRSMPHILAMKEERMRRGMKFLTEDVGLEIPYIARRPALTMYSIERRLLPRHCLINVLKGNGLLKANYDFYNISVISNDDFMEKFVQPYVESVPGLGDAYASSCTGCGVHQLKLLSKRKTKC

SEQ ID NO: 46324 - protein, 434 aa, Robiginitalea biformata HTCC2501
MNIPKTEYPRIVLVGGGFAGIALAKRMKGLPVQLVVIDRQNYHNFQPLLYQVSTGGLEPDSIAYPIRKILKRLDNMYFRWAEAESVDPARGVLRTDKGEITYDYLILATGTRTNYFGNDQMRDFALPMKTIPQALNIRSLALQNLEEAEYTEDQAERRALMNFCIIGAGPTGVELAGAFAELKRHVFPRDYKHLAVDEMEINLFEGADRVLPPMSETASRKSREFLESLGVRIHLDTFVDTYDGRLLTTKDRREFRTANCIWTAGVTGALLPGFPEGSTDSRTGRLLVDELNRVRGYGSVFAIGDIALMRTDDYPEGHPQMAQPALQQGAHLADNLERLLKGREMQPFNYKDKGSMATIGRNKAVVDLPGYQFGGFAAWFIWMFIHLMSLVGFRNKVVVFFNWVYNYINYDKAARLIVRPFTKKKRKETQYAGK

SEQ ID NO: 46325 - protein, 397 aa, Synechococcus sp. CC9311
MLTSKRLARLGSGVFDRNDQRKRLYKLGGTQQQQPLIDLSLGCTDLLPPPAAVQAMGDRLQEPRSAAYCLHAATASFREAAGAWCNQRLGVSVDPEREVLLLVGSQEGTAHFPLTVLDPGDQALILDPSYPSHRGGLELADACIQTLPLTAEQGWAPDFKAITISQWDQLRLLMLGFPHNPTACVGQQSWLDEAMGQAQRHDLVVAHDNPYLDLALEGEAPSLLRCPHWRERGIEFFSLSKGWCLGGFRLAFAIGAEPLITALRQIKSVIDFNQCQALQQGAVVALSDHADWPAHLLPTYRERRDRTRTALSELGWPIPSPSMALYLWMPVPAWASAQGWGDEQMAAQLLEHCGVAITPGSGFGEAGRDWLRLALVRPVAELEAAVARLKPWWHQQC

SEQ ID NO: 46326 - protein, 352 aa, Arabidopsis thaliana; identical to SEQ ID NO: 1058

SEQ ID NO: 46327 - protein, 641 aa, Helicobacter pylori J99
MQLSNADLERLKSMANTLRFLCADMIDKANSGHPGVCLGLADVMVVLSLHLNLNPTNPKWLNRDRLVFSGGHASALVYSLLHLWGFDLSLDDLKRFRQLHSKTPGHPELHHTEGIEITTGPLGQGFANAVGFSMASQYAQTLLDKEAISHKVYCLCGDGDLQEGISYESTSLAGHLRLDNLIVIYDSNQISIEGAINISFSEQVKTRFLAQNWEVLECDGHDYQAIHNALEEAKKSHKPTLLIAHTIIGKGAIGLEGSEKTHGSPLSKEVLKQSKENAQINPNESFIISPKNKMHFEEVKVRGISLEALWEKSLSPKTKEKIHALKNFDFNAINYPAFKKGESLATRVSNGMILNAIAKECEGFLGGSADLAPSNNTHLKHSGDFPLGQNLHFGIREHAMGAITNALAAYGLFVPFCATFFVFSDYLMPSIRLSALMKLKALFIFTHDSIGVGEDGATHQPIEQLSHLRALPHFYAFRPSDAFENKACMQVALSLNAPSALILSRQNLSVLDEVSKEQVLKGAYVKHHSKDPIITLVASGSEVSLALESAKILERENIPTQVVSAPCFDLLVEQDESYFKELFKGKVLVIEASRAIEWYRFADKIIGMDSFGSSAKGDKLFEKFGFSVENITAQAKRLLNA

SEQ ID NO: 46328 - protein, 379 aa, Cenarchaeum symbiosum
MSRQLAPGLEIEKADDRIMTLNVGPQHPGSGHMRLVVKIDGDYIVSCDPDPGYVHRGEEKMAEYRNFVLNIPHLERPVIHDSCNILYPYCLAAEDIIGVEVPERAKYVRVIASELNKCIYIQYWLAIYGIFLGHSTMFMWPAGDRELLIDLMEKLTGARVTHAYFVPGGVRNDLPANFEDVCLRQVNYFEKRIKEYADIFYDNPILKARTVGTGVLSRQDAVRFGTTGSVLRASGVDFDLRKREPYDAYEEMDFETPVLKEGDSYARSKVPWLDMMESCRIIRDALSKMPKSGKVRTKLKPNPKGKLPHEEVYRRVESGRGSLGCYIVSDRKPEPYRIKLSVPSFRNLICLPNLLRGEKLGNMPAVYWSLNYWPVEADR

SEQ ID NO: 46329 - protein, 423 aa, Oryza sativa (japonica cultivar-group)
MDRFKMIKEVGDGTFGSVWRAINKQNGEVVAVKKMKRKYYSFEECMSLREVKSLRRMNHPNIVKLKEVIRENDILYFIMEYMECNLYQLMKDRVKPFSEAEVRNWCFQIFQALAYMHQRGYFHRDLKPENLLVSKDVIKLADFGLAREVTSVPPYTEYVSTRWYRAPEVLLQSSIYDSAVDMWAMGAIMAELLTLHPLFPGTSEADEILKICNVIGSPDEQSWPQGLSLAETMKFQFPQVSGNQLAEVMTSVSSEAVDLISSLCSWDPCKRPKAAEVLQHTFFQGCTFVPPTVRSKAGVLPKTPPCVGVKGVSEHGMPRRYSTGTLSTTKPHSNASLKSSGLSKTGHPVLRHSRSLPETGRATMHKVSTLTERLTHMSVTSRTRTTPKPAAPLLKAGLGKSDLLGKTDEIPPAKRLTRKLVFV

SEQ ID NO: 46330 - protein, 469 aa, Novosphingobium aromaticivorans DSM 12444
MATAKDILARIKDEEIEWVDLRFTDPKGKWQHLTMVSTVLGEDELEDGLMFDGSSIEGWKAINESDMILKPDLDAVYVDPFSASPMLIICCDIVEPSTGELYARDPRSTAKRAEAFVKTAGLGDTVYVGPEAEFFLFDDVKFYDGYDGNGFRIDDIELPTNSNKDIEGGNLAHRPRAKGGYFPVAPVDSCVDIRGEMVRTMLDMGLPCDKHHHEVASAQHELGLTFGTLVQTADRMQVYKYVVQQVAHAYGKTATFMPKPIKGDNGSGMHTHISIWDSGKPLFAGNGYAGLSDMCLYFIGGVIKHAKALNAFTNPTTNSYKRLVPGYEAPVLLAYSARNRSASCRIPYGAGAKAKRVEFRFPDAMANPYLCYAALLMAGIDGIKNKIHPGEAMDKNLYDLPPAELAEVPTVCGSLREALESLEADHDFLLQGGVFTKEQIESYIELKWPEVLRWETTPSAVEFDMYYSL

SEQ ID NO: 46331 - protein, 429 aa, Pseudomonas fluorescens Pf-5
MADKKAQLIIEGAAPVELPILTGTVGPDVIDVRGLTATGRFTFDPGFMSTASCESKITYIDGDNGILLHRGYPIEQLAEKSDYLETCYLLLNGELPTAEQKAQFVSTVKNHTMVHEQLKSFFNGFRRDAHPMAVMCGVVGALSAFYHDSLDINNPQHREISAVRLVAKMPTLAAMVYKYSMGQPMMYPRNDLSYAENFLHMMFNTPCEIKPISPVLAKAMDRIFILHADHEQNASTSTVRLAGSSGANPFACIAAGIAALWGPAHGGANEAVLTMLDEIGDVSNIDKFIAKAKDKNDPFKLMGFGHRVYKNRDPRATVMKQTCDEVLKELGINNDPQLELAMRLEEIALTDPYFIERSLYPNVDFYSGIILKAIGIPTSMFTVIFALARTVGWISHWKEMLSSPYKIGRPRQLYTGYESRDITKLEDRK

SEQ ID NO: 46332 - protein, 565 aa, Bdellovibrio bacteriovorus HD100
METDNKYARPVYIPYSGTVLLEMSLLNKGSAFSEEERTHLNLHGLVPQTIETIEEQAERVYSQYRLLKADIDKHVYLRNLQDTNETLFYHLVVNHLTEMMPIIYTPVVGEACEHFSEIYRASRGLFISYPNKDRIDEMLRNVTKQKVKVIVVTDGERILGLGDQGIGGMGIPIGKLSLYTACGGISPAYTLPVVLDVGTNNQALLNDPLYMGWRQPRITGKEYEDFVDAFVQAVKRRWPDVLLQFEDFAQKNASPILKRYRDEICSFNDDIQGTAAVTVGCLIAASRANGGRLRDQRVVFLGAGSAGCGIAEQIIAEMKHEGLSDEQARQRVFMVDRFGLLTDKMPNLLEFQSPLVQKTETLAGWEVTNDEISLLDTVRNAKPTILIGVSAQPGLFTEEVIRTMQSHCEHPIVMPLSNPTSRVEATPADILRWTDGKALVATGSPFMPVHMNDQIYPIAQCNNSYIFPGIGLGVLACGARRVTDSMLMAASSALADCSPLAQNGKGALLPELSQIEKVSRTIAFAVAKAAQADEVAVKVSDEELLSLIDKNYWYPKYRSYKHASS

SEQ ID NO: 46333 - protein, 135 aa, Acidobacteria bacterium Ellin345
MTKAIQQSVTFPASARELFETYVDSRKHTASTGMPAKISRKVGGKFSGFGGMIGGRNLMLVPGQMIVQAWRSAAWKKTDANSILTITFTDTKSGGRVDLVHVNVPAHDHRGVTEGWKKYYWKPWRAYFRKQKKES

SEQ ID NO: 46334 - protein, 452 aa, Arabidopsis thaliana
MEANKKAKPSYGDVISNLPNDLLCRILSYLSTKEAALTSILSKRWSNLLLSIPILDFDDSVLLKPQKGQRKNVFFKAFVDRLLSQRVETSSHVQRVSLKCRQGGVEPDCVIKWILTTVRDLGVLDLSLCIDFGIFHLPFNVFRSKTLVKLRIGTMIRLSQFPSDVVSPTLNSLVLDLVEFRDGDKVEFRQILLAFPSLQSLRVHESNKWKFWNGSASSRTLKSLVYRSDDDSSAPKPCVSFDTPSLVYLDYSDMVADKYENLKFDSLVEARLDLHLTGIRNVKILCLSPDALEALYYRGEKIPMFNNLITLSLGSDKPHGSPFIFWKLLPSLLNNSLKLETLIIKGLVHYVAEGWEGLSPMTPMSRLCFSWDTVSDSLSSSAMKVLEISGYKGTWQELNQMKRFLGNLSRLEVVRVYHKAMDDKERINVMFDLFLLPKVSSECDIQVMKETA

SEQ ID NO: 46335 - protein, 336 aa, Synechococcus sp. CC9311
MTIRIGINGFGRIGRLAFRQAVSMDDVEVVAVNDLIDVDYLAYLLRYDSTHRQFQGDVRVENKNLIVNGKLIRITAERDPKELRWGEIGADYVLESTGFFLTDDKARAHIDAGAKRVVMSAPSKDETPMFVMGVNHKDYLGQEIVSNASCTTNCLAPLAKVVNDNFGIVSGLMTTVHATTATQKPVDSPSLKDWRGGRGAGQSIIPSSTGAAKAVGRVIPELNGKLTGMAFRVPTPDVSVVDLTVNLEKSTSYEEVKAAMKAAAEGELKGILGYTNDQVVSNDLLGDSATSVFDAGAGMALNDRFMKLVAWYDNEWAYSCKCIDLIKHMESSTYVK

SEQ ID NO: 46336 - protein, 407 aa, Pseudomonas fluorescens Pf-5
MAIEIKAPTFPESVADGTVATWHKQPGDAVKRDELIVDIETDKVVLEVLATADGVLGAIVKNEGDTVLSDEVLGSIVEGGAAAAAPAAAAAPAAAAAAPAAADGEDDPIAAPAARKLAEENGINIASVAGTGKGGRVTKEDVVAAVAAKKAAPAAAPAKAPAPAAGAPVFAAGDRVEKRVPMTRLRAKVAERLVEAQSNMAMLTTFNEVDMTEVMALRSKYKDLFEKSHNGVRLGFMSFFVKAATEALKRFPAVNASIDGSDIVYHGYADIGVAVSSDRGLVVPVLRNAELMSLAEIEGGIATFGKKARDGKLSMEEMTGGTFTITNGGTFGSMMSTPIVNPPQAAILGMHNILQRPMAINGQVVIRPMMYLALSYDHRLIDGKEAVTFLVTIKNLLEDPARLLLDI

SEQ ID NO: 46337 - protein, 323 aa, Glycine max
AKGQTPLFPRIFGHEASGIVESVGEGVTHLKPGDHALPVFTGECGDCAHCKSEESNMCELLRINTDSGVMIHDGQSRFSKNGQPIHHLGTSTFSEYTVVHAGCVAKINPAAPLDKVCVLSCGICTGFGATVNVAKPKPGSSVAIFGLGAVAVAAAEGARVSGASRIIGVDLVSARFEEAKKFGVNEFVNPKDHDKPVQQVIAEMTNGGVDRAVECTGSIQAMVSAFECVHDGWGLAVLVGVPSKDDAFKTAPINFLNERTLKGTFYGNYKPRTDLPSVVEKYMSGELEVDKFITHTVPFSEVNKAFDLMLKGQSIRCIIRMQE

SEQ ID NO: 46338 - protein, 403 aa, Oryza sativa (japonica cultivar-group)
MLSVSCPRVYMSRKALDFGQLASCRCRWAGRSGMRVAPRRRMPCVCFVASPSQPGLAAVDVPAEAISSARTTTMIPERISVSSLLEVVSDDLLKLNNNLKSLVGAENPVLVSAAEQIFGAGGKRLRPALVFLVSRATAELAGLLELTTEHQRLAEIIEMIHTASLIHDDVIDDSGMRRGKETIHQLYGTRVAVLAGDFMFAQSSWFLANLENIEVIKLISQVIKDFASGEIKQASTLFDCDVTLDDYLLKSYYKTASLLASSTRSAAIFSGVSTTICEQMYEYGRNLGLSFQVVDDILDFTQSAEQLGKPAGSDLAKGNLTAPVIFALQDEPKLREIIDSEFSESDSLATAIDLVHRSGGIRRAQELAKEKGDLALQNLQCLPKSQFRSTLENVVKYNLQRID

SEQ ID NO: 46339 - protein, 204 aa, Hevea brasiliensis
MNIFIVVLLCLTGVAIAEQCGRQAGGKLCPNNLCCSQWGWCGSTDEYCSPDHNCQSNCKDSGEGVGGGSASNVLATYHLYNSQDHGWDLNAASAYCSTWDANKPYSWRSKYGWTAFCGPVGAHGQSSCGKCLSVTNTGTGAKTTVRIVDQCSNGGLDLDVNVFRQLDTDGKGYERGHITVNYQFVDCGDSFNPLFSVMKSSVIN

SEQ ID NO: 46340 - protein, 97 aa, Glycine max
TIQKVKCINAKFSDDGSKLMATKSNLLISVYDRRTAKEIWAFEVPNAIAAALSPNGTYFQTFQKPLAPQEKNVTLWSIEIGATVYQQSQKNMTTPVA

SEQ ID NO: 46341 - protein, 298 aa, Bacillus cereus E33L
MPNIAVIGSISMDLVAVSKKRPKAGETVIGEAFHTIPGGKGANQAVAAARLGANVAMVGAVGDDNYGTVVKKNLENERVFIDYVVPVTDTATGIAHIVLAEEDNSIVVVQGANALVNESIVNRSKDLLIKADMVVLQLEIPLETVKYVLAICEEHKIPVMLNPAPAQVLSEDILEKATYITPNEHECRIVLDDFTSPIEDLLAKYPNKLLMTEGSNGVRFHNGAEIVHVPSIAVDVVDTTGAGDTFNGALAVALSEGETLQKAIRFANIAGGLSVTKLGAQGGMPTRDRVREVQVIVG

SEQ ID NO: 46342 - protein, 187 aa, Triticum aestivum
ALGPTSHAPGRHGRGIIRLTIQRGSSSSTARSNQSQVSKPPPPRSRRRREAMARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRGERA

SEQ ID NO: 46343 - protein, 103 aa, Ralstonia eutropha JMP134
MSDVQQKIDQIVKGNPVVLFMKGTAQFPMCGFSGRAIQILKACGVDSPATVNVLDDEGIRQGIKEYANWPTIPQLYVNGEFIGGSDIMMEMYQNGELQTLLKG

SEQ ID NO: 46344 - protein, 505 aa, Ralstonia eutropha JMP134
MKAQEIAACWQSMGLPRPWSDGTPAGTVIVRSPVDGEAFGHVPACTPAEADARIVRAHAAQSSWALVPAPVRGDIVRRFGEVLREHKTALGRLVSLESGKIQQEGLGEVQEMIDICDFAVGLSRQLHGLTIASERPQHAMRETWHPYGLCGVISAFNFPVAVWAWNAALALVCGNAVLWKPSEKTTLCALAAHGLLERVLAATAPHYVGISAVLPGGRMVGTHLVGHPAVRLVSATGSTRMGREVGIACAQHFKRSILELGGNNAAIVTPSADIELAVRAITFAAAGTAGQRCTTLRRCFVHADLMDTMASRLVTVFDRLPVGDPLEDGTLLGPLIDTGAADAMANALASCRAQGNIVTGGERLLADRFPHASYVRPALVMTDEQHDTMLTETFAPILYLMPYTSLDEAISLNNAAAHGLSSCIFTESLREAERFLSSAGSDCGIANVNIGTSGAEIGGAFGGEKATGGGRESGSDAWKGYMRRATNTINYGDTLPLAQGIRFEI

SEQ ID NO: 46345 - protein, 449 aa, Zea mays
LLWVTLIGLIFALIIQSLSANLGVVTGRHLAELCKTEYPAWVRICLWLLAELAVIAADIPEVIGTAFAFNILFHVPLWVGVLITGSSTLLLLGLQKYGVRKLELLVGLLVFVMAACFFIEMSIVKPPAEEVIHGLFIPSLSGPGATGDTIALLGALVMPHNLFLHSALVLSRNTPSSVRGINDACRFFLLESGVAMFVALIINICIISVSGTVCNSSNVSPDDSAKCSDITLDSSSFLLRNVLGNSSAVVYGVALLACGISSSITGTYAGQYIMQGFLDIKMRQWLRNLMTRSIAIIPSLIVAIIGGSSGAGRLVIIASMILSFELPFALIPLLKFSSSSSTMGQHKNSIFIIGFSWILGFVIIGINIYFLSSKFVGWILHNSLQIYANILIGIVVFPLMLIYVCAVIYLTLRKETIKFVACGELQTIETDKSKLANGSNMEEKKDQLV

SEQ ID NO: 46346 - protein, 319 aa, Shewanella sp. MR-4
MTVLLSFGEVLVDLLPTDISGKSHQAIAGGAPANVAVGYAKLGGKSYFAGGISTDDYGAMLKQALANEGVVTDYLTQVPEAPTATVVVNLDEHGERTFEFNRQGTADLCYSQRHFDAIPWQQMDIFHLCSNTFTEASIFNASLYGARCANSFNKIVSFDVNLRLSLWPDTALLAERVEQCFRYTQVLKMSREEAEYLALTRNKSFEDYLQFCLAQGVEVILITDGANPVQCITVNERFSVPVPQIKAVDTTAAGDSFMAGFLFALGSELAFDLEHLTLKHRLACQTQLRKAIEFAVRCGAVTCGQKGAFPALPTLSQVS

SEQ ID NO: 46347 - protein, 333 aa, Perilla frutescens
MENSTQESHPRPENVVTYDSPYPIYAMAISAVNRRRVAVGSFVEELKNHVDILSFSEDSSSLKPVPSLSFDHPYPPTKLLFHPSVSAPSNLLASSGDFLRLWEVKDSSIVAVSTLNNSKTSEYSAPLTSFDWNEVEPRRIGTSSIDTTCTIWDIEKGAVETQLIAHDKEVYDIAWGEAGVFASVSADGSVRIFDLRDKEHSTIIYESPMPDTPLLRLAWNKQDLRYMATILMDSNKIVILDIRSPTMPVAELERHSASVNAIAWAPQSCKHICSAGDDGQSLLWELPTVAGPNGIDPMTMYSAGAEINQLQWSAAQPDWIAIAFANKMQMLKV

SEQ ID NO: 46348 - protein, 120 aa, Synechococcus elongatus PCC 6301
MGAQEIIRSIEAEYTKSDLPTIYVGDTVKVGVRIQEGGKERVQPYEGVVIANSGGGINESITVRRIFQGVGVERVFLLHSPAVASVQVLRRGRVRRAKLYYLRDRVGKATRVKQRFDRSI

SEQ ID NO: 46349 - protein, 478 aa, Pseudomonas fluorescens Pf-5
MTQKFDVVVIGAGPGGYVAAIKAAQLGFTTACIEKYTDKEGKLALGGTCLNVGCIPSKALLDSSWKFHEAQDGFAIHGINHAGVTMDVPAMVGRKANIVKGLTSGVATLFKANGVTSIQGHGKLLAGKKVEVTKPDGSVEVIEAENVILAPGSRPIDIPPAPVDQNVIVDSTGALEFQSVPKRLGVIGAGVIGLELGSVWSRLGAQVTVLEALDTFLMAADTAVSKEALKTLTKQGLDIKLGARVTGSKVNGEEVVVTYTDANGEQTITFDKLIVAVGRRPVTTDLLAADCGVTLDERGFVHVDDHCATTVPGVYAIGDVVRGMMLAHKASEEGIMVAERIKGHKAQMNYDLIPSVIYTHPEIAWVGKTEQALKAEGVEVNVGTFPFAASGRAMAANDTGGFVKVIADAKTDRVLGVHVIGPSAAELVQQGAIGMEFGTSAEDLGMMVFSHPTLSEALHEAALAVNGTAIHIANRKKR

SEQ ID NO: 46350 - protein, 337 aa, Oryza sativa (japonica cultivar-group)
MAPSFRLSSAPESADEATAHKEIYDQLRRVAETFPSAPSLIGLPCSRHPDGWYTFTNGVVSSMVIKEHLTARATDIFLTTFPKSGTTWLKVLLYSTLHRGTDELVAHSPHQLVPFLESQVFVNDRIPDLSSLSSPRLFMTHIPSQSLPNSVATSGCKVVYLCRDPKDCFVSLWHFWNRFMPWDIDEAHRQFCDGVSQFGPFWEHILGYWRWHVEKPNQVLFLTYEELAADTLGQLRRLAEFVGCPFTTEEQKHGVDRNIVEACALENMSGLEVNRSGTITIVDSTVPNNTFFRRGVVGDWRNHLTPEMARRIDEITKSKFKGSGLLLHPQFLQVKRE

SEQ ID NO: 46351 - protein, 226 aa, Arabidopsis thaliana
  misc_feature (75)..(75): Xaa can be any naturally occurring amino acid
MGYWNSKVVPKFKKLFEKNSAKKAAAAEATKTFDESKETINKEIEEKKTELQPKVVETYEATSAEVKALVRDPKXVAGLKKNSAAVQKYLEELVKIEFPGSKAVSEASSSFGAGYVAGPVTFIFEKVSVFLPEEVKTKEIPVEEVKAEEPAKTEEPAKTEGTSGEKEEIVEETKKGETPETAVVEEKKPEVEEKKEEATPAPAVVETPVKEPETTTTAPVAEPPKP

SEQ ID NO: 46352 - protein, 476 aa, Ostreococcus tauri
  misc_feature (274)..(280): Xaa can be any naturally occurring amino acid
MQREKRTQREDAERLATLNEGVTYASTLRVEISDEAERRGIRARGDDKARLPGGAADALGAGRSGRAHFRVEASNGRTCHVGVLDYGGVSTGMIGIPRPMLRSLGLRETDVGAEVRVTYAALPSATRMTLKPKTNEFARACEAEENVRDILERTMMGRSAATVGDEIEVTVRDATYDLRVVRVEPDDGHGAVSLLETDVEVDLEPSDEYDEFVSRERRRKEEFERAKEALAEREREKETEKLRAAERRRALLESIVEEPPSGSSVVTLRLNLPXXXXXXXLIMLRHGEAMMSNANEKDADRALTRDGRARARETARAASERGWIPDVTLCSASRRSRETLEVMGEADAAFGAVGRTMYLGSLYHFASLDGQYRTHLAECVAREIGILAACPPEEAACAKVPDARTIMAVGHNKGMEEAATELCGEEVRLLPATAALLEREVDADATWADVLSEGKGKWTLVAVATPDGLVANATSS

SEQ ID NO: 46353 - protein, 449 aa, Bacillus cereus E33L
MFFTQFFKPAPHAERLPADRVDSEYRKLRLQVFLGIFIGYAGYYFVRKNFSLAMPYLIEQGFSKGELGVILSAVSIAYGLSKFLMGIVSDRCNPRYFLAAGLFLSGIINIIFGSFSFITTSIILMFVLQFLNGWVQGMGWPPCGRTMVHWFSISERGTKMSIWNVAHNVGGALMPSLVTLGLYFFANDWKSIFYFPGILSILVGIYVLITMRDTPQSCGLPSIEEHTGEYPPDEKVQDRERELSVKEILFTYVLNNKFLWYIAIANVFVYFVRYGVVDWAPTYLVEEKSFTHSSSRTAYALYEWAGIPGTLLCGWMSDKLFKGRRAPAGILFMVGVFIAVLVYWLNPPGNPMVDSIALVAIGFLIYGPVMLIGLHALDLAPKKAAGTAAGLTGFFGYLGGAAFASAAMGFIVDAFGWDGGFILLLASCVLAMFFLALTLKTGSAKPKKA

SEQ ID NO: 46354 - protein, 277 aa, Glycine max
MPLVLAKSDSIQIREVWNDNLEEEFALIREIVDDYPYIAMDTEFPGIVLRPVGNFKNSYDYHYQTLKDNVDMLKLIQLGLTFSDEHGNLPTCGDESGTCCIWQFNFREFNVNEDVFANDSIELLRQSGIDFKRNNENGIDAHRFGELLMSSGIVLNDNVHWVTFHSGYDFGYLLKLLTCQDLPDTQVGFFNLINMYFPTVYDIKHLMKFCNSLHGGLNKLAELLEVERVGISHQAGSDSLLTSCTFRKLKDNFFSGSLEKYAGVLYGLGVENGQGSH

SEQ ID NO: 46355 - protein, 428 aa, Oryza sativa (indica cultivar-group)
MLHLRNHLLPLLHAATSTASSSPLHLTHRLLSTAARSPFSVEHYLIATCGLTAAQARRASPKLSRLKSSSNPDAVLALLSSSAAGLDSLSLSRADLAAVVAAEPRLLRARPGTIARRIASLRGRANLSAPQIRSFLMSGGAAHLASSDVSPKLAFWVPFLGSFDMLLKILRRCNAILATDVDRVVRPNVALLGECGLGVCDIVQMTQNAAWLLTFNPERLKIVVRRAEELGVPTSSWAFKDAVCTVARNNEGTIAARMEFLRGTLGCSMDKLRSAISRKPSILGFSEKTLRGKIEFLLTKVQLETEYILQRPVMLTLSLDKRLAPRHYVLQALVEKGLIKNDVDYYSCVCFGNEHFVARYIDRHEDALPGLTDAYAAVHAGKSPAQSLTQHLKTDRYRSHGNIYFSQISTSVNGRTTNDLIADNANAS

SEQ ID NO: 46356 - protein, 511 aa, Geobacillus kaustophilus HTA426
MNISELLARNARKFPEKTAVIEGESSLSYAEVNCMVNRLASSLARLGVGRGDKVALYMPNTKEFAVSYFAVLRLGAVVVPINARLTAAEVQYILGHSEAKALIAHDLVHQVLAPLVGGSDGIWVKTGKAEGGWLSLEELIDSGDPEEIVCPAKEDDEATILYTSGTTGRPKGVLFTHRNVITVADMIVIETKIDRQSRLLHLMPLSHSAPLHLFFIGGTYVGATHVLAPAFSPDALLELVERHKITHFFGAPVAYLLTAKHPRFDEYDLSSVRCWMYGGAPLSREEVKFVASRFGAGRMMCLYGLTEAGPNGTYLSPEEHGEKAGSVGRDAALHCEVALVDENGQEVAPGEVGEIVLRGESIMKGYYKDEEKTNEVIKDGWLYTGDLARRDEDGYIWIVDRKKDVIISGGVNIYPKEVEDVLRTHPAIADVAVIGVPHPEWGETAKAFVVLSQPLEPLAEECKRFLSDKLADYKIPRLYEAIAELPRNATGKVLKQVLRMWETTAQGAQGR

SEQ ID NO: 46357 - protein, 383 aa, Oryza sativa (indica cultivar-group)
MRSPRSRALERDAGGVAVEHVELIPGMPDDVAVDCLARVQHGSHRAMRRVCRGWRSAAATPAFAMARAEAGANEDLVYLLQFANPAAAAAAAEEAKEDGDAPANSPAYGVAVYNVTTGEWRREKAAPPVPMFAQCAAVGTRLAVLGGWDPETFEPVADVHVLDASTGVWRSAPPMRSARSFFACAEAGGRIYVAGGHDKHKNALKTAEAYDAVADAWDPLPDMSEERDECDGMATVAGDRFLAVSGYRTARQGGFERDAEWFDPAARAWRRLDRVRAPPSAAHVVVRGRVWCIEGAAVMEWLGSRGGWREVGPSPPGLKAGTARAVCVGGGERVVVTGAIEDSDGGSGRHALWVFDVKTKNWTVVRPPPEFAGFAFSVAAVRI

SEQ ID NO: 46358 - protein, 457 aa, Saccharophagus degradans 2-40
MNNANQQKAHLVIVGNGMATGRLLDELIKRDANAYNITVIGDEPEGSYNRIMLSPVLAGETELATIINKPAAWYAQNNIRFVAGVRANAINRQAQTVALADGSCIAYDELVIATGSRPALIPATNQHLQNIFSFRTIEDVNSIASCAQAGRKAVVVGGGLLGLEAAYGLAQKGVQVTLVHRSKGLLNRQLDSGAGEFLQQVMASKNIQFALGTEVAAFNSDALGGSGFASETLKSATLTNGETIECDLAVISTGITPNKELGQEAGLACGRAIIVDDYMTSSDNCISALGECCEHKGETFGLVEPIWHQCISLAEKLCFKRNVAFVNPVVATKLKVSGVQLFSAGEHLTGDDCREIKMVDVKNKIYRKIVLRNNRIVGVVLFGDTRSGADYFELMQQAVDVSSVAALLVMGKAFYAEQLQAAQNLNQCANQADFSQADSLNTASVTVSKNANNDIAA

SEQ ID NO: 46359 - protein, 915 aa, Saccharophagus degradans 2-40
MTVQKSQLANVIASDNRADIASKTVKTTCCYCGVGCGVEATVEDNRVTAVKGDELHPANLGRLCVKGSSLHETQSNPNRLLQPMLHGEATDWETALNYSADKFKAIVEQYGPESVAFYLSGQLLTEDYYVANKLMKGFVGTANIDTNSRLCMASAVVAHKRAFGGDVVPGNYEDLENTDLVLLVGSNTAYAHPIIYQRIVKAKAARPNMKVVVIDPRRTATCDIADYHLAIRPGSDAFLFNGLLGYLADNNALDSEFIANHSEGFDEALSVAKAQVASVEQAAVMCDVAKNDLTAVYDLFAKTTKAVTVFSQGVNQSSSGVDKGNTIINCHLATGKIGKLGAAPFSITGQPNAMGGREVGGLANQLAAHMSFDNQPDIDRVASFWRAPNMAQGEGLKAVDMFQAVHDGKIKAIWIMATNPVVTMPDANFIREALEKCELVLVSDCIANTDTGKLADVVFPATTWSEKNGTVTNSERRISLQKGFLPAPGQAKHDWQIISEFAQKIGFEQAFNYTHPVEIFREHAALSGVDNGVDVGTNTRPVRGFDISGMQHISKQAYENLQPIQWPVNSHKPNGTARLFEDANFFTASGRAKFVPISARFPQMPPKDNQVIMNTGRIRDQWHTMTRTGSAAKLLGHIDEPFIDIHPADAKRFGLAHKDIAVLENRGARYLGRVNVSDSQRVSEVFVPMHWNDNFASSSRADALVNAITDPLCGQPEFKHSPVEINPYNAQWSGFIASELPVTPNADYWVKIPVDKGYKYRIADTVTPSNWSEWLTEQFPLVSDWVELTDSSQAFYRKVGFIEGRLAVVLNIARGNEQPIENRWLEQQLGEQCDLNQRFAVLAGVAGEGVEDEGPIVCSCFQIGAKAIQTAIEGGCCSAEALGEKLKCGSNCGSCIPEINGMIRAFSPQHAAKQA

SEQ ID NO: 46360 - protein, 424 aa, Oryza sativa (indica cultivar-group)
MNLTESKKRRSKSNQAAGESTALDPDAASVVGADGAPDSTVVACGALRASALGAGFPTVGAHAASAWWQESSPGSSEWMYPPSGFLNYLQSNKISPFTQTHPFVNYHNASQLPENFHFIGAPMSYSTMSPTTPCSKAIPSPTGRCAAAQIGSQDKETIDIEDDDTIEPARSDARSEKRLNWSNEEDIRLASAWLHNSIDPIDGNDKKSYQYWLDVTTTYNSTTKSNRMRNRNQLKQRWERIKKPVSEFNGCYARITKIHQSGMSEDQKMDQAFQLYASEHNDKPFTMVHVWRILRHEKKWSTYLKKINKEKYKSVTPNPTHVVNVEDAPKLRLIGHKKAKDERSGKRLASEAISVIDQKLDKFIEASSKAEKIGEVQQSLANKKLEVANLNHKAAQEQTKSKMIDLYKDLLLAPTSDLRESSIL

SEQ ID NO: 46361 - protein, 499 aa, Gibberella zeae PH-1
MAYIKNLIAILPFLGAGVEAAVSFPPLPSDLSTPVQQRIAFSGPNSITVGWNTYAKQAKPCVQYGTSQNALDKQACSDISTTYPTSRTWVNSVTLSGLSPATTYYYKIVSKNSTIDHFLSPRTAGDKTPFAINAIIDLGVYGEDGFTIDMDHSKRDIIPTIQPSLNHTTIGRLSTTADDYEFVIHPGDLGYADDWFERPKNLLHGQEAYQAILENFYDQLAPIAGRKPYMVSPGNHEAACEEIPVLNHFCPEGQKSFTDFMVRFGNIMPLPFASTSSDATAKVNANKAKQLANPPFWFSFDYGMAHVVMIDTETDFPDAPDQPGGSAHLNGGPFGRPNQQLQFLEADLSSVDRDVTPWLIVAGHRPWYSTNNEGCKPCQEAFEGLFYKYGVDLGVFGHVHNSQRFHPVYNGTIDPAGQQDPKAPMYIISGGTGNIEGLSAVGTKGPENAFAYADDFAYATIRFQDANNLQVDFIRSATGELLDRSKLFKSHKQHFVKQN

SEQ ID NO: 46362 - protein, 435 aa, Staphylococcus aureus subsp. aureus MRSA252
MQNDEMFERTVKPVLDVNEKPQPAQWAFLSLQHLFAMFGATVLVPFLTGLPISAALLASGIGTLLYILITKAQIPAYLGSSFAFITPIITGLSTHSLGDMLVALFMSGVMYVIIGILIKLSGTAWLMKLLPPVVVGPVIMVIGLSLAPTAVNMAMYENPGDMKGYNISFLIVAMITLLVTIFVQGFFKGFLSLIPVLVGIIVGYVVAIFMGIVKFDAIMSAKWIDFPHIYLPFKDYVPSFHLGLVLVMIPIVFVTVSEHIGHQMVLNKIVGRNFFEKPGLDKSIIGDGVSTMFASIIGGPPSTTYGENIGVLAITRIYSIYVIGGAAVIAIVLAFIGKFTALISSIPTPVMGGVSILLFGIIAASGLRMLVESKVDFANNRNLVIASVILVVGIGNLVFNLKEIGINLQIEGMALAALSGIILNLILPKEKKQNN

SEQ ID NO: 46363 - protein, 513 aa, Zea mays
  misc_feature (15)..(15): Xaa can be any naturally occurring amino acid
  misc_feature (265)..(265): Xaa can be any naturally occurring amino acid
MGCCGSSQRAGTHPXKKPPGALPPHRPSYSLNQHQAPAPPPPSAARAGARQVPPLKEFSLAELRAATAGFAAGNIVSESGEKAPNFVYRGRLDAGRRAIAVKKFTKMAWPDPKQFAEEAKGVGKLRHCRLANLIGYCCDGDERLLVAEFMPNDTLAKHLFHWENQTIEWAMRLRVAYYIAEALEYCSTEGRPLYHDLNAYRVLFDENGDPRLSCFGLMKNSRDGKSYSTNLAYTPPEYLRNGRVTSESVIFSFGTILLDLLSGKXRIPPSRALDMIKGNNIQVLMDSHLEGNYSTDEATTLVDLASQCLQYEPRDRANTKKLVSVLEPLQIKSEVPSYEMLGIPKHEEEAPPPPQPQRPLSPMGEACSRTDLTAIHQILVNTHYRDDEGSNELSFQEWTQQMRDMLEARKRGDFAFRDKDFKAAIDCYTQFVDVGTMVSPTVYARRSLCHLMCDQPDAALRDAMQAQCVYPDWPTAFYMQAVALAKLNMQSDATDMLNEASQLEEKRQKNTKP

SEQ ID NO: 46364 - protein, 1057 aa, Staphylococcus aureus subsp. aureus MRSA252
MPKRNDIKTILVIGSGPIIIGQAAEFDYAGTQACLALKEEGYRVILVNSNPATIMTDKEIADKVYIEPLTHNFIARIIRKEQPDALLPTLGGQTGLNMAIQLHESGVLQDNNVQLLGTELTSIQQAEDREMFRTLMNDLNVPVPESDIVNTVEQAFKFKEQVGYPLIVRPAFTMGGTGGGICHNDEELHEIVSNGLHYSPATQCLLEKSIAGFKEIEYEVMRDKNDNAIVVCNMENIDPVGIHTGDSIVVAPSQTLSDVEYQMLRDVSLKVIRALGIEGGCNVQLALDPHSFDYYIIEVNPRVSRSSALASKATGYPIAKLAAKIAVGLTLDEMLNPITGTSYAAFEPTLDYVISKIPRFPFDKFEKGERELGTQMKATGEVMAIGRTYEESLLKAIRSLEYGVHHLGLPNGESFDLDYIKERISHQDDERLFFIGEAIRRGTTLEEIHNMTQIDYFFLHKFQNIIDIEHQLKEHQGDLEYLKYAKDYGFSDKTIAHRFNMTEEEVYQLRMENDIKPVYKMVDTCAAEFESSTPYYYGTYETENESIVTDKEKILVLGSGPIRIGQGVEFDYATVHAVWAIQKAGYEAIIVNNNPETVSTDFSISDKLYFEPLTEEDVMNIINLEKPKGVVVQFGGQTAINLADKLAKHGVKILGTSLENLNRAEDRKEFEALLRKINVPQPQGKTATSPEEALANAAEIGYPVVVRPSYVLGGRAMEIVDNDKELENYMTQAVKASPEHPVLVDRYLTGKEIEVDAICDGETVIIPGIMEHIERAGVHSGDSIAVYPPQTLTEDELATLEDYTIKLAKGLNIIGLINIQFVIAHDGVYVLEVNPRSSRTVPFLSKITDIPMAQLAMRAIIGEKLTDMGYQEGVQPYAEGVFVKAPVFSFNKLKNVDITLGPEMKSTGEVMGKDTTLEKALFKGLTGSGVEVKDHGTVLMTVSDKDKEEVVKLAQCLNEVGYKILATSGTANKLAEYDIPAEVVGKIGGENDLLTRIQNGDVQIVINTMTKGKEVERDGFQIRRTTVENGIPCLTSLDTANALTNVIESMTFTMRQM

SEQ ID NO: 46365 - protein, 200 aa, Saccharophagus degradans 2-40
MVLDQYSAIIFDMDGTLVDSGQLHEVAWTETLNRFAIPIDRPLMRSLAGVPTKQTIAMLIERFDCKVDSPLEEMNHFKEQVVRDNIHKYVKPTQLAELAKRYHGVLPMSVGTGAYTDEAEVILELCGLRKLLDYIVGADQVTKPKPAPDTFLRCAQLMGQPAQQCVVFEDAKLGIQAAIAAGMDAIDVLTAFQIENEYFL

SEQ ID NO: 46366 - protein, 366 aa, Zea mays
  misc_feature (177)..(177): Xaa can be any naturally occurring amino acid
MEGAAAGWPEPVVRVQSLSESGAATIPARYVKPEAERPASAAGEEEGGGGIPVVDLSSPATARAVSEACRDWGFFQAVNHGVPGELLRRARGAWRGFFRQPMEVKQRYANSPATYEGDGSRLGVEAGALLDWGDYYFLHVRPPHLCDPRKWPHLPPGLRKTTEEYSLEVAALCGRLXAAMSAGLGVGEARLREAFGGAEGAGVCVRVNYYPRCPQPELALGLSSHSDPGGMTVLLADDRVRGLQVRRRGAWVTVDPVPDAFIVNVGDQIQVLTNATYRSVEHRVVVNAADERLSVALFYNPRSDLPLAPMPELVSPDRPALYCPMTFDDYRMYIRRKGPRGKSQVDSLKVADAVDADADADGRRCY

SEQ ID NO: 46367 - protein, 124 aa, Desulfovibrio vulgaris subsp. vulgaris str. Hildenborough
MINPIATPKAPGAVGPYSQGIDTGSLVFASGQLPLHPETKTMPADIREQAAQSLENLKAVLEAASSGLDKVVKTSVFLADLADFAAVNEVYAKYFATPFPARSCFQVAALPLGARVEIEAIAVK

SEQ ID NO: 46368 - protein, 467 aa, Aspergillus oryzae
MAMPMRTTRHATKLAQSSRLLAQYTSRRSYATAEPDLKSALKAVIPAKRELFQQVKQQGDDVIGEVKVANVIGGMRGLKSMLWEGSVLDPDEGIRFHGKTIKDCQKELPKGTSGTEMLPEAMFWLLLTGQVPSTSQVRAFSRELAEKSHLPQHILDLIKSFPRNMHPMTQLSIAVAALNTESQFAKAYEKGLNKADYWEPTFDDSISLLAKIPRVAALVFRPEEIDAVGTQALDVSQDWSYNFAELLGKGGQQNQDFHDLLRLYLALHGDHEGGNVSAHATHLVGSALSDPFLSYSAGLLGLAGPLHGLAAQEVLRWILSMQEKIGTKFTDEDVRTYLWDTLKSGRVVPGYGHGVLRKPDPRFEALMDFAATRPDVLANPVFQLVKKNSEIAPGVLTEHGKTKNPHPNVDAASGVLFYHYGFQQPLYYTVTFGVSRALGPLVQLIWDRALGLPIERPKSINLLGLKK

SEQ ID NO: 46369 - protein, 434 aa, Cryptococcus neoformans var. neoformans JEC21
METAQLLLKMPTTSSIWAAYNLNRYFVGVALLLGVVVLWTASNFITAGLETGDDAWNKPFLITYFNTASFTIYLLPTLWRWRKGARHHAMGQGHVRSGDAEHAASPSGGYLPIPSAPHEEHLSHPSHRKDPERTERIDGVTLHHLPPLTVRETAKIAAWWSIVWFIANWAVNASLAWTSVASVTILSSTSGFFTLALGRICRVESLTSTKVIAVIASFLGVLLVTHSDSLSSTPPPSPSAFLSLSSASSHPIFGDALALTSAAFYAVYVILLKVRVVDEERADMQLMLGFAGLFNTIFLIPIFPLLHYTGLERFSLPPTSSAWFICLVNFCITLSSDYLYVLAMLKTTPTLVTVGLSLTIPLAMLGEFFGLGLGSGGEGGMEGMTVWSVAGAGMVCVGFGMLGWQEYLKNKQGNEGVVIEREGEYEYGSDREDE

SEQ ID NO: 46370 - protein, 249 aa, Zea mays
MVKLAFGSVGDSFSATSIKAYVAEFIATLLFVFAGVGSAIAYGQLTNGGALDPAGLVAIAIAHALALFVGVSVAANISGGHLNPAVTFGLAVGGHITILTGVFYWVAQLLGATVACLLLGFVTHGKAIPTHAVAGISELEGVVFEVVITFALVYTVYATAADPKKGSLGTIAPIAIGFIVGANILAAGPFSGGSMNPARSFGPAVAAGDFAGNWVYWVGPLVGGGLAGLVYGDVFIGGSYQQVADQDYA

SEQ ID NO: 46371 - protein, 351 aa, Solanum lycopersicum
MNASNILLLIIVVQLVSVNLAFEKTQNVLSKSKIIHLNGSIGPESVAFDPNGEGPYIGVADGRILKLQLGSNNRLFWAEFAVTSSHRRDCTSPFAPKMEHICGRPLGLRFDTKTGELYIADAYLGLQVVGPKGGLATPLVQKFEGKPLVFTNDVDIDDDVIYFTDTSTKYQRWQFLTSFSSGDTTGRLMKYDKSTKKVTVLLGDLAFANGVALSKNKSFVLVTETTNFRILRYWLKGPLVGTHDVFVELPGFPDNIRINPKGDFWVALQAIRSVPSVSDSKFGMFSFNPQQMGDDGELHPTALKLSEDGRVLEVLEDVEGKTLRSISEIEEKDGKLWIGSVVMPFLRVYEM

SEQ ID NO: 46372 - protein, 358 aa, Aspergillus oryzae
MDILDRKPYNHAIHTSPANDLRLVKSDIPEIQPHECLVHVRATGICGSDVHFWKHGHIGDMVVTGDNGLGHESAGVVLKVGKDVTRFKPGDRVAMECGVPCSKPTCYFCRTGQYNACPDVVFFSTPPHHGTLRRYHVHPEAWLHHIPDNISFEEGALLEPLTVALAGIDRSGLRLADPLVICGAGPIGLVTLLAANAAGAEPIVITDLDEGRLAKAKEIVPRVRPVKVTREDTPKALAGRIVETLGQEAKLVIECTGVESSIHAGIYSTRFGGSVFVIGVGKDFQTIPFMHLSAKEIDLRWQYRYHDIYPKAIGLVAAGIIDLKPLVSHRFALEDGIKAFETASNPASKAIKVQILDD

SEQ ID NO: 46373 - protein, 359 aa, Streptococcus pneumoniae R6
MICSDSSYSFHNKNFMIFIRRKSLMVVKVGINGFGRIGRLAFRRIQNVEGVEVTRINDLTDPVMLAHLLKYDTTQGRFDGTVEVKEGGFEVNGKFIKVSAERDPEQIDWATDGVEIVLEATGFFAKKEAAEKHLKGGAKKVVITAPGGNDVKTVVFNTNHDVLDGTETVISGASCTTNCLAPMAKALQDNFGVVEGLMTTIHAYTGDQMILDGPHRGGDLRRARAGAANIVPNSTGAAKAIGLVIPELNGKLDGSAQRVPTPTGSVTELVAVLEKNVTVDEVNAAMKAASNESYGYTEDPIVSSDIVGMSYGSLFDATQTKVLDVDGKQLVKVVSWYDNEMSYTAQLVRTLEYFAKIAK

SEQ ID NO: 46374 - protein, 503 aa, Vibrio cholerae O1 biovar eltor str. N16961
MCCFSTFRRSFMSPPYLVIIAALIHLRNSLVHPNISLPEPFIASMAKILPDPTQLADFIAACQRPLRKSIRVNTLKISVAEFCQRAAEKEWQLTPVPWCENGFWIDADESLVPLGNTAEHMAGLFYIQEASSMMPVSALFMGNAHYDSVLDMAAAPGSKTTQMAALMDNQGVLVANEFSASRVKVLHANIERCGIRNTALSNFDGCVFGGWLPERFDAVLIDAPCSGEGTIRKDPDAMKNWSLESIQSIANTQKALIESAFQALKVGGTLVYSTCTLSREENQQVCWHLKQTYGDAVSFESLGNLFEHASLALTEEGFLHIFPQMYDCEGFFVAKIRKLASVPTPEVNKRLGKFPFNKASHKQQAEIAQQLHKSLGIELPSDAQVWLRDNDVWLFPEALEPLLGELRFSRMGIKIAEAHKSGYRWQHQVATCLASSSASHSVELDTTQAREWFMGRDVRPEGQSGQGEVIIRYANDVIGLGKWVGNRVKNGLPRELVRDKNLF

SEQ ID NO: 46375 - protein, 135 aa, Geobacillus kaustophilus HTA426
MHPVILFDGDCLFCHASAHWIAARDRQAVFRFAAQQSAVGQALLAKQEMSAGDSVVLIENGCCYVKSDAVLRIGRRLAWPWNWLAASGFLIPRLLRDHIYDTVANHRHRLTLKRDHCQLPPPELRSRFLDEWPLW

SEQ ID NO: 46376 - protein, 506 aa, Geobacillus kaustophilus HTA426
MIPVVTSDEMYAIDREVTERIGISADSLMENAGQALFRVLKGRIPRADRVAVLAGAGNNGGDGFVVARMLKSCGYETDVWLIPPKEKVKGAARTALEVYERSGYSWIPYEGNEQEFAMRAPHYDVIIDALLGIGVKGEVRSPYQEIIEQLNRSRAVVYAIDVPSGVPADGGDVAAAVRADMTLTIQCPKLGAYTFPAADYYGELAVVDIGIPPLVVKTNAARRFVWERSDVMRTMPKRRRSSHKGTYGKLLVVGGSKAMAGAVTLAAKAALRSGAGLVTMAVPETVYEAVANRMPEAMCRPWPAEGGAFAGAADWNGLDVDALAVGPGMGRTEGVRRLVGELVRKPVPLILDADALFFWDDYAEQVRRRSAPTVITPHPGEMARIVRRSIREVEHDRFGLSKRLAMEYGVYVVLKGPYTIVTAPDGSQYVNTTGNPALAKGGSGDVLTGIVAAFLLQHEAVQPAVSNAAFVHGKAADWLVQHGHSPWDVLASDVVEALPAVLASLA

SEQ ID NO: 46377 - protein, 337 aa, Ostreococcus tauri
MDARAEALRTIAAALATPGKGVLAADESTGTIGKRLATIGVENTLEQRVALRELLFDAPNCAAALSGVILYDETLRSTGKGGATFVEMLRANGTIPGIKVDAGVVPLPGSPEETATAGLDGLDERCKEYYDLGARFAKWRAVLKIDEARGFPSALAVAENANALARYATICQRNGLVPIVEPEILMDGAHDIETCLRVTRRVLDAVFSALRLHGAQMDGMILKPNMVTAGSAHPSANGGDDVVAEMTLRALRDVVPPAVPGILFLSGGQTEEQATERLRLMNRSSIPRAPWTLSFSYGRALQASCLKAWGGKAENVPAAQAAFFARCKANSEASIRP

SEQ ID NO: 46378 - protein, 455 aa, Debaryomyces hansenii
MVLPHEPEFQQAYNELVSALEDSTLFTEKPEYKKVIPVVSVPERIIQFRVAWENDNGDVEVNNGYRVQFNSALGPFKGGLRFHPSVNLSILKFLGFEQIFKNALTGLSMGGGKGGCDFNPKGRTDSEIRRFCVAFMRQLARYIGSDTDVPAGDIGVGSREVGYMFGAYKQMQNNWSGILTGKGLSWGGSLIRPEATGYGVVYFVEKMIEKATGGKESFKGKRVAISGSGNVAQYAALKVIELGSTVVSLSDSKGCIISQTGITPDQIKAIAAAKIHFKTLEEITKESASLFSGSNEVQYIAGVRPWTHCGQVDVALPSATQNEVSGEEAKALVEAGCKFVAEGSNMGSTKEAIDVFEANRSKAVWYAPGKAANCGGVAVSGLEMAQNSQRVTWAAEEVDEKLKNIMYTCFDNCYANAAKYSAEKDAENLPSLLKGANITGFIKVADAMFDQGEVF

SEQ ID NO: 46379 - protein, 505 aa, Rhodococcus sp. RHA1
MNLPAPEELCRRAEEALIRCGAEITDAGGPLVARTPITGTELRTVTASSADDVDRAITAAHEAFLEWRTVPAPQRGAVVRRLGQLLTEHKTDLAELVTLEAGKIPSEAQGEVQEMIDICEFAVGLSRQLYGRTMASERPGHRLMETWHPLGVVGVISAFNFPVAVWSWNTAVALVCGDTVVWKPSDRTPLTAIACDALLARAARDVGAPAGIHAVVQGAGDVGERLVDDARVALVSATGSVRMGRAVGPRVAARFGKCLLELGGNNAAVVAPSADLDLAVRGIVFSAAGTAGQRCTSLRRLIVHSSVADELVQRISSAYGQLKVGNPFDDGVLVGPLVNGSAFEAMQTALDKARADGGTVVCGGERSGGSDSAYYVSPALVRMPAQTSVVQEETFAPILYVLTYDDFDQAITLHNEVPQGLSSSIFTTDQREAERFLAADGSDCGIANVNIGTSGAEIGGAFGGEKETGGGRESGSDAWKAYMRRATNTVNYSDRLPLAQGVEFT

SEQ ID NO: 46380 - protein, 432 aa, Listeria monocytogenes str. 4b F2365
MDHSMSKKLHDEALLHIVGGVNSPSRSNKGVGGGIPVTMERASGAYFYDVDGNKYIDYLAAFGPIITGHAHPHITEAITKAAQNGVLYGTPTKHEITFAKMLKEAIPSLEKVRFTNSGTEAVMTTIRVARAYTGRDKIIKFAGCYHGHFDLVLVEAGSGPSTLGIPDSAGVTKSTAEEVITVPFNDFASFKEALAVWGDQVAAVLVEPIVGNFGMVAPEDGFLEAVNELAHANGSLVIYDEVITAFRFMYGGAQNYLGVIPDLTAMGKIIGGGLPIGAYGGRIDIMEKVAPLGPAYQAGTHAGNPASILSGIACLEVLQEEGLYERFEKYGSMLKDGIEKAALKHGIAVTVNQIVGALTVYFTEDPVTNYAEAGATNGELFGRFFKGMLEEGINLAPSKYEAWFITSAHSEADILETIQAVDTVFGKMVQDN

SEQ ID NO: 46381 - protein, 70 aa, Glycine max
  misc_feature (43)..(43): Xaa can be any naturally occurring amino acid
SITTGNRSGTSMVAPFTGTKSMADFCIRNTNDDITIIASNGAXVQCMHMWTPVSMKQIDTDSYLPDIDHA

SEQ ID NO: 46382 - protein, 595 aa, Dunaliella tertiolecta
MASVDCTLVSARGIKDVEIVGKQSPYAVLTVGPKTFKSGTANGGGSDPVWNQTFSFTNVTPDSSVKLEIFNSNVVLRDVAIGGCKAPMDKALSAGKDELTLPIITKKGKPHGEVKLILTLKPDATKQMVTSHKTRKAAGAWILPTYGNTDCWKDYEPGTLLGKGTFGTTYLATEKKTGQKCAVKVISKRKLTTPDEVDDVKKEVQIMHHLAGHPNVVGLKGVYEDKSNVCLAMEVATGGELFDSIVKRGHYSERDAAELIRTIVSVVAHCHNMGVIHRDLKPENFLLSDKSPRAQLKATDFGLSSFFQEGQVFTDIVGSAYYVAPEVLRRSYGKEADIWSCGIILYILLCGFPPFHGDSEKKIFEAIISKSVDFNTQPWPRISAPAKDCVKRMLQRDPKKRATANEIMQHDWMRENGVASDEPLEMEVVSRIKNFSGMNKLKKEALKVIAVNLPIDEISGMREMFMDIDKDKSGNITIDEFAAALHKKGQIVTEKEIEKIMKEADVDGDGTIDYEEFLAATINLGKLQREENLKTAFEHFDLDGNGEISHNELVQCLSKLGINDAHVKDIIKEVDADGNGQIDYNEFCIMMRNLD

SEQ ID NO: 46383 - protein, 97 aa, Oryza sativa
  misc_feature (22)..(22): Xaa can be any naturally occurring amino acid
RHGGPLLGAIDPPGNENDLHLXKLARYNVTEHNMTANYLVEFKKLENANHQVGACTLYYSTTDVNEGDAQKLYDTTDCEKPWMDSKELQDVKTVDAR

SEQ ID NO: 46384 - protein, 318 aa, Saccharophagus degradans 2-40
MSSNQLDQLKALTTVVVDSGDINAVARYQPEDATTNPSLVLKAIEQPEYNHLVAQAVAWAKEFAKDKPLVTATADKLAVMLGCEILKHIPGRVSTEVDAHLSFNTEATIAKALELVAMYEQAGVDKSRILIKIASTWEGIQAAKQLEKMGIQCNLTLLFGFAQAQACAEAGVFLISPFVGRILDWYKKDQPNADFTGLNDPGVVSVTKIYNFYKACGFQTVVMGASFRNVGELQSLAGCDRLTISPALLDELQNQTAPLVALLVDKGVSEEKPAPLTEGSFRWAMNEDPMATEKLAEGIRNFAKDQVKLYRLIEKVAG

SEQ ID NO: 46385 - protein, 129 aa, Thermoplasma volcanium GSS1
MRNDTLNDVINSIKNASRLGRREIIAEPAAKLIGKVLKVMQDYNYIKSFEVIDESRGGKFKIVLNTTINNCGVIKPRFPVKNENLEKYESRYLPAEDFGILILTTTKGVMSNIEARKLGIGGKLLAYVY

SEQ ID NO: 46386 - protein, 426 aa, Magnaporthe grisea 70-15
MSTGSAKFQPAARVAGRRQDVWSIINEAATASPKQPIVNMGQGFFGYNPPDFILNAAKQALDKVDCNQYSPTKGRPRLKKAIADAYAPFWGRQLNPDTEVTITTGANEGMLSAFMAFIEPGDEVIIFEPFFDQYISNIEMPGGKIVYVPLHPPTEGATKTLSAGAWNIDFDELERAITPKTKMIVLNTPHNPVGKVFTKDELQKIADLCLKNEIIILSDEVYDRLFYTPFTRIATLSPEVERITLTVGSAGKNFYATGWRVGWLMGPAELIQHVSAAHTRICYSSVSPLQEACAVGFEQAEKEGFWDECVRDMKRRMDLFNQVWHELGIPFSEPEGGYFVMVNLSTVQMPENYPFPPHVASRPRDFKLAWFLIQELGVAAIPPTEFFTDANAHIVEDYLRFAVCKPDDVLELAKERLRGLKKFIKQ

SEQ ID NO: 46387 - protein, 516 aa, Glycine max
  misc_feature (295)..(295): Xaa can be any naturally occurring amino acid
  misc_feature (423)..(423): Xaa can be any naturally occurring amino acid
  misc_feature (448)..(448): Xaa can be any naturally occurring amino acid
  misc_feature (493)..(493): Xaa can be any naturally occurring amino acid
MASISHFRTSANSFLSQYEPLSLLLAPLLSLLFAHALRSFFHLLSQNGLKATLLGFLINSLKLVPGVKGYIDAEKQKVVDKLQSDGKSKREGWKTELPSTGLGTSVLEKMREEKINDAVWQGKCSGTVYIGGSESDGHFSLINEACSMFAHTNPLHLDVFKSVARFEAEVVAMTAALLGSKEKSSGRQICGNMTSGGTESILLAVKSSRDYMKSKKGITRPEMIIPESGHSAYDKAAQYFNIKLWRVPVNKNFQADVKAIRRHINKNTILIVGSAPGFPHGVIDPIEIIWQFLPXELGHLASSFGICFHVDLCLGGFVLPFARELGYHIPPFDFSVKGVSSISVDVHKYGLAPKGTSVVLYRNHEIRKHQFVAVTEWSGGLYVSPTIAGSRPGSLIAGAWAAMMSLGKEGYLKNTKAIMEGSXRIQKGIEEIAELFIVGKPDMTIGAXGSAVLDIFESNDGMASKGWHLNALQKPNSIHYFGDPCTWGQLVEXFLIDLKESVKTVKANPGPNKGEA

SEQ ID NO: 46388 - protein, 473 aa, Bacillus cereus E33L
MQQPTNEKLHRTMKSRHLFMIALGGVIGTGFFLGSGYTINQAGPGGAILSYLVGGFIMYLTMLCLGELTVAMPVSGSFQKYATKFIGPGTGFMIGWLYWLGWAVTVGLELTSIGLMMKRWFPNVDVWVWCLVFGVILYASNAISAKSYAELEFWFSSIKVVTILAFVVLGGSALLGFISYDGKEAAPLFSNFVSDGGLFPNGLAAVLLTMITVNFSFQGTELIGIAAGESENPEKTIPRAIRNTVWRIMLFFILTMTILVGLISWKEAGVIESPFVVVFDKIGIPYAADIMNFVIITALLSVANSGLYAATRILWSLANEGMAPKSFQKVNKRGIPITALVVTIAVAALSLLTSFLAEDTVYMYLLSIAGLSAVSSWIIIALSQLRFRSQYIKGGGKLEDLKYRTPLYPIVPILALITNSIVVISLAFIPEQRMALYCGIPFIIFCYIYYYINKKRQKPMKVETTNETNNQTR

SEQ ID NO: 46389 - protein, 235 aa, Glycine max
  misc_feature (143)..(143): Xaa can be any naturally occurring amino acid
MASQVCKAASRAARSLLSASRASHGRAVGAATAVSLSCKVPLFYGKNGSGSGSASSSSSSWISGALALPAAAYMFQDQEVRAAELERTFIAIKPDGVQRGRISEIISRFERKGYKLVGIKVVIPSKEFAQKHYHDLKERPFFXGLCDFLSSGPVIAMVWEGQGVISYGRKLIGATDPQKSEPGTIRGDLAVVVGRNIIHGSDGPETAKDEIKLWFKPEELVSFTSNAEKWVYGVN

SEQ ID NO: 46390 - protein, 480 aa, Geobacter metallireducens GS-15
MKEYRLFINGEWVPSSTGTMADDINPATGDVYAKVHQASRDDIEQAIASAYRARVDWGKTVPAQREAILIKAAAILEERIPEFAEVLIEEGGATFGKAMFESSFVVTLLRSAAGECRRIFGETIPSDAPGLFSMSVRRPLGVIAGISPFNFPFLLAMKKVALALAAGNTFVLKPASPTPVIGLKIAELFEAAGLPKGVLNVIPVKGSTLGNTLVEDPRIRMVTFTGSTDVGKQLAEVAGRHQKKITLEMGGKSPLIVLKDADIDYAVDAAVFGIFLHQGQVCMANSRLIVEADIYDRFCEKLTAKVKGLKMGDPHKPDTVIGPLIDAKQCAFIDSQVHDALADGARVLSGGRSEGAFYQPTIVADVTRKMRIFDEESFGPVVCVIKAANSEEALALANDSSFGLSAGLITNDLQKAFDLSLRLESGMVHINDSSIFDEPHVPFGGVKDSGVGREGGHYSMEEMTEVKWITVQMGKRQFPF

SEQ ID NO: 46391 - protein, 389 aa, Arthrobacter sp. TE1826
MSIKKDYDVIVVGAGSMGMAAGYYLSKQGVKTLLVDSFHPPHTNGSHHGDTRIIRHAYGEGREYVPFALRAQELWYELEKETHHKIFTKTGVLVFGPKGEAPFVAETMEAAKEHSLDVDLLEGSEINKRWPGVTVPENYNAIFEKNSGVLFSENCIRAYRELAEANGAKVLTYTPVEDFEIAEDFVKIQTAYGSFTASKLIVSMGAWNSKLLSKLNIEIPLQPYRQVVGFFECDEKKYSNTHGYPAFMVEVPTGIYYGFPSFGGCGLKIGYHTYGQKIDPDTINREFGIYPEDEGNIRKFLETYMPGATGELKSGDVCMYTKTPDEHFVIDLHPQFSNVAIAAGFSGHGFKFSSVVGETLSQLAVTGKTEHDISIFSINRPALKQKETI

SEQ ID NO: 46392 - protein, 441 aa, Bacillus subtilis
MTLFLHGTSRQNQHGHLEIGGVDALYLAEKYGTPLYVYDVALIRERAKSFKQAFISAGLKAQVAYASKAFSSVAMIQLAEEEGLSLDVVSGGELYTAVAAGFPAERIHFHGNNKSREELRMALEHRIGCIVVDNFYEIALLEDLCKETGHSIDVLLRITPGVEAHTHDYITTGQEDSKFGFDLHNGQTERAIEQVLQSEHIQLLGVHCHIGSQIFDTAGFVLAAEKIFKKLDEWRDSYSFVSKVLNLGGGFGIRYTEDDEPLHATEYVEKIIEAVKENASRYGFDIPEIWIEPGRSLVGDAGTTLYTVGSQKEVPGVRQYVAVDGGMNDNIRPALYQAKYEAAAANRIGEAHDKTVSIAGKCCESGDMLIWDIDLPEVKEGDLLAVFCTGAYGYSMANNYNRIPRPAVVFVENGEAHLVVKRETYEDIVKLDLPFKTGVKQ

SEQ ID NO: 46393 - protein, 463 aa, Ralstonia eutropha JMP134
MTPNLQSHGAVPVHPVDEVLPAPRLLALGLQHVLVMYAGAIAVPLIVGGALKLPKDQIAFLIAADLFCCGLVTMIQSIGIWKVGIRLPVMMGVTFTAIAPIIATGSNPSLGLPAVFGAVMLAGIFTFLVAPYVGKMVRWFPPVVTGTVVLVIGISLMRVGINWAAGGNPMISTPNGPVPNPNFGVPVNIAIATVVLLTVLALVAFAKGFLCNVAVLIGILTGFAIALSLGKVSFDGLAAAHWVELITPFHFGWPTFDPMTTVTLCVVMVVIMIEGVGQFLALGEIVGRPVTCDDLTRGLRADGVGALVGAVFNTFTYTSYAQNVGLVQVTGVRSRWVCATAGAILVVLGCLPKLAFFAASIPQYVLGGAALVMFGMVAATGVRILGHVDFVENKKNAYIVAVSIALGMIPLVSERFFSQMPELLAKFCQNGILLGTLSAVLLNVLFNARSPQPQAHGLAKEPA

SEQ ID NO: 46394 - protein, 389 aa, Streptomyces sp. KB210-8SY
MSPTYDVIVIGLGGMGSAAAHHLSARGARVLGLEKFGPVHNRGSSHGGSRITRQSYFEDPAYVPLLLRAYELYEELERATGRNVATLCGGVMAGPPDSRTVSGSLRSATEWDLAHEMLDAKEIRRRFPTLAPDDDEVALFEAKAGLLRPENMVAAHLQLATRQGAELRFEEPVLRWEPYRDGVRVHTGENTYTAGQLVICPGAWAPQLLADIGVPITVERQIMYWFQPKGGTGPFVPERHPVYIWEDADGVQVYGFPAIDGPEKGAKVAFFRKGQHTTPETIDRTVHAHEVRAMADHMSALIPDLPGTFLKAATCMYSNTPDEHFVIARHPAHPESVTVACGFSGHGFKFVPVVGEILADLALTGATAHPIGLFDPARLTAPAARGVQP

SEQ ID NO: 46395 - protein, 502 aa, Solanum lycopersicum
MVLTTTSIRDSEESLHCTFASRYVQEPLPKFKMPKKSMPKEAAYQIVNDELMLDGNPRLNLASFVSTWMEPECDKLIMSSINKNYVDMDEYPVTTELQNRCVNMLAHLFHAPVGDDETAVGVGTVGSSEAIMLAGLAFKRKWQSKRKAEGKPFDKPNIVTGANVQVCWEKFARYFEVELKEVKLKEGYYVMDPAKAVEIVDENTICVAAILGSTLTGEFEDVKLLNELLTKKNKETGWETPIHVDAASGGFIAPFLWPDLEWDFRLPLVKSINVSGHKYGLVYAGVGWVIWRSKEDLPDELVFHINYLGSDQPTFTLNFSKGSYQIIAQYYQLIRLGFEGYKNVMKNCLSNAKVLTEGITKMGRFDIVSKDVGVPVVAFSLRDSSKYTVFEVSEHLRRFGWIVPAYTMPPDAEHIAVLRVVIREDFSHSLAERLVSDIEKILSELDTQPPRLPTKAVRVTAEEVRDDKGDGLHHFHMDTVETQKDIIKHWRKIAGKKTSGVC

SEQ ID NO: 46396 - protein, 502 aa, Capsicum annuum
MEIQFTNLVAFLLFLSSIILLLKKWKTQKLNLPPGPWKLPFIGSLHHLAVAGPLPHHGLKNLAKLYGPLMHLRLGEIPTVIISSPRMAKEVLKTHDLAFATRPKLVVADIVHYDSTDIAFSPYGEYWRQIRKICILELLSAKMVKFFSSIRQDELSMMVSSIRTMPNFPVNLTDKIFWFTSSVTCRSALGKICRDQDKLIIFMREIISLTGGFSIADFFPTWKMLHDVGGSKTRLLKAHRKIDEILEHVVNEHKQNRADGQKGNGEFGGEDLIDVLLRVRESGEVQISITDDNIKSILVDMFSAGSETSSTTIIWALAEMMKKPSVLAKAQAEVRQVLKEKKGFQQIDLDELKYLKLVIKETLRMHPPIPLLVPRECMKDTKIDGYNIPFKTRVIVNAWAIGRDPESWDDPESFSPERFENSSVDFLGSHHQFIPFGAGRRICPGMLFGLANVGQPLAQLLYHFDRKLPNGQSHENLDMTESPGISATRKDDLVLIATPYDP

SEQ ID NO: 46397 - protein, 225 aa, Magnaporthe grisea 70-15
MASPRWAALARDTNETKVKLALSIDGGDLPPDTHPSLLEAAASGHASQSSSSQKISINTGIGFLDHMLHAFAKHAGFSLLLTCQGDLHIDDHHTAEDVCIALGDAFKTALGSAAGIARFGFAYCPLDEALSRAVVDVSNRPFAVVELGLRREKIGDLSCEMIPHCIMSFATAARLTIHVDCIRGENDHHRAESAFKALAVAVRTAVGKVAGREGEVPSTKGTLSV

SEQ ID NO: 46398 - protein, 220 aa, Oryza sativa (japonica cultivar-group)
MGWATRFLAAVCFFAAGVVFAPDVLLGARSGSGSGCGAAAAAKGKLFPAYFMLISACAAVSVAAFAYLHPWKTASTVERYQLGFLLAALGFDLSNLLVFTPMTIEMMKKRHKIERDLSIGEEVGWSKNVQVAKNNPTLAAINKKFGMIHGLSSLANIMSFGSLAMHSCKYTDADDRLTKYLDYKEGLRERLKRSVEEDEKLICFINASIPQRLPEMVRCN

SEQ ID NO: 46399 - protein, 200 aa, Oryza sativa (japonica cultivar-group)
MLLLLLAVFFLLAGGAGLGMTAAAAAKAVHLLCFATSWGVTVWAILVGGVIMFLNLPRHAMGRLRGKVFPACFALNAACTAASAAAFAWLHRPPWPPAERRQLAVLLVAAGYDLANLLIFTPRTLEAMRERHKVERSLGIGGDGSFVGWRQNARAARSSSTLAAENARFWVAHSFSAVALVISAAGLFSHFCYLSGKIVI

SEQ ID NO: 46400 - protein, 324 aa, Streptococcus pyogenes M49 591
MQLYTAPHILIATGGHPVFPDIEGAQYGISSDGFFALDEVPKRTAVVGAGYIAVELAGVLHALGSKTDLFIRHDRPLRSFDKAIVDVLVEEMAVGGPCLHPHSEVAKVVKNTDESLTLYLKDGQEVEVDQLIWAIGRKPNLEGFGLDKTGVTLNEKGYIKTDAYENTSVKGIYAVRDVNGKLALTPVAVAAGRRLSERLFNGKTDEKLDYQNVATVIFSHPVIGSVGLSEEAAVKQYGQEAVKTYQSRFTSMFTAITNHRQPCLMKLVTVGDTEKIVGLHGIGYGVDEMIQGFAVAIKMGATKADFDNTVAIHPTGSEEFVTMR

SEQ ID NO: 46401 - protein, 730 aa, Novosphingobium aromaticivorans DSM 12444
MTNRFTFAQGIRFSIGLLLGASAPAALAQADDDPDGGGMVSRPVVQSTAPSASRELNAALARLAADPRNVPALFDAAEAALRLGDSDAAIGFVTRANEVQPNNPRAGVVMGRAYLVGEDPVSAIRAFDEAERAGGDTFAMASDRGLAYDLVGDNARAQRWYQVALSRGADDEVTRRYALSLAISGDRRAAEALLAPLIQRQDRPTWRTRTFVMAVTGGPDEAVAIAYATMPQELAAGIAPYLRYMPRLTTAQQAAAANLGRFPRAADIGRDDPRIVQYAALNPRAPRTAEAGLIPSGAPLGPGVAASTDKASRERRRRPGRDDKKLAAATPVAKPVSVTVTPISPQPAAALPPAAARPAAPSSPQVASAAAASVPQPASAAPRPTVLSALDLPPGAPRPAVPPIRATTPATVSRPSATPPVPAREVAARPVPATTVAPPAASSAPVSASPVPASAVARPGSFDLARVGGSAQVAAAAPVQAAAPVPPASSASNASASLAPVALPPSQPAQVAAATVPPPAAPAPVAAAAAPQRPADFASLFKSFTPPAEERTADRPAVDITRLPPKPAPKPVKPDTRGERPDGPIDVSRTSAKDAEKPSPKDLKAGLKDTKTAPKDTKTGAKDAKAAAKDAKAKKAEPSHPSRIWVQVLTGANKDVMDNEWRRIVKEAPEVLRGRKPFLSPWRNNFRLLTGPFESEAAAQEFIGKLRKSGVSSYQWTSPAGQPVDTLALK

SEQ ID NO: 46402 - protein, 324 aa, Nocardia farcinica IFM 10152
MTEMGAQRRSDLHPDVAAMLAALESFPDVTRYEAAELREIIAARRAPLTRQPDMRTARDHVIPGPGGDLTVRVYVPHGDALRPVVVFAHGGGFVFCDLDSHDEFCRSTAQAVDAVVVSVDYRRAPEHPGPAAMEDLYAAVTWVHRHAGEFGGDPERIAVAGDSAGGNLAATVSLAARDRGGPPIAAQVLIYPVIDDDFDTESYRRYGAGYYNTTEAMRWYWQQYAPHGTDSPYLVPTRADSLAGLPPAVVVTAELDPPCSAGEDYARRLAAAGVPVTAHRFDGLFHGFLTFPKLSLTGPARAELWQMMRAVLASPRPAVGEGTA

SEQ ID NO: 46403 - protein, 451 aa, Acidobacteria bacterium Ellin345
MSSHAILPRSFTKQYPVAARAHGARIWDTQGREYIDLSGSAVVNFIGFGNDTVVQAMAEQASRLPFVHSSQFTSEIAEHFAAEVLDFAGPAFEGGAVFFTCGGSEAVETALKLARQFQVETGHPDRCEIISRQQAYHGSTLGALAVSGNLSRREIYLPMVREFEHIRIPYCYRCEFSCELGCDDCGRKYADDLRHAIEHSAGRAAAFIGEPISGATLGAVAPPPIYWPAIASICKEHGLLLIADEVMTGFGRTGRNFAMDHWNVAPDILVAGKGIGSGYAPLGAVIVSARVVDALRKGSGMLIHGFTYNAHPVSMAAGSAVLAHIREMELVQAADSEHGSIGQAFMQALHLLEEIEAVGDVRGLGLLHAVEFVRDRATREAYPAALKFSGKVAAAALKRGVLTYPMQGSIDGTRGDHILLAPPAVELDRLLEAVHLLGDAIREASDQAARS

SEQ ID NO: 46404 - protein, 233 aa, Gossypium robinsonii
KILFTSLCHTDVYYWEAKGQTPVFPRIFGHEAGGVVESVGEGVTELKPGDHVLPVFTGECGDCGHCKSEESNMCDLLRINTDRGVMLSDGKTRFSINGKPIYHFVGTSTFSEYTVVHVGCVAKVNPAAPLDKICVLSCGISTGLGATLNVAKPTKGSTVAIFGLGAVGLAAAEGARIAGASRIIGVDLNPNRFEEAKKFGCNEFVNPKDYDKPVQEVLAEMTNGGVDRSVECT

SEQ ID NO: 46405 - protein, 388 aa, Zea mays
MLRLQKHLSLRLQEHLLPLHRSASLIQLSLQRSLLSTGSATYSSPGHFAADDYLVSTCGLTREQAANAAKCISHWKSSSNADAVLSFLTGPALGLSNAEIALLVAKDPRVLSCSVDNTLRARLARFRSHGFSAAQISEFVRVAPCFFRKFNIDVKLGFWMPFLGSPDRFLRLVKRNFYLLSSDLDKVVKPNIQLLQECGLSIQEIGSLCVANPRLLTSKPDRIRAVLVRAGEMGVPRKTLLFRHAVTAVAGLCPETFASKLKMMANILGCSEAEVARMVQKNPLVLRRSMETIQRACEFLINVVGVGTNFILDKPTILMYSLERRLVPRHYVMKVLQDKGLMRKDHSFYTLAAISASVFCSRYVHPHKNVLPNLAAAYASGCNGKIAI

SEQ ID NO: 46406 - protein, 174 aa, Rickettsia sibirica 246
MEDLSSWKEKFETCVYAQKLLDNIEYLNAKVKNPVDIEEVKKGIYYARKYHDLQIRQLGDPYYSHPIEVAIMLAEFVAEEAPKLYNAIMLQAVLLHDTIEDIALTEEVITIGPEVAKHIEGLTRIKPYGKISSEKGLNLLVRQKRYDTVLIKFFDRMYNLQTLGAKSPEKMRKV

SEQ ID NO: 46407 - protein, 1009 aa, Aspergillus nidulans FGSC A4
MPEYTESRDSIKNIWGERTPYKHQWPTRCDSHLVDTPDTWVQSACVLCSNGCGLDIGVKEGKVVGVRGRTVDRVNKGRLGPKGLNGWVSINHPDRLTHPLIRRNGKLERASWDEAMSLIVERAKDIQTRLTNHGIAFYTSGQLLLEEYYVLAMVGKAGLNTLHMCATLNLSPSYRSQDAKPMNRDGNTRLCTATAAASMRESFGSDGQPGSYADIDYTDCLFLVGHNMAATQTVLWTRVLDRLEGPNPPKLIVVDPRTSDTAKKATVHVRPRLGTNVALLNGLQHLIIKNGWVNDQYVASHVCGLEELKKVVEKYTPEYVEKITGVPVAQLHETAEALALSGSLLSTALQGVYQSNQATAAACQINNINLLLGHIGKPGSGILQMNGQPTAQNNRETGCDGEFPGFRNHQNPNHIRDIARVWNINYEQVPHWSEPTHIMNMLNYIESGSIEMFWVSGTNPLVSLPHLYRVRQLLTKPDLFVVVQDLFLTETAAIADVVLPAAQWAEKTGCFTNVDRTMHLSRKAVDPPGEAKADLDIFLDFAQRMDFRNRDGGPLIPFTNPEEVFEEWKKMSYGRPLDCSDLTYEKLSGGSGIQWPCTKEYPFGKERLFDDGKFFTDTDYCESYGHDLETGTPLTKGQYEAMNPAGRAILKAAHYRKPWESPDEEFPFYLSTGRNVFHFHTRTKTGRSKRLQNADKDACLVICQADADELGVTNGEMVIVRSRRGQVELPVKTEGISKGHVFIPFHFGYWDSKDQRARAANELTIEQWDPVSKQPMFKSGAVRIEKCVQKENEPPISRERQSEAIQNVEANKANATETRKDGQDSRVRWLEMWLGATHESLEMLRQIYDKLIPQLVHDLEIQAGLGVMRRITADIIAKLEPIVHRYHESRVYGRRVCERLRKALFPMEDDKDNSYETLIVLQSLEMFLTYIDGHLTALSPASQALWDQEFVDAVSFAAQHIQRQKAWVNTHIKVKSPQTLLVPQRPPMEVDADRDEEAAENVLVREFYY

SEQ ID NO: 46408 - protein, 481 aa, Xylella fastidiosa Dixon
MSFACVGLGGEERRGIARDAGIFWCVVRGITGIGGVSDGRLPVLAGVGTAWRCSQAVAVIGGRLVGWTLGVYLLPDEPGQWCFVSIKEIEMSIVRMTDLALSGKRVLIRQDLNVPIDQGLITSEQRIIASLPTIRVALERGAAVMVTSHLGRPKEGVWSEEDSLAPVAKRLSQLLGIEVPLRRDWVDGVQVAPGQLVLLENCRMNVGEAENDEALARKYAALCDVFVMDAFGTAHRAQASTHGVICCAAIAAGGPLLMAELDALSRGLKHPVKPLLAIVGGSKVSTKLELLSNLVNNVEQLITGGGIANTFLAAAGYSIGKSLYEADLIETAREIITVAKARGAEIPLPTDVVVAKQFLPGVTATVKTVDAIVADDLILDIGPQTARHYAALIETAATVVWNGPVGVFEFDAFSKGTEVLARAVAASSAFSIAGGGDTLAAIDKYGVADQISYISTGGGAFLEFLEGKTLPAVAALQARSG

SEQ ID NO: 46409 - protein, 431 aa, Datura stramonium
MAGQTVIVSGLNPAAILQSTIGGATPAPAAENDHTRKVVPLSRDALQDFMVSIITQKLQDEKQPFYVLDLGEVVSLMDQWNAGLPNIRPFYAVKCNPEPSFLSMLSAMGSNFDCASRAEIEYVLSLGISPDRIVFANPCKPESDIIFAAKVGVNLTTFDSEDEVYKIRKHHPKCELLLRIKPMDDGNARCPMGPKYGALPEEVEPLLRTAQAARLTVSGVSFHIGSGDADSKAYLGAIAAAKGVFETAARFGMSKMTVLDIGGGFTSGHQFTTASAAVRSALEQHFHDEQELTIIAEPGRFFAETAFTLATTIIGKRVRGELREYWINDGLYGSMNCVLYDHATVNATPLACMSNRSNLNCGGSKTFPSTVFGPTCDALDTVLRDYQLPELQVNDWLIFPNMGAYTKAAGSNFNGFNTSAIVTHLAYAYPS

SEQ ID NO: 46410 - protein, 491 aa, Candida albicans SC5314
MLRSFKSIPANGKLAQFVRYASTKKYDVVVIGGGPGGYVAAIKAAQLGLNTACIEKRGALGGTCLNVGCIPSKSLLNNSHLLHQIQHEAKERGISIQGEVGVDFPKLMAAKEKAVKQLTGGIEMLFKKNKVDYLKGAGSFVNEKTVKVTPIDGSEAQEVEADHIIVATGSEPTPFPGIEIDEERIVTSTGILSLKEVPERLAIIGGGIIGLEMASVYARLGSKVTVIEFQNAIGAGMDAEVAKQSQKLLAKQGLDFKLGTKVVKGERDGEVVKIEVEDVKSGKKSDLEADVLLVAIGRRPFTEGLNFEAIGLEKDNKGRLIIDDQFKTKHDHIRVIGDVTFGPMLAHKAEEEGIAAAEYIKKGHGHVNYANIPSVMYTHPEVAWVGLNEEQLKEQGIKYKVGKFPFIANSRAKTNMDTDGFVKFIADAETQRVLGVHIIGPNAGEMIAEAGLALEYGASTEDISRTCHAHPTLSEAFKEAALATFDKPINF

SEQ ID NO: 46411 - protein, 362 aa, Arabidopsis thaliana
MNRGVLESSPVQHLTAAGNPNWWNNVSRGLRPPTPLMSHEPPSTTAFIPSLLPNFFSSPTSSSSSSPSFPPPNSNPNFSSWLEMSDLPLDQPWSLSQLLLGGLMMGEEEKMEMMNHHHHQNQHQSYQAKRIQNWEEQVLRHQASMKQESSNNNSYGIMSSPNSPPNKSCATIINTNEDNNNNIHSGLNLSECNSSEMIGSSFANKKPKLQVPSSQSTLKVRKEKLGGRIASLHQLVSPFGKTDTASVLSEAIGYIRFLHSQIEALSLPYFGTPSRNNMMHQHAQRNMNGIFPEDPGQLVNEYCMKRGVSLSSTDNQKSNPNEEPMKDLRSRGLCLVPISCTLQVGSDNGADYWAPAFGTTLQ

SEQ ID NO: 46412 - protein, 449 aa, Ralstonia eutropha JMP134
MTTAVHPVDQILPARAMASLGFQHMLVSYLGAIAVPMIVASALKMTPAQTTMLISTALFTSGIATLLQTVGFWKFGVRLPLMQGVAFSSVAPVIAIGSDPSLGFNGVCGAIIGAGVITMLLAPVIGRLKRFFPPVVSGCTITAVGLSLFPVSFHWFGGGRGAPDFGSPVFFAVGFGVVALILLINRHRSELVRNLAVMIGLLVGGAVAWMLGMGNFDEVSRAPWFTMVTPFAFGMPVFDIGAITTMVIVMVVQMVESMGLFVAVSEIVKRPITEQDATRGLRANGLASAIGGMFAAFPYIAFMENVGLVIVTGVRSRWVVATCGVMLCAVALVPKIGALFASIPPAALGGAAMVMFGVVVAAGIKTLGRVEYDRNPANLSVVAITLACAMMPVMLPSMLDKLPGFLQPFVHSSVIIACVVSVLLNLLLNGVPARDESEHPIHTDNIQEV

SEQ ID NO: 46413 - protein, 390 aa, Oryza sativa
MGKGGKGAEAAAAAVAGAGEEENMAAWLVAKNTLKIMPFKLPPVGPYDVRVRMKAVGICGSDVHYLRVICCSLTERMKDNVAYICLLFECVQEMRIAHFVVKEPMVIGHECAGVIEEVGSGVTHLAVGDRVALEPGISCWRCRHCKGGRYNLCEDMKFFATPPVHGSLANQIVHPGDLCFKLPENVSLEEGAMCEPLSVGVHACRRADVGPETGVLIMGAGPIGLVTLLAARAFGATRVVIVDVDEHRLSVARSLGADAAVRVSARAEDVGEEVERIRAAMGGDIDVSLDCAGFSKTVATALQATRGGGKVCLVGMGHNEMTVPLTSAAIREVDVVGIFRDKDTWPLCIEFPLSGEIDCKAVITHPCGMYKEDLVDAYRSKTLFRRLDVG

SEQ ID NO: 46414 - protein, 193 aa, Shewanella sp. MR-4
MNRRQFFKLCAAGAATSAISALGLMSEKAYAAVREFKLIGAKETRNNCPYCSVGCGLLMYSQGSGGKNSEHAIFHIEGDADHPVNRGALCSKGAGLVDYVNSPHRLQYPEYRAPGSNKWERISWHDAFKRIARLMKDDRDANLIEKNADGVTVNRWLTTGMMTSSGMANESGLATQKFARALGLVAIDTIARN

SEQ ID NO: 46415 - protein, 794 aa, Shewanella sp. MR-4
MTNHWIDIKNSNVVIIMGGNAAEAHPVGFGWVTEAMQHNNAKLIVVDPRFNRSASLADHYAPIRSGTDIAFLLGVIRYLISTNQVNFDYVKAYTNASYLVRDDFDFHDGLFSGFDEAKGEYNKESWFYQLDEDGYAKVDETLEHPRCVWNLLKQHVERYDFATVSNITGTPTADYQVVCDAIASTHTKDRVATFMYALGWTHHSKGAQNIRSMAMIQLLLGNIGQLGGGVNALRGHANVQGSTDMGLLAQSLPGYLKLPNDKEPTLAAHLAANTPKPLRPGQTNYWQNYPKFYVSLLKAFWGENATPENEFGYQWLPKWDQMYDFGKHLDMMYRGKVNGCIVQGVNAINSMPNRNKNIKALSNLKYLVVLDNLSSETATFWQNEPGFNEVDTASIQTEVFRLPATVFAEEEGSIVNSGRWMQWHYKGANPPGEAMSDSEIVSGLLQELKHLYREEGGKLPEPIEAINWNYIDPHNPSSIELTKELNGYDVATKRQISSFAELKADGSTASACWIYAGSWTEAGNQMARRDNHDPSGKGITPGWAFAWPLNRRVLYNRASCDVNGKPWDEHRKIVEWKDGKWEGIDVPDFNAKLNPQESAHPFIMQAEGVGRFFALKLLKEGPFPEHYEPVESPIGTNPLHPNVVHSPVLRWFEGVKDTIGTKEEYPYACTTYSLTEHFNFWTTHCRLAAIAMPETFVEMNEQLAAEKGIKNGDWVKVSSKRGHILTKALVTKRMRPLQVNGQTVHTLGIPRHGSHNALTRKAYSCNVLTTEMGDANTGVPEYKAFLVNVEKAEV

SEQ ID NO: 46416 - protein, 658 aa, Streptococcus pneumoniae R6
MSNLSVNAIRFLGIDAINKANSGHPGVVMGAAPMAYSLFTKQLHINPAQPNWINRDRFILSAGHGSMLLYALLHLSGFEDVSMDEIKSFRQWGSKTPGHPEFGHTAGIDATTGPLGQGISTATGFAQAERFLAAKYNREGYNIFDHYTYVICGDGDLMEGVSSEAASYAGLQKLDKLVVLYDSNDINLDGETKDSFTESVRDRYNAYGWHTALVENGTDLEAIHAAIETAKASGKPSLIEVKTVIGYGSPNKQGTNAVHGAPLGADETASTRQALGWDYEPFEIPEQVYADFKEHVADRGASAYQAWTKLVADYKEAHPELAAEVEAIIDGRDPVEVTPADFPALENGFSQATRNSSQDALNVVAAKLPTFLGGSADLAHSNMTYIKTDGLQDDANRLNRNIQFGVREFAMGTILNGMALHGGLRVYGGTFFVFSDYVKAAVRLSALQGLPVTYVFTHDSIAVGEDGPTHEPVEHLAGLRAMPNLNVFRPADARETQAAWYLAVTSEKTPTALVLTRQNLTVEDGTDFDKVAKGAYVVYENAADFDTILIATGSEVNLAVSAAKELASQGEKIRVVSMPSTDVFDKQDAAYKEEILPNAVRRRVAVEMGASQNWYKYVGLDGAVLGIDTFGASAPAPKVLAEYGFTVENLVKIVRNLK

SEQ ID NO: 46417 - protein, 394 aa, Zea mays
MSSPSTATAITASASPAAMQETSNKATTNTTTIASPTTAARYRRPSLLVILSACLVLMGAGGPLLLRVYFVHGGKRLFLSAMLQISGWPLLLPPICVSLYRSRRHGVAKKLLLPPRLAGAAAVLGALYAVSCFVYALGSQALPLSTSSLLLATQLAFTAVFAFLFVGLRFTPFSANAVVLLTIGPAVLGVGPGSGKPAGEASRTYWTGFCEAIAAAALAGLVLPLVEVATARYARRTGPAARVPPPYAPVMQMQAVMGAAGTVVCLLGMAVKSDFQAVASEAATFGLGETNYYLVLVWDAVSWQLLNLGIVGVITCASSLLAGIMIAVLLPLSEVLAVIFLHEKFDGPKGIALVLSLWGFASYLYGEKAQSKMQQTQKMEQQLAIKTDLESAAP

SEQ ID NO: 46418 - protein, 341 aa, Arabidopsis thaliana
MKQASSSSSSRNSTSLTNRLKTIFKKAEELSILCAIEVCVIYYGPDGELRTWPKERETVKDMALRYKEARKRKKSRNLHEFLEKEKDKDKGKTNLKKNWYPNFDHYSPQQLSQLIQSLERTLSTLQERLRIVEAQKLQNTNLVHQSLTPSYLNQTQHLNPSKFSLFMYNHGDATLSQLPLSAPHSNQLINYQNHLMQHGFGQNMCSDNITNNNFEHPGVSNTQDYSPLLSVQASAVNNYGLNNHLMQQQDQLHGFDQNMCMVSEIINNNNGLQHPNLSNTVPHEFSSDFNQNPYGNAVGNISFSQDMFSSYDASSLLQTSSLPPLHNIPSSYCFPGNSRLL

SEQ ID NO: 46419 - protein, 230 aa, Gossypium hirsutum
LFTSLCHTDVYFWEAKGQTPVFPRIFGHEAGGVVESVGEGVTELKPGDHVLPVFTGECGDCRHCKSEESNMCDLLRINTDRGVMLSDGKTRFSINGKPIYHFVGTSTFSEYTVVHVGCVAKVNPAAPLDKICVLSCGISAGLGATLNVAKPTKGSTVAIFGLGAVGLAAAEGARIVGASRIIGVDLNPNRFEEAKKFGCNEFVNPKDYDKPVQEVLAEMTNGGVDRSVEC

SEQ ID NO: 46420 - protein, 389 aa, Nocardia farcinica IFM 10152
MRALCWNGVNDLAVETVEDPRLVNPHDVIVRVRLTTTCGSDLHFIDGYLPGMRAGDVFGHEFMGEIVEVGREVRDRKVGDRVVVPSFIGCGTCFYCTRDMYSLCDTTNPNAELQQPVFGYPTGGIYGYTHPFGGYQGSHAEYVRVPFGDVNSFVVPEGITDEQALFVSDAVPTGLMGADFCDIAPGDTVAVWGSGGVGLMAGHTARLLGAGRVVVIDRIPERLALARKHFDAETIDYTAVDSVQEALREMTGGRGPDACIDAVGMEGHGTGLQQIYDRAKQLLRLETDRATPLREAILACRKGGVVAVLGIYGLTDKFPMGVVTNKGLTIRTAQQHGQRYVPRMFDHILQGDLDPSYLVTHDLSLEDGPRGYEVFKNKDEGCVRAVFRP

SEQ ID NO: 46421 - protein, 230 aa, Gossypium hirsutum
LFTSLCHTDVYFWEAKGQTPVFPRIFGHEAGGVVESLGEGVTDLKPGDHVLPVFTGECGDCRHCKSEESNMCDLLRINTDRGVMLSDGKTRFSINGKPIYHFVGTSTFSEYTVVHVGCVAKVNPAAPLDKIFVLSCGISTGLGAILNVAKPTKGSTVAIFGLGAVGLAAAEGARIAGASRIIGVDLNPNRFEEAKKFGCNEFVNPKDYDKPVQEVLAEMTNGGVDRSVEC

SEQ ID NO: 46422 - protein, 334 aa, Pseudomonas fluorescens Pf-5
MTALTNRQFLLAKRPIGPATRDTFTYQQVAVGEPAAGQILVQNQYLSLDPAMRGWMNEGKSYIAPVAIGEVMRALGVGQVIASSHPGFAVGDYVNGALGVQDYFLGEPRGFYKVDPKLAPLPLYLSALGMTGMTAYFALLDVGAPKAGDTVVLSGAAGAVGSIAGQIARIKGCRVVGIAGGQDKCRFLIDELGFDGAIDYKNEDVHAGLKRECPKGVDVYFDNVGGDILDAVLSRLNVKARVVICGAISQYNNKEAVKGPANYLSLLVNRARMEGFVVMDYAAQFAEAGQEMAGWMAKGQLKSKEDIIEGLETFPETLGKLFSGENFGKLILKV

SEQ ID NO: 46423 - protein, 278 aa, Triticum aestivum
MAAAAAEQDYWGLFREETGWYNEIFLSAVVPGGGGWWRALPHPLRSWLRNCIGGYLLYFATGFLWCFVIYYWKRNAYIPKDAVPTVEAMKKQIIVASKAMPFYCALPSVSEHMIESGWTRCFFHISEVGWPMYIIYVSLYLIFVEFGIYWMHRELHDIKPLYKHLHATHHIYNKENTLSPFAGLAFHPLDGILQAISHVIALFLLPMHFRTHIALLFIEAVWTANIHDCIHGKIWPVMGAGYHTIHHTTYRHNYGHYTVWMDWLFGTLREPEDLLKKD

SEQ ID NO: 46424 - protein, 359 aa, Oryza sativa (indica cultivar-group)
MDGGGVDGYGMEMVRNRKVVLRRYVTAGYPTVDDMEVVSSTVMPRVPLGTMAPAVMVKNIYLSCDPWMRGRMTKHDDATAEIAEDFVLGEAMVNFGVSKVVDSTHPVFAAGDLVWGLCGWEEYSLITQPETLHKINHPDLPLSYYTGVLGVTGLTAYAAFFEVGKPKKGETVFVSAASGAVGQIVGQLAKIAGCYVVGSAGSDEKVTLLKTKFGFHDAFNYKKEGNDLTGALRRCFPDGIDIYFDNVGGATLDAALVNMRRGGRVVVCGMISQYNLQEPEGVHNVIQILSKTIRVEGFAVFNHFGLYPMFEDEMARYLKEGKVTVLQDVVKGIEKASEALIGMFSGRNVGKLLVAVADE

SEQ ID NO: 46425 - protein, 605 aa, Pimelobacter simplex
MTQLDDRPVTTADTDPATAWFAAFEDALAARDIDRAAGLFAATSFWRDLIAFSWNLTTVENPDGVADLLAHTLDRVDPRGFRLTEPADTADGVTTAWFEFETAVGRGRGLVRVVDEDGPKAWTFLTTLYELKGHEEPRASRPRWRVHGATKERVTWLEQRQAEDAALGVDTQPYVLVVGGGQGGNRSARVRQLGVPALVIDKHPRPGDQWRNRYKSLCLHDPVWYDHLPYLKFPDNWPVFAPKDKVGDWLEFYTRVMEVPYWSNTVATKASYDESAGEWTVHLEREGKPLVLKPTHLVMATGMSGKANVPSYPGAEVFQGEQHHSSQHPGPDAYAGKKVVVIGSNNSAFDICGALWETGADVTMVQRSSTHIVKSDTLMDIGLGDLYSERAVENGVTTEKADLIFASLPYRIMHEFQIPLYDKMRERDRDFYDRMTAAGFDLDWGDDGSGLFMKYLRRGSGYYIDVGAAELVANGDVKLAHGQVDHLTETSVVLVDGTDLPADLVVYATGYGSMNGWAADLISQEVADRVGKVWGLGSDTTKDPGPWEGEQRNMWKPTQQENLWFHGGNLHQSRHYSLYLALQLKARHVGIDTPVHRLQEVHHLG

SEQ ID NO: 46426 - protein, 350 aa, Acidobacteria bacterium Ellin345
MPNTMLAVMKPEAAPGSEIREVPVPKFGPNEVLVKVKVASICGTDLHIYNWDQWAQRRIKPPLIPGHEFCGDVVAVGSEVTLVKEGDFVSAEMHVNCGKCLQCRTGQAHICQHVKIIGVDANGAFAEYVVIPESNIWKLDPAIPQEYASILDPLGNAVHTVLAGDIAAKTVAITGCGPIGLFSIAVAKACGATKVFAIEVNEHRRAIAKKMKADFVLDPTKDNVKQVVLDNTEGVGVDVLLEMAGRQDAIKLGFSILRLGGRASLLGIPGKPIEINLAEDIIFKGAIVQGINGRKMYETWYQMEALLKAKMLDLHPVITDKIPMKDFSTAMARLQSGEASKILMYPNGTK

SEQ ID NO: 46427 - protein, 151 aa, Triticum aestivum
KVLSPQDAALLIQMNYRAHLAHRSQVLRCLRDLAVAKAKLKELRSLFYNLSYRRRLSHDHEERQRFSEKIIVLLLTVDALEGPDFMVRTAKKSMLEELESMLEIVDPQPPGKQRSFSRRKFDLPEGGAIPNEKTAGVNNAVRVINTGKGKQ

SEQ ID NO: 46428 - protein, 988 aa, uncultured marine gamma proteobacterium EBAC31A08
MTLRFQKMLNKIIDACRENKSERTKLDAFLSEYGLDNKEGVALMCLAESILRIPDKKTRDLIISEKLSEGAWIEHLNKADSVFVNASTWGLLLAGKVVSTPDEWTKNPSALLSSLISKSGEFPIRNAVVGAMHILSQEFVMGRDFDDIKKIKNIENEIYSFDMLGEAARNAEQADTYYQSYKNAIDEVGKINLTKNTINGVSIKISALSPRYEMKKLKDIKSDLLPKLIQLTEYAKSKDVEITIDAEEQDRLAVSLEIIKEMALSPNIKNWKGFGIAVQAYGKRAIATIDWLEELLENRAPMHVRLVKGAYWDYEIKHAQIYGYDGYPVYTKKSVTDLAYLACAKRIFNVEKIYPKFATHNAHTISAIHHLGSNKDYEFQRLFGMGELLYKSANKILNTEKNTSIYAPIGKYKDLLPYLVRRLLENGANSSFINRLLDPETDSAWLARGPHLKIEDEKKEIPMPRNIFNDRPNSKGFDLSERVNLEMLEEELGKFDSKEIKASSIYKAKDYKKTNTHDISSLADGRNIGTASYDDLDYIKGSLEEQNISEWSLMHVEKRASILEKIADDIEANPSELIYYLMNEAGKTVQNTIDEIREAIDFLRYYAKQAVGLQTEDHILEGPTGEINALSYSPKGHILCISPWNFPVAILIGQISAALACGNKVTVKPSEHTSILGYIIVNKFHEIGVPKDALNLILGDGIHGDMLSKVNNIKGVAFTGSLKTAKKIQSSLASNHESIIPLIAETGGINSMIVDSSALLEQATDDIIRSAFDSSGQRCSALRVLCVQDEIYDDLLSMIKGGMKELKIGNPQNLDTDIGPIISKTSLDSLNAYVKGFEDKNYSIFRSADNVDENFVAPTIIEIDNISDLKDEQFGPILHIVRFKSNEMDALIENINDSGFGLTMGIHTRVEKRADIFSDKCNVGNIYINRDMVGAVVGSQPFGGQNLSGSGYKAGGPNYLLQFLNEKVVSKNSVAFGGNTELLNIQED

SEQ ID NO: 46429 - protein, 370 aa, uncultured archaeon GZfos1D1
MDISQTIFEEYADDLGPEKIIHIYEPVAKLRAIVVIDNVAAGPVIGGVRMAPNLTTTEIMRLARAMTLKNAAAGLPHGGGKAGILADPKTEGKEHLIRVFARTIEHLHDYIPGPDMCTDESCMAYIFDEIKRAVGLPRVLGGIPLDEIGATGFGVAECAEVAKEYIDLDLNGARLVVEGFGNVGKNTARFLEEKGASLVAASDTSGTVYNMDGIDVSGLIRVKEEKGSVIYHEDAEKLKTGDLLKIPGDIFVPAARPDVIDERNVSTLDTKLVIQGANIAITLGAEKALHERGVLSVPDFIANAGGVIAAAVEYRHGDEKEAFSEIKSKIRANTKKILDKTYSEGLYPRDAAEMIAKERVLSAMSYRRCI

SEQ ID NO: 46430 - protein, 461 aa, Thermobifida fusca YX
MSRYAHPAGPRHADVLPEEHPPSPPADLLELHPRVWPSTATRVDGEITIGGVGVTELARKFGTPLYVIDEADFRARARDYRLAFEDADVYYAGKALLTKAVARWVAEEGLKLDVCTGGELAVALAAGFPPERIGMHGNNKSAAELARAVEVGVGRIIIDSFDEIDRLERIAAERGRVPEVLIRVTTGVEAHTHEFVATAHDDQKFGLSLSNGAAAEAVRRLLTSPHLRLVGLHSHIGSQIFDTAGFEVAARRLSTFLTQIYAEHGISLPELDLGGGLGIAYLPDDDPLDPKSIADSLRSIVEHECAAQNLPVPRIAVEPGRAIAGPAGITLYEVGTVKDVEGIRTYVSVDGGMSDNIRTALYGAEYTCVLASRHSDAEPMLSRLVGKHCESGDIVVRDLYLPADLRPGDLVAVAATGAYCYSMASNYNHVPRPAVVAVREKNARVLVRRETEEDLLRLDVG

SEQ ID NO: 46431 - protein, 605 aa, Marinobacter sp. ELB17
MTETKMTENKVTATQQARQWLDSFEETLNSDNPAQAADLFEDGGFWRDLVTMTWNIKTMEGRGAIRDMLSATAKRTQPANWQVSEEATEQDGVIDAWVTFETVDAIGKGHLRLRNGHAWTLLTTMQELKGFPEKRKFHRAKGAEHGASKSRKSWLETLQDEQQELGYSRQPYCVIIGGGQGGIALAARLKQLDVPTIVIERSAKAGDSWRNRYKSLCLHDPIWYDHLPYLPFPDHWPVFAPKDKIGDWLEMYTKIMELNYWSSTECTAARYDEASKEWVVDVVRDGEKVTLRPQQLVLATGMSGIPNIPDIPGMDTFEGEQHHSSRHPGGEAFKGKKCVILGANNSAHDICAALWENSADVTMIQRSSTHIIKSDTLMDDVLGGLYSEQAVADGMTTEKADLTFASVPFRIMPDFHIPVYQQVAEKDADFYGRLRKAGFMLDFGDDGSGLFMKYLRRGSGYYIDVGASELVADGEIKLKSGVSIEHINPRSVTLTDGTELPADLIVYATGFGSMNGWAAHIISEEVADKVGKCWGMGSDTTKDPGPWEGELRNMWKPTQQKALWFHGGNLHQSRHYSLYLALQLKARKEGLDTPVYGQESVHHLS

SEQ ID NO: 46432 - protein, 276 aa, Streptococcus pneumoniae R6
MGVKKKLKLTSLLGLSLLIMTACATNGVTSDITAESADFWSKLVYFFAEIIRFLSFDISIGVGIILFTVLIRTVLLPVFQVQMVASRKMQEAQPRIKALREQYPGRDMESRTKLEQEMRKVFKEMGVRQSDSLWPILIQMPVILALFQALSRVDFLKTGHFLWINLGSVDTTLVLPILAAVFTFLSTWLSNKALSERNGATTAMMYGIPVLIFIFAVYAPGGVALYWTVSNAYQVLQTYFLNNPFKIIAEREAVVQAQKDLENRKRKAKKKAQKTK

SEQ ID NO: 46433 - protein, 697 aa, Aspergillus oryzae
MESARKEQGQGYFSHNSSGGSGATRNPSTPNEGQRSHLRQNSSIDGLTMGSLPPNSPVIRIIYTGGQTKVLNIKHCKTADEIILCVLKKLQLPEHQYRNYCFYVLDGLEPDPSNCRRLADHELMEICESNHKSERGRLILRKIHAGEPDTDELRRASQLAIDESQATHINALNSSNPRTQFKIQQLTGEPWHNIKQPISPMSARHQNSSEHDLQVLNTERHAVSKLRSFFGARPPSEMIIHEITSYFPSHHREDIEKTMRMSIRRSQRLSRAASRLSVVSNTSYASSLRDAPPIPSIADTWLNTGAQPTRASRPLSVSKFSLPQATYRDSIASSSLQPLQEESPIEPNRKSYVSFDSGSDDPSTSRQSLVDENASVAATDGGSLNERLSVLVAEDGEEEDDGLNDFLAGNNFAPKNWMKGSLIGEGSFGSVFLALHAITGELMAVKQVEIPSATKGTEFDKRKNSMVTALKHEIELLQGLHHKNIVQYLGTAADDQYLNIFLEYVPGGSIATMLKQYNTFQEPLIKNFVRQILAGLSYLHSRDIIHRDIKGANILVDNKGGIKISDFGISKRVEASTVLGSRASGTGGGHLHRPSLQGSVYWMAPEVVRQTAHTKKADIWSLGCLVVEMFIGAHPFPDCSQLQAIFAIGSNKARPPAPEHASKDAVAFLDMTFQVDYEQRPSADELSKCQFLATPIA

SEQ ID NO: 46434 - protein, 451 aa, Mycobacterium avium subsp. paratuberculosis K-10
MTTSTVVPRISGGEEEHGHLEEFRTDPIGLMQRVRDECGDVGWFQLVDKHVILLSGAQANEFFFRSADEDLDQAEAYPFMTPIFGKGVVFDASPERRKEMLHNSALRGEQMKGHASTIEGEVKKMIADWGDEGEIELLDFFAELTIYTSTACLIGLKFREQLDHRFAEYYHDLERGTDPLCYVDPYLPIESFKRRDEARVKLVALVQEIMDQRLANPPKDKADRDMLDVLVSIKDEDGKPRFSADEITGMFISLMFAGHHTSSGTSAWTLIELIRHPDVYAEVLAELEELYADGQEVSFHALRSIPKLDNVVKETLRLHPPLIILMRVAKGEFEVEGFPIHEGDYVAASPAISNRIPEDFPDPDAFKPDRYNKPEQADIVNRWTWIPFGAGRHRCVGAAFAQMQIKAIFSVLLREYDFEMAQPADSYRNDHSKMVVQLARPAKVRYRKRNA

SEQ ID NO: 46435 - protein, 101 aa, Bdellovibrio bacteriovorus HD100
MATTHERIDQIVKGNKIVLFMKGTQQFPMCGFSARACAILQDMGVQFHDVNVLDDDEIRQGIKEYGNWPTIPQLYINHQLVGGSDIMMEMYQSGELQELLK

SEQ ID NO: 46436 - protein, 590 aa, Burkholderia vietnamiensis G4
MSLIEVKVPDIGDFSGVDVIEVNIKPGDVIEKEQTLLTLESDKASMEVPSDIAGTVKEIKVKAGDKVSQGTVIALVEASTGAAAPAPAKAPEAPKPAAAAPAPAAAAPAPAPQVGSYGGSADIECDMLVLGAGPGGYSAAFRAADLGMKTVLVERYSTLGGVCLNVGCIPSKALLHTALVVEEAAALASHGITFGKPEVDLDKLRDFKGGVVKKLTTGLAGMAKARKVEVVTGIGAFVDPFHMEVQGDNGKKVVKFKQAIIAAGSQAVKLPFMPEDPRVVDSTGALELRQLPKRMLVIGGGIIGLEMATVYSTLGAEIDVVEMMDGLMMGADRDLVKVWEKFNAKRFGNVMLKTKTVGAQAKEDGIYVKFEGEKAPAEAQRYDLVLVAVGRSPNGKKIGADKAGVAVTERGFIDVDKQMRTNVPHIFAIGDIVGQPMLAHKAVHEGHVAAEAAHGEKAYFDALQIPSVAYTDPEVAWAGKTEDQCKAEGIKYGKAVFPWAASGRAIANGRDEGFTKLIFDEATHRVIGGGIVGLNAGDLISEVCLAVEMGADAEDIGKTIHPHPTLGESVGMAAELYEGVCTDLPPQRKK

SEQ ID NO: 46437 - protein, 415 aa, Burkholderia vietnamiensis G4
MIEIGVKIGDTVEKEQSLVTLESDKATMDVPSPAAGVVKDIKVKVGDAVSEGTLIVLLEAAGAAAPAVAPASAPAPAAAAPAPAAAPAPAPAASAPAAAAPAAAPSGEYRASHASPSVRKFARELGVDVARVSGSGPKGRITKDDITGFVKGVMSGQRAAPGAAAAPAGGGELNLLPWPKVDFAKFGPFEAKPLSRIKKISGANLHRNWVMIPHVTNNDEADITELEALRVQLNKEHEKAGVKFTMLAFVIKAVVAALKKFPTFNASLDGDNLVFKQYYHIGFAADTPNGLVVPVIRDADKKGLVDIAKEMAELSKAARDGKLKPDQMQGGCFSISSLGGIGGTHFTPIINAPEVAILGLSRGQMKPVWDGKQFVPRLTLPLSLSYDHRVIDGAEAARFNAYLGALLADFRRIIL

SEQ ID NO: 46438 - protein, 898 aa, Burkholderia vietnamiensis G4
MSAVPNEVMKYVAAERDDDPQETVEWLESLDGVISSVGTGRAHYLIEKQIEFARMHGEHLPFSANTPYINTIPVEAQAKIPGDQDIEHRIRSYTRWNALAMVLRAGKDTNVGGHIASFASAATLYDVGYNHFWHAASDQHGGDLVFVQGHSSPGVYSRAFLLGRLSEEQLDNFRQEVDGNGISSYPHPWLMPDFWQFPTVSMGLGPIMAIYQARFMKYLESRGIAQTAGRKVWAFLGDGETDEPESLGAIGMASREKLDNLVFVINCNLQRLDGPVRGNGKIIQELESEFRGAGWNVIKVIWGSRWDALFARDKTGALMRRMMEAVDGEYQTYKSESGAYVREHFFNTPELKALVADWSDDDIWALNRGGHDPHKIYAAFHEASNSQGAPTVILAKTIKGYGMGESGQAMNITHQQKKLPVEQLKKFRDQFRLPITDEQIADVPYIKFEEGSKELEYMRQKRMELGGYLPHRRQKATSLPVPALDAFEPLLKGTGEGREISTTMAFVRILNILLKDKALGKRVVPIVPDESRTFGMEGLFRQIGIWNQDGQKYVPEDSDQLMFYKESKTGQILQEGINEAGGMCDWIAAATSYSTHGEIMVPFYIFYSMFGFQRIGDLAWAAGDMRSRGFLLGGTAGRTTLNGEGLQHEDGHSLLWAASVPNCVSYDPTFGYELAVIIQDGLRRMVQEQEDVYYYVTVMNENYEHPAIPQGEHVAADIIKGMYAFRKAEADKKAPRVQLLGAGTIFNEVIAAADLLKNDWGVAADLWSVPSFTELAREGHDVERWNLLHPTEERRLSHVQKCLKDTQGPVIASTDYVRALVDQIRGQIDRRFVVLGTDGFGRSDTRAKLRHFFEVDRYWVAVAALNALADEGTIERKVVADAIAKYNLDPSKPNPMTV

SEQ ID NO: 46439 - protein, 99 aa, Brassica napus
MTTVKGLLKGLRYITQIFDEDKDQDIQIGFPTDVKHVAHIGSDGPAANMPSWMGDFKPQEHENGQVVSRGDVTNNPIGEGVGLQELLPPPEKQKHKKTR

SEQ ID NO: 46440 - protein, 405 aa, Geobacillus kaustophilus HTA426
MEHLRERALLVHRQARGKLSVEVKVPVVNANDLSLIYSPGVAEPCKEIYVDQDEMYNYTVKGNFVAVVSNGTAVLGLGNIGARAALPVMEGKAALFKAFAGIDAVPLCLDTEDPEQIIQTVKLLEPAFGGINLEDIAAPACFVIEERLRQEMAIPVFHDDQHGTAIVVAAGLTNALKVVGKQLADCRVVINGAGAAGVAIAKLLLSIGVGELIVCDTKGAIYEGRSHGMNAIKEEIARQTNHRRISGTLADVIQGADVFIGVSVAGALTPAMVRTMNRGAVVFALANPVPEIMPDEAKAAGAAVVATGRSDLPNQVNNVLAFPGIFRGALDVRATQINEAMKIAAAEAIAGLIQPEELTEEYVIPNPFDRRVVEAVASAVARAAMETGVARVKEKVEEQNRVREG

SEQ ID NO: 46441 - protein, 534 aa, Symbiotaphrina kochii
MAAAVDASFTSPAANAQYPLTSDDGSIGLIASRLIQGLSFWNVVGTIFLMMVIYDQLSYIRNKGSIAGPLMKIPFMGPFLQSMNPKFEGYKAKWDSGALSCVSVFHKFVVIASTRDMARKIFNSPTFVRPCVVDVATKLLRPTNWVFLDGKAHVDYRKGLNGLFTRKALELYLPGQEEVYDKYLAKFVAITKTNNGKPIPFMPEFRELNCAISCRTFVGHYISDEAVKKIADDYYKITEALELVNFPIIIPFTRTWYGKKAADMVLEEFAKCAAKGKVRMNAGGSITCIMDGWIKSMIESKIYQERIAKGESVDPSEKPAMIIREFTDYEISQTIFTFLFASQDASSSATTWLFQLLADRPDVLARVREENLAVRDGDRDKRVTMDILDNMTYTRAVVKETLRYRPPVLMVPYVAKKDFPISDSYTVPKGSMVIPTTYPALHDPEAYPNPETFNPDRWITGDAESQTKNWLVFGTGPHYCLGQIYAVNNLMALIGKASLHLDWDHTVTPKSEDIKVFATIFPQDDCLLAFQNRP

SEQ ID NO: 46442 - protein, 139 aa, Brassica napus
MARVSFKDSLKALEADIQHANTVALDYPREKDGARVQMRLSYNPAAQFLLFLVQWTDCHLAGALGLLRVLIYMTYADGKTTMSVYERKTSIKDFYAVIFPSLLQLERGITDIDDRKQKEVCKVRYRNKEEIERVKLSEI

SEQ ID NO: 46443 - protein, 535 aa, Symbiotaphrina buchneri
MAAAMNASFTSPAANAQYSASAHDGLAGLAMAQVLEGLTVWNAIGTVLIMLVLYDQLSYIRNKGRIAGPFFKIPFMGPFLQSVNPKFEEYKAKWDSGALSCVSVFHKFVVIASDRDMARKVLNSPAYVKPCVVDVAHKLLRPTNWVFLDGKAHVDYRKGLNGLFTRKALELYLPGQEEVYDKYFARFLEVSQKENKGNPTPFMAEFREINCAISCRTFVGHYLSDAAVKKIADDYYKITAALELVNFPVIIPYTKTWYGKKAADMVLDEFAKCAAKSKIRMNAGGEITCIMDGWIKSMIDCRKYQERIAKGETVDASEKPAMMLREFTDFEISQTIFTFLFASQDASSSATTWLFQLLADRPDVLAKVREENLAVREGDRNKRLTMDILDKMNYTRAVVKETLRYRPPVLMVPYLVKKTFPITDSYAVPKGSMIIPTTYPALHDPEAYPSPDTFDPERWITGDAENQTKNWLVFGTGPHYCLGQTYAQLNLMAMIGKASLHLDWTHTVTPDSEKIKVFATIFPQDDCLLTFSPRA

SEQ ID NO: 46444 - protein, 215 aa, Magnetospirillum magnetotacticum MS-1
MTTHAAMANAIRFLTMDAIEKSKSGHPGMPMGMADVATVLFTRFLKYDAKAPKWADRDRFILSAGHGSMLLYALGYLTGFEDLSDIEQIKNFRQMGYRTAGHPEFGHVAIAETTTGPLGQGIANAVGFALGEKMAAARHGAEIVDHYTYVIAGDGCLMEGISQEAISLAGVWNLSKLIVLWDDNHICIDGDTAISTSDDQLARFQASNWDVCRVD

SEQ ID NO: 46445 - protein, 504 aa, uncultured marine gamma proteobacterium EBAC31A08
MSIKYYDWSKFQANTRPNKVAIRELDNNKIYTYGELDKRSSRLASHLQSSGIKKGDRIAILSLNCSEFFELEFACGKIGAIEIPLNWRLTKPELSYILNDSEPKTLIYDNQFEEMVKELKEECNISEIIALDQFDQESDYEKVLSNASGIYYQEEVDLEDNIMIMYTSGTTGHPKGAMITHKMQLFNVINLGISAAVSPESVHLVVLPLFHTGGMNCYSNPILHAGGELILLKEFEPGKVLSIIGSSDYGVTHLFAVPAPYQFMMNHPDFESTNLSGVKYAGVGGAPCAEAILKTYISKGVSMQQGWGMTETSPGATGLESSEAERKIGSAGKPLLHTEVKVVGDDGNELPAGEVGEIYIKGPNITPGYWKKEEATRDSFEDGWLKTGDAAYFDDEGFLYIVDRWKDMYISGGENVYPAEVZNVIYQLPQIAEVGVIGIDSPKWGETGKAFVALKPDHELTAEEVIDHCLKNLAKYKIPEKVEFIAALPRNATGKVLKRTLRDM

SEQ ID NO: 46446 - protein, 186 aa, uncultured marine proteobacterium ANT32C12
MLYQIFYPLMSARPLLRLDQARVERATVITDSEHQFHDSRTNSYAWIQHDASEIIHEVSKRFSILVKMPINNAEQFQLVHYGPGTEYKPHFDAFDKSTEEGRNNWFPGGQRMVTALAYLNDVEDGGATDFPDIHVSVKPNKGDVVVFHNCKDGTSDINPNSLHGGSPVISGEKWAVNLWFRQEAIY

SEQ ID NO: 46447 - protein, 118 aa, Ralstonia eutropha JMP134
MNSQDNCIFCKIVAGQIPSRKVYEDDDMMAFHDIHPKAPVHFLLIPKSHVDSLAECGPAEGEVLARMMLKVPELARAAGCGNGFRTVINTGPDGGQEVYHLHVHVLGGPRHQWKVPLP

SEQ ID NO: 46448 - protein, 207 aa, Triticum aestivum
  misc_feature (108)..(108): Xaa can be any naturally occurring amino acid
  misc_feature (147)..(147): Xaa can be any naturally occurring amino acid
  misc_feature (160)..(160): Xaa can be any naturally occurring amino acid
VRIPAATRGPGRADLDVASSAEAEAAKRIRPEDLLDLLDDDADAAAAGDLASVMRSLEEEICAGDLAAPQPELGFLLEASDDELGLPPAAGAASSSSDDAGGWEPEEXAGVFGEQIWGFEDEIDGAYAFGGVASSPEAAAAAAAAAXAEWGDDGFDAGLXFGFGDESFGPSESRRAPPGDHAVPFDQSSSVDGRMDGWISLFFFTFG

SEQ ID NO: 46449 - protein, 640 aa, Desulfovibrio vulgaris subsp. vulgaris str. Hildenborough
MTIPCSRPLFIEPFDLYLFGMGRHRHLYRILGAHPAVQDGEAGYRFAVWAPNARSVHLSGDCNGWRHEGCPLFPVGVSGVWAAFVPGVRRGSLYKFVVRGADGRQEQKADPFALWAEMRPGVASVAWDIDNHAWGDGAWMAERARQGLPLERPVSIYEVHLGSWRRRHGDGHPFLTYDELGDQLIPYATGLGFTHLELLPVAEHPLDQSWGYQTGHYYAPTSRFGSPEGFKRFVDRCHQAGLGVILDWVPAHFPRDAWSLGRFDGTALYEHLDPRLGEHPDWGTYIFNYGRNEVRNFLTANALYWLREFHIDGLRMDAVASMLYLDYSREAGQWLPNRHGGRENLDAVDFLREVNTVIHAEFPGAMTLAEESTAWPGVSRPVYTGGLGFSFKWNMGWMHDTLGYLAEDPIHRAYHHGSLTFSMLYAFSENFVLPLSHDEVVHGKGALLSKMPGDMWQQQANLRLLYAYQWAHPGKKLLFMGGEFGQWNEWDESRELDWCLYRFPAHEGIARLVGDLNRLLRSEPAMHRRDHDWSGFRWVDFADYGSSVISFLRLAAGERPLLWIFNFTPVVRRFYRVPCPRGGTWRELCNTDSAYYGGSDVGNAGAVMAREDHWGGGHFIELTLPPLAAMCFAPVTGQGT

SEQ ID NO: 46450 - protein, 313 aa, Brucella suis 1330
MSHGEAPLKIFVFGSVNVDVSARMAALPRPGQTVNASGYGIGLGGKGANQAVAVAKLGGAIRFVGAVGHDAFGELALKQMREFGLDTGSVRVIDDVDTGMAIIQVEETGQNTIAVCAGANARWSSADIDAYGADIAKARITLLQREVPHEANLAVAKAVRAAGGTVLLDPAPVGDASQMADLIALSDIISPNETEAAEITGIEPTDLASAEAAGRKLLERGPKIVILKLGSRGALLVTADEVKHFTPFKVKVVDTVAAGDSFNGGFAVAFSQARPLHDCVRYGSAAGAIAVTRVGAGAAAPTAREVEELIGRA

SEQ ID NO: 46451 - protein, 135 aa, Ralstonia eutropha JMP134
MAKKWLNKVKWDDNGLVPVIVQEVGTNDVLMFAFMNRDALQKTAELGEAVFWSRSRKRLWHKGEESGHVQKVHEMRLDCDEDVVLLKVTQVDNIACHTGRHSCFFQKFEGDAESGDWQTVEPVLKDPSQIYTAKP

SEQ ID NO: 46452 - protein, 257 aa, Brassica napus
MSSSREENVYMAKLAEQAERYEEMVEFMEKVAKSVDVEELSVEERNLLSVAYKNVIGARRASWRIISSIEQKEESKGNEDHVAIIKDYRGKIEAELSKICDGILNVLEAHLIPSASPAEFKVFLLKMKGDYHRYLAEFKAGNERKDAAESTLVAYKSAQDIATAELAPTHPIRLGLALNFSVFYYEILNSPDRACSLAKQAFDEAIAELDTLGEESYKDSTLIMQLLRDNLTLWTSDMTDEAGDEIKETSKPEGAAE

SEQ ID NO: 46453 - protein, 266 aa, Shewanella sp. MR-4
MCILFVALNTHPQYPLIICANRDEFHHRPTAPAQFWPPEQNMLAGKDLQAGGTWFGVNKQGQIAGITNLRVAQKSQEPMRSRGELIIKALSSGSLICPNWLEEHAEDYQPFNLVFGQGTDLYCFNSLKRNTVKLTAGFHAISNGALDDIWPKMAKGQRSLEALIQQAGPLELESLIQLMQDDSRPQDNELPDTGVGLEWERRLAAIYIRHPDYGTRSTSILLQDAQGEIQFTEVRYDGKGRRLGQQDFHFTLPPQLPKEPDCLAHF

SEQ ID NO: 46454 - protein, 257 aa, Coccidioides immitis RS
MAAFDKCKTRPAHIDAILNGLDRYNPETTAVFQDYVVQQCEDRTFDCYANLALLKLYQFNPPLLNAETVTNILAKALTVFPSPAFSLSLALLPAYTQPYATSSTQATTANLPMQTADFVEAVQKLTHLSTLLESAQYTAFWSTLNSDDLYADLTADVAGFEELIRIRIAVEVGKAFREIGADVLMGWLDMRGMETLEKFVVDVCGWEVDKSKAEGENGVIVRVPRNKENEARGEVKGEKVGIEMFGRVVRRGFEQPA

SEQ ID NO: 46455 - protein, 703 aa, Oryza sativa (japonica cultivar-group)
MGSYAYKYCMCFTRKFRSPAADPPPDVRAAFLAAGGGDGGLRRFLAQAQGETPAEVDRILALLSGGGGGGGGGGIAARLVGPRPGPAPSLDDFFGFLFNADLNPPIATQVHQDMSAPFSHYYIYTGHNSYLTGNQLNSDSSDIPIIKALQRGVRVIELDMWPNSAKNNIDILHGGTLTAPVQIIKCLKSIKEYAFCASPYPLVITLEDHLTPDLQAKVAEMLVKTFGNLLYIPSSDPINEFPSPESLMKKIIISTKPPEEYKKFLKSKDNQNINGGLANLAEEGSLRRIDSNAEESDGKDELDDQDEDSSDEDDPKFQQETACEYRELITIHAGKPKGHLKDALKVDPDKVRRLSLSETQLAKATASHGADVIRFTQKNILRVYPKGTRINSSNYDPMNAWTHGAQMVAFNMQGHDKALRLMQGFFRANGGCGYVKKPDFLLRTGPNGEVFDPNASMPVKKTLKVKVYMGDGWRMDFSKTHFDTFSPPDFYTRVGIAGVRADCVMKKTRTIEDQWVPMWDEEFTFPLTVPELAVLRIEVHEYDMSEKHDFGGQTCLPVSELKQGIRAVPLHDRRGTREKLPYHMVVVLKSIPRGDLVEYFFCETSQPVTRESSLSILAYSFPGFEDVNVCYLKQPFQKILYHIQQNLGIETIKKCQIRNKSVSKIGTDTVSKDHPKNLVPFTEECLAVMEAFGEVSLLDIIDF

SEQ ID NO: 46456 - protein, 310 aa, Arabidopsis thaliana
MKQISSGEVWRWNKEVEMDSIRDCLKHCSSIAIDTEFPGCLKETPMDASEEIRYRDMKFNVDNTHLIQLGFTLFDRRGFAKTWEINLSDFDEHKCFKNDKSIAFLKSNGLNLDKIGEEGIGIDEFFRDFSQILTEKDGKITWVNFQGSYDNAYLVKGLTGGKPLPETKEEFHETVQQLLGKFVFDVKKIAESCSGLSSRFGLQRIADVLQMKRVGKAHHAGSDSELTARVFTKLTFDLLNSRKQCVRRVDHQQFQLEQQQHQQFMMTRCYIPIPMPIPRPRPVMFAAHHPNPYFGGGYFGMPVQGRNYVL

SEQ ID NO: 46457 - protein, 179 aa, Oryza sativa (japonica cultivar-group)
MAAAAASSSSSSAAATPQGVTERRGIPAASFVEDVETYLRQAGLDVNSGLAFLQERLQQYKIVEMKLLAQQRDLQAKIPDIEKCLDIVATLQAKKALGEALTADFELSEGIYSRAKIEDTDSVCLWLGANVMLEYSCDEANALLKKNLENAKASLEVLVADLQFLRDQQTITQIRLSED

SEQ ID NO: 46458 - protein, 369 aa, Nocardia farcinica IFM 10152
MTVSLPLVFDAPRRGMPPRHLADLDAEQRRAAVAELGLPKFRADQIARQYYGRLEADPARMTDLPAPVREQIGAALFPRLLDVVKHVACDDGRTRKTLWRAGDGTLLESVLMRYADRNTLCISSQAGCGMACPFCATGQGGLNRNLSTAEIVDQVRAAAAALRDGAVAGGPGRLSNIVFMGMGEPLANYKRVVAAVRRITAPAPDGLGISQRNVVVSTVGLAPAIRKLADEGLSVTLAVSLHTPDDELRDTLVPVNNRWPVAEVLDAARYYADTTGRRVSVEYALIRDINDQPWRADMLGAKLHKALGSRVHVNVIPLNPTPGSKWDASPKPVEREFVRRVNEQGVPCTVRDTRGQEIAAACGQLAAEN

SEQ ID NO: 46459 - protein, 350 aa, Rhodococcus sp. RHA1
MVLVGGQGTRLRPLTLSAPKPMLPTAGLPFLQHLLARIGAAGIRHVVLGTSFKAEVFEEYFGDGSKLGLEIDYVTETEPLGTGGGIRNVLPKLRGDHAMVFNGDVLGGTDLGAILDTHRNRDADVTLHLVRVGDPRAFGCVPTDADGRVTAFLEKTQDPPTDQINAGCYVFKREIIERIPEGRPVSVEREVFPSLLAEDARIYGHVDSSYWRDMGTPEDFVRGSADLVRGIAPSPALDGPRGESLVHPGAGVAPGALLIGGTVVGRGAEVGAGARLDGAVLFDGAVVEAGATVERSIIGFGARIGPRALVRDAVIGDGADIGARCELLRGARVWPGVTLPDGGVRFSTDV

SEQ ID NO: 46460 - protein, 246 aa, Glycine max
QIRSPPQRRNDAQNDYFSVVSQGIGKLSFVAASAANVVQVGTKEFTSKVKEGGYDHKVNETVNVVTQKTSEIGQRTWGIMKGVMAMASQKIEEYTKDDPNWKNDNWQRNENDTNGYYQDFNREKKGWNSSTGREQSSSGEYKTESSSSWDDWDHKDSRKEEPAKGSTHSSGGQFSTYNSSSWDDWEHKDSRKEEPAKGSAPHNNDDWAGWDNAKDDGFDNIYEGANKKGVGHKGKSDGTWTEEGFL

SEQ ID NO: 46461 - protein, 213 aa, Ostreococcus tauri
MQAAVAKNMLPSLSVPVSRIAMSICTDEFDKLYASLKPKGVTMTALLTKAIGVALAQHPIMYSTYHDGKGIEYNDKVNIACAVALEDGLITPVLRDCANTDVYQIGRDWSGLVKKARGSGLSPADYAGGNFTVSNLGMFGVDQFDAILPPNQSCILAVGSSKKTVVPVGGMIGVKSFMTVNIVADHRHINGNVAADFGKTLRDVIENPASLTM

SEQ ID NO: 46462 - protein, 353 aa, Bacteroides thetaiotaomicron VPI-5482
MDFKIAVLAGDGIGPEISVQGVDVMSAVCEKFGHKVSYEYAICGADAIDKVGDPFPEETYEVCKNADAVLFSAVGDPKFDNDPTAKVRPEQGLLAMRKKLGLFANIRPVQTFKCLIHKSPLRAELVENADFICIRELTGGMYFGEKYQDNDKAYDTNYYTRPEIERILKVAFEYAMKRRKHLTVVDKANVLASSRLWRQIAQEMAPNYPEVTTDYMFVDNAAMKMIQEPAFFDVMVTENTFGDILTDEGSVISGSMGLLPSASTGESTPVFEPIHGSWPQAKGLNIANPLAQILSVAMLFEYFDCKEEGALIRKAVDASLDENVRTPEIQVADGAKYGTKEVGQWIVDYIKKA

SEQ ID NO: 46463 - protein, 121 aa, Zea mays
  misc_feature (17)..(17): Xaa can be any naturally occurring amino acid
QVLAATQMPEEPAGWFXGYSHKSIDNIVILSGDQLYRMNYMELVQKHVEDDADITISCAPVDESRASKNGLVKIDHTGRVLQFFEKPKGADLNSMRVETNFLSYAIDDAQKYPYLASMGIY

SEQ ID NO: 46464 - protein, 189 aa, Triticum aestivum
MKLSYLLLAALFAAAYASSERAIAVAGAGGRGSLLSDPEQQCVYTVYVRTGSIWKGGTDSAIGVTLLGSDGTGVRIADLEQWGGMMGAGHDYYERGNLDIFSGRGPCMERAPCWANVTSDGAGAHHGWYCNYVEVTATGPHMGCAQQLFTVEQWLATDASPYRLYAAVDNCGDKQAAAKGQEARASTAL

SEQ ID NO: 46465 - protein, 502 aa, Methanosarcina barkeri str. Fusaro
MKCINSLRMKAIDRNCECLGLLPVQLMENAGAIIAQHIREKLESGRVLFLAGRGNNGGDAFVAARHLAGSSGYTVKVMLLGKARDIRTKEALHNFSLLKFSRVDVLEITDSSQLEASASEAFQEADLLVDAVFGTGIRGKLRELESMAIDFINREGEAGKTIISIDIPSGLDPDGGDFEKTVHAGLTVTFHHMKTGLLSEKAKEYTGIIKVADIGICADAEQYVGPGDLMMLHRRESGEHKGDSGKILVIGGGPYSGAPALASLAALKAGADLVTVAVPAPVAEIVASYSPNLIVRKLSSNILCPEDLSILMDPINSHDVVVMGMGLGRATETLEAVRKILPFCRKAVLDADALSALSGAIFESLAGNCELIVTPHAGEFTRLRNLETPESLESRIKAVREFSEEKGVVTLLKGKIDITSDGKQTLLNRTGNPGMTVGGTGDVLAGLTGSLFSRNPAFLAAACAVHINGSAGDLAFEKAGNGLLATDVLEKIPEIIKAAEIG

SEQ ID NO: 46466 - protein, 416 aa, uncultured marine gamma proteobacterium EBAC31A08
MKKNAFYAQSGGVTAVINATAGALILEAKKHKDIGKIYAGKNGILGALNEELIDTSKESISALESLKYRPGGAFGSCRFKLKDLESSEREYKRLIDVFKAHNIGYFFYNGGNDSADTAFKVSQISKKLNYPINCIAIPKTVDNDLVLTDCCPGFGSAAKYIATSTLEASLDVRSMAATSTKVFILEVMGRHAGWMAAASSLARKEKGDAPHIILLPEITFNQKKFLAEVKSVVKKNGYCVVVVSEGLKNNKNRFLSESATIDAFGHAQLGGVAPYIANLITDKLKLKNHWAVSDYLQRSARHIASKTDLEQAMAVGAKAVQYAVEGMNGVMPIIVRGKAKKYRWKIEPAPLAKIANLEKKLPKSFIAKNGMDVTPKAIAYLMPLIQGESFPNFRNGIPEIKELKLKEVKKKLKLWL

SEQ ID NO: 46467 - protein, 195 aa, Ralstonia eutropha JMP134
MRVAEVTRNTSETQIRVSLNLDGTGRQKLASGVPFLDHMLDQIARHGMFDLEVEATGDTHIDDHHTVEDVGITLGQAVAKAIGDKKGITRYGHSYVPLDECLSRVVIDFSGRPGLEFHVPFTRARVGSFDVDLTIEFFRGFVNHAGVTLHIDNLRGINAHHQCETVFKAFGRALRMAVELDPRAANTIPSTKGTL

SEQ ID NO: 46468 - protein, 665 aa, Geobacter metallireducens GS-15
MCGITGFMDFSLQCGPDAMRANARRMADALMHRGPDDSGAWCDQGAGVGLAHRRLSILDLTPAGHQPMESRSGRFTIVFNGEIYNHQALRKELAAFEPWRGHSDTETLLAGFEAWGIEATLKRTVGMFALAVWDNAERTLTLARDRMGEKPLYYGWNQGVFLFASELKALRAYPGFDAEINRDAIALLMRHSCIPTPHSIYRGIYKLWPGTILTLRNTGRGIAPWDAADPPFKLFQGEGVSLRPYWSLLEAAEQGHARPFEGTESEAIGELERVLTEAVLAQQISDVPLGAFLSGGVDSTAIVALMQAHSSRPVKTFTIGFHEDDCNEAKYAGEIASRLGTDHTELYVSPGDSLAVIPRLPQLYDEPFSDPSHIPTFLVSLLAREHVTVSLSGDGGDELFGGYVRHTLLHRIWNNIGWCPLPMRKALSDKIRFLSPGQLQAVLRNLPFIDRVHAPVYKAYRLAELIRADSPASMYEICISHWQQDDPVVVGGQSPFHASSGRMPRQLDSFSLPEKIMLMDSVTYLPDDILVKIDRAAMGVSLETRVPFLDHRVVEFAWRLPLGLKIRGGQSKWILRQVLNRHIPKELVERPKHGFGIPLGTWLRGPLREWAEELLNESRLLREGFLDPRPVRQKWLEHVSGRRDWEFHLWDVLMFQSWLEQERRP

SEQ ID NO: 46469 - protein, 117 aa, Glycine max
MMEDPTTLLNSEYSRLFGEDTDLYNRIVLGALLPHSVWGPLPRFLQTWLRNYLGGVLLYLLSGLLWCFYIYYWKRNVHVPKGDDLRFESRLKEVLIIFCVCSVSNMIVFKRGYLWGN

SEQ ID NO: 46470 - protein, 475 aa, Helicobacter pylori J99
MEHQNTTQKQGELKRDMKMRHLLMIAFGGAIGTGLFVGTGGNIASAGPLGTLIAYCFGGLVVYCIMLSLGELASVYPTTGSFGDYAAKFIGPGTGYMVFWMYWLGWVITVALEYIAIGMLMQRWFVNIPIHYWVISCIALVFLLNFFSVKIFAEGEFFFSLIKVLAVIAFISIGVIGIIYQIYLHGFSSIFDNFHFGDKGFFPNGSEAVFSAMLAVIFAFTGTEVIGVAVGETKNASEVMPKAIKATLWRIVFFFLGSVFVISVFLPMSDSSIAQSPFVSVLERINLPFIGMGIPYVADIMNAVIITAMFSTANSGLYGASRMIYGLSKQKMFFKVFSQLNRQGTPTYAMFFSLSFSLIGLLVQIYAKENVVEALINVISFTVIIVWVSVSISQYSFRKQYLKAGHSLEDLPYKAPFLPFLQLIGITGCIIGVIGSAMDKDQRIGMILTIVFAVVCYIGYYFTQKANENNKKDLI

SEQ ID NO: 46471 - protein, 300 aa, Helicobacter pylori J99
MQFHSSSALITPFKKDLSVDEAAYETLIKRQIFQGMDACVPVGTTGESATLTHKEHMRCIEIAIETCKSTKTPSNSRMKVLAGVGSNATSESLSLAKFAQKIGADAILCVSPYYNRPTQQGLFEHYKTIAQSVEIPVMLYDVPSRTGVSIEVPTALKLFREVPNIKAIKEASGSLKRVTELHYYEKDFKIFSGEDSLNHSIMFSGGCGVISVTGNLMPNLISQMVNCALKFEYQQALEIQNKLFDLHQALFVETNPIPIKMAMHLAGLIENPSYRLPLVAPSKETIKLLEKTLQQYEVIA

SEQ ID NO: 46472 - protein, 520 aa, Coccidioides immitis RS
MTKVDQKVALIVIDGWGVPGPQSPPEGDAIAAAETPVMSSFADPKAKTAQGYTELDASSLAVGLPEGLMGNSEVGHLNIGAGRVVWQDVVRIDQTLKKGELNKVQSIVNTFNRAKTGNGRLHLLGLVSDGGVHSHINHLVGLLKVAKEMEIPKVFIHFFGDGRDTDPKSGAGYMQQLLDSMKEVGIGELATVVGRYFAMDRDKRWDRIEVAMKGIVLGDGEASDDAVKAINERYEKGETDEFLKPIIFGGDERRVKDDDTLFFFNYRSDRVREITQLLGDYDRSPKPDFPYPKNIAITTMTQYKTDYTFPIAFPPQHMGNVLAEWLSVKGLKQCHIAETEKYAHVTFFFNGGIEKQFEGEDRDLIPSPRVATYDLDPKMSAAPVGEKMAERIAEKKYDLVMNNFAPPDMVGHTGVYEAAIQGVAATDKAIGRIFESCKENGYILFITADHGNAEEMKNGDGSPKTSHTTNKVPFVMANAPEGWSLKEKDGILGDVAPTILDAMGIEQPKEMSGSSLLIRN

SEQ ID NO: 46473 - protein, 490 aa, Lactuca sativa
MAMAGLYRRVLPSPPAIDFASIEGKQLFLEAIQNGTMEGFFKLISYFQTQSEPAYCGLASLSMVLNALAIDPGRKWKGPWRWFDESMLDCCEPLEKVKAKGISFGKVVCLAHCAGAKVEAFRTNQSNIDEFRKHVIACSTSDDCHVISSYNRATFKQTGSGHFSPIGSYHAGRDMALILDVARFKYPPHWVPVPLLWEAMDTLDDASGFRRGFMLISRLQRPPALLYTLSCKHESWVNIAKYLMEDVLVLLGSRNVKDVKDVLSVVFNSLPSKFLEFIKWVAEVRRTEEGDQSLSPEEQERLAIKGEILKQVQESELYRHVTEFLLSEKSGCNGPLCLGKESSLSDIAASVCCQGAGILEGKRESSSNGFCCGETKVHCLKSNEGEMGVTVVSGKVMNGMSEQHVDMLIPSIGMHPASNDVLTTLLLALPPHTWSGIKDEALLHQINGLVSTETLPILLQEEIMHLRGQLHVLKRCKDDEVEEDLSAPSV

SEQ ID NO: 46474 - protein, 476 aa, Gonyaulax polyedra
QSTPHAPMSAHSWAADVLSGGPPRAPSTAGAGCEVPRESCCESSDSKGCPCLEASVAFRRAWQAAQARPADAAAAPQAAAVAERVERCGSSEASYGLGRCPSTANLQGLCLPRPVGPSLARESDTVAHSELLCDSLLQAHEPAEVEHQDAAAAGPAKSTRPNSRAPLGEITNTRVATAAGDEPKHAKPCPPTPPDHDPQLVKEYTSDVMRSMLQREEHFMPRPNYMQDQPQINAKMRSILNDWLFEVHRLYGLRRETLFLTVSITDRYLSHVPVSRQRLQLVGVSALLIAAKFEEIEPPELADLVYVTADSYTKQEIVDTEMAMLSVLSFEVAAPTAANFMRHFQAHGRILAALHFESQHPELAHAGGLPPPAVGACDEARGDLAWYLLELALLDIRAVRHAPSHLAAAALLLANRLSGQRPAWPASLARLSGYVEKELEACACELGQLLEAARRAFLQAMRSKYRHTEMLYRHPA

SEQ ID NO: 46475 - protein, 471 aa, Burkholderia vietnamiensis G4
MSKTVADVMQLVKDEDVKFVDFRFTDTRGKEQHVSVPVSAFDEDKFESGHAFDGSSIAGWKGIEASDMLLMPDPTAAFIDPFYEESTLVMTCDVVEPADGKGYERDPRSLAKRGEAYLKSTGLGDTAYFGPEPEFFIFDSVQWNTDMSGCFVKINSEEAPWSAGKEFEGGNTGHRPGTKGGYFPVAPVDTFQDMRSEMCLLLEQLGIPVEVHHHEVAGQGQNEIGTKFSTLVQRADWTQWSKYIIHNVAHSYGKTATFMPKPVVGDNGSGMHVHQSIWKDGQNLFAGNGYAGLSEFALFYIGGIIKHARALNAITNPTTNSYKRLVPHFEAPVKLAYSARNRSASIRIPHVSNPKGRRIETRFPDPMANPYLCFTALMMAGLDGVQNKIHPGEAADKNLYDLPPEEDAKIPTVCAGLDQALEALDKDREFLTRGGVFTDGMIDAYLALKEQELAKFRMTTHPIEFEMYYSL

SEQ ID NO: 46476 - protein, 364 aa, Arabidopsis thaliana
MAKNSVEFDRYIERKAFDNTKEGVKGLIDAKITEIPRIFHVPQDTLPDKKRSVSDLEIPTIDFASVNVDTPSREAIVEKVKYAVENWGFFQVINHGVPLNVLEEIKDGVRRFHEEEDPEVKKSYYSLDFTKNKFAYSSNFDLYSSSPSLTWRDSISCYMAPDPPTPEELPETCRDAMIEYSKHVLSLGDLLFELLSEALGLKSEILKSMDCLKSLLMICHYYPPCPQPDLTLGISKHSDNSFLTVLLQDNIGGLQILHQDSWVDVSPLPGALVVNVGDFLQLITNDKFISVEHRVLANTRGPRISVASFFSSSIRENSTVYGPMKELVSEENPPKYRDTTLREYSEGYFKKGLDGTSHLSNFRI

SEQ ID NO: 46477 - protein, 753 aa, Arabidopsis thaliana
MIETGGDKQSSVEEGCGGRTILVGVKLDAPSRELLTWALVKVAEPGDTVIALHILGNEIVDRAGNSSLLSLVRTFDSVLDVYEGFCNLKQVDLKLKLCRGSSARKILVREAKSFSATKVLVGISKSHHAIRSSASVAKYIAKKLSKDCWVIAVNNGKILFQKEGSPSSTINQSQGKEDVRRITLLNVLQRSVTLNKTTKVVSHSEEDSNSKEEEEDQACGQNLRQVLAAARLENCSVCGFDSLSPNDTTTPGKLSGASDFDRSEDDDECNKAMEIVPVNGSEDSGGSVTMLVRKLPEPRPGWPLLRRAVSTLGQSVTPHKIPVVQWALKLPPRDTKQLGYDSSEDNLSTLNALVPFGINSITNKSIPDNSPRKLPEELEGLYERFSSTCRFFKYKELVSVTSNFSADNFIGKGGSSRVFRGCLSNGRVVAVKILKQTEDVLNDFVAEIEIITTLHHKNIISLLGFCFEDHNLLLVYNYLSRGSLEENLHGNKKDPLAFCWSERYKVAVGVAEALDYLHNTASQPVIHRDVKSSNILLSDDFEPQLSDFGLARWASISTTHIICSDVAGTFGYLAPEYFMYGKVNDKIDVYAFGVVLLELLSGRKPISSGCPKGQESLVMWAKPILDDGKYSQLLDPSLRDNNNNNDDQMQRMALAATLCIRRSPQARPKMSIVLKLLKGDEDTLEWAMQQVNSSSEESEMLKDEQCQRSNLQSHLNLALLDVEDDSISMGSIEQGVSVEDYLKGRTSRSSSFD

SEQ ID NO: 46478 - protein, 337 aa, Haloarcula marismortui ATCC 43049
MSNTNRVYRLAKRPEGTPDHDTFELSEEEIPEPGPGEVLIKTLYLSVDPYMRDRMRDSESYEEPWDVGDALKGAVVGEVVESNGARFDEGDVVTGELEWAEYATAPGPVLTEVNPELAPISTALGVLGMPGLTAYFGTREVAQPAAGDTFVVTGAAGAVGSVAGQLAKLQGARVVGFAGSDEKVSFLEDDLGFDVGINYKTTDDYRAALDEAAPDGVDAYFDNVGGPITDAVFTRLNTDARVAVCGQISLYNSEEIPMGPRKLTQVIQSRATVEGLLVSDFEPRFEEATKQLGQWVASGDISYRETVTEGIENAPDAFLGLFEGENIGKQLVQVAER

SEQ ID NO: 46479 - protein, 568 aa, Xanthomonas campestris pv. campestris str. 8004
MTHSVEDIKSTSRRLRGSLEQSLADPVTGALREDDQTLIKYHGSYQQDDRDIRDERRRQKLEPAYQFMIRTRTPGGVISPSQWLALDGIATRYANHSLRITTRQAFQFHGVIKRELKATMQAINATLIDTLAACGDVNRNVQVAANPLLSQAHATLYADAARVSEHLLPNTRAYYEIWLDEERVSGSGAEDEPIYGDRYLPRKFKIGFAAPPHNDVDVFANDLGFIAILREGQLLGYNVSIGGGMGASHGDAETWPRVANVIGFVTGDQLLDIATAVVTTQRDLGNRAVRKRARFKYTIDDHGLDTIVAEIERRAGFSLQPAQPFAFAHNGDRYGWVEGEQGDWHLTLSLPAGRIADTDTAAHLSGLRAIAQLQMGEFRMTPNQNLVIAGVPAEQRAQIDQLVAQYGLDAGNLAPTALARGAMACVALPTCGLAMAEAERYLPDFSAALQPLLERHGLAQTPIVLRLSGCPNGCSRPYLAEIALVGKAPGRYNLMLGGDRRGQRLNTLYRENINEADILAALEPLLARYAAERDRHTDEGFGDFLHRSGLIALPPYPTHRHLDLELLA

SEQ ID NO: 46480 - protein, 423 aa, Saccharophagus degradans 2-40
MSQAFENAQQYIPGGVNSPVRAFKAVGGEPVFIKRAKGAYLYDINDKRYVDYVLSWGPMILGHADDDVLAAVTEKLQYGLSFGAPTEIETELAKKICNIMPGMDKVRFVSSGTEATMSAIRLARGYTGRDKIIKFEGCYHGHSDSLLIKAGSGALTFGVPSSPGVPACLAEHTVTLTYNNIEQVKQAFAEIGDQIACVIVEPVAGNMNCIPPIAGFLETLREECTKAGSLLILDEVMTGFRLGITGAQGYYGVQPDITTLGKVMGGGMPVGAFGGSKEVMDYIAPTGPVYQAGTLSGNPVAMAAGLATVQKLENPDFYAPLFAKTKTLCEGIQTLAKEAGIPLTGNYVGTMWGLFFTEEEKVTNYQQVMACDIPRFNKFFHGLLEEGVYIAPASYEAGFLSAAHTDADIDFTLQAAKNVFARI

SEQ ID NO: 46481 - protein, 335 aa, uncultured marine gamma proteobacterium EBAC31A08
MFQTFALKIFFYMPIWLLKIIFYRKRTVIRGHQFDAQSAALLSLLPKKDLSELLDGEIAKARITLEEARIQNKVSLTPSIQVRKVDHILPKHDLILREYKPHQEDLKKVILYFHGGGYVLNSVNTHDDMVSYMSDKIGVKFYSLDYRLSPESKYPDSLDDALDAFSWLIGQGYGPGDISVCGDSAGAHLAASLCHYLAEQNKDLPSSQLLIYPMCDPSCSSESYNLLSSGYLLTKKTMIWFWDKLRTSEVNNNDSAFNLLKFNFEKTLPPTIIVTGGFDPLCDDGEKYAYLLHKGKHNVKQLHYPTMFHGFASMTKLKAAQIAVEDFLKEYKKIL

SEQ ID NO: 46482 - protein, 125 aa, Triticum aestivum
MAFWQARDFLFCGVCGTLLDFNSHRYASCPLCGFKRKAKDIEGKETRYAVTAEDIRRELKMKPFVVLESAPNMDIIVQRSLTERACPECNHHELEYYTKQLRSADEGQTIFYECPECGHAFNENT

SEQ ID NO: 46483 - protein, 129 aa, Brassica napus
TPESPRRVQIPQSSCSTPLFSSNSAAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 46484 - protein, 694 aa, Coccidioides immitis
MKLFIALAIALSLFLTDPGEAEEDTDGREEAARSLKDVDHVIIFMQENRSWNTYFGTMAGTRGFQDPNVQVNPDGLPVWFQKVDSDQSTDTKTLLPWHLGYLGGNWSEAIQCMAAGSNGYRANQAALNYGLNNQWVTDNTPWSWGYLKRDDIPVQFALAEEWTVADMYQQSQITSTNPNRVMLVSGSINAPGSPQSPDEGGVYLDNTETPGCEKPNVNCYPLKWKTIFELYEDAGVSWQVYQGEDNFDDNPLAWFEQYQNARPGTPLADKGMAFLGLDKFYKDAAKGTLPQISFIVGPRELSEHAPYSPKDGAWLQEKVVEAVTKSPKYGKSVLMISFDESGGWGDHVPPYHSPTDTPGEWIDDYLGVFGRIFTGPGFRVPFYIISPWTRGGRVLTEHSDHTSQILFIEEWLTAKGIENIKSPEVVPWRREHMSNLVNAFDFENARTQTILFRICLRHVELTLYFQPNLSLPNLPKAELPHRDESGNWDGSAYCESLYPETRPPVPYDSQPDRMPTDLVEEGYKECIGTLTEGRFLVFSTTEQSRLLLHSNPDDLTTTDATNADPDSDSDPDPDLDYNSLYRNSDARWVLHYYNNNSTSSTDVNTTAINQDPPYLLSSGNRRVWLGEEGKLVPRRDAVAIDIDFVRGEGEDKGRGYYIKYHDRDDGYISVNEDGGVRVGEEKTKFKVLSVTYHD

SEQ ID NO: 46485 - protein, 650 aa, Thermobifida fusca YX
MAGGRGSRGAPSVFPQHDRDFRMPTATTAHNTARRTDLRNIAIVAHVDHGKTTLVDAMLWQSGAFRANQDVDERVMDSGDLEREKGITILAKNTAVRYTTPAGENIVINIVDTPGHADFGGEVERGLSMVDGVLLLVDASEGPLPQTRFVLRKALAAQLPVILVINKVDRPDSRIAEVVDDTYELFLDLDATEEQIDFPIVYACAREGRASLTRPADGSLPDSDTLEPLFTTILDTIPAPAYTPGAPLQAHVTNLDASPFLGRLALCRVHQGEIRKGQQVAWIRTDGSIEHVKVTELFLTEALDRKPAEKAGPGDIIAIAGIPDIMIGETLADPADPRPLPPITVDEPAISMTIGTNTSPLVGRVKGAKVTARLVKERLDRELVGNVSLRVLPTDRPDTWEVQGRGELALAILVEQMRREGYELTVGKPQVVTKVIDGQVHEPVERLTVDIPEEYLGAVTQLLNIRKGRMETMTNHGTGWVRMDWTVPSRGLIGFRTEFLTETRGTGIAHHVFDGYAPWFGELRTRATGSLVADRSGKATAYAMFGLQERGTLFVEPGTEVYEGMVVGENSRADDIDVNITKERKVSNVRSSTAEELERLSPPRKLSLEEALEFCREDECVEVTPEAVRIRKVILDQKERARILAHRKRR

SEQ ID NO: 46486 - protein, 347 aa, Geobacillus kaustophilus HTA426
MKALLLAGGLGTRLRPLTENIPKPMAPIANRPWLEHLIVHLRDQGVNEFVIAAHHCSEVIRRYFEDGKRWNVKITYALEPFPLGTAGAIKNAERWLKERFLVFNADIVHLPQLIPLLDFHRQHGGLATIVLTEVDDPSSYGVVEQDDRGQILRFVEKPRREEAPSNRINAGMYIFEPDVMRYIPAEREVSIERETFPLLIEKNVGVYGIVSTGYWRDMGTPARYRQVHWDALSREFPIPLKGREIQPGVFVGENVEIGSGVLFVPPVLIGDHVKIGPQAVIGPNAVIGDRCQIGARVHCAQTIVWDRSVIRDRSRLQNSIFGYRTVTPAGEVFEDSIINQFKEAVQA

SEQ ID NO: 46487 - protein, 133 aa, Glycine max
SARGTISEPPRWLSFGNETEAKPGTCARQALSITLLENKMSRVYAAPPKERLKAFYNTPPSKYETIDQGRGLCFRVIRMGFEDIYLSSPGSLSEKYGKDYFICTGPASILVPVTVNPGEEWRGAQVIEHDNLT

SEQ ID NO: 46488 - protein, 118 aa, Shewanella oneidensis MR-1
MAEETIFSKIIRREIPADILYQDELVTAFRDISPKAPTHILIVPNHLIPTANDMKASDEPALGRMMTVAAKLATEAGIAKDGYRLIMNCNKHGGQEVYHIHIHLVGGEPLGPMLSQGQ

SEQ ID NO: 46489 - protein, 228 aa, Pseudomonas aurantiaca
MTLQIGFLLFPNVQQLDLTGPYDVLASLPDVQVHLVWKTREAVTASTGLVLQATTSFADCPQLDVICIPGGSGVGPLMEDAQTLDFIRRQAAQARYVTSVCTGSLVLGAAGLLRGKRATTHWAYHHLLEALGAIAVQERVVRDGNVLSGGGITAGIDFALTLVGELFDAATAQRVQLQLEYAPAPPFAAGSPQTAPKAVVEQARQLAANSIRQRGEIVERVVARWRQA

SEQ ID NO: 46490 - protein, 443 aa, Arabidopsis lyrata subsp. lyrata
MEFTEAYKQTGPCCFSPNSRYVAVANDYRLVIRDTFSFQVVQLFSCLDKISYIEWALDSEYILCGLYKKPMIQAWSLTQPEWTCKIDEGPAGISYARWSPDSRHILTTSEFQLRLTVWSLLNTACVHVQWPKHGSKGVAFNQDGKFAAICTRRDCKDYVNLLSCQSWEIMGSFAVDTLDLADLEWSPDDSSIVVWDSPLEYKAYECGLGVKTVSWSPCGQFLAIGSYDQMLRVLNHLTWKTFAEFLHLSTVRAPCSAAIFKEIDEPLQLDMSELSLDENFMPSNYDASEGYISVRYEVMELPVAFPFQKPPADKPNPKQGVGLLAWSKDSQYICTRNDSMPTALWIWDMRRLEVAAILVQKEPIRAAVWDPTCTRLLLCTGSSHLYMWTPSGAFCVCNPLPGFSISDLKWNIDGSCLLLKDKDAFCCATVPSLPESSDYSSDD

SEQ ID NO: 46491 - protein, 649 aa, Ostreococcus tauri
MALSHVAFSGRRASLDMCGIFAVLRLTGDARKNRRRVYDLAKRLRHRGPDSYGMEVRVDERSGAQTFMVHKRLSIVAPGKSGDQPLYTDASRKTTFIANGEIYNHAELREKYGIVSENKSDCQVIGHLYEQHGPGFVSELDGMFAFVIEDRENDVIVAARDHMGKIPMYMANGKDGSVWFSSEMKTLHDDPGVASYEIFPPGHVYVKKGDEPATIERWFNPQWIAEESYVPTTPADLPALRECVVDAVTKRLMADVPYAVLLSGGLDSSLITSIAVRQRKLAKNTYGADEPVHSFSIGIKGAPDLVAARKVAEQLGTIHHEVHFTPEEALDALPDVIWHLETFEQVRASVPMYLLSRHIKSLGFKMVLSGEGADELFGGYLYFHKAPNPTEFHAECRRKTMRLHQWDVLRANKSTMSWGIEVRTPLLSQQVIDMAMNMRPEDKMIDVNKKDADGHPFLEKYILRKAFDTPEDPYLPQEVLWRQKEQFSDGVGYDWVDGLAAHAELEVSDEMFAKRAERFPLHPPTTKEYYLLRSIFEEHFVTGFENGDCAYATCPFGKSIACSTPEAVSWDPEWEKSVGDISGRAVKNVHVAADKFDVKKEKANETVAASLVGRGKASCSSESAVTFASLACVRRLSRGFYFCRAPPCL

SEQ ID NO: 46492 - protein, 343 aa, Neisseria meningitidis FAM18
MGIKVAINGYGRIGRQVLRAIYDYQIQDQLQIVAVNASGSLETNAHLTKFDTVHGRFEADVSHDGGNLIVNGDKIPFFSTRNPAELPWKELGVDLVMECTGAFTSKEKAKIHLESGAKKVLISAPGGDDVDATVVYGVNDSVLTADMTVVSNASCTTNCLSPVAKVLSESVGIVKGAMTTIHALTNDQTVTDVRHKDLRRARSGVENMIPTKTGAAKAVGLVLPELKGRLDGLAIRVPTVNVSLVDLSFQAARDTTVEEINALMKAASEAGALKGVLGYNTLPLVSMDFNHTTEASHFDATLTKVVDGNMIKVFAWYDNEWGFSCQMLNTARRMFGLEVRPLK

SEQ ID NO: 46493 - protein, 63 aa, Glycine max
IKFGQTYYVPSSEPEFFTKRQCKIVTSDGKQVGYLGIVHAEVLRKFGIPDPCTFVEIDIEALL

SEQ ID NO: 46494 - protein, 466 aa, Debaryomyces hansenii CBS767
MADDKSQIKINFFTNEEDESLHTSDAPLYVPVSLKRYGLSEIVNHLLKKDGETDETKPVPFDFLIDGVLLRTSLEDYLVKNGLSSEASLNLEYTRAVLPPSFLASFNNDDWISSLDTINPLSALVKASNMSISQPKILSGSYDGIVRTYNMSGKVEKQYVGHSGPIRSVKWISPTRIVSSGNDRQVRLWKTSIDSNIEDDEEIEDGRTLAILEGHKAPVVSLAVEYQNNRILSAGYDKAIGFWSTNYREMTTIQPLEYDSNVISTSSKKRRKMALQDSTIRRRSPLSFLEGHSQPVEDVIFDFNDATVGYSVSQDHTIKTWDLVTSRCVDTRTTGYSLLSLLQLPSLNLLVCGSSARHINLFDPRVSSTTTEQTNNQKLIGHTNFVVGLSKCPTNDNMFASCSHDGTVKVWDVRSEKSLYTITREQNNAAKGQDKVFSVIWDNDIGIISGGQDKKIQINKGSDITK

SEQ ID NO: 46495 - protein, 415 aa, Candidatus Kuenenia stuttgartiensis
MAKAYLIVGSGPAGITAAERIRNLDSDAEIIVISEEKTPMFYRPRIPEYAVGKIGIEEIMVKKKGFYVQKKIQLHLGTRATKLDKKKRVVETSEKNIYGYDKLLIATGISPIEPKFPGSRLKGVFTMHDLIQAERLKVAVRDAKQVVVVGGGLLGMDMAEEFRTTGLHVVFLVRRNSLGDPFFDEYGCKLIRDEFKNMEVEVITNAEVQSLEGTNNQLASVLLTDGRRFDSNLCFIAIGATHAVDWLKDSGLKIENGVLVDRYLRSHDDDDAVFSAGNAAQIMDPVFEKHIVQTNWINAIAQGDIAGNNMAGGGLRKYETTSNYFKRVGDLFFNLIGTGNLRMKGGKRNYFKGKTPKEYVMVTTKEGRVVGAVVCGRHKITVKLKDSIEKQSDFSNMDKLIDQEEKSIEDLSKLF

SEQ ID NO: 46496 - protein, 496 aa, Xylella fastidiosa Dixon
MSAPFALYDTAAAAALDARLAAHLGDDGDLLMQRAGRAAWDLLRQRWPDARQVLVACGTGNNGGDGYVLACLAHRAGLQVQVVHLPGRGPASLLAQRAYDAYLAAGGQVMLFSGVLETADVLVDALFGIGLNRPLDVPTQGLINALNAAGRPVLALDVPSGVDAERGAVFGTPVCAHVTLQFMVPHVGLYTGPALEAVGERVLAALDVSPALRDALPPCAERWGPQRLASRFRPRRRNSHKGEFGRVLCVGGNWGSGGAIMLSAEAALRSGAGVVHVATREAHVAPLLARCPETMPRGVAGSAELMPLLAAADVVALGPGLGQDSWGQALLAASLDSGCALVIDADALNVLAAAPGSLPPGAILTPHPGEASRLLGCTTAQVQADRRAAAQALAARFAAVVVLKGAGSLIAAPGCLPCVIDAGNPGMAVAGMGDVLTGVIAALRAQGDSVFDAALFGALLHAAAGDLVARDGGERGLLPRDVLPVLRRLINPDSAP

SEQ ID NO: 46497 - protein, 529 aa, Debaryomyces hansenii CBS767
MVNPADVPIEVSKVFDTILVLDFGSQYSHLITRRLREFNVYAEMLPCTQKISELTWKPKGIILSGGPYSVYEDGSPHVDHDIFKLNVPILGICYGMQELAWINGKGVARGDKREYGPATLNVEDSSCSLFKGVDHSQVWMSHGDKLHALPTGFKVVATSDNSPFAAISNEKENIFGIQFHPEVTHTKQGKVLLRNFAIDICQASNNWTMENFIDTEIARIQKLVGPTAEVIGAVSGGVDSTVGAKIMKEAIGDRFHAIYVDNGLMRLNETEQVYKTLTEGLGINLTVVDATDLFLGKLQGVTDPEKKRKIIGNNFIHVFEAEAAKIKPASGQEIEYLLQGTLYPDVIESISFKGPSQTIKTHHNVGGLLEDMKLKLIEPLRELFKDEVRHLGEIMGVPHDLVWRHPFPGPGLAIRVLGEVTREQLKIAREADNIFIEEIRKAGLYKDISQAFAALLPVKSVGVMGDQRTYEQVIALRAIETTDFMTADWFVFEAAFLKKTASRIVNEVDGVARVTYDITSKPPATVEWE

SEQ ID NO: 46498 - protein, 359 aa, Aspergillus nidulans FGSC A4
MSSQTPTAQNLSFVLEGIHRVKFEDRPIPKLKSPHDVIVNVKYTGICGSDVHYWDHGAIGQFVVKEPMVLGHESSGIVTQIGSAVTSLKVGDHVAMEPGIPCRRCEPCKAGKYNLCEKMAFAATPPYDGTLAKYYTLPEDFCYKLPESISLPEGALMEPLGVAVHIVRQANVTPGQTVVVFGAGPVGLLCCAVAKAFGAIRIIAVDIQKPRLDFAKKFAATATFEPSKAPATENATRMIAENDLGRGADVAIDASGVEPSVHTGIHVLRPGGTYVQGGMGRSEMNFPIMAACTKELNIKGSFRYGSGDYKLAVQLVASGQINVKELITGIVKFEDAEQAFKDVKTGKGIKTLIAGPGAA

SEQ ID NO: 46499 - protein, 129 aa, Triticum aestivum
MAVSWTRVLKRGVIPRDTAQWVGTRGFAVAAKGKEGEKGGAADAKPVLSKEMKSTGVFGANILKEGSDPKIQPDSEYPGWLWHMIDKRPVLSELRRKDAKALPYEDQKRLIKLDNRTRIKENNALTGKN

SEQ ID NO: 46500 - protein, 519 aa, Saccharomyces cerevisiae
MLSRTRAAAPNSRIFTRSLLRLYSQAPLRVPITLPNGFTYEQPTGLFTNGEFVASKQKKTFDVINPSNEEKITTVYKAMEDDVDEAVAALKKLLKRSVYCRAGVRAKALFNLADLVEKHQETLAAIESMDNGKSLFCARGDVALVSKYLRSCGGWADKIYGNVIDTGKNHFTYSIKEPLGVCGQIIPWNFPLLMWSWKIGPALATGNTVVLKPAETTPLSALFASQLCQEAGIPAGVVNILPGSGRVVGERLSAHPDVKKIAFTGSTATGRHIMKVAADTVKKVTLELGGKSPNIVFADADLDKAVKNIAFGIFYNSGEVCCAGSRIYIQDTVYEEVLQKLKDYTESLKVGDPFDEEVFQGAQTSDKQLHKILDYVDVAKSEGARLVTGGARHGSKGYFVKPTVFADVKEDMRIVKEEVFGPIVTVSKFSTVDEVIAMANDSQYGLAAGIHTNDINKAVDVSKRVKAGTVWINTYNNFHQNVPFGGFGQSGIGREMGEAALSNYTQTKSVRIAIDKPIR

SEQ ID NO: 46501 - protein, 176 aa, Triticum aestivum
  misc_feature (163)..(163): Xaa can be any naturally occurring amino acid
  misc_feature (170)..(170): Xaa can be any naturally occurring amino acid
MGPTLMASSATSVAPFQGLKSTAGLPVSRRSNGASLGSVSNGGRIRCMQVWPIEGMGGWGSLSYLPPLTHKTLLKQVDYLIRSKWVPCLEFSKVGFIFREHNASPGYYDGRYWTMWKLPMFGCTDATQVINEVEEVNKEYPDAYVRIIGFDNMRQVQCVSFIXAFKPPGXEESGKA

SEQ ID NO: 46502 - protein, 470 aa, Medicago truncatula
MNMMRRLKSIASGRTSVSSDPGGDSTTKRAKFDLETEGKENEETNRGERGGNNQDKYVDAVEETSSSCNSNVSAVAKTEKSGFDQLPKELHEMKIKDDKSKNNNEKDMEATVVNGNGTETGQIITTSIGGRDGQPKRIISYMAERVVGTGSFGVVYQAKCVETGESVAIKKVLQDKRYKNRELQVMRMLEHTNVLKLKHCFYSTAEKDEVYLNLVLEFVPETVYRVSKHYVRMHQHMPIIYVQLYTYQICRGLNYLHHVVGVCHRDIKPQNLLVNPACHQLKICDFGSAKMLLPGEPNISYICSRYYRAPELIFGATEYTTAIDVWSAGCVLAELLLGQPLFPGESGVDQLVEIIKILGTPTREEIKCMNPNYSEFKFPQIKAHPWHKIFHKSMPSEAVDLVSRMLQYSPNLRCTALDACAHSFFDDLRDPNARLPNGQELPPLFDFTAQELAGAPDELRRRLIPEHARS

SEQ ID NO: 46503 - protein, 943 aa, Medicago truncatula
MSTVELFSNLCKELRNWRCEQGIRYIIIPVRSEVLKISIVGKNICEFVRDVWREPDKISTVNKTDICLIPKINQPEFVSQFRPISLCNTIYKIVSKVVVGRLKEYIPHIVSPHQTGFVPGRSIHENIVVAQELAHSMNRMRGRTGYFVIKVDLAKAYDMLNWDFIWRTLKEIGFPDVLIDLIMHGVTSVETNVKWNGARTEYFRPQRGIRQGDPISPYLFVLCMDKLSHLITHEVNQGRWKALRAGRRGPVISHLMFADDLLLYGEATTSQMKCVTDTLKTFCDLSGQQVSQEKTSMLFSKNVHRGVRQQLLLLCGFKETSFLGKYLGVPLLGRAPKRADFQYVIDQVNGKLAAWKTNQLSFAGRVTLAKSVIEAVPIYPMMTNIIPKACIDEIHKIQRQFIWGDNENNKRYHVVSWETVSKPKVFGGLGLRRLNVMNKACIMKLGWSIYSGSTSLWAEVMRGKYQRSDIPAELFIAKPSDSSLWKALVKLWPALERNIFWSIGDGKSVGAWIQMWIEERLCVSELEIDIPQQCKEMKVADLVDFNGNWNFELLNQWLPYDVVQRIMTIAVPDENDGNDKQMWSGSSNGKFTIASAYHMLSKFDNDAQDEIWLKLWKIRAPERIKHFMWMLYHGRLLTNLRKHKMGIGNPMCRFCHDEIEAEIHVLRDCPKATALWLCVVDNAARTSFFEGDLSNWINFNLFTNVYWNHNVEWRDFWATACHAIWNWRNKETHNDNYQRPLHAKNIIMSYVNDYHNAIAKSVIVTSQLRHLEEVGWKEPPIGWVKINTDGACKDGSIAGCGGLIRGSQGEWLAGFSKFLGKCDAFIAELWGVLEGLRCAKRMGFTAVELNVDSLVVVNIITSGKESNARGRSLVQKIRKLLQMEWEVKVKHSYREANRCADALANIGCIMENEMMFYESCPTQINHLLAADQAGVTFPRLIKM

SEQ ID NO: 46504 - protein, 511 aa, Glycine max
ERARMASFVGAMAIADLVKTTLGPKGMDKILQSTGRGREVTVTNDGATILKSLHIDNPAAKVLVDISKVQDDEVGDGTTSVVVLAGELLREAEKLVATKIHPMTIISGFRMAAECARNALLEKVVDNKADSEKFRSDLLNIAMTTLSSKILSQDKEHFAKLAVDAVMRLKGSTNLESIQIIKKPGGSLMDSFLDEGFILDKKIGIGQPKRIENAKILVANTAMDTDKVKIYGARVRVDSMARVAQIETAEKEKMREKVQKIIGHGINCFVNRQLIYNFPEELFADAGILAIEHADFDGIERLALVTGGEIASTFDNPESVKLGHCDLIEEIMIGEDKLIHFSGVAMGQACTIVLRGASHHVLDEAERSLHDALCVLSQTVNDSRVLLGGGWPEMVMAKEVDALAKKTPGKKSLAIEAFSRALLAIPTIIADNAGLDSAELISQLRAEHQKEGCTAGIDVISGSVGDMAERGICEAFKVKQAVLLSSTEAAEMILRVDEIITCAPRRREDRM

SEQ ID NO: 46505 - protein, 404 aa, Triticum aestivum
  misc_feature (13)..(13): Xaa can be any naturally occurring amino acid
  misc_feature (34)..(34): Xaa can be any naturally occurring amino acid
  misc_feature (67)..(67): Xaa can be any naturally occurring amino acid
MLSVSSPRMHMSXRNAVDLGLLAACRCRRWAARXAPRRRAPCVCFVAAPSQTGLAAIDVPAAETIRXARRPGTARLPERVSIASLLDVVSDDLLKLNNNLKSLIGAENPVLVSAAEQIFGAGGKRLRPALVFLVSRATAEVAGLSELTTEHKRLAEIIEMIHTASLIHDDVIDDSGMRRGKETIHQLYGTRIAVLAGDFMFAQSSWFLANLENIEVIKLISQVIKDFASGEIKQQSTLFDCDVTLDDYLLKSYYKTASLLASSTRSAAIFSGVSTAVCEQMYEYGRNLGLSFQVVDDILDFTQSAEQLGKPAGSDLAKGNLTAPVIFALQESPELREIIDSEFCDTGSLSAAMELVHRSGGIRRAQELAKEKGDLALQNLQCLPRSHFRTALENMVKYNLERID

SEQ ID NO: 46506 - protein, 443 aa, Boechera stricta
MEFTEAYKQTGPCCFSPNSRYVAVANDYRLVIRDTFSFQVVQLFSCLDKISYIEWALDSEYILCGLYKKPMIQAWSLTQPEWTCKIDEGPAGISYARWSPDSRHILTTSEFQLRLTVWSLLNTACVHVQWPKHGSKGVAFNQDGKFAAICTRRDCKDYVNLLSCQSWEIMGSFAVDTLDLADLEWSPDDSSIVVWDSPLEYKAYECGLGVKTVSWSPCGQFLAIGSYDQMLRVLNHLTWKTFAEFLHLSTVRAPCSAAIFKEIDEPLQLDMSELSLDENFMPSNYDASEGYISVRYEVMELPVAFPFQKPPADKPNPKQGVGLLAWSKDSQYICTRNDNMPTALWIWDMCHLEVAAILVQKEPIRAAVWDPTCTRLLLCTGSSHLYMWTPSGAFCVCNPLPGFSISDLKWNIDGSCLLLKDKDAFCCATVPSLPESSDYSSDD

SEQ ID NO: 46507 - protein, 792 aa, Xylella fastidiosa Dixon
MKFSENWLRNHVPIQANRDVLVATLTAIGLEVENVAVLGEALDLIVVARIVNVVPHPESDLLQICQVDVAQDNLLQIVCGASNVRPGLVVPLALLGAKIGALTIKSTTLRGVESNGMLCSAKELGLDTEASGLMELPEDAPIGTPLADYLALPDASIEIKLTPNRADCFSVRGIAFDVAAACASEVTPFHIDEIPAVSARTLPVELHAGANAPRYCGCVIEGIDSAAPTPVWMAERLRRSGIRPVSLLVDITQYVMLELGQPMHAFDVDTLRGPIGVRLSRNDEALKLLDGRTVVLDNDFLVVTDADQPIALAGLIGGWETRITDTTVNVFLEAAHFAPAAIMGRGRKLGLHTDASHRFERGVDPALPPQAIAFATRLILELAGGKPGSLIHVELPEYLPAPASILLRRTRIARLLGIVIDDAEVERILQALGMQVTTQAEGWRVVAPSRRFDIAIEEDLIEELVRIRGYEHLPTALPVGASHIAMPSETRLDMTSVRRQLIARELQETINYAFIDAELLRRWQLNTGQVMLMNPLSAELAVMRPRLLPGLVAALGRNIARQLERVRLFELGNVFTASDEAGAAPLETRHVAAAVCGDAFALQWGEQVRKVDFYDLKGDLESLAAASGAVLTFHSSAQPWGHPGRSADVWCDDMCIGWIGQLHPALTQTLEINVDVIAFELALEPLVRRALPRAHALSRFPFVRRDLACVVPEHVTWSELAITVRDVIGPLLRDVKLFDRYVGKGIEPGFKSLAIGLILQDDTRTLIDRDVDDIMTKVVMAIQQRHDVRIRS

SEQ ID NO: 46508 - protein, 292 aa, Oryza sativa (japonica cultivar-group)
MAAAHGGGNVKQSGSSFLDSGGGGGGAMLQQESSSSTGTGGGGQDFLRPMGLAAGSSSYSSMLGLSSRMYGGGGTATMDVPWGSSNAGAARSLSDLISFGGGAMDKPPPPPPSSAPARTSSADYKKQQGQQEISSPVKTSSSGGGGKEGKKKRSEEAAGSEGSTKKSKHEATSPTSSLKVPKVKLGDKITALQQIVSPFGKTDTASVLYEAINYIKWLHEQVQLLSDPYMKSSSSKDYNAWGGLDRKEKADAEVDLRSRGLCLVPVSCTPQVYRDNNGPDYWTPPYRSCLYR

SEQ ID NO: 46509 - protein, 832 aa, Oryza sativa (japonica cultivar-group)
MSQASLSPSSSGDEEEEDEGVEGYRKGGYHAVRPGDPVRRRPLRRPAEARVGELLHRLARLRRPHPGFDLVCHFLLRGNSLIRYWKMLDKFFWLVMAGSFKCCDKKFVALKIQKSAPEFAQAAFHEIEFLSEITKRDPSNCKCIIQLIDHFKHAGPNGQHICLVFEFLGDSLLKLVQYNRYNGIGFGPVREICRSILIGLDYLHRELGIIHSDLKLENILLISTIDPSKDPIRSGLKPNLERPEGNPNGEVMLNPIEKKLKMRARRVLAKLAEKKKSAAEYARAERSLDGIDMTCKIVDFGNACWADKQFTDFIQTRQYRAPEVILGSGYSFPVDMWSFACIAFELATGEMLFTPKEGQGYSEDEDHLALMMEILGKIPKKIATMGTKSKEYFDRHGDLKRIRRLKFSSIERVLVDKYKISESDAREFAEFLCPLFDFAPEKRPTAAQCLQHKWLQYSDGKNYGTLNISDVKNASVTCSPGTTASSDSKSIDVTRNIGDKPDSYAERADAKCNTSKKSIINSNSENSNVQPNTASVGNRNSKIDDVNSNTGSITNKDSKNTVIKPSIGSFVNRNAETVDVKPNIGSITSRGDSSSDTKSNIGSVASKDAKTIDAKPSTSSITSQDSKIGDGRSNIDGIANRDAKTADVKHNIRSVVNTYLRNFDVKHNTGNIVDGGVKHSDLKPGTVSAANVDSKSISAKPSTGSFENSDAKSISAKTSTGSFDNSDARNIMKANTGIVANNDIKDTDVQTNTESVTSGDDLNDIDRKPNIGRVAASIQRLESSIGKVQSGKYRGCSGVSMGLVGVGRTQVPPAPTLDPPLMAFIPVLRKGY

SEQ ID NO: 46510 - protein, 377 aa, uncultured archaeon GZfos22D9
MEDIFRFADELGPAKVIHVYEPSVGLKAVLVVDNVARGPAIGGLRIAPDVSPEECFRLARAMTLKNAAADLPHGGGKSVIYGDPKMPTKEKEKLIRALASSLREIQEYIFAPDMGTDEECMAWVKDEIGRVVGLPSDFGGIPLDEIGATGWGLSHATEVALEYCDFDMEGAQVVVQGFGAVGKHTARFLTEKGAMLVGVADSRGTIYNPQGLDVLALIELKKAGKSVADYPDGKKLDRDAVINIECDIWIPAARPDVIDKNNVNLLKTKLVIEGANIPITEGAEKHLHEKGVLYVPDFIANAGGVICAAMEYQGADQSAAFHAIEEKLCRNTRLVLDEAASRGILPREAAVDLAVQRLKKSMSYRRWSLFSSAPGFV

SEQ ID NO: 46511 - protein, 294 aa, Nicotiana tabacum
MDQYEKVEKIGEGTYGVVYKARDRVTNETIALKKIRLEQEDEGVPSTAIREISLLKEMQHANIVRLQDVVHSEKRLYLVFEYLDLDLKKHMDSSPEFSKDPRLVKMFLYQILRGIAYCHSHRVLHRDLKPQNLLIDRRTNALKLADFGLARAFGIPVRTFTHEVVTLWYRAPEILLGTRHYSTPVDVWSVGCIFAEMVTQRPLFPGDSEIDELFKIFRVMGTPNEDTWPGVTTLPDFKSAFPKWPSKDLATIVPNLDGAGLDLLDKTSRLDPSKRITARNALEHEYFKDIGYVP

SEQ ID NO: 46512 - protein, 400 aa, Mycobacterium avium 104
MSELLESIQSRAEQGAITDAEIFAAHVGGKLSVSLTSPLDTQRALSIAYTPGVAQVSRAIAADHRQAAHYTWANRLVAVVSDGSAVLGLGDIGPAASLPVMEGKCALFQAYGGLNAIPIVLDTKDPDEIVETLVRLRPTFGAVNLEDISAPRCFEIERRLIEALDCPVMHDDQHGTAIVVLAALMGAGKLLGRDMSSLKVVVSGAGAAGVACTNLLMAMGVSDITVLDSRGILHAGRDDMNDVKAALARRTNPAGLTGSLAEAIRGADVFLGLSGGVVPEEMIAAMAPGGIVFALSNPDPEIHPQIAAKYATVVATGRSDFPNQINNVLAFPGVFRGALEAGARRITEKMMVAAAEAIFSVVSDDLAPDRIVPSPLDTRVGDAVATAVALATEVSDAPAG

SEQ ID NO: 46513 - protein, 117 aa, Oceanicola granulosus HTCC2516
MAFDPARLRYNADGLIPAIAQEAETGEVLMLAWMNAEAVARTLAEGRVVYWSRSRQAFWRKGDTSGHVQELVEMRFDCDEDALLLLVRQTGAACHTGRRTCFYRAVRDGEEVETEAL

SEQ ID NO: 46514 - protein, 225 aa, Glycine max
  misc_feature (138)..(138): Xaa can be any naturally occurring amino acid
MGSRVFALFITGVVLLGSRILALDHTVVEKRLNENTVSLTTKGSPQLCQLCEQFATETLFYLKENETRIEIIDTLHQACLKFHSLKLECTKLVDYYAALFFAQIDSLSPEEFCVSASLCEEVTYIRLPGHEHACTLCXHEVVDEIRTGLEDPEMELKIIEILLKGCNNTESFVQKCKKMIIQNAPLILEDIKKFLEKRDFCDSIRVCGGKIARPPGGGLRGLSTV

SEQ ID NO: 46515 - protein, 293 aa, Nicotiana tabacum
MDQYEKVEKIGEGTYGVVYKARDRVTNETIALKKIRLEQEDEGVPSTAIREISLLKEMQHANIVRLQDVVHSEKRLYLVFEYLDLDLKNTWITTPEFSEDPRLVKMFLYQILRGIAYCHSHRVLHRDLKPQNLLIDRRTNALKLADFGLARAFGIPVRTFTHEVVTLWYRAPEILLGSRHYSTPVDVWSVGCIFAEMVTQRPLFPGDSEIDELSRFRVMGTPNEDTWPGVTTLPDFKSAFPKWPSKDLATIVPNLDGAGLDLLDKIVRLDPSKRITARNALEHEYFKDIGYVP

SEQ ID NO: 46516 - protein, 314 aa, Zea mays
  misc_feature (257)..(257): Xaa can be any naturally occurring amino acid
  misc_feature (274)..(274): Xaa can be any naturally occurring amino acid
WTPAVRSGFFLNPRVRSEIDAASRRQGEMGKGAQGSDAAAAGGEVEENMAAWLVAKNTLKIMPFKLPPVGPYDVRVRMKAVGICGSDVHYLREMRIAHFVVKEPMVIGHECAGVVEEVGAGVTHLSVGDRVALEPGVSCWRCRHCKGGRYNLCEDMKFFATPPVHGSLANQVVHPADLCFKLPDGVSLEEGAMCEPLSVGVHACRRAVVGPETGVLVVGAGPIGLLSLLAARAFCAPRVVVVDVDDHRLSVARSLGXADAAVRVSPRPGDLADXVERIRAGWARKSRHLDCAGSANLSTGLERHPPPGRGPGRD

SEQ ID NO: 46517 - protein, 366 aa, Desulfovibrio vulgaris subsp. vulgaris str. Hildenborough
MSTPDSTTQTWTLPVGPLHVALEEPMYFKLDVDGEIVRNVEITAGHVHRGMEALAMRRNLFQNIVLTERVCSLCSNSHPFTYCMAVEHLAGIEVPARADHLRVVAEEIKRTASHLFNVAILAHIIGFKSLFMHVMEVREIMQDIKETVYGNRMDLAANCIGGVKYDVDAELLAMLLAGLDKVERNAREIYRIYASDPMVTGRTTGIGVLPPDEARRFGVVGPVARGSGLAVDVRRDVPYAAYPQLSFDVITEEGCDVRARALVRLREVFESISIIRQCVATLPEGAMTVIMPEIPAGQSVARSEAPRGELMYYLRTDGTDIPNRLKWRVPSYMNWDALGVMMRDANVADIPLIVNSIDPCISCTER

SEQ ID NO: 46518 - protein, 692 aa, Zea mays
MTTVAHHHHLAAATVLFFVAFTMAPLAAGDPVGQLCGTSGNYTLNSTYQGNIRRLAATLPKNTSTSATLFATDTFGAVPDIVYALALCRGDTNASACSGCVAAAFLDAQQLCAYNKDATMFYDPCLLRYSNQNFLADPSSDGRGTALILMNTQNVTARFKVFDAAVAALLNATAAYAAANSSKRFGTGVEAFRNFDTDRPLTYELAQCTPDMTPADCQSCLSGIIQTGPKYFSGKQGGRILSVRCNYRYEQYPFFTSTPLLQLAEPTVGAPAPAPAVVNGTPTPPTTGGARRGTTGNKTGRVLAITLPIVAAVLATIVLCSCLWRKRKTPGKSALPDTTNPEDIQSIDSLIIDVSTLRAATENFAEANKLGEGGFGSVYKGILPDDQEIAVKRLSQTSRQGMEELKNELVLVAKLQHKNLVRLVGVCLEDHEKLLVYEYMPNKSLDTILFNHERCGELDWGKRFKIVNGIARGLQYLHEDSQVKIIHRDLKASNVLLDNDFNPKISDFGLARLFGSEQSRDVTNRVVGTYGYMAPEYAMRGHYSVKSDVFSFGVLILEIVTGRRNGGSYSSEESADLLSLVWEHWTTGTLVEIMDPSLSSLAPRDLMLKCIHIGLLCVQDDHEDRPMMSTVNVMLSSSTVTLQAPSRPAFCFPKSGFNSEINSEVYPPGAYQSASRSPMSLNDVSITELEPR

SEQ ID NO: 46519 - protein, 218 aa, Enterococcus faecalis V583
MKKFDGVIFDMDGLLFDTELIYYTSTQKVADAMGLPYSKEVYLDYVGISDEEVQENYRRIYASYGHDTVEEFIRRSYDDTLQEFRSGNVPLKPGVVEFLDFLDDQKIPRLVASSNVRPAIEMLLSHAGIQDRFVGIVSAEDVKRAKPDPEIFQKARQLLGTEAPKTLIFEDSFHGVSAAHSAGIPVIMVPDLLQPTEVIQEKTLHVLESLHQAPHYLK

SEQ ID NO: 46520 - protein, 237 aa, Thermobifida fusca YX
MGLRTTESEWATPRAALFDLDGTLINSEPRSVAVWARVLQDRGVEPDEALLCKFMGRRGEDVINELAHLFPGESVEDIFADRWRYGQDPDLPPVEQLPESVAFLKYLHAQGVPFALVTSAGRQWAESTLEWLGVRDMFRGIISADDVTVGKPHPEGYLSGAELVGYGPEHIVVFEDTPAGIMAGRNAGMRVVGVTTTHPPQALAHAHLVVEHLGQVGWPQLVLRDPEPPQTALAGQG

SEQ ID NO: 46521 - protein, 689 aa, Alkalilimnicola ehrlichei MLHE-1
MAPTDPSELARAQEACAREPVHIPGAVQPSGCLVSLDQRLRRLLQASANLHRFFGVTPEQALASDPKALLGRHLLRRISASLPQAPLQPVSLVAGMRLRGRNRRFRTTAYRSGERVVLEFEALSGPDTQTLFPAMGDWLSHLAGARTAGALLETLVAAARDLTGHERAMVYQFDPDWHGCVVAESRCEHMDSYLSHHFPASDIPPQVRQLYDVNPVRSIPDAPAAPVPLVPTEDPLDQHPLDLSAGVLRAVSPIHQAYLHNMGVKSALSVAIRDDAEGLWGLLACHGQEARSLPPTLRDAVLALVQVAQSRLMLLNAQRNARYQRRVRACRARLVLERRPRATRLSELVADHGADWLTLFRACGIALAYRGQYHTFGTAPPDRTLAALVQGLVRLAPRDASWSWHSPDDWPVAAELPRGRCCGLLAAPVLVDSEQPAFLLFFRAENVQTRLWAGRPEALWGAEKVAAPLTPRHSFAAWREEVRGHSAPWRDIEREAVLDLADEVAVLLSRKEIDLLNAQLTEANRRLKRQATTDSLTGVWNRYRMQEQIELERGAHERYGTPCSLLLFDIDHFKAVNDQYGHEAGDQVLVALARAVVGELRATDFLGRWGGEEFIVLATNSAPEEAWTLAERLRQCIAGLRFPGVGPVTISVGVASLSRGDTVDRLIDRADRAMYRAKQRGRNRVEQAE

SEQ ID NO: 46522 - protein, 485 aa, Oceanicola granulosus HTCC2516
MRDATPTASHYVDGAYLEDAEGAAIEVIYPATGARIATVHSASGQVVEAALAAATRAQPAWAALPGVERGRVLRRAADILRARNRELSELETLDTGKPLSETLVADATSAADALEYFGGLAAAITGEHIPLADGDFVYTRREALGVCVGIGAWNYPTQIAAWKAAPALACGNTMVFKPSETTPLCALKLAEILTEAGAPPGVFNVVNGLGDVGAALVADGRVAKVSLTGSVPTGRKVYAAAAQGMKHATMELGGKSPLVIFDDADLESAISAAINGNFYSTGQICSNGTRVFVQSGIKEAFLERLAERTANATLGDPLDEATTLGPMVSAAQLEIVLDYVARGRAEGARLVTGGARVEREGFWIEPTVFADVTDDMTIAREEIFGPVMTVLDFETEDEALARANATEYGLAAGVFTADLTRAHRMAAGFEAGTTWINTYNLTPVEAPFGGSKMSGVGRENSAAAIAHWSELKSVYVSLNPTEAPF

SEQ ID NO: 46523 - protein, 475 aa, Oryza sativa (japonica cultivar-group)
MGDGRVGGGTNRPAWLQQYELVGKIGEGTYGLVFLARLKQSHPHAAAGVGRRGSPIAIKKFKQSKEGDGVSPTAIREIMLLREINHENVVKLVNVHINHADMSLYLAFDYAEHDLYEIIRHHREKLNLPINPYTVKSLLWQLLNGLNYLHSNWIIHRDLKPSNILVMGEGEEHGIIKIADFGLARIYQAPLKPLSDNGVVVTIWYRAPELLLGAKHYTSAVDMWAVGCIFAELLTLKPLFQGVEAKATPNPFQLDQLDKIFKVLGHPTVEKWPTLANLPCWQNDQQHIQGHKYENTGLHNIVHLPQKSPAFDLLSKMLEYDPRKRITAAQALEHEYFRMDPLPGRNALLPSQAGEKIVQYPVRPVDTTTDFEGTTSLQPTQAPSGNAAPGNQSVVPRPIPRQMQQPMVGMSRMGGTNMAAFGAAPQGGIAGMNPGNIPMQRGAGAQSHPHQLRRKADQGMGMQNPGYPTQQKRRF

SEQ ID NO: 46524 - protein, 482 aa, Triticum aestivum
  misc_feature (267)..(267): Xaa can be any naturally occurring amino acid
  misc_feature (278)..(278): Xaa can be any naturally occurring amino acid
  misc_feature (329)..(329): Xaa can be any naturally occurring amino acid
MASTAAPPAALVARRAASASVAAPLRGAGLAAGCQPARSLAFAAGADPRLAVHVASRCRAASAARGTRAVATMAKKSVGDLTAADLEGKRVLVRADLNVPLDDNQNITDDTRIRAAIPTIKYLLSNGAKVILTSHLGRPKGVTPKFSLAPLVPRLSELLGIEVKKAEDVIGPEVEKLVADLANGAVLLLENVRFYKEEEKNDPEFAKKLASLADLFVNDAFGTAHRAHASTEGVTKFLKPSVAGFLLQKELDYLDGAVSNPKRPICXPIVGGSKVSSXKIGVIESLLEKCDILLLGGGMIFTFYKAQGLSVGSSLVEEDKLELATSLLXRAKAKGVSLLLPSDVIIADKFAPDANSQTVPASAIPDGWMGLDIGPDSVKTFNDALDTTQTIIWNGPMGVFEFDKFAVGTESIAKKLAELSKKGVTTIIGGGDSVAAVEKVGVADVMSHISTGGGASLELLEGKELPGVVALDEGVMTRSVTV

SEQ ID NO: 46525 - protein, 69 aa, Brassica napus
MAANDAGRPLPKFGEWDVNDPATADGYTVIFSKAGEDKKTGRSSTKTNSQRKHDGDKPAVKKWLCFTFS

SEQ ID NO: 46526 - protein, 963 aa, Triticum aestivum
MPMPMRTMLLRHLSPAPALPNPRRSSASSPQRRPARARPPPLHSARATALRARRTPMAAGETGASVSVSAAEAEAEATQAFMPDARAYWVTSDLIAWNVSEQEAASVYLYASRTAAMGLSPSNGGIQGYDSKVELQPESAGLPETVTQKFPFISSYRAFRVPSSVDVASLVKCQLVIASFGADGKHVDVTGLQLPGVLDDIFAYTGPLGAVFREDSVSLHLWAPTAQDVSVCFFDGPAGPVLETVQLKESNGVWSVTGPREWENRYYLYEVDVYHPTKAQVLKCLAGDPYARGLSANGARTWLVDINNETLKPASWDELADEKPKLDSFSDITIYELHIRDFSAHDGTVDSDSCGGFRAFAYQASAGMQHLRKLSDAGLTHVHLLPSFHFAGVDDIKSNWKFVDECKLATFPPGSDMQQEAVVAIQEEDPYNWGYNPVLWGVPKGSYASDPDGPSRIIEYRQMVQALNRIGLRVVMDVVYNHLDSSGPCGISSVLDKIVPGYYVRRDTNGQIENSAAMNNTASEHFMVDRLIVDDLLNWAVNYKIDGFRFDLMGHIMKHTMMRAKAALQSLTRDAHGVDGSKIYLYGEGWDFAEVARNQRGINGSQLNMSGTGIGSFNDRIRDAVNGGNPFGNPLQQGFNTGLFLEPNGFYQGNEADTRRSLATYADQIQIGLAGNLRDYVLITHTGETKKGSEIHTFDGLPVGYTSSPIEIINYVSAHDNETLFDVISVKTPMNLSVDERCRINHLASSMMALSQGIPFFHAGDEILRSKSIDRDSYNSGDWFNKLDFTYETNNWGVGLPPSEKNEDNWPLMKPRLENPSFKPAKGHILAALDSFVDILKIRYSSPLFRLSTASDIKQRVHFHNTGPSSVPGVIVMGIEDARDEKPEMAQLDANFSYVVTVFNVCPHEVSMDIPALASMRLELHPVQVNSSDALVGKSVYEAATGRFTVPRRTVSVFVEPRC

SEQ ID NO: 46527 - protein, 365 aa, Ipomoea batatas
MVGGGDFLAVQTHGGQYVQYDIFGNLFEVTSKYAPPITPIGRGAYGIVCSALNAETNEMVAIKKIADAFDNYMDAKRTLREIKLLRHLEHENVIAIKDVIPPPLRREFNDVYIATELMDTDLHQIIRSNQGLSEEHCQYFLYQILRGLKYIHSANVIHRDLKPSNLLLNSNCDLKICDFGLARTNLDNEFMTEYVVTRWYRAPELLLNSSDYTAAIDVWSVGCIFMELMNRKPLFQGKDHVHQMRLITELLGTPTDSDLGSIQNENARRYIRQLPLRPRQQLANGFPHVHPLAIDLMDKMLTFNPSKRITVEEALAHPYLAQLHDKSDEPICPVPFTDFEKQAYGEEQIKDMIYQEALAMNPGYA

SEQ ID NO: 46528 - protein, 125 aa, Aspergillus nidulans FGSC A4
MSDLTNIFTPNACPPVGPYSQAVKANGQIFLSGQIPADKNGNLVEGDIRTKTQACCDNIKAILDAAGSSVDKIIRVNVFLDDMSNFAEMNAQYEKFFTHKPARSCIAAKQLPKGVPVEIECIALA

SEQ ID NO: 46529 - protein, 516 aa, Medicago truncatula
MIAGMSLGSTGIVGNLIVYLTREFNIKSITATQISNVVVGSTSIFPVVAAIVADSFFGSFYVAFASSCILLLGTILLFLTETINSLKPHPCSKDSSTTCKPPTGIQYTVLYISILLISIGFGGSRFTAASLGANQFDKPEHQGTFFNWYFFTFYVASGAALTGIIYIEDNLGWAIGFGICAVAAFVGVVVFVLGYRFYRAEKPQGSAILDLGRVFVASARKWRCKLSSRAEDYYGSSSGHDVLVHVLPPPIPGKGLRFFNRAALITDADLHSNGTIKKSSWRLCTIQQVEDFKKIVGILPLWTSSLFLSIPIVMQMDFIILQALVMDRSLGYHFEIPAGSISVIVLISAPIFLTFLDRVLLPSWHKVTRKSPKLLHQIGVGHVFNVLGMVVSALVESKRLKLAHEHVSMSVLWLFPQLVLVGIGEAFHFPGQVTFYYQQFPQSLKSTSTATVSMLIGVAFYMSNALIDQVRRSTDWLPDDINHGKIDNVYWMLVLLGGINFVYYLFCSSPYKYENV

SEQ ID NO: 46530 - protein, 114 aa, Alkalilimnicola ehrlichei MLHE-1
MSDCLFCRMVSGELQPDVVHETDDVLAFRDINPQAPLHVLVIPKKHIATINDIEAGDEALIGKLYRAAAVIAAQEGVAESGYRTVMNCNADAGQEVFHLHLHVVGGRRLRWPPG

SEQ ID NO: 46531 - protein, 402 aa, Xanthomonas oryzae pv. oryzae KACC10331
MLKDRANQVPSCSSSTWRSWHCCSGDREQVLRCSVPASGIIAGETSLRRSAGFDGWRSPLQVRKPNVMTQTITVIRGDGIGPEIMDATLFVLDALQAGLTYEYADAGLVALEKHGDLLPESTLASISKNKVALKSPLTTPVGEGFSSINVAMRRKFDLYANVRPAKSFPNTKSRFADGVDLITVRENTEGAYLSEGQTVSEDGETAFSGILITRKGSERIVRYAFDLARATGRKKVTAVHKANIIKSTSGLFLKVARDVAAQYPEIEFQEMIVDNTCMQLVMRPEQFDIIVTTNLFGDILSDLCAGLVGGLGLAPGANIGLDAAIFEAVHGSAPDIAGQGKANPCALLLGAAQMLDHIGQPQNAERLREAIVATLEAKDSLTPDLGGSGNTMGFAKAIASRL

SEQ ID NO: 46532 - protein, 591 aa, Nicotiana tabacum
MESALKEQRGGESVLDLSPRATPAGGVEDVYGEDCATEDQLITPWTIAVSSGYNLLRDPRYNKGLAFTERERDAHYLRGLLPPVISTQELQEKKIMQSLRQYDVPLHKYVAMMELEERNERLFYKLLIDNVEELLPIVYTPTVGEACQKYGSIFKRPQGLYISLKEKGRILEVLKNWPERSIQVIVVTDGERILGLGDLGCQGMGIPVGKLALYTALGGVRPSACLPITIDVGTNNEQLLKDEFYIGLRQKRATGQEYYDFLHEFMSAVKQNYGEKILVQFEDFANHNAFELLAKYGTTHLVFNDDIQGTASVVLAGLIASLKLLGGSLADHTFLFLGAGEAGTGIAELIALEISKKTKYPVEETRKKIWLVDSKGLIVSGRKETLQSFKKPWAHEHEPVNNLLDAVKAIKPTVLIGTSGVGRTFTKEVIEAMASTNERPLIMALSNPTSQAECTAEEAYTWSEGRAVFASGSPFPSFEYNGKLNIPGQANNCYIFPGFGFGLVMSGTIRVHDDMLLAASEALAAQVTEEHFAKGMIYPPFADIRKISAHIAASVAAKAYELVVATRLPRPANLVKYAESCMYTPNYRSYR

SEQ ID NO: 46533 - protein, 229 aa, Oryza sativa
MGHYSEQRPGFEVTKDWNGADQVMIRSPRGASVLVSLHGGQVVSWRNDRGEELLFTSSKAIFKPPKAMRGGIPICFPQFGNCGTLEQHGFARNRLWAIDDEAPPLNHNDNNGKVSVDLLLKPSEDDLKCWPHCFEFRLRVSLSTDGDLSLVSRVRNVNGKPFIVWNPWDKKSKTMADFGDEEYKQMLCVDAAAVERAITLKPGEEWTGKLELSAVASTNCSDHLDYPCS

SEQ ID NO: 46534 - protein, 416 aa, Synechocystis sp. PCC 6803
MKKSHYSVIIVGGGQAGLAISYLLKQESIDHVIFEKNQIGHAWRNQRWDSFCLVTPNWQCRLPGFPYAGGDDQGFMLKDEIVQYLEDYAASFQAPILEGVEVSKLSQRTDAFEVITSQGIYTADQVVVATGGYHTPKIAAIAKKLPPHIVQLHSVDYKNPETLPDRILLVGTGQSGCQIAEDLHLAGKTVHLATGSAPRSPRRYRGRDVVEWLELMGHYDLPIDEHPQKEMVRHKTNHYLTGRDGGREIDLRQFALEGMHLYGRLKDIDGNQILFADNLKENLDQADATAARIKQSIDEYIAKNQLDAPIEAPYQPVWEPTSIPLTLNIDEIDAVIWSTGFNFNYAWVDVPVFNSMGEPLHNRGVTNVAGLYFLGLPWLYTWGSGRFSGVARDAEYLAEKIRETLPANQINPCTVA

SEQ ID NO: 46535 - protein, 760 aa, Debaryomyces hansenii CBS767
MLSDRYSDSGSEVLRNRETGEWINQQNVREVKRFDEFTTIDWVEDELCEHWKRLSKNRSINSRATSFKDKLISATQNWFVLGFMGIVIGLIAGCLNIITAWLTSIRMGHCSGNFYLNETFCCWDQDEDKCTNWVSWSQIGFFNYIIYVIISVLLAYSAAILVKKYAPSAAGSGISEIKCIVSGFVMKGFLGWWTLLIKSVGLPLAIASGLSVGKEGPSVHYAVCVGNSIAKLFGKYRKSATKAREFLTATSAAGVAVAFGSPMGGVLFSIEDISTVFQLSTIWKSYFCSLIAVTTLAALNPFRTGQLVMFEVTYNTNWHYFEIPFYIILGIFGGVYGIVVSKFNLRVVAFRKKYLSNMAVREVIILSSLTACFCYFNEFLRLDMTETMQILFNECDAGSEHAICNPNSKKVSIFMSLIFATVARMVLTIFTYGCKVPAGIFVPSMATGATFGRALGMIVEKIQQSNKESSIFSTCPANGDKCIIPGTYAFLGAAAALSGITHLTVTVVIIMFELTGALRYIIPTMIVVAITKSINDKYGKGGIAEQMIKFNGLPLIESKEEYRFNTTVKSAMSNITVAFPSDESESISLNQLKKLLTKTTYSGFPIIQSTAHPRVIGYITRADIKYNLENTVSVGDSVKCNFNSEQSQDSEDHIEFGAVVNRHPFTVNVTTTLEYVLDVFVKLGPGFILVEQEGLLVGIITRKDILRYEYSVHAMHSNKDLESAHAAFDERVWHLMNYFATALKKNIGKLLHNDEYRYIH

SEQ ID NO: 46536 - protein, 313 aa, Zea mays
MAASCASTLPPLSFVSSSSSPRRFRRSGVVAMASVGQKVYAPGVAVSEGNGGLPKIDLKSPHGSEAEIYLFGACVTSFKVPNGKDLLFVRPDAVFNGQKPISGGIPHCFPQFGPGPMQQHGFARNVNWSITDSEVTEGDPAVTLELKDDTYSRSMWDFSFHALYKVSLHSKSLSTTLAIINTDDKPFSFNSALHTYFSASITGVSVKGLKGCKTLNKDPDPKNPLEGKEEKVTFPGFVDCVYLGAPSELILDNGLGDKIAIANSNWSDAVLWNPHLQMEACYKDFVCVENAKIEMVQLEPKQSWVAEQKIELV

SEQ ID NO: 46537 - protein, 316 aa, uncultured marine gamma proteobacterium EB000-45B06
MSDKNLINKDLKEVNNLLRKNIIKEKTISNLYAYIFKKNGKQLRARLSLIASSADRRQGKKRLKLAAIIELLHNATLVHDDVVDESPTRRGVKSVNNIWTNAHGVLIGDYIYSKAFMLMVELGNSKILEELSNATNDISKGELIQLDAIANTGISLSELEDISYFKTGRLFEASAKCGALLCNSKKSYVNSISECAKNLGIVFQIKDDLLDYLGKEDALGKPAFQDIKEGKVTYPFYFAYQNANSDDKKILSTMLGNKKVSHSKVSNLIERLGGINDTENLAIKYINKCKVLAGKLDNDLQQEMLKLLDSSINRIK

SEQ ID NO: 46538 - protein, 214 aa, Aspergillus nidulans FGSC A4
MSQHTASTSPDASSTTQVAGHPSSATSRAAELASLKVKLRGALRQFPDFPSPGILFEDILPIFSDHSTHEALVRCLELHILETLADEKPDVIVGLEARGFLMGPSLALKLGAGFVPVRKRGKLPGPCETQGYEKEYGQDFFQMQSDAIKPGQKVIVIDDIIATGGSAYAAGELIKKMGGNVLGFVFLLELEFLHGRDKLSAPVHTLLTGQETKA

SEQ ID NO: 46539 - protein, 685 aa, Pseudomonas aeruginosa
MKRRSVLLSGVALSGTALANDSIFFSPLKYLGAEQQRSIDASRSLLDNLIPPSLPQYDNLAGKLARRAVLTSKKLAYVWTENFANVKGVPMARSVPLGELPNVDWLLKTAGVIVELIVNSFASLPASAAAQFERIPAGLNGDLEAARQVHEALLEEAKNDPAAAGSLLLRFTELQTRVIALLTRVGLLVDDILKSASNLVTQGGQGDGLNRFRAVFGTLRLPEVADSFRDDEAFAYWRVAGPNPLLIRRVDALPANFPLGEEQFRRVMGADDSLLEAAASRRLYLLDYAELGKLAPSGAVDKLLTGTGFAYAPIALFALGKDRARLLPVAIQCGQDPATHPMFVRPAESESDLYWGWQMAKTVVLVAEENYHEMFVHLAQTHLVSEAFCLATQRTLAPSHPLHVLLAPHFEGTLFVNEGAARILLPSAGFIDVMFAAPIQDTQATAGGNRLGFDFYRGMLPESLKARNVDDPAALPDYPYRDDGLLVWNAIRQWAADYVAVYYASDGDVTADVELAAWVGEVIGSGKVAGFRPITGRSQLVEVLTMVIFTASAQHAAVNFPQPSMMTYAPAICAMSAAPAPDSPSGKSEADWLKMMPPALVALEKVNIYHLLGSVYHGRLGDYRQTGFPYAPVFSDRRVTASGGPLERFQARLKEVEATIRTRNQARRKPYEYLLPSRIPASTNI

SEQ ID NO: 46540 - protein, 537 aa, uncultured archaeon GZfos23H9
MPVIKLYNADLENLTGVSIERIKERLPLLCADVERIESDSMDVEFFPNRPDLFSVEGVARTMKQFLDIKPGLATYNVAKSRIEMVVESSVLEVRPYIVCGVVRDLHFDSSTIESLMLLQEHLHRGIGRNRAKVSVGVHDLGKVKPPFLYRAVDPGFSFVPLDYEEEMSMAEILERHPKGVAYKYILEDETNYPLILDSSGGVISFPPIINAERTRVTESTTDIFLDVTGLDDNVSVALNIIACALAERGGQLQSVVLHYPDAEIETPSLAPKTMETSVADVNSLTGLELSAEDCKKCCERMGLSAKLKSDGRLDVIIPAYRSDILHPWDIIEDIAIGYGYDRIKPEIPGTMVIGEVHPIEDKKRQVREIMTGLGYFEVLTFTLTSERKQFELMLRKRHEEEVKVASPISTEHTMLRSTIMPNLLEILALNQHRDLPQRIFEVGPVVLNIKEKYRLAAVSTHANANFAEVRSVVDSVLKERCMDEVELSESEDGAFLAGRRADIKVDGKRIGVFGELHPAVILNFGLDHPVVGFEVGV

SEQ ID NO: 46541 - protein, 1248 aa, Coccidioides immitis RS
MIAEEKGISRVEADEEAAIGIDSHVQAAKHQSRTHLSFRKVQPVDVHVKELVVRVDTVPPIWQSSPSLLWDRLRRKTKGDPLKTVLDGVTAAMPSGSLTAIIGGSGSGKTSLLNVMAGRMNTGRVKISGSATFNGHDNINSVRSAYVMQQDVLIPTLTVRETLQYSADLRLPPPTTHDERQNVVNNVILELGLKECADTRIGTTTHKGCSGGEKRRTSIGVQMLSNPSVLFCDEPTTGLDATSAFQVIKTLKALARDGRTVIVSIHAPRSEIWGLFDQVILLSRGSVLYSGPVDMALSHFEECGHSIPAFVNPAEFLIDLAAYDNRSEESEFFSRERIEKLQRAWRESPNNRLLDEKASSQNRGIASEKAYQSITPQKGASFGQQFRVLTARTMKMTVRDPMGMTASLFEAIGMAVMNGWVYLRLDRSLAGIRSRQGSLYTASSLNGYLILLYEVFRLTTDIQLFDRERNEGVVGVPAFLLSRRAARLFLEDLPVPCLFSVIFYFMVGYRLAAPEFFIFLALNILTQYLAVSFASVCISLSRNFPGASLVGNLSFTLQTMACGFFVQANQIPVYVRWIKWMTYTFYVFGALCANEFIGPSGPPEGQFYDCPFSDDPSDPYCKEYTGRFILETLGLPSNWIWRPMVALVGFITLFFGAAYLILQFRKVDMDIAQSRSSEGDLSAGKEKFVARLPDKSHHVSIRLDNYALEIQKRRIGKRGIESRRLRILRPISAEFRPGQLNVIMGPSGSGKTSLLCSIARRLHGSIGTRYHLSGQMLYNSSVPSENVIRAVSSFVTQDDDALMPSLTVRESLQFAAGLRLPSWMSKEEKNRRAEDILLKMGLKDCADNLIGSDLIKGISGGEKRRVTIAIQILTDPKVLLLDEPTSGLDAFTATSIIDALNGLAAEGRTLILTIHQARSDLFHYFSNILLLARGGHLVYAGKGSEMLPHFKQLGYPCPEATNPADFVLDLITIDLQEKGREDASRERVQRLISGWEQKPVELTRQTSVISTPAELGSLKRKMSPFHLMYPLVLRRSAINLRRQPHLLVARTMQVIGIAIILTLFFAPLKKNYESVQSRMGFIQQLAAMYFVGMLQCIAIYPYERDVFYREESDNCYSVEAFILQYTSLELPFEIASSLIFGVVAAFAVRLESSVKMLFILAFNCFCIVFTCTDAQRLPNGNCPIETGEQVLMLYNQDDKNPAINVMALGLVAIGYRLVAYLLLKAMRSHGISKSIWIGLSKSSKKPQA

SEQ ID NO: 46542 - protein, 436 aa, Arabidopsis thaliana
MPSPPTTTSLSVTQTINGSHSFTIKGYSLAKGIGIGKHIASDTFTVGGYQWAIYFYPDGKNPEDNSAYVSVFIALASDGTDVRALFELSLLDQSGKGKHKVHSHFDRALESGPYTLKYRGSMWGYKRFFRRLMLETSDFLKDDCLKINCTVGVVVSEIDCPRLHSIHVPASDIGSHFGMLLENEDGSDITFNVSGEKFRAHRLVLAARSPVFESEFLDVTGEEDRDIEVTDMEPKVFKALLHYIYKDALIEDAESSSSSGSSVGPSASDTLAAKLLGAADKYKLPRLSLMCESVLCKDISVDSVANILALADRYNASALKSVCLKFAAENLIAVMRSDGFDYLREHCPSLQSELLKTVAGCEEELSGGGGKTRSVWGQFSDGGAETNGRQAQTWGDINGGAERSQSVWVEVVNANGSGRNNNDNNNSDDPMAELED

SEQ ID NO: 46543 - protein, 253 aa, Zea mays
MAGPRRLLLLLLPLLVLLGAHPPQRGSAEEGTKVSLELYYESLCPYCSRFIVNHLAGIFEDGLIDAVHLRLVPYGNARVASNSEISCQHGPYECLLNTVEACAIDAWPDLDVHFSFIYCVEDLVVKRQYKDWESCFEKLGLDAKPVTECYKSEHGHKLELKYANQTDALEPPHRYVPWVVVDGQPLLEDYENFEAYICKAYKGTPPKACEGLERLQMALETAAEARNGVSYNSGVSKLATAEDEGGEHKVGEY

SEQ ID NO: 46544 - protein, 468 aa, Oceanobacter sp. RED65
MSENTLKLIKDNDVKWVDLRFTDTKGKEQHVTIPAKDVDEEFFEVGQMFDGSSISGWKGINESDMILLPDDTTPFLDPFTEDATLCLRCDIIEPSTMQGYERDPRSVAKRAEEYLQSTGLGDTAFFGPEPEFFIFDDVRWGADMSGTFYKINSEEAAWNTEAVMEGGNMGHRPSVKGGYFPVPPVDSSHDMRAAMCNTMMAIGLDVEVHHHEVATANQNEIGVKFNTLVKKADEVQMLKYVVHNVAHAYGKTATFMPKPVVGDNGSGMHVHQSFWKDGENQFAGDSYSGLSETALYYIGGIIKHAKALNAFTNPSTNSYKRLIPGFEAPVMLAYSARNRSASIRIPYVASPKGKRVEARFPDPTANPYLAFAAMLMAGIDGVKNKIHPGDAADKDLYDLPAEEAAQIPQVAGSLREALGALEADMDFLVEGGVFTKDMIEAYIELKMEDVYRVEHTTHPAEFDMYYSL

SEQ ID NO: 46545 - protein, 210 aa, Zea mays
MGNFCGSDWTKEQDMALRKAYFSARPSPHFWKRVSKMVPGRSAEDCFNRIYNDLSTPTPIAPRPRTNSPGTPDSYMNSDSLGKHSGRSSARKKPFSRLRTKPSEPSPGVLKPIKNVILHERYIDKLARREGAKRPRRRAPAGSKAADSGKSLSEQQAGSLKAAKNALISEATDFISSFKTLQANSLAHAVENSEDEIECDASNCSHDDKE

SEQ ID NO: 46546 - protein, 178 aa, Brassica napus
  misc_feature (27)..(27): Xaa can be any naturally occurring amino acid
EIIRRTRFASVLDTDQPRTIPCHDQVXFWFGDLNYRLNMSDSEVRKLVSQKRWDELKNSDQLIRELRRGHVFDGWREGPIKFPPTYKYEFDSDRYAGENVREGEKKRAPAWCDRILWLGKGIRQECYKRSEIRMSDHRPVTSIFNVGVEVFNQRKLQRALHVNNAAACAVHPEPSFLF

SEQ ID NO: 46547 - protein, 147 aa, Clostridium thermocellum
  misc_feature (1)..(1): Xaa can be any naturally occurring amino acid
  misc_feature (31)..(31): Xaa can be any naturally occurring amino acid
  misc_feature (142)..(142): Xaa can be any naturally occurring amino acid
XGSSHHHHHHSSGLVPRGSQSTSLYKKAGLXYTLENCVFCKIIKRELPSTIYYEDERVIAIKDINPAAPVHVLIIPKEHIANVKEINESNAQILIDIHKAANKVAEDLGIAEKGYRLITNCGVAAGQTVFHLHYHLLGGVDXGPKIL

SEQ ID NO: 46548 - protein, 525 aa, Triticum aestivum
  misc_feature (414)..(414): Xaa can be any naturally occurring amino acid
MLLRTRRCLPAALSRAAVHPRVSPALPSPGAPRQHGPVAVANQGSALEPRSGPIDWVRSSTMARANPATLFPASTGGHYRVGMQARWFSSAGLPPHMVIGMPALSPTMNQGNITKWRKQEGDKIEVGDVICEIETDKATLEFETLEEGYLAKILVPEGSKDVQVGQPIYVTVEESDDIEKIPADTSFGGDHKEDESSGSAAQTVEVDAAEQSPVMSRISPAAKMLIKEHGLNASLLKASGPRGTLLKGDVLAALKSGTALSSAKEKTAPAAPSPQPARDSQVQSQTTSPKGDTFEDITNTQIRKVIAKRLLESKQTTPHLYLSKDVILDPLLAFRNELKEQHGVKVSVNDIVIKAVALALRNVPEANAYWDNAKEEAQKCDSVDISIAVATEKGLMTPIIRNADPKTISSNIRXKVKQLAEKARAGKLAPNEFQGGTFSISNLGMYPVDHFCAIINPPQAGILAVGRGNKVVEPVMDNDGTEKAAVVTKMMLTLSADHRIFDGQVGGKFFTELALNFSDIRRLLL

SEQ ID NO: 46549 - protein, 366 aa, Guillardia theta
  misc_feature (324)..(324): Xaa can be any naturally occurring amino acid
DNGSGMVKAGFAGDDAPRAVFPSIVGRPRHQGVMVGVGQKDSYIGDEAQSKRGILTLKYPIEHGIVTNWDDMEKIWHHTFYSELRVAPEEHPVLLTEAPLNPKANREKMTQIMFETFNTPAMYVAIQAVLSLYASGRTTGIVLDSGDGVSHTVPIYEGYALPHAILRLDLAGRDLTDYMMKILTERGYSFTTTAEREIVRDIKEKLCYVALDFEQEMQTAAQSSSIEKSYELPDGQVITIGNERFRCPEVLFQPSFIGLESAGIHETTYNSIMKCDVDIRKDLYGNIVLSGGTTMFSGIADRMQKEITALAPSTMKIKIIAPPXRKYSVWIGGSILASLSTFQQMWISKQEYDESGPSIVHSKCFS

SEQ ID NO: 46550 - protein, 341 aa, Arabidopsis thaliana
MSCWRKKSKKKNSEANQRQRWFQENGKVLLEDLIELCNGKSNPIKTFSAEEILQATDNFSESNLVIRFNFMYRGILQNRPVLIKRATWNYYKSDTLEKICRDIAVSSMVSGHKNFLKLLGCCLEFEHPVLVCEYAERIPFNTPNPEMLLPWRMRIKIAKEIAIAVSYLHTALSRTMIHTDIQPFNIFVDSNGTAKLSDFCLCIAIPEGETFVKVHADRVEGTLDYLEYNYAATGLITEYTDVFSFGVLFEDESLFEEFEDKQNVMNLRISDRISKFVEEGRIFDMLDPKMLESMGDDETEEHKIRRMKAVLMLSLRCTGHRGDVPKMMEVAKELKRIERWT

SEQ ID NO: 46551 - protein, 380 aa, Rhodopseudomonas palustris CGA009
MTERIREFLRDRRAKGLDVEPCLVVDLEVVRDNFMHFAKALPDSRVFYAIKANPAPEVLSLLASLGSCFDCASVQEIQMALAAGATPDRISFGNTIKKERDIARAYELGIRLFSVDCTPEVEKVARAAPGSKVFCRILYDCAGAEWPLSRKFGCDPEMAVDVLDNAKRLGLEAYGISFHVGSQQRKVKAWDRALAMAAQVFRDCAERGISLSMVNMGGGFPTKYLKEVPPVVQYGRSIFRALRKHFGNQIPETIIEPGRGMVGNAGVIETEVVLISKKSDEDDVRWVYLDIGKFGGLAETMDESIRYAIKSRHDGAEMTPCVLAGPTCDSADVLYEKMPYPLPVTLEIGDKLLIEGTGAYTSTYSSVAFNGFPPLATYHI

SEQ ID NO: 46552 - protein, 559 aa, Bartonella henselae str. Houston-1
MRYKSMGDSLSIRNEKAFEAALQALRRHAIKDGVYDIRRHFIEDEQRFSNFSLNLDDFLFDFSKCGVTFKTLQLLDDLAVAADVLGRRDAMFSGKAINTTEKRSVLHIALRLPADEVFMLDGTDLVHDIQGVLADMERFSDMVRDGSYKGNSGEKIIDIVNIGIGGSDLGPAMVTYALKPYHDGPNCHFVSNADSAHISDTLSVLNPATTLFVIASKTFTTAETIANAQVARQWIMSHLGKEAVCKHFIAVSSALDKVAEFGIDSSRTFRFWDWVGGRYSIWSAIGLVVMLAIGGQNFRQFLEGAQHMDRHFKTAPLRKNIPIRFALLGFWHRVVCGYASRAVIPYAQRLARFPAYLQQLDMESNGKQVSLDGKTLTFSSGPVVWGDSGTNGQHAFFQLLHQGTDVIPVEFILFIKGHEQNLHPMYDMLVANCLAQSKALMKGRSVEDARRMLLKSGIDERESENLALHKSFAGNRPNMMLVQDLLTPFALGRLIALYEHRIFVEGILMNINSFDQWGVELGKELANELLPILRGENKTNNRDSSTLGLLAHIQARRGE

SEQ ID NO: 46553 - protein, 295 aa, Arabidopsis thaliana
MAALIRAPPRDFLMVKREWASTRIQAAFRAFLARQAFRALKAVVRIQAIFRGRQVRKQAAVTLRCMQALVRVQSRVRAHRRAPSDSLELKDPVKQTEKGWCGSPRSIKEVKTKLQMKQEGAIKRERAMVYALTHQSRTCPSPSGRAITHHGLRKSSPGWNWYDDVGTFSRKSSESSVLSEYETVTVRKNNLSSTRVLARPPLLLPPVSSGMSYDSLHDETSTSSTSQSPVAFSSSVLDGGGYYRKPSYMSLTQSTQAKQRQSGLSCNGDARRSAGSDQCTDLYPPGNVWAKSQRS

SEQ ID NO: 46554 - protein, 1547 aa, Nostoc sp. PCC 7120
MINWNDYLESLCKDYAQWWNAYTLTDVVGQQRIEQKRSPLLLDFIVQTVQSAKEERSASQEQVERLDVLAGLRKYAQEHVLLVGRPGSGKSTALLRLLLEEAERPLPQPLPDAERGVLAPPSLAGKGVGGLGQIPILVELRYYQTSILDLIRDFLKRHCLLLDTATIEQLLFDGQFLLLVDGINELPSEKARQDLYKFRQDNQKTTPMIFTTRDLGVGGDLGITKKLEMQPLTAEQMQQFVRAYLPAQGEQMLQNLGDRLREFGETPLLLFMLCLLFVETGDIPPNLGLLFRELTQRYKNELKPNVPVKGVSRDHWSWLLQHLAFNMTKGDKLTELNVAILKSKAEEVLTQLLKDEGFNPPRDQASESLKDLLNHDLIQLAANDQIEFRHQLIQEYYTAECLLKLLPSLSDDSLQREYLNYLKWTEPLKLMLELVDDRALAVRVVNLALKVDYQLGAKLAGAAKPELQQQTVDLIPGLKIPLLFKICLLGLTKSEKAISHLNPLLEDENSSVRDSAASALGEIKSEAAIPGLIKLLEHENSSVRYSAASALGEIKSEAAIPGLINLLEHENFDVRYRAASALGEIKSEAAIPGLINLLEHENSSVRYRAASALGQIKSEQAILGLIKLLEHENSSVRYRAASALGQIKSEQAILGLIKLLEHENSDVRYRAASALGEIKSEQAIPGLINLLEHENFDVRYSAASALGEIKSEQAIPGLINLLEHENFDVRYSAASALGEIKSEAAIPGLINLLEHENFDVRYSAASALGEIKSEAAIPGLINLLEHENFDVRDSAASALGEIKSEAAIPGLINLLEHENFDVRYSAASALGEIKSEAAIPGLINLLEDENSDVRYSAASALGEIKSEAAIPGLINLLEDENSPVRRRAASALGQIKSEAAIPGLINLLEDENSPVRRRAASALGQIKSEAAIPGLINLLEDENSSVRYSAASSLGQIKSEQAILGLIKLLEDENSSVRRRAASALGEIKSEQAIPGLIKLLEHEDSDVRYRAASALGEIKSEQAIPGLIKLLEDEDSFVRYRAASALGEIKSEQAILGLINLLEDEDSSVRYRAASTLGQIKSEQAIPGLINLLEDEKSSVRDSAASALGEIKSEQAIPGLINLLEDENSSVRDSAASALGEIKSEQAIPMLMNRLENEEFVSANNGNTLYSALEALEAIQENCQYYRCLTEQKPQLYLPPSQPSKTSLMYILHLSDLHFGTPDEANKWSNQLAMDLKQELQIPHLDALILSGDIANKSTPDEYAAAQKFLDELRQDFSLKFEQIIIAPGNHDLNWQISEEEGYIPTLRKKYQESMDESCVIDDGGAYIAVVDPENHKRRFEHFSNFYQAIKNQPYPLEYEKQYTLDHFPNQNLLILGLNSAWQLDHHYKSRASININALTNALTDIRRNQYYQNCIKIAVWHHPLDSAWEDRIKDQSFMEQLAVAGFRFFLHGHVHKAETSLYRYDMSANGRKLDRICAGTFGAPTRELNPGYPWQYNLLKFADNKLTVYTRRREELNGPWKPDARWLMGAGQNPLPYYEVMMDYT

SEQ ID NO: 46555 - protein, 834 aa, Bartonella henselae str. Houston-1
MNRGFNESEILSTKSVKLAAAFDHKNDAIHAAAELLVQVGAVDKSYLASMLKREAVTNTWLGNGIAIPHGMVENRDLIIRDAVAVIQIPAGVDWCDGNKARLVIAIAACQDCYREICKKLTLLLFDKERLEELSTTADKQQIVTMLFSQDTKRERAFIGDLSVRQEWTLDYPSGLHARPASLWVDFAKKAQGSIRVRHGQYTVEMKNLVGLLQLGAKNGDVLIFSTDASEGVQLLKEAISVVKKVSISEKCVMRETEAQTKAFHGWYPRSMQKGISGVGASPGLALGKIFILRHDDISITDQPISFASGKACLENALTKTKQKMASIINDITVRVGADSAAIFSAQMVLLEDENLIAQVCRFMAEGHGVAWSWDKAVRQFAGMFSKVDNPLLAARAVNLVDVGRRVLGEINPSYRSFFLNDIPRGVILVTDDLSPSDVAQLDCTKVQGLATAWGGPLSHTAILARTLSIPMVVAAGVDVLAIEPDIQAIIDGDNGFIYPDPTSEDVKEAEKRISIVVKKRDNGICVCRLPVQTTDGQRIRIMANVNYANQVPVALNLGAEGIGLMRTEFLFLESPHIPDEDAQFNVYRAMTAAVGDKPLIIRALDIGGDKQVQHLHLSKEDNPFLGVRGTRLLLRRRDLLVPQLRALYRAAKEGGDLWILFPMVMSVSEIVAMKKIAEEIRNDIGAPKLKFGIMIEVPAAAIMADVLSAHVDFFSIGTNDLTQYTMAVDRQNPYLVSEADSLDPAVLRMIYHTIQGAAKHRCWVSVCGGMAGDPFAAMILTGLGIHELSMISCDISSVKACLQAHSFEDMKVLAKKALQCETARAVRALSNDVR

SEQ ID NO: 46556 - protein, 453 aa, Arabidopsis thaliana
MNPTQKPDPVYDIVILGASGFTGKYVVREALKFLQTPSSPLKSLALAGRNPTRLTQSLEWAARPNPPPSSVAILTADTSDPDSLRRLCTQTKLILNCVGPFRIHGDPVVSACADSGCDYLDISGEPEFMERMEAKYHDRAEETGSLIVSACGFDSIPAELGLLFNAKQWVSPSVPNQIEAYLSLESDKKIAGNFGTYESAVLGVANAEKLKELRRSRPRRPRPTICGPPAKGPTLENQKTIGLWALKLPSADAVVVRRTLTTLTEKPHGLPGINESPEQIQKREAFWSSIKPAHFGVKITSKSLFGIFRYVTLGVSLGLLSKFSFGRWLLLKFPSVFSLGWFQKKGPSEEEVESATFKMWFIGRGYSEESLASQGETKPDLEIITRISGPEIGYITTPITLLQCGLIVLGQRESLVKGGVYTPGIVFGSTDIQQRLEDNGISFELISKIKTQG

SEQ ID NO: 46557 - protein, 130 aa, Haloarcula marismortui ATCC 43049
MTGNDPFANALSALNNAESVGHLEQTVSPASNEIGSVLEVFYDRGYIDGFSFVDDGKAGEFEVELKGAINECGPVKPRYSAGADEFEKWEKRFLPARDYGTLVVTTSHGIMSHYEAREQGVGGQVIAYVY

SEQ ID NO: 46558 - protein, 144 aa, Brassica napus
  misc_feature (12)..(12): Xaa can be any naturally occurring amino acid
  misc_feature (30)..(30): Xaa can be any naturally occurring amino acid
  misc_feature (46)..(47): Xaa can be any naturally occurring amino acid
  misc_feature (57)..(57): Xaa can be any naturally occurring amino acid
  misc_feature (63)..(63): Xaa can be any naturally occurring amino acid
  misc_feature (65)..(65): Xaa can be any naturally occurring amino acid
  misc_feature (75)..(75): Xaa can be any naturally occurring amino acid
  misc_feature (88)..(88): Xaa can be any naturally occurring amino acid
  misc_feature (96)..(96): Xaa can be any naturally occurring amino acid
  misc_feature (109)..(110): Xaa can be any naturally occurring amino acid
  misc_feature (121)..(121): Xaa can be any naturally occurring amino acid
  misc_feature (128)..(128): Xaa can be any naturally occurring amino acid
NGSSMLSSAAVXTSPAQATMVAPFTGLKSXSAFPGARKGNNDITSXXSNGGKVICMXVWPPVXKXKFETLSYLPXLTEGELGKEVDYXLLRNKWIXPCGEFEIEHGFVXXGAWKHPPDTNXGRYWTMXEFLRDGLCSRGSQKQN

SEQ ID NO: 46559 - protein, 105 aa, Zea mays
IRLEGSRKQLLLLLLEGEVISEKYVLEYGTDCLEMRVGAIERSGERVLVIDDLVATGGTLCAAIRLLERAGADVVECACVIGLPKFKDLYKLNGKPVYVLVESRE

SEQ ID NO: 46560 - protein, 302 aa, Gloeobacter violaceus PCC 7421
RIGRNFLRCWLGRKQSDFEVVAINDTSDPNTNAHLLKYDSMLGQFSGEVSADENSLTANGHTIKCFSDRNPLNLPWKDWGVDLVIESTGVFTSRDGASKHLAAGAKKVLITAPGKNDDGTFVMGVNDHNYDPEKHTIISNASCTTNCLAPVAKVLHENFKIVKGTMTTIHSYTGDQRLLDASHRDWRRARAAALSIVPTSTGAAKAIGLVLPELKGKLDGLAFRVPTPNVSVVDLVVEVEKPTLVEQVNHVLKEASENELKGILAFSEIPLVSIDYRITDVSSIVDAQLTMVLKDNLVKVIS

SEQ ID NO: 46561 - protein, 120 aa, Capsella bursa-pastoris
MASKTLILLGLFAILLVVSEVSAARESGMVKPESEETVQPEGYGGHGGHGGHGGHGGHGGHGHGGGGHGLDGYHGGHGGHGGGYNGGGGHGGHGGGYNGGGHHGGGGHGLNEPVQTQPGV

SEQ ID NO: 46562 - protein, 156 aa, Clostridium thermocellum
  misc_feature (1)..(1): Xaa can be any naturally occurring amino acid
  misc_feature (31)..(31): Xaa can be any naturally occurring amino acid
  misc_feature (113)..(113): Xaa can be any naturally occurring amino acid
XGSSHHHHHHSSGLVPRGSQSTSLYKKAGLXYIEVVKTNKAPEAIGPYSQAIVTGSFVYTSGQIPINPQTGEVVDGGIEEQAKQVLENLKNVLEAAGSSLNKVVKTTVFIKDXDSFAKVNEVYAKYFSEPYPARSCVEVSKLPKGVLIEIEAVAIK

SEQ ID NO: 46563 - protein, 131 aa, Hordeum bulbosum
MGGCVGKDRSIVEDKLDFKGGNVHVITTKEDWDQKVAEANKDGKIVVANFSASWCGPCRVIAPVYAEMSKTYPQLMFLTIDVDDLMDFGSTWDIRATPTFFFLKNGQQIDKLVGANKPELEKKVQALGDGS

SEQ ID NO: 46564 - protein, 436 aa, Saccharopolyspora spinosa
MASPNPLRALDEVWRDTYYRRTARSRKANEAAEKFVAKGQRARFNSGMPYPVYIERGAGSHFTDLDGNDFLDCNAGWNAAFLGRGNPTVSATVQEAMAKLGAPGGAMHPSLIRDEFAELLCERVPGAERVIFAPSGSEANTYALRLARSFTGKQKVIRMAGGFHGQHDALLGAQSSKAGTASTAQDNVITVPFNDLDAARSALAEHAGSVAALITEPMMTIPGAVHQRDQFLAGLRAATRQHHVVFVLDEVITGCRFAVGGASEFYDFAAPDLTVMGKMLGGGLPTAAVVGRADIIEQPISASNTHAQNPVTLAAAVAAMRVTEADGYARVAKMGDRLRRELRAVTDELTTPVQVTGDGPCVGIHFVDEEVVDFATAERADHSLWQLLCLGIASHGLGLSSRTFGPTLAWTESDLDVAVKGFSSTLEAISTACASN

SEQ ID NO: 46565 - protein, 403 aa, Saccharopolyspora spinosa
MITKVSNHSEDAASLTERARNVLPGGITRSTVYVPPHPPYAATGSGALVQDVSGHVLVDCNNNYTSLIHGHSSRQEIVEAAVSATRSGTAFGLPTRHEVDFAEYLAARTGVEKWRFCNSGTEAVLMMLRAARAFTQRDTIIRFAGSYHGTGDEVVDPKAAGVPKWVEESVLVVPQGDLDALKDALREHGNRVAAVLIDLMPNRAGLNPATREFVQELRALTRRYGVLLAIDEVISFRLSWGGFHQHYGVEPDLISTGKIIGGGFPVGAVGGKAGFLREFDPARAGAVMWGGTFSANPVTMVAGLTALRLFDQDAISALNAKGESMRGDLEAAGVRVNGFGSLLRIMTSDTKALWWSLYERGVLAGSNGLLALSTAMNDKHLSHVIEAVAEGARNVGDTGTPEQ

SEQ ID NO: 46566 - protein, 512 aa, Mycobacterium avium 104
MTDVVTHTETAPTPAAKAAKPVHTRAVIIGTGFSGLGMAIALQKQGVGFVILEKADDIGGTWRDNSYPGCACDIPSHLYSFSFEPKPDWKNPFSYQPEIWDYLKGVTEKYGLRRYIEFNSLVDRAHWDDDEHRWHVFTTDGREYVAQFLISGAGALHIPSLPDIEGRDEFAGPAFHSAEWDHTVDLTGKRVAVIGTGASAIQIVPEIVGQVAELQLYQRTPPWVVPRSNPEIPPAVRAAMENVPGLRALVRLAIYWGQEALAFGMTKRPNLLKVIEAYAKYNIRRSVKDKELRRKLTPHYRIGCKRILNSSTYYGAVADPKTELVTDHIARITPDGIVTADGTHRPVDVIVYATGFHVTDSYTYVQIKGLHGEDLVDRWNREGIGAHRGITVADVPNLFFLLGPNTGLGHNSVVFMIESQIRYVADAIATCDKLGAQALAPTRAAQDRFNDELQRRLGPSVWNSGGCSSWYLDEHGKNTVLWGGYTWEYWRATRAVKPEEYQFYGIGSRAGV

SEQ ID NO: 46567 - protein, 476 aa, Gibberella zeae PH-1
MLSTQLQHSQASRQAAKAATLGLVRTLSSSESLFRTPATIRTSYSAPQQHRIFSSTPNNRLRDFFPVKETPHIQTTKPAWPHEGYTYEEMMAVEPAHREPKTIGDKTAWKIVRVARYCMDKATGMDRDQKSDKSKPTTSIVAQKPLTEAQWLIRFIFLESVAGVPGMVGGMLRHLGSLRRMKRDNGWIETLLEESYNERMHLLTFMKMCEPGWFMKMMIIGAQGVFFNSLFVSYLISPKIVHRFVGYLEEEAVHTYTRCIKEIEDGNLPKWSDPKFEIPDIAIQYWKMPKEHRTMKDLILYIRADEATHRGVNHTLGNLNQNEDPNPFVSEFKDQYKYSSSSDAYFLRYGPRHPKEKLANINVNAKTKICLVRIFKHQRNHSVVTNREQKAGDRDKGTGAGVVPIARKSSSVNFPITGNEKSTASECGIRSWAAYYRVIERVTETHARFDVIQLVPCIRFLSITTYHEQLYSYCGL

SEQ ID NO: 46568 - protein, 148 aa, Arabidopsis thaliana
MPSSTFSGTVSTPKLSVAVDMGNPFLNLTVDAFLKIGAVGVTKSLAEDTYKAIEKGSLSKSTLEHALKKLCKEGVYWGAAGGVYIGTEYGIERIRGSRDWKNAMLAGAATGAVLSAVGKKGKDTIVIDAILGGALATASQFVNNHYFY

SEQ ID NO: 46569 - protein, 180 aa, Quercus robur
MAEIRDQYGNPIQLTDEHGNPEQLTDEHGHPMHLTGVATTKIHDEPDRDTTEGTLASTAVGVGGAKEHDQQLDQQKQQHELEVSRTSSSSSGSSEDDGQGEIEGQGGEVRRRKKKGLKEKIKEKLTCGKSKEEQSQTESFTSTATTTISTGATSPGAQPEHEKKSVIEKIKEKLPGHHSH

SEQ ID NO: 46570 - protein, 337 aa, Rhodopseudomonas palustris CGA009
MALSKNHTKTPTMSEQAAAAIPSALRTLEAEASGVTALATALQSDLGVRFAATIDLIQNAKGRLIITGLGKSGHIGRKIAATFASTGTPAFFVHASEASHGDLGMITADDIILAMSWSGEQPEMKNLINYAKRFKIALVAMTSDSTSTLATAADVSLTLPKAREACPHNLAPTTSSLMMLALGDALAIALLESRGFTPGDFSVLHPGGKLGAMLKYARDLMHTGEAIPLKPLGTRMSDALVEMSAKGFGCVGIIDSNGQIAGIVTDGDLRRNMRSDLMTATVDEVMTRNPKTISPNLLAGQALELLNSSKITALLVAEGKKPLGIVHLHDLLRAGVA

SEQ ID NO: 46571 - protein, 438 aa, Gibberella zeae PH-1
MAIKKVFARSVYDSRGNPTVEVDVVTETGLHRAIVPSGASTGQHEACELRDGDKSKWNGKGVTKAVENVNTVIAPALIEKNLDVKDQSAVDAFLNELDGTTNKTKLGANAILGVSLAVAKAGAAEKGVPLYAHVSDLAGTKKPYVLPVPFMNVLNGGSHAGGRLAFQEFMIVPTDAPTFSEALRQGAEVYQALKGLAKKRYGQSAGNVGDEGGVAPDIQTAEEALELITDAIEQAGYTGQMKIAMDVASSEFYKESEKKYDLDFKNPESDPTKWITYEELANMYSELCKKYPIVSIEDPFAEDDWEAWSYFSKTQDIQVVGDDLTVTNPLRIKKAIELKSCNALLLKVNQIGTLTESIQAAKDSYADGWGVMVSHRSGETEDVTIADIAVGLRAGEIKTGAPARSERLAKLNQILRIEEELGDQAIYPGKDFRKSVNL

SEQ ID NO: 46572 - protein, 355 aa, Aspergillus oryzae
MKTYNIASIPADGIGPEVISAGVTVLNALAEKLNTFKLDFTHYDWSSETYKTTGKYIPDGGLEDLKRHDAILFGAVGAPDVPDHISLWGLRLSICQPLQQYANVRPTRVLRGTQSPLRNCPPGKLDWVIVRENSEGEYAGQGGRSHRGFPWEVATETAIFSRHGVERIMRFAFETAAKRPRKLLTVVTKSNAQRNGMVLWDEVATEVGKEFPEVQVDKMLVDAMTTRMVLKPETLDTIVASNLHADILSDLAAALAGSIGIAPTSNLDPTRQHPSMFEPIHGSAFDITGKGIANPVATFWTAAEMLAWLGEETAAQKLMECVENVCERGILTADLGGKATTKEVTEAMVGEIQRL

SEQ ID NO: 46573 - protein, 444 aa, Candida albicans SC5314
MAQTPQSIDFEKIKESSDGTLKGMLTQGFNEIVVNNPYFAAGGGLMLLGTGLALARSGVVKGSGFIYRQLLVDLEIPSKDKSYLWFLEWMSQYKHRTSRHLSVETNVITHDNGAITTNFSLVPGPGKHLIRYKGAYMLVNRERSGKLLDMTSGTPFETVTLTTLYRDRKLFNDLLSEAKSLALKAREGKTVIFTSWGPEWRPFGQPRSKRLLGSVILDEGIAENIVNDVKDFLTSGEWYHKRGIPYRRGYLLYGPPGSGKTSFIQALAGELDYNICILNLSENNLTDDRLNHLMNHIPNRSILLLEDVDAAFNKREQTNDQGFNNGVTFSGLLNALDGVASAEECITFMTTNHPEKLDPALLRPGRVDYKVMIDNATEHQVKRMFLRFYENEEELCEKFLAKYRKLNMQHVSTAQLQGLFVYNKRDPEAAIAMIETLQNPNTVF

SEQ ID NO: 46574 - protein, 491 aa, Aspergillus oryzae
MATEYKLPFELNDPSLLHFDSFVGNSWVQAKNPGTDIPWASCPTNSAEDVPSAVETAHAAFEQYKKSNPRQRAQWLLKWDTLIREAKPDLAKILTHETGKPLAESYGEIDYATGFTWWFAGEAERIHGSISVPSAPNRRVFTVKQPIGVAAALVPWNFPIAMVLRKAGAAFAAGCTMIVKPSPETPLTALVLAHLAQKAGFPAGVFNVLTTDLENTPSLSEALCKHPLVKKVTFTGSTRVGKLIASHCAHGLKKLTLELGGNCPFLVFDDANLDQALDQLMALKWRHAGQACITANRVYVQAGIYDRFAQLLKERTQKLVVGHGAKEGTTMGPVTTPRSIDKALSQVEDARRLGADVILGGNKVTDTKGYFFEPTILTGMTKDMLVSREETFAPIAALYKFETEEEAVQLANDTSMGLASYAFTKNIDRMWRLLENLDAGMIGMNTGNSSAAESPFGGIKESGYGKESGKEVAVNEYLVTKTGTLTIEGQY

SEQ ID NO: 46575 - protein, 372 aa, Candida albicans SC5314
MKKSTGPTQTRQVVFNISQNFKVLKILGEGAYGIVALAVHLPTETKVAIKKIEPFERPLFCLRTLREIKLLTKFKNHDNIVRLYDVQKPMNYDSFNEVYLIQEYMPSDLHNIIHTHLLSDQHVQYFIYQILKGLKMIHSARVIHRDLKPSNILVNEKCDLKICDFGLARLDTKHYNFDEAPRISMLTEYVATRWYRAPEIMLSASNYSTAIDLWSVGCILAELLTYRALFPGSDYINQLKLIFEVLGTPTDEDLQIIKSERAQKFIRSLPTKVKIDLSEFINNHPYRNIKHRGRDQVNPLAIDLLEKLLVFDPAKRITVQEALEHPYLNSYHEQLDEPVTSPIPIEEFDFDIDKKNLDTNDLKKQIFEIVMS

SEQ ID NO: 46576 - protein, 208 aa, Saccharopolyspora spinosa
MGIGGPVGVGKTALVAAICEQLRERLRLGVVTNDIYTTEDADYLKNRGALPPERIVAVETGACPHSAVRDDISANLEAAEQLARKARAQDGEPLDLLLIESGGDNLTMTFSRGLVDAWIFVLDVAGGDDVPRKGGLGVTSADLLVINKVDLAPYVGADPARMIHDGQARREGRPTVMNSLQQDPAASHVVDWIRHLLDGRQPARSGRS

SEQ ID NO: 46577 - protein, 130 aa, Synechocystis sp. PCC 6803
MTMKIIQTAQAPAPVGPYNQAIAANGFLFTAGQIALDPQTMTIMGEGNVEVQAKQVLTNLGAVLQEAGCGWENVVKTTVFLKDMNDFAAVNAIYGQYFDEATAPARSCVEVARLPKDVLVEIDCVAVLPT

SEQ ID NO: 46578 - protein, 57 aa, Medicago truncatula
MVDFGDEEYKQMLCVDGAVIEKPVNLKPGEEWTGRIQLSVVRSSFCSDRLGLDRSGI

SEQ ID NO: 46579 - protein, 428 aa, Synechocystis sp. PCC 6803
MAGSLFADASKRLEKALKYVAISDDAGERLKYPKTSLSVSIPVRMDDGSLKIFPGYRVRYDDTRGPGKGGVRYHPNVTMDEVQSLAFWMTFKCALLNLPFGGAKGGITLNPKELSRAELERLSRGYIEAIADFIGPDIDILAPDVYTNEMMMGWMMDQYSIIRRKISPAVVTGKPVTMGGSQGRNTATGTGAFYIMQGMLPKFDQYPENTTVAVQGFGNAGMVVAECLYQDGYKVVAISDSQGGIYNEQGIDIPAVIDYKQRHRTLAGMYCDQAICDLGENQQISNAELLALDVDVLIPAALENQITRDNADQVRARYIFEVANGPTTTAADDILASKGIYVFPDILVNAGGVTVSYFEWVQNRSGLYWSAKEVNDRLKEKMVEEAEHVWNITQELDVNVRTAAYIHALNRLSEAMDAKGTRDYYQDS

SEQ ID NO: 46580 - protein, 195 aa, Medicago truncatula
MGHSAAVWDFRAATEFTKDWNGIDQVVLRTPQGASARVSLHGAQVTSWRNEQGEELLFTSCKTLSKAPKAIRGGIPICFPQFGNCGSLELHGFARNKMWAIDENPPPLPPNDSSGKSFVDLLLRLSEEDVKCWPHSFEFRLRVSLTTDGDLTLISRVRNINAKPFSFSFAYHTYLLVSDIRYGYYFLVLDNHLFF

SEQ ID NO: 46581 - protein, 389 aa, Arabidopsis thaliana
MEQQEEKRKIKAYQRKSKRSKSGSSSIPLDLVSEILLRLPEKSVARFRCVSKPWSSITTEPYFINLLTTRSPRLLLCFKANEKFFVSSIPQHRQTFETWNKSHSYSQLIDRYHMEFSEEMNYFPPTESVNGLICFQESARLIVWNPSTRQLLILPKPNGNSNDLTIFLGYDPVEGKHKVMCMEFSATYDTCRVLTLGSAQKLWRTVKTHNKHRSDYYDSGRCINGVVYHIAYVKDMCVWVLMSFDVRSEIFDMIELPSSDVHKDVLIDYNGRLACVGREIIEKNGIRLWILEKHNKWSSKDFLAPLVHIDKSLSTNKFLLKGFTHAGEIIYVESMFHKSAKIFFYDPVRNTSRRFELKGFTDDEFVLSNEHGYTLHVFPNHVESQISFT

SEQ ID NO: 46582 - protein, 422 aa, Wolinella succinogenes DSM 1740
MIYIDNIVAQEVMDSRGNPTVKATVTLSDGNSASAIVPSGASTGKREALELRDGDSRYLGKGVLQACENVNTKLSEELIGLSPFDQSEIDAIIQELDGTENFANIGANAALGVSMAVARSAAKSLNIPLYRYLGGANALTLPVPMLNIINGGSHADNTVDFQEYMIMPLGFENFSESLRASAEVYHHLKKILKDSKHITSIGDEGGFAPNLKTNEEPIQIIIQAIEKAGYRPGEEIALALDVASSEFVNEQGLYHLEGEGRTLSSEELVGYYESLIAKYPIVSIEDGLSEDDWKGWKYLTERLGGKVQLVGDDLFVTNAKILQEGISQGIANAILIKPNQIGTVSQTMQTVRLAQRNHYRCVMSHRSGESEDSFIADFAVALNTGEIKTGSTARSERIAKYNRLLAIESELCRSEYLGRSLF

SEQ ID NO: 46583 - protein, 122 aa, Arabidopsis thaliana
  misc_feature (55)..(55): Xaa can be any naturally occurring amino acid
  misc_feature (106)..(106): Xaa can be any naturally occurring amino acid
  misc_feature (108)..(108): Xaa can be any naturally occurring amino acid
RTHIISSSFLSSATILPSPRHSTMGAPFNKLNSSPAFPTTHKANNDITSITSNYXRVNCMHVWPPILKKKSETLSYLPDLTDSELANEVDYLILNKWIPCVEFYLXTXFVYREHCNSPLFYY

SEQ ID NO: 46584 - protein, 125 aa, Oryza sativa
MEAVKPRWYERTLVLAVQRVFFNAYFLGYLLSPKLAHRVVGYLEEEAIHPYTEYLKDIEAGKIENVPAPPIAIDYWRLPAGATLKDVVVVVRANEAHHRDVNHFASDVHFQGMDLKDTPAPLDYH

SEQ ID NO: 46585 - protein, 620 aa, Arabidopsis thaliana
MAVFKAPLKGEFHGARKMEGKQYKHHLLQQQSTGRRRVFVQTDTGCVLGVELDRNDNVHTVKKRLQIAFNFPTEESSLTFGDMVLKNDLSAVRNDSPLLLKRNLMHRSSSTPCLSPTGNDLQRKDRSGPIEILSHSPCFLSLKQTANDIVKAMKMGVEPIPVNGGLGGAYYFRDEKGQSVAIVKPTDEEPFAPNNPKGFVGKALGQPGLKPSVRVGETGFREVAAYLLDYDHFANVPPTALVKITHSVFNVNDGMDGNKSREKKKLVSSKIASFQKFVPHDFDASDHGTSSFPVASVHRIGILDIRILNTDRHGGNLLVKKLDDGGVGRFGQVELIPIDHGLCLPETLEDPYFEWIHWPQASIPFSEEELDYIQSLDPVKDCEMLRRELPMIREACLRVLVLCTVFLKEAAVFGLCLAEIGEMMTREFRAGEEEPSELEMLCIEAKRLTTEQDVLSPKSDGEGETEFQFDIDYNELDSVYGSETETDEFFAKNPFSNGRSSLGELKESIAEEEEDDEEEAKLTLSLSKLSTSMKNNLSNTMGSGYLKPPKDNQTDKALVSHKSANVQLPLSVNFVKLADMKEVEWVVFLERFQELLYSAFAERKTMTLRNTQRLGTSCKF

SEQ ID NO: 46586 - protein, 496 aa, Burkholderia pseudomallei K96243
MTAFDSSLVPSGDILIGGEWRRGRGATTPSFYPADGSLNTEIHMADAADAREAVQAADAAWRRADWAGLKPHQRADVLYRIADLIHAHREALAQLQRRDNGKPINETRALVASAANTFRYFAACAQTLDEALTPSRGDYLSMSVHEPLGVVAAITPWNSPIASDAQKLGPALAAGNAVVLKPAEVTPLASLALARLCEQAGVPRGVISVLPGKGSVIGDALVRDPLVKKVSFTGGTEVGRGIARLAAEKLMPLSLELGGKSPTIVFDDAELDHAVNGVLYGIFSSSGESCIAGSRLFVQRSIYGAFVARLVEAARKLRVGDPASERTQMGPLITARHRDTVERYVALGRDEGARVLCGGERPTGEGRDAGFFYLPTILDGLSNHARICREEIFGPVLVALPFDDEAALVADANDSVFGLAAGIWTRDYKRAWRVARALDAGTVWINTYKQFSISTPFSGRKESGMGREKGSLGIREYMQQKSLYWGLNDSPLPWAN

SEQ ID NO: 46587 - protein, 176 aa, Triticum aestivum
MATAEGKNKIIKLKSSDGKEFEVEQAVAMESQMIRHMIEDEYTDNGLLLRNVNSKILSKVIEYCNKHVQAKAADTSDFGGGARPLGATSAVPAASAEDLKNWDANFVKVDTATIFDLALAANHLNIRGLLDLTCQTVADMMTGKTPEEIRKIFNINEKLRPGEEEKIRRENQWAFE

SEQ ID NO: 46588 - protein, 331 aa, Oceanobacter sp. RED65
MAAFGTVFMPKMALATYENQAWANASIVPSDKLELHPGAHVLHYSSTCFEGLKAFKHEDGSVNVFRMDANIERMAQSTDLLFLPSIDKQQLGDMIKEIVALYADEVPAPPGSMYIRPTHIGTEPSIGKAAVSSETSLLYVLLSPVGDYFAGGVKPLRLLLEENGMRCAPHMGMIKSGGNYASALGPIARAKNECQADQVLFCPNGDVQETGAANFILIDGNEIITKGLDSSFLHGITRDSILTIARDLGMTVTERDFTVNELIERAQKPGTEAALSGTAAVLTPVGTLIHNGEEITVGSGEPGATTLKLRQALNDIQWGKAEDKFGWLHKI

SEQ ID NO: 46589 - protein, 637 aa, Debaryomyces hansenii CBS767
MLKANNFNTRIAKTTKLGKIQIRSNSNGVNNSNSSIHTHTIKTPVGIKAAIASLKPKTTRLSIEGPIECDLQGFALLNAPGFNKGSAFSKEERQAFGLEGLLPSRINSLDEQVERAYRQFSYLKTPLAKNDFCTSMRIQNKVLYYELVRRHIREMIPIIYTPTEGDAIAAYSHRFRKPEGCFLDITEPDMIDKRLSAFGEDKDIDYIVVSDGEGILGIGDQGVGGVRIAIAKLGLMTLCGGVHPGRVLPIVLDVGTNNQELLHDELYMGNKFPRVRGKEYWDFIDKFINAVKQRFPNAVLHYEDFGVSTGRKMLQKYRESLPSFNDDIQGTGAVVMASMTAALQFSDRNLLDSKVLIYGAGSAGLGIADQIVNHMVSHGATEEQAVASIHCMDRRGLLLKSFDEMSDAQTKYADVDSEWEGVDTRNLVEVIRHVKPTVLVGCSTQAGAFTEQVIKEMYNHNKQPIVFPLSNPTRLHEAFPIDIMKWTDNKALIATGSPFEPVNGFAISENNNCFTFPGIGLGAVLSRCTTISDTMVSAAVDQLALLSPKMENPKNGLLPRLEQIDEVSAKVATAVILQSLKEGTARVESEEKPDGGFVEVPKDFNKCLKWVQSQMWKPIYRPLVKVKHVPEVHTYQH

SEQ ID NO: 46590 - protein, 563 aa, Oryza sativa
MAAAAAAMATATSATAAPPLRIRDAARRTRRRGHVRCAVASGAAEAPAAPGARVSADCVVVGGGISGLCTAQALATKHGVGDVLVTEARARPGGNITTAERAGEGYLWEEGPNSFQPSDPVLTMAVDSGLKDDLVFGDPNAPRFVLWEGKLRPVPSKPGDLPFFDLMSIPGKLRAGLGALGVRAPPPVCVLSPLCILDSLVKFDCAERFRRRFQGREESVEDFVRRNLGAEVFERLIEPFCSGVYAGDPSKLSMKAAFGKVWRLEDTGGSIIGGTIKTIQERGKNPKPPRDPRLPTPKGQTVASFRKGLTMLPDAITSRLGSKVKLSWKLTSITKSDNKGYALVYETPEGVVSVQAKTVVMTIPSYVASDILRPLSSDAADALSIFYYPPVAAVTVSYPKEAIRKECLIDGELQGFGQLHPRSQGVETLGTIYSSSLFPNRAPAGRVLLLNYIGGSTNTGIVSKTESELVEAVDRDLRKMLINPKAVDPLVLGVRVWPQAIPQFLIGHLDHLEAAKSALGKGGYDGLFLGGNYVAGVALGRCVEGAYESASQISDYLTKYAYK

SEQ ID NO: 46591 - protein, 115 aa, Bacillus clausii KSM-K16
MSNLITEITSEQLRTDHPDFRPGDTLSIHVKVVEGTRERIQVFEGVVIKRRGSGISETFTARKISYGVGVERTFPLHSPKIDKIEVKRYGKVRRAKLYYLRSLRGKKARIKEIRR

SEQ ID NO: 46592 - protein, 496 aa, Arabidopsis thaliana
MAGTGLFAEILDGEVYKYYADGEWKTSSSGKSVAIINPATRKTQYKVQACTQEEVNAVMELAKSAQKSWAKTPLWKRAELLHKAAAILKDNKAPMAESLVKEIAKPAKDSVTEVVRSGDLISYCAEEGVRILGEGKFLLSDSFPGNDRTKYCLTSKIPLGVVLAIPPFNYPVNLAVSKIAPALIAGNSLVLKPPTQGAVSCLHMVHCFHLAGFPKGLISCITGKGSEIGDFLTMHPAVNCISFTGGDTGISISKKAGMIPLQMELGGKDACIVLDDADLDLVASNIIKGGFSYSGQRCTAVKVVLVMESVADELVEKEKAKVAKLTVGPPEENSDITAVVSESSANFIEGLVMDAKEKGATFCQEYKREGNLIWPLLLDNVRPDMRIAWEEPFGPVVPVLRINSVEEGINHCNASNFGLQGCVFTKDINKAILISDAMETGTVQINSAPARGPDHFPFQGLKDSGIGSQGVTNSINLMTKVKTTVINLPTPSYSMG

SEQ ID NO: 46593 - protein, 476 aa, Saccharopolyspora spinosa
MPAQAAVIDGKLVEGPETLDVLDPSTGTLLDRTLRGTGEHVDAAVAAARAASREWAHTPYSERSAILRRIGELIRRDRGEFALLESQDTGKPLAQACADTDVAARYFEYYANTMEAFFGHSLPPNGDFVAYTRHVPFGVTGHIIPWNYPLQIGCRTIAPAIAVGNCAVVKPAEEAPLSVLKVARTALEAGLPAGVLNVVPGLGAQAGAALAGHAGIDHLSFTGSVPVGAAVAHAAAENVIPVVLELGGKSPNIVFPDADLDAAIPVIVKSMLQNAGQTCSAGSRLLVHEEVRDEVLARIDEALRGVRIGPGPQDLDLGPLISAKQRDRVTQMVQRAADSGARQLGGPGQVELPEGGFYFPPTVFTDVDPAQEIAQEEVFGPVLAAMSFGTVDEAIQLANGTQYGLIAAAWTRNLDVAHVMAEEIRAGQVYLNTYGGGGGVEYTFGGFGKSGYGREKGFEALKGFCQTKTIVTKVTR

SEQ ID NO: 46594 - protein, 306 aa, Sporothrix schenckii
MDGKRQLNSFQQLEKLGEGTYATVFKGRNRHTGEFVALKEIHLDSEEGTPSTAIREISLMKELKHENIVALHDVIHTESKLMLVFEYMDGDLKKYMDTNGERGALKPMLIKSFMYQLLKGIDFCHQNRVLHRDLKPQNLLINGKGQLKLGDFGLARAFGIPVNTFSNEVVTLWYRAPDVLLGSRTYNTSIDIWSVGCIMAEMYTGRPLFPGTTNEDQMLRIFRIMGTPTEHNWPGISQFPEYKATAPRYATQDLRQILPQIDATGIDLLQRLLQLRPELRISAHDALQHPWFHDILQYQHCQQAAG

SEQ ID NO: 46595 - protein, 319 aa, Lactobacillus sakei subsp. sakei 23K
MKRIGILTSGGDAPGMNAAVRAVARKAMHEGLEVYGINYGYAGLVAGDIFKMDPITVGDKIQRGGTFLYSARYPEFAQVEGQLKGIEQLNKFGIEALVVIGGDGSYHGALRLTEHGYNAIGLPGTIDNDIPFTDQTIGFDTAVNTVLESIDRIRDTAASHERTFVVEVMGRGAGDIALWAGVAGGAQDIIIPERDFDVKAVAEKLRASREHGQKHAIIVLAEGVMHADEFSEKLSEYGDFHLRSTVLGHVVRGGSPTASDRVLASRLGSKAVELLLEGKGGVALGIEKNEIIAHDMLDLFNHKHHAMLDLYDLNEDLAY

SEQ ID NO: 46596 - protein, 424 aa, Oryza sativa
MQLLGAPPPVLPSGSAAPTNTPATAAAEEEEEESLLEGHKAAREWAQVHGQHEGRTWAVGSGAAATLGQSNGRDAPARAEDGSFGLVLLLFVPHLLLHARLWLLSPTFASQPQQFSQVTSAAESRRVELDLDATTSFFGVYDGHGGAEVAMYCAKRFHTMLLEDVDYINNLPNAITSVCFRLDDDLQRSNEWRESLNPCANRNCLTNICANLHHFTEDYVPPSYEGSTACVVIIRGNQIIVGNVGDSRCVLSKNGQAISLSFDHKPHHEAERERIQRAGGHVFLQRILGMLATSRAIGDFAYKQNRNMPPSQQMVTCVPDIRVENITDDTEFLVIASDGVWDGMRNNNVVQFVRQELRPGEENLRETCEKLVGHCLHSNDNATAILVKFKPIEEDPDEVASARDEHQHNPEGGDEKLDINNDND

SEQ ID NO: 46597 - protein, 151 aa, Xanthomonas oryzae pv. oryzae KACC10331
MRAGIGEAGFGIRKAVLARTVSCYQSRITNFQSRTMTDTIFGKIIRREIPATIVYEDDEVLGFQDIAPQAPVHVLFIPKQHAIPTLDDVPPEQALLVGQLAIAAAAYARAQGLAQDGYRIVMNCREHAGQTVFHIHLHLLAGAPLGRFGTP

SEQ ID NO: 46598 - protein, 612 aa, Arabidopsis thaliana
MCIAKVISQKLSNVRVIEGPTVQEGIRKLADVSCVIYVDVDYEDSEAVLDVPSLTRHFPVKCLPHAYASKQWLPTFVNQARKFREMSGILRALSLRRFSQKQETGACLLPEIRRRTNMKFELVFIPYPGIGHLRSTVEMAKLLVDRETRLSISVIILPFISEGEVGASDYIAALSASSNNRLRYEVISAVDQPTIEMTTIEIHMKNQEPKVRSTVAKLLEDYSSKPDSPKIAGFVLDMFCTSMVDVANEFGFPSYMFYTSSAGILSVTYHVQMLCDENKYDVSENDYADSEAVLNFPSLSRPYPVKCLPHALAANMWLPVFVNQARKFREMKGILVNTVAELEPYVLKFLSSSDTPPVYPVGPLLHLENQRDDSKDEKRLEIIRWLDQQPPSSVVFLCFGSMGGFGEEQVREIAIALERSGHRFLWSLRRASPNIFKELPGEFTNLEEVLPEGFFDRTKDIGKVIGWAPQVAVLANPAIGGFVTHCGWNSTLESLWFGVPTAAWPLYAEQKFNAFLMVEELGLAVEIRKYWRGEHLAGLPTATVTAEEIEKAIMCLMEQDSDVRKRVKDMSEKCHVALMDGGSSRTALQKFIEEVAKNIVSLDKEFEHVALK

SEQ ID NO: 46599 - protein, 189 aa, Triticum aestivum
MVLVLALGDLHIPHRAPDLPAKFKSMLVPGKIQHIICTGNLCIKEVHDYLKSLCPDLHITRGEYDEDARYPETKTVTIGQFKLGLCHGHQVVPWGDLDSLAMLQRQLDVDILVTGHTHQFKAYKHEGGVVINPGSGTGAHSSITYDVNPSFVLMDIDGLRVVVVYVYELIDGEVKVDKIDFKKTATMHG

SEQ ID NO: 46600 - protein, 416 aa, Oryza sativa
MAAGVDERWRMRRWWRPNTLVINIGDQLQLGDRLPVSHVAGRSPHTPQSSLHTRAAVVVVLSSSDVVVAVAVVNMAAEAEQQHQLLSTAVHDTMPGKYVRPESQRPRLDLVVSDARIPVVDLASPDRAAVVSAVGDACRTHGFFQVVNHGIDAALIASVMEVGREFFRLPAEEKAKLYSDDPAKKIRLSTSFNVRKETVHNWRDYLRLHCYPLHQFVPDWPSNPPSFKEIIGTYCTEVRELGFRLYEAISESLGLEGGYMRETLGEQEQHMAVNYYPQCPEPELTYGLPAHTDPNALTILLMDDQVAGLQVLNDGKWIAVNPQPGALVINIGDQLQALSNGKYRSVWHRAVVNSDRERMSVASFLCPCNSVELGPAKKLITDDSPAVYRNYTYDEYYKKFWSRNLDQEHCLELFRT

SEQ ID NO: 46601 - protein, 305 aa, Rhodopseudomonas palustris CGA009
METSLDATAEQPRGLWLPLITPFRDGELDAASLRRLIAHYARAPLDGLILGATTGEGLTLDEAELERLVMLTADALAASDRKLPVYLGLSGSDTRKLVKTLARTAHWPIDGVLIACPYYTRPSQRGLVLHFEAAADATARPILIYNIPYRTGVNLQNEAMLRLAERANIVGVKDCCADPAQTAELLRLRPPGFAVLTGEDALAFDALSRGCDGAILASAHLETEAFAAMMHRLQAGDRLGGATEWQRLADLPKLLFAEPSPAPVKYALWRRGLIDSPEVRLPMTPVSPTLAAAIDARMLPGLSAA

SEQ ID NO: 46602 - protein, 404 aa, Burkholderia pseudomallei K96243
MPRTVVVIGGGQAAGWVVKTLRDEGFAGRIVMIADEAHLPYERPALSKAVLAGEADIATVRVMQPDAFGALDVDAWQPERAASIDRARRVVRTASGREIEYDRLVIATGGTPRRLPDAIVGTAHLHYLRTLDEALALGEKLRASRRVLVIGGGWIGLEVAATARKLGVDALVVEGAPRLCARSVPGAVSDFLLDLHRANGVDVRLNASLASLDAHPDDARRVRATLAGGGVVDADFAVAGIGLALNTSLATEAGLHVDDGIVVDEYGATSDPAIFACGDVANHPNAWLKRRVRLESWANAQNQAIAAAKAVLGVRAPYAEIPWFWSDQYDVNLQILGDLPADARCIVRGELAAKRATLFFVADGALRGVIAINAARELKLARKWMNQGRAIDVAALADTAKALA

SEQ ID NO: 46603 - protein, 468 aa, Burkholderia pseudomallei K96243
MSTLETAIAGAPAADTAAGAATPGAIIARIERLPANAMQIRARVLIGTATFFDGFDVITIAATLPLLIHKWGLSPNQIGMLIASGAIGQLLGAFLFPALAQKHGRVRAIAWSSAVIGVTSIACGFASTFETFVLLRIVQGLGLGGELPVAATYINEITRAHGRGRFVLLYEIVFPIGLLASMAFGAWLVPRFGWEVMYFIGGMPLLLALVLTRLVPESPRWLASRGRLDEAGRALHAFEASVKEPLPPVAHAGEFDTLVLSHPKRRMVDLFGPAYLKRTLAVATLWATCGFIQYGLSTWLPTIYKNFYHAPLQLALNLAVIGSVMGVAGSLVSALAVDVVGRKPVIVWSFVLCALSLVFAGVYHASSVYVVAAFCSLALGLMASGFITSYVYTPEQYPTSIRAAGCGLGSAWLKIASFVAPMVVPRAIVGGDLSPAFYLLAAVPLIAALTVHSVGIETKGQVLEKLEA

SEQ ID NO: 46604 - protein, 608 aa, Bartonella henselae str. Houston-1
MQLRNIAIIAHVDHGKTTLVDELLKQSGNFRDNQRTSARMMDSNDIEKERGITILAKVTSVVWKDTRINIVDTPGHADFGGEVERILNMVDGAIVLVDAAEGPMPQTKFVVGKALKVGLRPIVAINKIDRADARADEVINEVFDLFAALDANDEQLDFPILYGSGRDGWMAETPEGPKDQGLSPLFDLVTRHVPSPSIAEGPFRMIGTILEADPFLGRIITGRIHSGSIKPNQNVKVLRQDGKVLETGRISKILAFRGLERQPIEESIAGDIVAIAGLQKGTVADTFCDPAVNEPLTAQPIDPPTVTMSFLVNDSPLAGTEGDKVTSRVIRDRLLKEAEGNVALKIEESTDKDSFYVSGRGELQLAVLIENMRREGFELSVSRPRVVMQKDENGTTLEPIEEVVIDVDEEYSGTVVQKMSERKGEMIELRPSGGNRVRLVFYAPTRGLIGYQSELLTDTRGTAIMNRLFHAYEPYKGDIGGRVNGVMISNDNGESVAYALFNLEDRGPMIIDAGVKVYQGMIIGIHSRDNDLEVNVLKAKKLTNMRASGKDEAVKLTPPVKMTLERALSWIQDDELVEVTPKNIRLRKLYLDPNERKRFEKTRSSLSN

SEQ ID NO: 46605 - protein, 119 aa, Oceanobacter sp. RED65
MSKPKPSDPTIFSKIIGREIPADIVYEDDECLAFKDINPCAPVHILVIPKKPIPRLCDASKEDMVLLGHLNLVANQVAADAGVGDAFRLVVNNGEGACQSVFHLHYHVIGGRTLQWPPG

SEQ ID NO: 46606 - protein, 331 aa, Bartonella henselae str. Houston-1
MTAQSSHMLVLQSTVTSAFKTIASEKQGLEALEEALLGYLSSAFQAAVQTIRNANGHVVITGLGKSGHIGAKIAATLASTGTPAFFVHAAEANHGDLGMIGSDDVILALSWSGETSELSGIINHAARFRTPLIAMTSGEHSVLGRQADIVLLLPKIEEACPHGLAPTTSTIMQLAMGDALAVALLEMRGFTATDFKIYHPGGSLGASLKYVRDIMHQGESIPLVAQGTAMAKAMSVLVEKHFGCVGVVNQEGELIGIVTDGDLARNIHVNLSKFNVDELMTKDPKIVEPNTLVGAATAFINEHHIGAFFVVENKKPIGIVHFHDLLRIGAA

SEQ ID NO: 46607 - protein, 146 aa, Synechococcus elongatus PCC 6301
MTRTTGMTAVIRRLIWGMSLFAAIAPASWSFAQTTNAPAPAQADQSLTLFSDIQEANSKTGVVTARGNVVILYPARQLRATAAQAQYFSRERRIILTGNVFVQQEGGNSLRGETVTYLIETGKFVALPTPQGQVQSIYNLDSAESP

SEQ ID NO: 46608 - protein, 199 aa, Zea mays
  misc_feature (153)..(153): Xaa can be any naturally occurring amino acid
  misc_feature (167)..(167): Xaa can be any naturally occurring amino acid
MADVDEYRCFIGNLSWSTTDESLKDAFSKFGNLTEAKVVLDKFSGRSRGFGFVTFDEKQAMEDAIEGMNGLDLDGRNITVDKAQPQGPGRDRNGDRDYDRERGSRYERGRDYGGGRAPRGGGGWWWWWWVTAFKLWERPGHFARECPSGDGGXGDRYGGRDDRYGMXGGGGGGGRYGSDRGGDRYGGGDRYSRDRSGPY

SEQ ID NO: 46609 - protein, 384 aa, Synechocystis sp. PCC 6803
MGTKRIGILTSGGDCPGLNAVIRAVVKASALKGWEVYGIPYGTDGFVEVAHGKYQAEDLLLTKHGYALPGMLKGLDVLQFLSGSVLGSLSKGHPEQPAIAEAILKGYAILDLEALIVIGGDGSLDIIYDLAQKGNWHIIAIPKTIDNDVPFTDLAVGFSTAVDIVTQALYDLTFTAASHERIIIVQVMGRDAGHLTLHAGIAGGADIILIPEITPCLTSEIIRNCCYQLMNLRKSGRHFALIVISEGVHDQNNKKNKHIADYLAEEISETSQHLCDIKDPAFCDLISLDIRATTLGHLQRSGTPLSFDRLLATVFGIRAVELIEQEIYDQVVIWRSGKVEHADLKPIISIIKECHQENRCPFPVDRDGFMVKTAKSLGIYLGED

SEQ ID NO: 46610 - protein, 287 aa, Oryza sativa (indica cultivar-group)
MTGFGSPCGACKFLRRKCVRGCVFAPYFCHEQGAAHFAAIHKVFGASNVSKLLAHLPLADRPEAAVTISYEAQARLRDPIYGCVAHIFALQQQVRIVHSIDVSLVGVAGLLILVSRRVFEQVMTLQAQLASLKAAAAQGIHHQDVGATTKGGYMSAAATAADDQLGYGGYDQWCGSNGGGAPAASQPGAYSSNGGAGHGHDSITALLAAGSDYMQHSLYHAFEHSEGAGAVDDGHAAAAAFEAAAESSSCGMAASFAADESVWRSSSSGYQDCEDLQSVAYAYLNRS

SEQ ID NO: 46611 - protein, 429 aa, Xanthomonas axonopodis pv. citri str. 306
MSDLDQVTLNAGDKSVVLPVLKPTLGNDCVDISKLTKETGLFTYDSGFTATASCKSAITYIDGDNGVLLYRGYPIEQLAEKSSFLEVSYLLMNGELPTADEFKKFDHEVTHHTMMHESLKNFLGGFRHDAHPMAMLAGSVASLSAFYHDTLDLNDPEQRRQAAIRLIAKVPTLAAAAYRYSIGWPIRYPRNNLNYVDRFLHMMFEVPSEPLEINPVVAKALDLLFILHADHEQNASTSTVRLVGSTGANPYASVAAGITALWGPAHGGANEAVLKMLEEIGTADNVESAVAKAKDKNSSFRLMGFGHRVYKNFDPRAKIIREMTHKVLGELGVNDPLLEVALKLEEAALKDDYFVQRKLYPNVDFYSGIIYKALNIPVEMFTVMFAIARTAGWVSHWLEQQVDPEMKIGRPRQIYTGYDKRDYTDSAKR

SEQ ID NO: 46612 - protein, 126 aa, Xanthomonas axonopodis pv. citri str. 306
MSQIIHTDQAPAAIGPYSQAVRAGNTVYFSGQIPLDPATGEIVPGDIGAQARRAFDNLKAVAEAAGGSLDKIVRLGLYITDLGQFAAVNAVMQEYFQAPFPARSTIEVSGLPKGAGFEVDAVMVIE

SEQ ID NO: 46613 - protein, 486 aa, Mycobacterium sp. KMS
MINANLIINGREETSDRTIDVVSPADIRVLLGSVPDAAPGQVDEAVAAAAMAFPEWSSRPLEERQGALLAAAGTIHDMIEEYAPILSRENGKILEESHVDLEFASGICGYTAGISAEILADQQIRDTGGTTLIRRRPIGPVAAITPWNFPVVLAFMKLAPALVAGNTVVLKPAANSPLVLAEVIRALQQHFPPGVLNMVTGGDAVGEALVAHPRIRKIGFTGGIDTGRKVMAAAARDIKRVTLELGGNDPAILLDDVDLSPETMRQIVKGAFGTTGQVCFGLKRIYVPTRIHDRFVEAFSAAVDEIVVGPGDDPRVTMGPLNNAQQKNLVEKIVDDARSSGATVTTLGQRLDSAAWDHGHFMMPSVVTEADPRLAIVEEEQFGPVVPVLKYDELDDVIRLVNQSQYGLAASIWTSDEERAFLLGRRFDTGSVFINSHTFTSLDPRAPFGGAKASGLGREFSPASLDSYTELQTISRRIGPPGPPLS

SEQ ID NO: 46614 - protein, 555 aa, Arabidopsis thaliana
MAGLVLSNDTEAKISGDCKRGGCITFPFMIATLLGISVTSYGWVLNLIVFLIEEYNIKSIAAAQISNIVNGCLSMLPVVTAILADSFFGNIPVISASAFISLLGIFLLTLISSFENLRPRPCETGSILCQSPSKLHLGVLYAALALVTAGTSGTRVALASAGANQYDKPRDKGSFFNWYFLTVNTGAIISATAIVYTQENASWRLGFGLCAAANLISFIVFISGKRFYKHDKPMGSPFTSLIRVLVAAILKIKVVTSSKEEDYHREVEKESKTCIGMPSKSFRFLNRAALKSEKDLNQEDGLCHNPWRLCSVEEVEDFKSVLRVLPLWLAILFVGTSIGVQASMTVLQALVTDRGLDSKFKVPAGSLQVIVLISSCVFLVLNNWTIYPIYQKITHKQLTPLQQVGIGQVFNILSMAISAIVEAKRLKTVENEHPMSVLWLLPPLVIVGIGDAFHYMANVAVFYGEFPESMRNTATSVTSVAFGISFYLSTALINLIQRTTAWLPDDINHGRVDNVYWVLVIGGVLNLGYFFVCSWYFTYRKIQDDNRQDPKDVTN

SEQ ID NO: 46615 - protein, 666 aa, Xylella fastidiosa Ann-1
MTKPTRRQLANAIRFLAADAVQAAHSGHPGMPMGMADIAEVLWNDFLRHNPNNPNWFNRDRFILSNGHGSMLQYALLHLSGYDLPLDELKRFRQLHSKTAGHPERSETPGIETTTGPLGQGFANAVGFALAEKLLAQRYNRPEHLIVDHRTWVFMGDGCLMEGISHEAAALAGTWNLGKLICFWDDNNISIDGNTAGWFTEDTPARFEAYGWHVIRDIDGHDAEKIATAIQAAVAQENKPSLLCCRTVIGFGSPNKAGKESSHGAPLGAEELEATRKMLDWPYGPFEIPSEIYDGWRANGTGMLRQAEWEQAFDNYARQYPKEAAELTRRSHAELPTDFLSQLDAYIAKVHAAGPCIASRKASQMAIEAFAPLLPELIGGSADLAHSNLTLWKGSQTVVGDAPNANYAYYGVREFGMSAIANGLALHGGFIPFDATFLVFSDYARNAVRMSALIPAHVIHVYTHDSIGLGEDGPTHQPVEHLAALRYIPNNDVWRPCDAVESAVAWKAAITRNNGPSCLVFSRQNLPHQPRHDAQLEQIARGGYILADAASSIPDIILIATGSEVSLAIEAKKTLDAMQLKTRVVSMPSTNVFERQDPTYRESVLPSKVHKRVAIEAGVTGFWWQYVGLHGAVIGLDTFGASAPADVLYKHFNITAEHVVEVAKAL

SEQ ID NO: 46616 - protein, 541 aa, Oryza sativa (japonica cultivar-group)
MGQCCTGGGKAVAGDEAEPGTSKAAPPSRGTSSKNGSAKQQPCSPAAKAAATEAAAAASSSKKPAGPIGEVLERPMEEVRTTYSIGKELGRGQFGVTHLCTHKATGEKLACKTIAKRKLANKEDVDDVRREVQIMHHLSGQPNIVDLRGAYEDKHNVHLVMELCAGGELFDRIIARGHYTERAAAALLRAIVGIVHTCHSMGVIHRDLKPENFLLLSKGDDAPLKATDFGLSVFFKEGEVFRDIVGSAYYIAPEVLKRKYGPEADIWSIGVMLYIFLAGVPPFWAESENAIFTAILRGQIDLASEPWPKISSGAKDLVRKMLNINPKERLTAFQVLNHPWIKEDGDAPDVPLDNVVLNRLKQFRAMNQFKKAALRIIAGCLSEEEIKGLKEMFKNIDKDNSGTITLEELKNGLAKQGTKFSDNEIEQLMEAADADGNGIIDYEEFVTATVHMNKMDREEHLYTAFQYFDKDNSGYITKEELEQALKEQGLYDANEIKDVITDADSNNDGRIDYSEFVAMMRKGSGCAEATNPKKKRRDLVL

SEQ ID NO: 46617 - protein, 348 aa, Corynebacterium glutamicum ATCC 13032
MVGGKGTRLRPLTVNTPKPMLPTAGHPFLTHLLARIKAAGITHVVLGTSFKAEVFEEYFGDGSEMGLEIEYVVEDQPLGTGGGIRNVYDKLRHDTAIVFNGDVLSGADLNSILDTHREKDADLTMHLVRVANPRAFGCVPTDEDGRVSEFLEKTEDPPTDQINAGCYVFKKELIEQIPAGRAVSVERETFPQLLEEGKRVFGHVDASYWRDMGTPSDFVRGSADLVRGIAYSPLLEGKTGESLVDASAGVRDGVLLLGGTVVGRGTEIGAGCRVDNTVIFDGVTIEPGAVIENSIISSGARIGANAHISGCIIGEGAQVGARCELNAGMRVFPGVVIPDSGIRFSSDQ

SEQ ID NO: 46618 - protein, 349 aa, Flaveria brownii
EFYIGLRQRRATGQEYAELMNEFMSAVKQNYGEKVLIQFEDFANHNAFDLLEKYRTTHLVFNDDIQGTASVVLAGLISALKLVGGSLADHKFLFLGAGEAGTGIAELIALEISKQTNIPLEESRKKVWLVDSKGLIVRSRLDSLQHFKKPWAHDHEPVDKFLDAIKTIRPTVLIGSSGTGQTFTKEVVETMSSLNEKPIILALSNPTSQSECTAEQAYTWSEGRAIFASGSPFGPVEYNGKLYMSGQANNAYIFPGFGLGLIISGAIRVHDDMLLAASEALAEQVTEEHFDNGLIYPPFTNIRKISAHIAAKVAAKAYELGLASRLPQPENLVAYAESCMYSPKYRSYR

SEQ ID NO: 46619 - protein, 424 aa, Oryza sativa (japonica cultivar-group)
MANRRKFSQAGGGGGGGVFDPFGTKQAVSSLRKGGRLPVYVAGVFFVIFVIIMYGEDIRSLTLDPIARAGTTPARIVEPVVTEERHVARVNPPRREVSSAEKAAALPLDVDERPKLATPTPTEAAKEVPKLFMERLRGKRFMFVGDSLNRNQWESMVCLVQSAMSPGKKYVTWEDQRVVFHAVEYNATVEFYWAPFLVESNSDDPKIHSIQHRIIKADAIAAHAQNWRGVDYLVFNTYIWWMNTLNMKIMRPGGQSWEEHDEVVRIEAYRKVLTTWASWVNDNIDPARTSVFFMSISPLHISPEVWGNPGGIRCAKETMPLLNWHGPIWLGTDWDMFHAAANVSRTAATRVPITFVDVTTMSERRKDGHTSVHTIRQGKVLTPEQQADPGTYADCIHWCLPGVPDIWNLILYTRIMSRPQLGLG

SEQ ID NO: 46620 - protein, 428 aa, Bartonella henselae str. Houston-1
MRLGGRLQAAIDVLKEIEIRHRPIGEALKDWGVCHRFAGASDRAAIGTIVYDVLRRRYSLQWRMESDDIRDSVFGTLLDTNKMTIEQIDGELEGDRFAPQLLGMRQRQSWQRRQLVDAPDYIRGDIPQWCQAHLRPLFADNWVIEAAALATRPSLDLRVNSLKATPEKVFQELAKNKVQSFSWFRQALRIAPIEKFGRHPNVQVKPAFQKGHFEIQDLGSQIVAHLVEAKERMQVLDYCAGAGGKTLALAASMKNQGQIYAYDSDKARLAPIFDRLRRAGVRNVQPRAQREELQSLVGRMDRVLLDAPCSGTGTWRRHPDTKWRLTLEQVRQRQREQRAILNETIDYLKLNGRLVYITCSLFVDENEEQISRFLQQHCNFYAIDMRALWKQHFSSSSVQPVFSNYGLTLSPATTKTDGFFLSVLQKKH

SEQ ID NO: 46621 - protein, 518 aa, Bartonella henselae str. Houston-1
MSISHSDTVLIIDFGSQVTQLIARRVRAMGVYCEVVPFQLALEGMQRIKPKAVILSGSPYSVIDEGSPRAPMEIFEMDIPVLGICYGQQIMCVQLGGKVASGHEREFGRAFLEVQENSALFEGVWEKGSCYQVWMSHGDRVTALPEGFRVIGTSKGAPYAAIADEKRRLYAVQFHPEVVHTLDGTKLLQNFVLKISNLKGNWSMASYREQTIAKIRQKVGKSRVICGLSGGVDSSVVAVLLHEAIGDQLTCILVDHGLMRKNEAQEVLTLFRDHYNIKLIHVNAANMFLNALEGEIDPEKKRKTIGRLFIEVFEEETKKIGGAEFLAQGTLYPDVIESISAIGKSVTIKSHHNVGGLPERMNMKLVEPLRELFKDEVRSLGKELGLPEQFIGRHPFPGPGLAIRCPGAVTREKLEILREADAIYLDEIRKAGLYDEIWQAFAILLPVQTVGVMGDGRTYEFVCALRAVTSVDGMSADFYPYDMEFLSKTAARIINEVRGINRVVYDVTSKPPGTIEWE

SEQ ID NO: 46622 - protein, 366 aa, Aspergillus oryzae
MDQDTENKVLVIKNMDSGYLVAGEQVTLEDVSYDATEPLAEDELMVQLLYATYDLFKRDLASSSADATELRGRKPVETMSIAQVIKSNNKQFQEGDMVIGRLPVQQYVLIKADDATELKLLENPCEFDDIRLFLSVLGVPGLLAFSSLYEIGRPKKGETILIAGASDEIGQLVGQMARLEGLKVFGSVESDEKLDFLITELGFDGGFNYAKESPYEALPRLVPNGIDIYYDNLSWMSRLNIGGLDTHFDLLGSRHLNAAFSSMRRYGRIMFYGTIAEQTVLDPIIGMFLHNTVLKRLTIRGFGLSDPSFGKKWGKLHMERMQQWVKEEKLKIPTFEITGMDNAAKAFVEAFYSSENTHTHTILAVT

SEQ ID NO: 46623 - protein, 111 aa, Glycine max
MTRMFNTNLVMILAIIGILVFSSANNVVVGQCPGMEGLITQCSEYVEKSGPEMSPSPQCCHEIENADTPCLCQHFNKAILQFIDIQKVIYVARSCGKPIPSGTTCGGVTVS

SEQ ID NO: 46624 - protein, 536 aa, Gibberella zeae PH-1
MEAVNSTTSGFSSVLAGTKYANVNIPPQIDYVIEAVSNAGVWTWVFTLVALCIAYDQIAYIVRKGPIVGPAMKIPFIGPFLDSMDPRFDGYHAKWSSGPLSCVSIFHKFVVIASTRDMARKVFNSPAYVKPTVVDVAPKLLGHDNWVFLDGKAHVDFRKGLNGLFTRKALELYLPGQEEAYNTYFKHFLKMTKDAGGKPVPFMHEFREVMCAVSCRTFVGHYISDEAVTKIAEDYYLITAALELVNLPVILPYTKSWYGKKAADMVLAEFSKCAAKSKVRMAAGGEVTCIMDAWILSMIQSERWRKAEEKGEPHNVEKPSPLLRMFNDYEISQTIFTFLFASQDATSSAATWLFQVTAQRPDVLDRVREENIKIRNGDPNAPLTMDQLESLTYTRAVVRELLRWRPPVIMVPYVTKKAFPLTDDYTVPKGSMLIPTTFMALHDPEVYDNPSHFDPERYYSGDAEEKGSKNYLVFGTGPHYCLGQVYAQLNLALMIGKASVMLDWKHHATPKSEEIKVFATIFPMDDCPLTFEERKW

SEQ ID NO: 46625 - protein, 303 aa, Kluyveromyces lactis NRRL Y-1140
MSVILASAGYDHTIRFWEALTGVCSRTIQHADSQVNRLEITSDKKYLAAAGHLHVRLYDIRSNNPNPVSSFEGHKGNVTSIAFQQENRWMVSSSEDGTIKVWDVRSPSVQRNYKHNAPVNEVAIHPNQGELISCDQDGNIRIWDLGENQCTNQLTPEDNTPLQSLSVASDGSMLVAGNNKGNCYVWKMPHHTDASTLEPVTKFKSHTKYITRVLLSADVKHLATCSADHTARVWNIEDNFELETTLDGHQRWVWDCAFSADSAYLVTACSDHYVRLWDLSTSEIVRQYGGHHKGAVCVALNDV

SEQ ID NO: 46626 - protein, 497 aa, Arabidopsis thaliana
MSVYDAAFLNTELSKPTSIFGLRLWVVIGILLGSLIVIALFLLSLCLTSRRKNRKPRADFASAAIATPPISKEIKEIVPAQNQSVPAEIQVDIGKIEHRVVFSDRVSSGESRGTASASETASYSGSGNCGPEVSHLGWGRWYTLRELEAATNGLCEENVIGEGGYGIVYRGILTDGTKVAVKNLLNNRWLRVIVIRVLLLFNCIAFGVSLIARGQAEKEFKVEVEVIGRVRHKNLVRLLGYCVEGAYRMLVYDFVDNGNLEQWIHGDVGDVSPLTWDIRMNIILGMAKGLAYLHEGLEPKVVHRDIKSSNILLDRQWNAKVSDFGLAKLLGSESSYVTTRVMGTFGYVAPEYACTGMLNEKSDIYSFGILIMEIITGRNPVDYSRPQGETNLVDWLKSMVGNRRSEEVVDPKIPEPPSSKALKRVLLVALRCVDPDANKRPKMGHIIHMLEAEDLLYRDERRTTRDHGSRERQETAVVAAGSESGESGSRHHQQKQR

SEQ ID NO: 46627 - protein, 558 aa, Coccidioides immitis RS
MVPTDVTVWDWLFDPYSPHCPLSKYPASEIAGYTNASTRERVSFAQVKEYTTFLSTALVRMFDFNEGDTVALFSQNTIWYPVAMLGAIRVGGVVSGASPAYNVDEMTYALKTAQAKILMTMPSSMTVAVEAAKNAGIPQNRIFLLEGEVEGYTTMKQLLDIGRSYGSEGQVKAFKIPPGKKNKDVCGFLSFSSGTTGLPKAVMIAHQNVIAQCLQVQQVTPESHKKVLAVLPLFHITGLVHQLHLPVLLNAEIYMLPSFTMEAMLDAVSTFKIKEMLLVPPILIRLVRDPVVDKYDLSHVERFSSGAAPLSAEILAFLEKKFPGTGFKQGYGMTESCSCITTHPIGKMGYEYAFRVGTIVANTEVKIIDPDTGAELGYNQPGEILARGPQVVMGYLNNPKATRETFDEDGWLHTGDVGKIDEEGFITITDRIKEMIKVKGIGVAPAELEDLLLGHPDVEDAAVLAVPDEYSGERPKAYVVLKPARKDDDLVATGRKLIKYVQEKKVRHKWLVEVEFTEEIPKSASGKILRRVLREQQKNGGKKGTVVRNDESAAKARL

SEQ ID NO: 46628 - protein, 260 aa, Mycobacterium sp. KMS
MTAGDRRVAIVTAAAAGIGKAIALRWCREGGCCVMADTDGEGLDAAVHELAESGAAVCGVAGDVCLSDVANSVVERALTEFGRLDTLFNVVGGSLARNVEEISEEQWRSQIDMNLGSVFQMSKPVIPLLRQGGGGSIVNVASTAGILAENRCSAYSASKGGVVLLTKNMALDFARDNIRVNAIAPGGTRTPRIERFLAEHPEHASMMVDLCAMQRFAGPEEIAAPAVFLASPEASYITGAVLPVDGGMTAGVTFRAFEAV

SEQ ID NO: 46629 - protein, 324 aa, Propionibacterium acnes KPA171202
MSYSASSEFTDLVSAKLALIEDELGRQAGADTPFVTEAANHIISAGGKRFRPLLVVLCSQFGDAVNDADLVRAAVVMELTHVASLYHDDVMDEASRRRGAPSANLRWGNSVAIMVGDYLFSKASLAVAELGVDFVKLQARTFSRLVQGQIAETRGPSQGQDPLAHYLKVVADKTGSLIAASAVFGAMVSHASAENVAALEQFGEDIGEVFQLADDLIDITSTVTGKTPGTDLREKVPTLPTLLLRASDDPADAELKEMLDADLSDDAVLSDVLDKLRANHVIDEARVEIQRRADRARTHLTPLPDGDAKQALEALCDEVVSRSS

SEQ ID NO: 46630 - protein, 428 aa, Chlamydophila pneumoniae CWL029
MFEAVIADIQAREILDSRGYPTLHVKVTTSTGSVGEARVPSGASTGKKEALEFRDTDSPRYQGKGVLQAVKNVKEILFPLVKGCSVYEQSLIDSLMMDSDGSPNKETLGANAILGVSLATAHAAAATLRRPLYRYLGGCFACSLPCPMMNLINGGMHADNGLEFQEFMIRPIGASSIKEAVNMGADVFHTLKKLLHERGLSTGVGDEGGFAPNLASNEEALELLLLAIEKAGFTPGKDISLALDCAASSFYNVKTGTYDGRHYEEQIAILSNLCDRYPIDSIEDGLAEEDYDGWALLTEVLGEKVQIVGDDLFVTNPELILEGISNGLANSVLIKPNQIGTLTETVYAIKLAQMAGYTTIISHRSGETTDTTIADLAVAFNAGQIKTGSLSRSERVAKYNRLMEIEEELGSEAIFTDSNVFSYEDSEE

SEQ ID NO: 46631 - protein, 469 aa, Xylella fastidiosa Ann-1
MSLENVEKLVKDKKIEFVDLRFVDMRGVQQHVTFPVNILEPSLFKDGKMFDGSSIAGWKGINESDMVLLPDASTAYLDPFYADPTLVMTCDILDPATMQSYVRDPRGIAKRAEIYLNSLGIADQAFFGPEPEFFIFDSVRFSNDMGHAFFQIASEEAAWNTGAEFEGGNSGYRPTVKGGYFPVPPTDSLHDLRAEMVKTLEQVGIETEVHHHEVATAGQCEIGTKFDSLVKKADQLMTMKYILKNVAYRNGKTVTFMPKPIVGDNGSGMHVHQSLSKGGVNLFSGDDHAGLSQLALYYIGGIFKHAHAINAFSNSGTNSYKRLVPGFEAPVMLAYSARNRSASCRIPWVSSPKARRIEMRFPDPLQSGYLTFTALMMAGLDGIKNKIHPGPPNDKDLYHLAPEEEKLIPQVCSSLDQALEALDKDRDFLKAGGVMSDDFINGYIALKMQEVTQFRAATHPLEYQMYYAN

SEQ ID NO: 46632 - protein, 562 aa, Emericella nidulans
MGVDIKGLFKPKAEQQEHSQATTPSRTDSIAEKDNGIIDDSPVKYLTWRSFILGIVVSMGGFIFGYSTGQISGFTTMADFKKRFAERQANGEYVFSNVRNGLIVGLLCIGTMIGALVAAPIADRIGRKLSMSFWSIIHIVGIIIQIATDSNWVQIAMGRWVAGLGVGALSSVVPMYQSEAAPRQVRGAMISAFQLFVAFGIFISYIINYGTESIQSTASWRITMGIGFAWPLILGLGALFLPESPRYAYRLGRIDEARKVMTKLYGVEVNHRVVVQEMKDMKDKLEEERAAGVAPWHEVVTGPRMLYRTLLGIALQSLQQLSGANFIFYYGNSIFTSTGLNNSYVTQIILGAVNFGMTLPGLYIVEHFGRRASLMVGGAWMAICFYIWASVGNSVLDLDNPQNTPKAGAAMIVFTCFFIAGFATTWGPIVWSICSEMYPNRSRATSIGIATCANWTWNFLISFFTPFISGSIHFAYGYVFASCCVVGVLIVFFFVNETQGRTLEEVDTMYVLHVVPWKSASWVPDESIVRDLHPGSDANKTEGLGQAEHGEESRPEPVEIRE

SEQ ID NO: 46633 - protein, 198 aa, Propionibacterium acnes KPA171202
MGAWSGFGITFETMFRKSFTQGYPEKGKEKPMPPRMHGRHQLNRWPDGLEKCVGCELCAWACPADAIYVEGADNTDEERYSPGERYGRVYEINYLRCILCGMCIEACPTRALTMTNDFKMADTSRAKHIWTKDELLAPLKEGMEQPPHPRRLGDDEDDYFNGLPPSGQDDVRTGPANSGATAHRDDDNDTQHKDEEAA

SEQ ID NO: 46634 - protein, 442 aa, Arabidopsis thaliana
MAIIQLGSTCVAQWSIRPQFAVRAYYPSRIESTRHQNSSSQVNCLGASKSSMFSHGSLPFLSMTGMSRNMHPPRRGSRFTVRADADYYSVLGVSKNATKAEIKSAYRKLARNYHPDVNKDPGAEEKFKEISNAYEVLSDDEKKSLYDRYGEAGLKGAAGFGNGDFSNPFDLFDSLFEGFGGGMGRGSRSRAVDGQDEYYTLILNFKEAVFGMEKEIEISRLESCGTCEGSGAKPGTKPTKCTTCGGQGQVVSAARTPLGVFQQVMTCSSCNGTGEISTPCGTCSGDGRVRKTKRISLKVPAGVDSGIRLRVRGEGNAGKRGGSPGDLFVVIEVIPDPILKRDDTNVLYTCKISYIDAILGTTLKVPTVDGTVDLKVPAGTQPSTTLVMAKKGVPVLNKSNMRGDQLVRVQVEIPKRLSKEEKKLIEELADMSKNKTANSTSR

SEQ ID NO: 46635 - protein, 369 aa, Zea mays
MTGCLWPCVGAAVAGHGAGHRKAGLFRSKPRTPAEVVQHARDLVTYILDNKDGCGAGKRDAKHEHRMVELSKEVKEMKGILYGNGEEDPCEEACKQLTKEFFKKDTDTFRQLIVCLQYVDLETQKDITQVIANLQRQKVDSRLVASDYLETNLDLLDILMSGYGNLDIAIHYSTLLRDCIRHQVAARYVLQSPHFRTFFDHIQFPDFNVQSDVFKTFKELMTRHKSTAAEFFSKNYDWFFAEFNSKLILSASNYFIRRKAIQLLRDILLERSNAAVMVRYVSSKEHLMIQMNLLRDESIAIQVEAFHVFKLFVANKEQAPEITGILLANRSKLLRFLKDFTTVEKDDKKFEADKATVISDILALNGAEK

SEQ ID NO: 46636 - protein, 387 aa, Desulfitobacterium hafniense Y51
MNQYLSPIAANLPPSGIRKFFDLVSTMKNVISLGVGEPDFVTPWTVRESGIFSLEQGQTMYTSNSGLLELRQALSWNMEKKLGLEYNPNDEILITVGASEAVDLAMRALLGPGDALLLTDPAYVSYGPCATLAGAEVHYVPTREEEDFRVRVEDLERVYTPNAKVLVLSYPNNPTGAIMTWEDYQPIAKFVQDHDLIVVADEIYSDLSYGGSHTAFASLPNMRNRTLHISGFSKSYAMTGWRIGYVAGHHDFIQAMTRIHQYTMLCAPITAQLAALEAVRSAEQAMQDMVATYDRRRRLMVHGFRKMGLSCFEPLGAFYTFPSIKATGLTSEEFANELLQEEKVAVVPGTAFGPSGEGHIRCSYAYSTEQIQEALTRMERFVSKRIK

SEQ ID NO: 46637 - protein, 329 aa, Zea mays
MMSSRAGSILLRHAGSRLFTAAAISPAAASRPLLAGGNGVPAVMLRLMSTSSPAAPTEAKDEAAKASKVGGDKKAVVINSYWGIEQNNKLARDDGTEWKWTCFRPWETYTADTSIDLTRHHEPKTLMDKVAYWTVKSLRFPTDIFFQRRYGCRAMMLETVAAVPGMVGGMLLHLRSLRRFEQSGGWIRALLEEAENERMHLMTFMEVAKPRWYERALVITVQGVFFNAYFLGYLLSPKFAHRVVGYLEEEAIHSYTEYLKDLEAGKIENVPAPAIAIDYWRLPANATLKDVVTVVRADEAHHRDVNHFASDIHCQGMQLKQSPAPIGYH

SEQ ID NO: 46638 - protein, 837 aa, Synechococcus elongatus PCC 6301
MRAVLLAGGLGTRLRPLTCDRPKPMVPILNRPIAAHILQLLHRHGYQEILATLYYRPETIQQYFQEGQDWGVDLRYILEADRPLGTAGSVKNLTSQLQETFLVASGDCLSDFDLTAALAWHRQQQAIATVILARVDQPLEFGCVVCDRQQRIIRLIEKPDASELISDTVNSGFYILEPEALDYLPLDEPSDFATHLLPRLLAAGEVVTGYVDQGYWCDIGNRQAYQRAQLDALLGRVRLQANQMEWRPGIYVGEGTTIASSAQLEPPLWIGQHCYIGEEVQLKAGTVIGDESRIEAGACLDRAVVWNRVQIGQRSHLEGCVLADGVRLERHVQIHEGAVIGSGCRLQEEAQVQAEVRIWPRKQIEAGAIVNLNLIWATSARRRLFSDGGVRGIANVDITPEFAVKLGVAYGSTIPPGSSVTVSRDQRSISQMVTRSLIAGLMSTGITIRNLEAAAVPIARSMLARLPVVGGIHVRLDPLWPTHVLIEFLDREGLTVDRALERRIEAAFFQEDLRRVPMQDLGTMITVSETLPLYRQLFCDRLDRDLLLRSPNRIVIDYAYSVSGAVLPLLLSEFGCDAVILNASLRQQPPTENERQSLLEQMGQVVSAIKANCGVQVAANGERFTLVDEQGMALDHEQLTVLMAEICWLRRPGGTVVVPMTSSSAVDQTAWRYHGRVHRCRPTPTALMAACRNLPDVILGGSGELGFIFPEMHAGFDAIFGIARLIEGLDRQSRSLSQWVESLPSIAHRHLTLSCPRNLLGTLMRQLLESHEPDRLNFQEGLRIQGDRGDQWLLVLPDASYPLIHLYANAQDHQWVEQTLGSYQQQIEQFVATLQSP

SEQ ID NO: 46639 - protein, 595 aa, Aspergillus oryzae
MGLPKLKLPRANADRAYKDEPDPRPSDAVLRQSANGDDGLVDTKIPFLTFRSFSMCVVISMGGFLFGYDTGQISGFLEMEDFLQRYGEQRADGTYYFSNVRSGLIVALLSIGTLMGALVAAPIADRVGRKWCVSGWCVILCAGITVQISSPTGKWYQVALGRWVAGLGVGALSLLVPMYQAETGPRHIRGSLVSTYQLFITLGIFVANCINFGTEKKTSTASWRIPMGVTYIWAIILGFGISMFPESPRHDYRKGKVDKAISTLAKMYGVPKNHRALAIEFDEIKQKYEEEVARGQVSWIQLFKAPRMAYRVAVGVALQALQQLTGANYFFYYGTTIFQGAGIENSYVTQMILGAVNFGSTFLGLYLIENYGRRRSLIAGALWMFCCFIVFASVGHFSLNRDDPPSTKTAGVVMVVFACLFILAFASTWGPMVWTIIAELYPSEYRARAMSLATASNWLWNFLLAFFTPFITSAIDFRYGYVFAGCLFLAAGLVYFAVMEGKGRTLEEIDTMYVWKVKPWHSSKYVFPETEPSIMEKRRASHASNPSTNPTTIDDNHETTVLSGKNINCRSSLNLRPKSRGLIRREEKTWSKLLA

SEQ ID NO: 46640 - protein, 342 aa, Glycine max
MDHSADAHRTDLMTITRFVLNEQSKHPESRGDFTILLSHIVLGCKFVCSAVSKAGLAKLIGLAGETNVQGEEQKKLDVLSNEVFIKALISSGRTCILVSEEDEEAIIVEPSKRGKYCVCFDPLDGSSNIDCGVSIGTIFGVYALKDVHEPTIEDVLLPGKNMVAAGYCMYGSSCTLVLSTGAGVNGFTLDPSLGEFILTHPNIKIPKKGKIYSVNEGNAKNWDRPTATYVEKCKFPEDGSSPKSLRYIGSMVADVHRTLLYGGIFLYPADKKSPNGKLRVLYEVFPMSFLMEQAGGQSFTGKERALDLVPTKLHERSPIFLGSYDDVEEIKALYAAAEGEQE

SEQ ID NO: 46641 - protein, 305 aa, Synechocystis sp. PCC 6803
MHKFLPIAYFEDKFVPFEDAKISVATHALHYGTAAFGGLRGIPDPEDPGTILLFRLDRHGDRLSKSAKFLHYDISAEKIKEVIVDFVKKNQPDKSFYIRPLVYSSGLGIAPRLHNLEKDFLVYGLEMGDYLAADGVSCRISSWYRQEDRSFPLRGKISAAYITSALAKTEAVESGFDEAILMNSQGKVCEATGMNVFMVRNGQIVTPGNEQDILEGITRDSILTIAADLGIPTCQRPIDKSELMIADEVFLSGTAAKITPVKRIENFTLGGDRPITEKLRSVLTAVTENREPKYQDWVFKIPLNG

SEQ ID NO: 46642 - protein, 234 aa, Triticum aestivum
RGRGRGVKACIVSCGGLCPGLNTVIRELVCGLAHMYNVNNIFGIQNGYKGFYSSNYVAITPKTVNDIHKRGGTVLGTSRGGHDTKKIVDNIQDRGINQVYIIGGDGTQKGAYEIYKEIRKRGLKVAVAGVPKTIDNDIAIIDKSFGFDSAVEEAQRAINSAHVEACSAENGIGLVKLMGRYSGFIAMYATLASRDVDCCLIPESRFLVMGERGGGWGWLLVFFGVCGWFFWVGF

SEQ ID NO: 46643 - protein, 199 aa, Lactobacillus sakei subsp. sakei 23K
MEVHEVEMVMSAVAASQYPTDQLPEIALSGRSNVGKSSLINKLINRKSYARTSSKPGKTQTLNFYRVENELYFVDVPGYGYAKVSKKQREKFGQIIEAYLTNRDNLRGLISLIDGRHEPTDDDIAMYVFAKYYDIPVLVVATKMDKISTGKWNRQEKIIKEALDFNPVDKFVCFSALTGAGKDTVWEWIEQQCDIGGRR

SEQ ID NO: 46644 - protein, 732 aa, Glycine max
MASSTSSISLSQALLRPTTTSLPSSSSSSLRLTPTLRPTPPALSLRRRLTTSIRAAASVKTVEKATADAALVEKSVNTIRFLAIDAVEKANSGHPGLPMGCAPMGHVLYDETMKYNPKNPFWFNRDRFVLSAGHGCMLQYALLHLAGFDSVKEEDLREFRQWGSRTPGHPENFETPGIEVTTGPLGQGIANAVGLALAEKHLAARYNKPDNEIVDHYTYAILGDGCQMEGIANEACSLAGHWGLGKLIAFYDDNHISIDGNTEIAFTESVDSRFEGLGWHVIWVKNGNNGYDDIRAAIKEAKAVKDKPTLIKVTTTIGYGSPNKANSYSVHGSALGAKEVDATRQNLGWSHEPFHVPEDVKKHWSRHTPEGAALEAEWNAKFAEYEKKYKEEAAELKSIINGEFPAGWEKALPTYTPESPADATRNLSQTNLNALAKVLPGLLGGSADLASSNMTLLKMFGDFQKDTPAERNVRFGVREHGMGAICNGIALHSPGLIPYCATFFVFTDYMRGAIRLSALSEAGVIYVMTHDSIGLGEDGPTHQPIEHLASFRAMPNILMLRPADGNETAGAYKVAVLNRKRPSILALSRQKLPQLPGTSIEGVEKGGYTISDNSTGNKPDVILIGTGSELEIAAKAADDLRKEGKAVRVVSLVSWELFDEQSEAYKESVFPAAVSARVSIEAGSTFGWEKIVGAKGKAIGIDRFGASAPAGRIYKEFGITKEAVVAAAKELI

SEQ ID NO: 46645 - protein, 444 aa, Mesembryanthemum crystallinum
MVTIKCVKARQIYDSRGNPTVEADIHLDDGTYARAAVPSGASTGVYEALELRDGGKDYMGKGVYKAVKNVNEIIGPALVGKDPTQQTAIDNFMVQQLDGTVNEWGWCKQKLGANAILAVSLAVCKAGAQVKKIPLYQHIAEIAGNKNMVLPVPAFNVINGGSHAGNKLAMQEFMILPTGASSFKEAMKMGSEVYHNLKSVIKKKYGQDATNVGDEGGFAPNIQENKEGLELLKTAIEKAGYTGKVVIGMDVAASEFYKEDKSYDLNFKEENNDGSQRISGEALKDLYKSFVAEYPIVSIEDPFDQDDWEHYAKMTAECGEKVQIVGDDLLVTNPKRVKKAIDENSCNALLLKVNQIGSVTESIEAVKMSKKAGWGVMASHRSGETEDTFIADLSVGLSTGQIKTGAPCRSERLAKYNQLLRIEEELGDKAVYAGANFRRPVEPY

SEQ ID NO: 46646 - protein, 285 aa, Zea mays
VERRLGNYTQTEDEILVSAYMNMSKDPAIGTNQSGKAYWCRISDYYNEHKKKANARTQHSLEHRWSDIQRDTTKFCAAYDKVIRLKQSGKSEDDQVKDALQMFEGMHKKQFRFMHCWYMLRREVKWTTWLSSCETPHNNIGNVNVNETGSQAKQGEDEFGSPSDTFVRPMGRDRAKKARSTSTSSNSTACMALLEKFQEDTARFEEKATKYEDLAAASTEEDRRDMKMYRDRKIQLSENMFKLHQLERDDRIMNMDLDKVAPYARDYYVYMQKDILARLPPPSDT

SEQ ID NO: 46647 - protein, 552 aa, Xylella fastidiosa Ann-1
MKALFRACRIGKVMLRYRLDTLLDGTAAERWLRLAKPFVPRISAEIVEQSRGRRLRLALQELGPIFVKFGQILSTRRDLVPQDIGDELVMLQDRVEPFEGQTARSIIETALGKSVESAFAHFDTVPLASASISQVHAATLHDRREVVVKVLRPDIEHQISDDIALLKSLATLIEHTHPNADKIRPREIVAEIETTLAAELDLQREGANASVLRRFWEASDDIYVPEVIWSHSAERVLTLERMYGIPSDDIALLDASGIDRKALSSKGIRVFYTQVFRDNFFHADAHSGNIWVDSDPARKSNPRFIVLDFGIMGQLSQKDQYYLAENFMAIFHKDYRRIAELHVEAGWIPPHVRIEELEAAARSVCEPYFTRPLSQISLAEVLMKLFHVARRYQLTLQPQLILLQKTLLNIEGVGRQLDPELDIWVVARPVLERILRARYSPRHALKELNKRLPEIMTHAPDTPRLIHTWLVQQVESRKQNDVYLQQIRALAMTLQGLQRRVVNAIVGSGLLVAAAVLYCLHPDGLYLGTIPVWSLISGCVGALALFSAWWRS

SEQ ID NO: 46648 - protein, 433 aa, Propionibacterium acnes KPA171202
MSENHEYLSQGGDWAQIVDEAAERGDETVVVNFGPSHPSTHGVMRLIIELDGESVSDLRVGIGFLHTGIEKNMEFRTWTQGVTFMTRCNYVANFFNELVYCLAVEKLLGITDDVPERARVLRVMITELNRISSHLIAVGTGGLELGASSVAEVGLREREIILEFNQAVTGLRMNNAWIRPGGVATDLPETGLDQLRDLIKRMEKYLPEIGQFCNENPIFKARTQGIGYADLSTCMALGVTGPALRATGLPWDLRKTQPYCDYDTYDFDVATWDTCDCYGRFRIRLEEMDQSVRILKQCLKRLEDTQGDRHMVEDPHIAWPAELALGPDGQGNSNEHIRHIMGESMEALIHHFKIVTEGFRVPAGQVYQAIEGAGGELGCHLVSDGGVRPYRSHLRDPGFVNVQSLPAMCEGGMLSDVVPSLASLDPVMGGVDR

SEQ ID NO: 46649 - protein, 274 aa, Propionibacterium acnes KPA171202
MSDKPTPRGAAGGSDSGDRIPDGRNFLDPSHPDQVHTPAKGREWTDRRIDTRKGMWGATSGPGDTSGYGGIVRTVEISGNSERPYGGWFDEVADRMAELVPDFSDGLTVVDRGEITFFVRPEKLLELVKVLRDDDALRFESCTSLTCVHYPHMAGREMHVVYNLLSMTHNRRIRLEVALADPGQEDVARTGRSDVDSLPHVPSVVSVYPHADWQEREAWDMFGVIFDGHPALTRILMPDDWVGHPQRKDYPLGGIPIEYKGAVVPPPDQRRSYN

SEQ ID NO: 46650 - protein, 251 aa, Brassica napus
MFTEEVLKNVFPLLEGEDLAACMGVCKQWRHIAKDDFYWKCQCAKKWPSVCKRTKPPTGTYYKMFQTFSKRRLNRTLPPPRLSFENLEFFVDIWSEDKPVYSGLIPGLAMETGIKPLPSGISNVLRTHLAKPDYKMVVPAEPRFTVPLNQTVSVSMLVGRNDSDKVARIINRSVFEYIDRSSYRALAFEYLDLSPYYPFVSGIRAWVSLLFMDAEDINDGVLDVFGIQLDFCDVAETKEEVLWLLDMLDWK

SEQ ID NO: 46651 - protein, 358 aa, Arabidopsis thaliana
MAAALVRRFCRGSSFPVSGHGYRMLSTVENVSESGKSMNLYSAINQALHIALETDPRSYVFGEDVGFGGVFRCTTGLAERFGKSRVFNTPLCEQGIVGFGIGLAAMGNRVIAEIQFADYIFPAFDQIVNEAAKFRYRSGNQFNCGGLTIRAPYGAVGHGGHYHSQSPEAFFCHVPGIKVVIPRSPREAKGLLLSSIRDPNPVVFFEPKWLYRQAVEDVPEDDYMIPLSEAEVMREGSDITLVGWGAQLTIMEQACLDAENEGISCELIDLKTLIPWDKEIVETSVRKTGRLLISHEAPVTGGFGAEIAATIVERCFLRLEAPVSRVCGLDTPFPLVFEPFYMPTKNKILDAIRSTVNY

SEQ ID NO: 46652 - protein, 146 aa, Oryza sativa (japonica cultivar-group)
MAEPPSQSPAQTPPQAAQQQQQGPGESARDDMMACVAALEAALLPCLPARELQAVDRSLQSSHQIDVERHARDFMEAAKKLQSYFISLQREDRPSTEEMLRKDIAIMEEELKTKSELIDKHKKLIEGWQKELKDQLGKHVTELERV

SEQ ID NO: 46653 - protein, 376 aa, Arabidopsis thaliana
MEMIETEISLSGYHKRYGHLKFIELSDPPLTKRPRYSPSVIPPLPDQNPIFTLKLSPILLKNNKRKRFTPKSSSSLSVEEITKQVFDGVVRKSSSWIKSEFLGRGSYGSVYLATSKKAKTKTTMAIKSAEISRASSLMDEERILTRLSSPFIVRCYGHEIAREETLFGGERTNYNLILEYCSGKSLFDLVNSNLGGLSEKDVKLLARDILYGLDYIHRANIIHCDIKPENILLAPVENRIRPNGYVAKIGDFGLALEKGSSEYEKASGHRRGTTRYMSPELIRHGIVDYAVDTWAFGCTVLEMLTGQQVWGEHSDLGSVDWDILIGQSCYIPYIPDWLSEEAQHFLSRCLKRDPASSCKMKYPTLYLVCVSGSFGK

SEQ ID NO: 46654 - protein, 173 aa, Thermoanaerobacter tengcongensis MB4
MTLDDIKEMIREIPDFPKKGIRFKDITPVLKDAKAFNYSIEMLAKALEGRKFDLIAAPEARGFLFGAPLAFRLGVGFVPVRKPGKLPAETLSYEYELEYGLDSLEIHKDAVVKGQRVVIVDDLLATGGTVYASAKLVESLGGVVDSILFLTELTFLDGRKKLDGYDIISLIKF

SEQ ID NO: 46655 - protein, 229 aa, Brassica napus
MATGLDMSLDDMIAKNRKSRGSGSGPGPTRRNNPNRKSNRSAPYQSAKAPESTWEHDMYSDGSQAFPSRSSSGIETGTKLYISNLDYGVMNDDIKELFAEVGELKRYTVHFDRSGRSKGTAEVVYSRRGDAIAAVKKYNDVQLDGKPMKIEIVGSNLQSASAPSGRHGNANFNGASRRGGQGRGGPQRRGGQGGRGRGRRSGKGPTEKVSAEDLDADLDKYHAGDMETN

SEQ ID NO: 46656 - protein, 199 aa, Vibrio vulnificus YJ016
MKKKILVPIACGTEEMEAVTAIDMMARAGYDVTVASADFDGKLTLTASRGVILGAQCRLVDVADEQFDVIVLSGGVAGAETFRDSPILIEMLKQHMYEGKLVAAICAAPALVLQHHNLYPKAIMTCHPNFMSHIGEQNWRPKRVTYDVNHNLLTSQGPGTALEFAMEIIILLSGKQHARQVAEPMVTVPVLNYHKLGEE

SEQ ID NO: 46657 - protein, 569 aa, Azoarcus sp. BH72
MAYNLGVPPGWRKATRNLPALSPPVIVTDTFTPPQRLPVWSSLEQHAARLRATRVRTLFDTDAGRFQRLSRSVCGLTVDFSKQRLDAAALADLLELASAAGLQDGIAGLFGAAQMNFTEGRAALHMALRGSCPAPGGEDVTRYFREARSFARALREGGIKGATGKSINHVINLGIGGSDLGPRMVFEALAHTHRPVKVDFVANIDPRDLDEALAGVDPERTLFIVSSKSFGTAETLSNATAARAWLASTLPARVADNALAVHFAAVSNATASAAAFGIPPERVFPLPEWVGGRYSVWSAIGLPLLIAFGEAGFDAFLAGGRDLDQHFLKAPLADNLPVLMGLVGLWNTDFLGLETLAVLPYAHGLRNFAMWLQQLEMESNGKRTLRNGEASAVQTSPVVWGGVGTVGQHAFHQLFYQGTRTIPMDFIVPVGDDDPRQRGLVDNAFAQAAALMNGRDLATATAALAAKGMTPDEVERLAPHLVCPGNQPSTTILLPQLDAYHLGALLALYEHKVFVQGWIWGINSFDQYGVELGKEMARALAQGGSAECDASTAGLMAAAAAIRASNRAR

SEQ ID NO: 46658 - protein, 343 aa, Burkholderia xenovorans LB400
MKALAKLERAPGLTLTDVKKPEVGHNDVMIRITRTAICGTDIHIWKWDDWAQKTIPVPMHVGHEYVGEIVEMGQEVRGFAIGDRVSGEGHITCGFCRNCRAGRRHLCRNTVGVGVNREGAFAEYLVIPAFNAFKIPPEISDDLAAIFDPFGNATHTALSFNLVGEDVLITGAGPIGIMAVAIAKHVGARNVVITDVNDYRLELARKMGATRAVNVSRESLRDVMADLHMAEGFDVGLEMSGVPSAFTGMLEAMNHGGKIALLGIPPAQTAIDWTQVIFKGLEIKGIYGREMFETWYKMVAMLQSGLDLSPILTHHFKVDDYREAFATMLSGESGKVILDWTAA

SEQ ID NO: 46659 - protein, 377 aa, Zea mays
MADGEDIQPLVCDNGTGMVKAGFAGDDAPRAVFPSIVGRPRHTGVMVGMGQKDAYVGDEAQSKRGILTLKYPIEHGIVNNWDDMEKIWHHTFYNELRVAPEEHPVLLTEAPLNPKANREKMTQIMFETFNAPAMYVAIQAVLSLYASGRTTGIVLDSGDGVTHTVPIYEGYALPHAILRLDLAGRDLTDCLMKILTERGYSFTTTAEREIVRDIKEKLAFVALDYEQELETAKSSSSVEKSYELPDGQVITIGAERFRCPEVLFQPSLIGMEAPGIHETTYNSIMKCDVDIRKDLYGNIVLSGGTTMFPGIADRMSKEITALAPSSMKIKVVAPPERKYSVWIGGSILASLSTFQQMWISKDEYDESGPAIVHRKCF

SEQ ID NO: 46660 - protein, 125 aa, Escherichia coli CFT073
MKKENVVAEETIFSKIIRREIPSDIVYQDDLVTAFRDISPQAPTHILIIPNILIPTVNDVSAEHEQALGRMITVAAKIAEQEGIAEDGYRLIMNTNRHGGQEVYHIHMHLLGGCPLGPMLAHKGL

SEQ ID NO: 46661 - protein, 637 aa, Synechococcus elongatus PCC 6301
MAVEPFQSQESFRRPLEWGSCLVCCAFPTGSGCMTDVSVSKIRNFCIIAHIDHGKSTLADRLLQETGTVQAREMKEQFLDNMELERERGITIKLQAARMNYRAQDGEQYVLNLIDTPGHVDFSYEVSRSLQACEGALLVVDASQGVEAQTLANVYLALENDLEIIPVPNKIDLPGADPERVKREIEEVIGLDCSGAIEASAKSGIGIGEILESIVHLVPPPSDTTGEPLRALIFDSYYDPYRGVIVYFRVIDGTVRKGDRIRLMASGKEYEIDELGVLSPNQVQVEELHAGEVGYIAASIKAVADARVGDTITLARARATEPLPGYVEAKPMVFCGLFPTDSDRYPDLRDALEKLQLSDAALQYEPETSSAMGFGFRCGFLGLLHMEIVQERLEREYNLDLITTAPSVVYQVTTLDGEVLRLDNPSKLPPPQQREKIEEPYVKVEIITPENYVGALMDLCQTRRGIFIDMKYLTQERTTLIYEMPLAEVVTDFFDQMKSRTKGYASMEYSLIGYREGELVRMDILINSEPVDPLATIVHRDKAYYVGKALVEKLKELIPRHQFKIPLQAAIGSRVIASESIPALRKDVLAKCYGGDISRKKKLLQKQAKGKKRMKAIGTVDVPQEAFMAVLKLDREG

SEQ ID NO: 46662 - protein, 222 aa, Coccidioides immitis RS
MSDSKAQKSAYGTPSSDTAFRKTWDREAYNEKAAVDAAKAKAESKARYEAKLLGKKYHAPVDYSTLEATTSRTQRLDVASLVGKTTIVPAGAAVGKRGRGAGFYCSDCDLTFKDNIQLVEHLNSKQHLIATGQSGEVVRAGVEDVRLRLRMLSHKRRMEAEEERKAGELDLNQRLKIREEEEEREREERRRKRNEKRRKTGKNGENGIKQEDSWEGRLGIIS

SEQ ID NO: 46663 - protein, 1062 aa, Bacillus clausii KSM-K16
MPKRTDLTKILVIGSGPIVIGQAAEFDYAGTQACQALKEEGYEVILINSNPATIMTDTAMADRVYIEPLTLEFVTRIIRKERPDGLLPTLGGQTGLNMALELKNAGILEQYQIELLGTKLDAIEQAEDREQFRALMNVLGEPVPESEIVHTLDEAFAFVETIGYPVIIRPAYTLGGTGGGIAYNDEDLAEIVASGLKYSPVTQCLVEKSIAGFKEVEYEVMRDSKDEAIVVCNMENFDPVGVHTGDSIVFAPSQTLSDNDYQMLRNSALSIIRALGIEGGCNVQFALDAHSDQYYIIEVNPRVSRSSALASKATGYPIAKIAAKIAVGYHLDELKNPVTETTYASFEPSLDYVVAKIPRWPFDKFESANRKLGTQMKATGEVMAIGRSLEESLLKAIRSLEAGYDHLFDEQLEKKPEDELLEKIAKADDERLFAIGALLRKGISVETIYETTSIDRFFLQKLARIVALEETINEARSNEAMLLRLKRAGFSDSYIGRKWGSEEKDVFAVRQQAGIVPVYKMVDTCAAEFASPTPYFYSTYEQENESQRTEKESILVLGSGPIRIGQGIEFDYATVHTVWAIKEAGYEAIIMNNNPETVSTDFSTSDKLYFEPLTVEDVMHVVGLEKPKGVIVQFGGQTAINLAAALAERGVSIIGTTLEDMDRAEDRDKFEQTLVELGIPQPLGKTATSVDGAVAIARKIGYPVLVRPSYVLGGRAMEIVYHEEELLRYMQTAVKVNPKHPVLVDRYLTGKELEVDAISDGNDVYIPGIMEHIERAGVHSGDSIAVYPPQTVPDHLKQRLIERTTSIAKGLNIVGLLNIQFVWHKDDVYVLEVNPRSSRTVPFLSKITGVPMAKVATHVMLGKTLRQLGYQSGYHPETEEVSVKVPVFSFAKLRRVDISLGPEMKSTGEVMGRDQTLEKALYKGLVASGMNIPAHGAVLFTIADKDKNESVSIAKRFHEIGYSLVATSGTANVLAEAGIPVKVVNKINEGEPHLLDLIRQGEVQFVINTLTRGKQPARDGFRIRRESVENGVVCLTSIDTAQALLSVLESITFATWSMPQHG

SEQ ID NO: 46664 - protein, 273 aa, Oryza sativa
MSEGEEEEGRQVQEVVAHVYDVASSGSSEGGGGGTAILHVNRFFKDAIGLGGIFHTAIQVYGDEEWSFGYCENGTGVFSCPPCKNPMYTYRESIVLGKTTCSIFTVNQILRELSWKWPGGSYELLSRNCNHFCNTFCEKLDVPKLPAWVNRFANAGDAALEVAENTAEKLKQAKKDIAGACKAATTYLTGASSSSPSNADDSGGSTNSSLFEGTWLRSIIGISMKPSRSLMCSDSSDSSDDEKSEDERESDCQQPSGDQIEEKKDATQEQAGK

SEQ ID NO: 46665 - protein, 429 aa, Xanthomonas axonopodis pv. citri str. 306
MNHSRSHALFAQAQTLLPGGVNSPVRAFKSVGGEPFFVARADGPYLFDVDDNRYIDYVGSWGPMIAGHNHPAVREAVEQSIRNGLSFGAPCAAEVAMAQTITRLVPSCEMVRMVNSGTEATLSAVRLARGATGRNRIIKFEGCYHGHGDSFLVKAGSGMLTLGVPTSPGVPAGLSELTATLSFNDFEGATALFDEIGAEVAAVIIEPVVGNANCIPPQAGYLQHLRTLCTRHGALLIFDEVMTGFRVALGGAQAHYGVTPDLTTFGKIIGGGMPVGAYGGRRDLMEQVAPAGPIYQAGTLSGNPVAMAAGLAMLELVQEPGFHTRLSEATSMLCEGLEDAARAAGIAVTTNQVGGMFGLFFTDDIVESYAQATACDITTFNRFFHAMLQQGVYLAPSAYEAGFMSSAHDEAVIDATLAAAREAFAEVAR

SEQ ID NO: 46666 - protein, 291 aa, Zea mays
MAAAPSSLVSSHLSRLADLRRAAAPATPTVPQQLRVGFSRRRAQRVVAMAGSGKFFVGGNWKCFLYPLIQNGTKDSVSKLVSELNAATLETDVDVVVAPPFIYIDQVKNSLTGRIEVSAQNVWIGKGGAYTGEISAEQLVDIGCQWVILGHSERRHIIGENDEEKLLEEREAGKTFEVCFEQMKAFADSISNWADVVIAYEPVWAIGTGKVATPEQAQEVHAAVRDWLTTNISPDVASSTRIIYGGSVNAANCAELAKKEDIDGFLVGGASLKAPDFATIINSVTAKKVAA

SEQ ID NO: 46667 - protein, 296 aa, Nilaparvata lugens yeast-like symbiont
MPYVSVARYGKDNVRVLKVSRDAGIGVQTVTEMTIRCLIEGDIEASYTGADNSSVVATDSIKNTIYILAKQHRVNPPELFASIISSHFIQKYSHIHVADVDIITHRWLRMDVDGKPHPHSFIKDAGETRNVHVNAKRQDGIAIASSIVGLSLLKSTGSAFGGFVRDEFTTLPESWDRILATDVDASWKWSKFANLEAVEQSAAKFDAAWESARCITLELFAQDDSPSVQNTMYKMCQQILNVLPDTQSVTYVLPNKHNFELDLSWHGGIQNTGKQAEIYVPQTCPNGLIKCEVSRS

SEQ ID NO: 46668 - protein, 54 aa, Glycine max
TVPAEAVFQSEVKKLQQEQFKPAEQVTLEPFERDHACVVGTYRAPKKAKAATAA

SEQ ID NO: 46669 - protein, 477 aa, Methanosarcina acetivorans C2A
MWEEGGSILDYGEPETLEKWRNSEKTEKSEDPMRKQETELDFFEQEIGLLDVVGPRAREIIGQDCKVMSACVSRPYPLVVDRAKGSVIKDIDGKEYIDFIAGIAVMNSGHSNPEVNAAISAQLEKMVHCGYGDFFAEPPLKLAKKLRELSGYSKVFYCNSGTEAVEAAMKLALWKTKRPNFIAFYNAFHGRTLGALSLTCSKVRQKEHFPTMRTVHTHYAYCYRCPLNLEYPSCGVECAKQIENLIFRKELSPEDTAAVFIEPVQGEGGYIVPPQEFHKEVKRICTDNDVLLIADEVQTGCFRTGPFLAMENFEVRADITCLAKALGAGLPIGAMLADSTLMDWPPGVHSNTFGGNLLSSASALASLEFLEKENMENRVREMGTHIRQRLRELQENCPCIGDVRGLGLMIGAEIVKSDKSIDPIRRDRIVREAFKEGVLLLPCGDSVIRFSPPLVMTDEEADLGLDKFEKALRRAAK

SEQ ID NO: 46670 - protein, 503 aa, Methanosarcina acetivorans C2A
MVLYSLFQGDFVVQEYKLHIGGESRDSATGETFDNINPATLENLATVQVAGSEDVDRAVEAAEEGFRVWSEVPAPRRAEVLFRTARILQERKEDLARLMTEEMGKVLPETRGDVQEAIDIAIYAAGEGRRMFGETTTSELKDKFCMTVLRPIGVVGMITPWNFPLAIPGWKIMPALIAGNAIVFKPASDTPLLAIKLVEILMEAGLPPGVVNLVTGPGGSTGKAIVQHPRIKAISFTGSLETGKWIMEECAKTMKRVSLELGGKNPVIIMDDADLELALEGVLWGAFGTTGQRCTATSRLILHEKIKDEFTARLLAKTKLLRVGNGLLPETDIGPIINKAQLEKIERYVRIGMEEGATLLLGGKAIDPGLPGYFFEPTVFTDVRPDMRIAQEEIFGPVLSIITVSGLEEAIEVANNTRYGLSSAIYTENVGKAFRAVKKIEAGITYVNAPTIGAEVHLPFGGVKGTGNGFREAGTEAIKEFTEIKAVYIDYSGRLQRAQIDME

SEQ ID NO: 46671 - protein, 443 aa, Escherichia coli CFT073
MVNKFKGVTLTTPLKKIVIVGGGAGGLEMATQLGHKLGRKKKAKITLVDRNHSHLWKPLLHEVATGSLDEGVDALSYLAHARNHGFQFQLGSVIDIDREAKTITIAELRDEKGELLVPERKIAYDTLVMALGSTSNDFNTPGVKENCIFLDNPHQARRFHQEMLNLFLKYSANLGANGKVNIAIVGGGATGVELSAELHNAVKQLHSYGYKGLTNEALNVTLVEAGERILPALPPRISAAAHSELTKLGVRVLTQTMVTSADEGGLHTKDGEYIEADLMVWAAGIKAPDFLKDIGGLETNRINQLVVEPTLQTTRDPDIYAIGDCASCPRPEGGFVPPRAQAAHQMATCAMNNILAQMNGKPLKNYQYKDHGSLVSLSNFSTVGSLMGNLTRGSMMIEGRIARFVYISLYRMHQIALHGYFKTGLMMLVGSINRVIRPRLKLH

SEQ ID NO: 46672 - protein, 148 aa, Triticum aestivum
SARGGNPMLQTMKKFSRILALMTIPFTMHFPKAIFCYWVTANLFSLGYGFALRKTAVRYFLNLPEVVPQPKAAQLSTFNLFEAPKPVSAVDTPTGNNGDSPTGDNCDSPTAANGSEQSNAELSDRVVFLEKKIAELERRAKARGESQE

SEQ ID NO: 46673 - protein, 532 aa, Synechococcus elongatus PCC 6301
MLDASISPVVLVILDGWGYRNATEGNAIRTAETPIMDALWEAYPSTLIHTSGKDVGLPDGQMGNSEVGHLNLGAGRIVPQELVRITDAVEDGSILENPALLQACSAVRQHGSKLHLIGLCSDGGVHAHLDHLGGLLKLAAAQGIQDVYIHAITDGRDTNPTEGVNCITKIERLIATAGVGQIVTICGRYFAMDRDRRWDRVRKAYELLTIDGEGCGQTATEVLQETYAKGVSDEFVEPTRLAPGAIAPGDGVIFFNFRPDRARQLTYAFVEAEFEGFERDLIQPLTFVTFTQYDANLNVPVAFEPQNLTNILGEVVANHGLRQFRTAETEKYPHVTYFFNGGIEEPFPGEDRELIPSPMVATYDRAPKMSAQAVTDAAIAAIDKGIYSLVVINYANPDMVGHTGKMGATVEAIETVDRCLGRLVSAINRAGGTALITADHGNAEYMWDENGEPWTAHTTNLVPFIVVEGERRKLPGFGTEIPLREDGRLSDIAPTILQLLGLPQPVEMTGRSMIEPAAYEVKQGRTPVKVGV

SEQ ID NO: 46674 - protein, 595 aa, Kluyveromyces lactis NRRL Y-1140
MPTISVNKRQLFEALGKNYTNEEFDELCFEFGVELDEDTTEEALKTGEEPELKIEIGANRYDLLCIEGIAQSLNEFLGNVEAPEYKLSKPTTKLIIEESTTQIRSYACAAILRNVTFTEANYASFISLQDKLHSNLCRNRTLVAIGTHDLDTIKGPFHYRAEKPTDIKFVPLNQSKEYDGAELIELYKQPEQKNNLGRFVHIIEDSPVFPVIYDDNNVVCSLPPLINSEHSKISLNTKNIFIEVTATDRTKSEVVLDQIVAMFSRYCEDQFTVEPVEIVSEHNNQSRVTPNFTPKIMDVKVDYINSCLGLTLSPEEISKNLKKMSLKATPSSDDQNILHVEIPITRSDILHPCDIMEDAAIGYGYNNLPKGNQLSNANFVASALPINKISDILRIASSQASWLEVLPLTLCSHDENFKFLRMEDDNTKAVKLANPKTLEYQVVRTSLLPGILKTVKENRKHSLPIKVFEAGDVVFKNDKLERRAFNQRHWAAAYVGKTASFEIIQGLLGKIMQTFRTQWLPDYGAGSTGRGYWIEKDDTLTTYFPGRGAKIMFRHKEGEEARQIGHIGVLHPEVMSNFDIPYAGSYVEINSEAFL

SEQ ID NO: 46675 - protein, 258 aa, Glycine max
MESCQQKVMEKLLHGHGCANQLKLIMDHHAESDSSVEREDLAKSVLHCFSDALSILIDTNDHNKDDDKSNNSSPQDSSHVLESSRKPFHKRGRKTSMAESSDYRRHESPNPIYHDGFLWRKYGQKQIKESDHQRSYYKCAYTNDQKCEAKKQVQMIQNNPPLYSTTYFGRHTCQLHQAFETFPIDTSDPQDSRMIRFDNPDSSTHQHQNQIIHLKAEQMMPSEKAEEWSSPSEYMSSEVAYAVEAFGFNPARTSSDLS

SEQ ID NO: 46676 - protein, 333 aa, Aspergillus oryzae
MQSVLKPIIGPKKEIHDLSGRVALITGGALGIGYEVARAFVLNGARVIMVNRKEEQGQAAIDKIKEEAGADAKIEWVPCDMGNLAQIKEVFTGIREREERLDLLILSAGINANQYGETHDKIDRHFQVNWLGQFYVCNLLFPLIRKTSKLPDTPAPRIVWETSEQHRAAPKVVHFGSLDEINNPAIDNTELYGRSKLAIILGVKYGFLDRVIKPNEDNIYVLSVHPGAVNTTMQQQWKDAYPGLLGKVLTTAMLAIGRDVEQGAFSALWAATSPEIEEKSWNGYYFSDSAQPGKETSQASDPTLGASLWDLSHRIIQDKVGKDAIVDWNSSKS

SEQ ID NO: 46677 - protein, 295 aa, Moorella thermoacetica ATCC 39073
MIQVKASTGLVALLGHPVQHSLSPLMHNAAFAAGGQNLVYLAFDVKPGDLAAALAGLKALGFRGANVTVPHKEAIIPYLDAVDPVAARIGAVNTIVNEDRCLKGYNTDGSGFLRSLEEAGFDPAGKRAVILGAGGAARAVAFALATAGCGSLVLANRTPERATELAGALAGAGLPAPVVYRLGDAGMRSEVEAADLVLNTTSLGMWPRVEETPLPPDWFRPGQWVYDLVYNPLETKFLAGARRRGCRVISGLDMLLYQGAAAFTLWTGREAPVAVMDRVLREAMGASSGGPAAGR

SEQ ID NO: 46678 - protein, 468 aa, Lactobacillus sakei subsp. sakei 23K
MVVGDFAIELETVVIGSGPGGYVAAIRAAEMGQKVTVIERENIGGICLNVGCIPSKALISAGHRLQEAKNSEVFGVSTTGATLDFAKTQDWKQHQVVEKLTGGISMLFKKHKIDVLDGSAFLVDEHSLRVIKEESAQTYSFKNLIIATGSRPIEIKGFKFNKRVIDSTGGLNLTEVPKELVVIGGGYIGSELAGAYANLGAHVTILEGTDSILPNFEKDMVQLVTKNFKTKGVDVITGAMAKESIETDQNVTVKYEVGGKEEQLVADYVMVTVGRRPNTDDMGLEQAGIKMADRGLIEVDQQGQTNIKGIYAIGDIVSGAALAHKASYEAKIAAEAIAGKKVIVDYKAMPAVCYTDPELATTGLTVAEAKEKGYNAKGFKFPFAANGRALSLAETDGFVRLVTNTDDNTLLGAQVAGVGASDLISELTLAIESGMNAEDLALTIHPHPTLSEAIMDDAELALGLPIHI

SEQ ID NO: 46679 - protein, 355 aa, Sclerotinia sclerotiorum
MASRAPNPSSGSRKISFNVSEQYDIQDVVGEGAYGVVCSALHKPSGQKVAIKKITPFDHSMFCLRTLREMKLLRYFNHENIISILDIQKPRNYESFTEVYPIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFKTMFPKTSDLALDLLEKLLAFNPVKRITVEEALKHPYLEPYHDPEDEPTANPIPEEFFDFDKNKDNLTKEQLKQLIYHEIMR

SEQ ID NO: 46680 - protein, 540 aa, Lactobacillus sakei subsp. sakei 23K
MAYQFKLPDIGEGIAEGEIQKWAVAEGDTIAEDDTLLEVQNDKSVEEIPSPVSGKIVKILVGEGEVATVGQVLVEIDAPGVEGNDAPTAETTTPAAEQPAAPAASEGVYQFKLPDIGEGIAEGEIQKWAVAEGDTIAEDDTLLEVQNDKSVEEIPSPVSGKIVKILVGEGEVATVGQVLVEIDAPGHNTATASAPVATTPAPQAAETPVATNNSSDTSVVAISDPNRKVLAMPSVRQFARENNVDISQVPATGKHGRTTKEDIQNFMQNGTALVASTTTTDTKSAPVTTATPEPAVAVKPYESATPELETREKMSPTRKAIAKAMVTSKHIAPHVTLFDEVEVSKLMTHRKKFKDVAAKKDIKLTFLPYIVKALVTVLRDFPTLNASIDDTTSEIVYKHYINVGIATDTDHGLYVPNIKDADSKSIFAIAKEIGENTQKALDNKLKPAEMSGGSMTISNIGSIGGGWFTPVVNYPEVAILGVGRIGTEPIVNEDGELAVGKVLKLSLSFDHRLIDGGTAQRAMNELKELLADPELLLMEG

SEQ ID NO: 46681 - protein, 332 aa, Lactobacillus sakei subsp. sakei 23K
MQRSRIKMAQKTMIQAITNALDLELASDENVLIFGEDVGKNGGVFRATEGLQAKHGEERVFDTPLAESGIGGLSIGLALEGFRPVPEIQFFGFVFETLDSIAGQMSRTRYRMGGTRNMPITIRAPFGGGVHTPEMHSDNFEGMITQIPGIRVVVPSNPYDAKGLLIAAIRSNDPVLYLEHMKLYRSFREEVPDESYTVPLDKAAVTLEGSDVSIITYGAMVREAKKAAENLAKDNISVEIIDLRTIAPLDIKTIIASVEKTGRVVIVQEAQKQAGVGAQVASEISERAVLSLEAPIGRVSAPDTPFPFGQAESTWLPNATDIENKVKEVINF

SEQ ID NO: 46682 - protein, 434 aa, Ustilago maydis 521
MPETKSSIPSDSSSTSSSSSTAGDNRFFPSSHGPTLSGVASLLASPTTRNVIVLAGAGISTSASPPIPDFRSPGTGLYANLAAYNLPYAEAIFDIGYFQRHPQPFFTLAKHLYPGNFKPALAHYFLTLLQRKQKLKRVFTQNVDTLERIAGVEADKVVEAHGSFATSTCIVCKHSVDDDWIRNKVESGQVARCPRPKCPGRKTGSKGEQRGGLVKPDIVFFGESLPPRFFRCIPDLKTADLLIVMGTSLQVQPFASLIDAVPATCPRLLINLERVGELASSNGYLGGGMGAGMYNESGFDFDGLTHGGKHKTRDVFYEGKADDGVAELVKLIGKEWQTELEKLKEEGYKQLDRDKKSTQMATESKNGSGHTDSSRKQEDSKTKVEGLANSSTIKGDSTKLDELTRDLETKVKLDDQSKEVARDSQGVVSNKPSS

SEQ ID NO: 46683 - protein, 317 aa, Pseudomonas putida KT2440
MKMNHLDIAKEALVAQAQAVAKLADRLDGQFQSAVDLILACEGRTVVCGMGKSGLIGKKMVATFASTGTPSFFLHPAEAFHGDLGMLKPVDVLVLISYSGETEELIKLIPSLKSFGNKFIAMTGSGNSTLAKHADIWLDISVDREVCPNNLAPTTSTLATMAMGDALAVALITANQFKPMDFARYHPGGSLGRKLLTRVADVMHSPAPIVSPASSFQDCLLMMTQSRLGLAMVMDGNELVGIVTDGDLRRALLKNNQVIHASVTEFMTLNPHTIPADCRVSVAEAYMLENKIRALAVVDDCGAIVGVVEIFDGNPVA

SEQ ID NO: 46684 - protein, 391 aa, Oryza sativa (indica cultivar-group)
MERLISKSVAARIPLPGGGSPSRRLAVAGLGGGGGVEPWAGRLRAQPRLGPIAARPHDGVSAPPREAAPAAAVGPPWKLLWSLLPKVIKMFDCVSTVNCENAMIISCIHHSLAQCSLHDLLASRAALFLLVALVTGTLQSSIPYPAHASVQSITKTGGLFTSEILSSGWAGFIAGCLHTLSGPDHLVALAPLSIGRSRLESGLVGALWGCGHDAGQVIFGLLFLLLKDRLHIEILRTWGTRVVGLTLLIIGGMGIREATEVQESSLALEGVDCNITSSEPLQTPAAPRKKKVGFATFATGVVHGLQPDALLMVLPALALPSRFAGAAFLGMFLMGTVFSMGSYTAFVGSCSEALKEKVPRITEKLTWAASLVAICMGIALLVGQFFGFSLY

SEQ ID NO: 46685 - protein, 554 aa, Pseudomonas putida KT2440
MAFYRTPHDVTALPAWKALQQHREAMRGFSMSEAFAADAKRFDQFSLSACGLFLDYSKNLITEQSRDLLVNLANEVGLQDAIKSMFSGEIINASEGRPVLHTALRRPVGDKLSVNGVNVMPEVHKVLNQITELVGRIHDGLWRGYSEKPITDVVNIGIGGSFLGPELVSEALLPYAQRGVRCHYLANIDGSEFHELSANLRAETTLFIVSSKSFNTLETLKNAMAARTWYLAQGGSEAELYRHFIAVSSNKAAAVAFGIREENIFPMWDWVGGRYSLWSAIGLPIALAIGTANFKELLSGAYTMDQHFQTAPFDKNMPVLLALLGVWYGNFWDANSHAILPYDHYLRNITKHLQQLDMESNGKSVLQDGTPVKTDTGPVIWGGVGCNGQHAYHQLLHQGTQLIPADFIVPVVSFNPVADHHQWLYANCLSQSQALMLGKTREEAEAELRAKGLNEADIEKLAPHKVIPGNRPSNTLVVERISPRRLGALVAMYEHKVFVQSVIWGINAFDQWGVELGKELGKSVYQRLVGSLEDSAEDGSTQGLINYFRGKHRG

SEQ ID NO: 46686 - protein, 605 aa, Oryza sativa
MEASTSLLVLVLAAAAFAAGTVTEAAGDGCSAGCDLALASFYVTPNQNVTNMADLFGIGAANYRSLAPYNPNIPNLDFINVGGRVNVYFTCGCRSLPGSPGATYLAGAFPFQMSRGQIYTSVAANYNNLTTAEWLQATNSYPANNIPDTAVINATVNCSCGDASISPDYGLFLTYPLRAEDTLASVAATYGLSSQLDVVRRYNPGMESATGSGIVYIPVKDPNGSYLPLKSPGRRKAKQATLLQSSEDSTQLGTISMDKVTPSTIVGPSPVAGITVDKSVEFSYEELSNATQGFSIGNKIGQGGFGAVYYAELRGEKAAIKKMDMQATHEFLAELKVLTHVHHLNLVRLIGYCIESSLFLVYEFIENGNLSQHLRGMGYEPLSWAARIQIALDSARGLEYIHEHTVPVYIHRDIKSANILIDKNYRAKVADFGLTKLTEVGGTSMPTGTRVVGTFGYMPPEYARYGDVSPKVDVYAFGVVLYELISAKEAIVRSTESSSDSKGLVYLFEEALNSPDPKEGLRTLIDPKLGEDYPIDSILKLTQLAKVCTQEDPKLRPSMRSVVVALMTLSSTSEFWDMNNLYENQGNKIIDPSVVASTVEMAELV

SEQ ID NO: 46687 - protein, 408 aa, Xanthomonas axonopodis pv. citri str. 306
MSTAADSPLSLAHYYLPVYRPRQVVLERGQGSRVWDDAGREYLDLSSGIAVSGLGHNDPDLVAALTEQAGKLWHTSNVFFSAPPLKLAEELVSASRFAHKVFLCNSGTEANEAAIKLVRKWASSQGRPADKRVIVTFRGSFHGRTLASVTATAQPKYQEGYEPLPGGFRYVDFNDVAALEAAMAGGDVAAVMVEPIQGEGGVMPAAPGFLSRVRALCDQHDALLVLDEIQCGMGRTGTLFAHWQEQVTPDIVTLAKALGGGFPIGAMLAGPKVAQTMQFGAHGTTFGGNPLAAAVARVALRKLASPQIADNVVRQSAALRAGLEALNAEFGLFAQIRGRGLMLGAVLAPEHAGQAGAILDLAAKHGLLLLQAGPDVLRFVPALNLTDAELADGLARLRLATAEYVAQP

SEQ ID NO: 46688 - protein, 425 aa, Cryptococcus neoformans var. neoformans B-3501A
MTSLPQALKRAQQTYANRNRKSYEAHQAASRHLPGGSTRSSIFIHPFPLCIQKGQGVKITDLDGHEYVDFVSDFTSGIYGKSHPVLIDAIKEALDNGLQLGAHTLAETTLASHFTSRFPSIELVRFANSGTEANILAISTAVKHTGRKKVLVFEGGYHGSVMSHFHMKGGDGDDLKVPFDFVVCSYNDPKGADALISQHPSEIGAILVEPMLGAGGCIPGDPAFLQFLREKASSIGAVLIFDEVQTARLSTGGRQKILGITPDLTTVGKFFGGGFAFGAFGGKKEIMEKFDARKGGAISHGGTFNNSPLTMVAGATAMEKILTEDALKNLNKLGDWMREEINRMFTSDGSPFLMTGLGSINQFHCTLSSNQNQVLDLLFFYLLERGFWIAQRGLVSLSFAMTKEDVQRFIEAAVEATQKVKATLK

SEQ ID NO: 46689 - protein, 528 aa, Synechococcus sp. RS9917
MSSIQSDGQRKPAIVILDFGSQYSELIARRVRETEVYSVVLGYSTSAEELRELAPKGIILSGGPSSVYAEGAPLCDPALWSLGIPVLGVCYGMQLMVQQLGGRVEAATGKAEYGKAPLVVDDPTDLLTNVDDGSTMWMSHGDSVEALPPGFVGLAHTANTPMAAVADHQRQLYGVQFHPEVVHSTCGMALIRNFVYHICGCDPDWTTAAFIDEAVRLVREQVGEKRVLLALSGGVDSSTLAFLLKKAIGDQLTCMFIDQGFMRKGEPEFLMDFFDRKFNIHVEYIHARKRFLDKLAGITDPEEKRKIIGTEFIRVFEEESKRLGPFDYLAQGTLYPDVIESAGTNIDPKTGERVAVKIKSHHNVGGLPKDLQFKLVEPLRKLFKDEVRKVGRSLGLPEEIVRRHPFPGPGLAIRILGEVTDEKLDCLRDADLIVREEIKEAGLYHEIWQAFAVLLPVRSVGVMGDKRTYAWPIVLRCVSSEDGMTADWSRLPPELLERISNRIVNEVKGVNRVVLDITSKPPGTIEWE

SEQ ID NO: 46690 - protein, 413 aa, Thermoanaerobacter tengcongensis MB4
MAVNPLKAVQEQIKNACELLNLEESVYEILKEPLRVMEVSIPVQMDDGTVKVFKGYRSQHNDALGPAKGGIRFHPDVTLDEVKALSMWMTFKCGVVGLPYGGGKGGVAVNPQELSPTELERLSRGYIRAISSIIGPEKDIPAPDVGTNAQVMAWMVDEYNKIVGYNSPAVITGKPLIYGGSKGRVDATGYGVALIAREAAKKLEMDIKNCTVAIQGYGNVGSYTGIHLQRLGAKIVGVVDIYGGVYNERGIDAEKLAEHVRKTGSVKDFEGTTSLTNEELFALDVDVLIPAALENQITEENAPNVKARMVCEAANGPTTPEADRILREKGIFVVPDILANSGGVIVSYFEWVQNLMNYYWTEEEIKERQEIVMINAFNNIYQLAQEYKVDMRTAAYMIAIKRIYEAMKVRGWI

SEQ ID NO: 46691 - protein, 165 aa, Oenothera elata subsp. hookeri
MFPMVTGFMNYGQQTVRAARYIGQGFMITLSHANRLPVTIQYPYEKLITSERFRGRIHFEFDKCIACEVCVRVCPIDLPVVDWKLETGVRKKRLLNYSIDFGVCIFCGNCVEYCPTNCLSMTEEYELSIYDRHELNYNQIALGRLPMSVIDDYTIRTILNSAQIK

SEQ ID NO: 46692 - protein, 462 aa, Desulfitobacterium hafniense Y51
MSSEKDHHVELHRGLKNRHIQMIALGGAIGTGLFYGSATTIQLVGPAIIVSYLLGGTAIFFIVRALGEMCVDQPVAGAFSYFAYKYLGDFPGFFSGWNYWFNYIAVSMAELTVVGVYINFWYPNVPQWVTALAFLVIITLINLINVEAFGEFEFWFALIKVVAILAMIAFGLVMIFFGLGEQGAVGFSNLWTHGGFLPNGVWGLLLSLVIVMFSFGGVELIGITAAEADDPKRSIPKAINQVVWRILIFYIGALTILMILYPWDQIGTSGSPFVEIFSAIGIPAAAHILNFVVLTAALSVYNSGIYSNGRMLHGLALQGNAPKFLTKVSRNGIPINGVFASSAVTLIAVILNFLVPGKVFLYLISIATIAGIFNWAMILVTQLRFRKVEAEKGREDQLQFKMPLYPISNYIALAFLAMVVVLMAYIPDMVYSLYIGPIWIIILYIGYKFLRRNPETKPPHRE

SEQ ID NO: 46693 - protein, 662 aa, Oryza sativa
MTLQMEPPPPPPRRSVSTSCDLHPGETFTGFCAACLRERLAGLEASTAAAAAAPGRRSTSAIRSLFSRPFVAAGGGGGGGGGGGAVPSGSSAAVPDLRRCKSFSCGRGGDVLAGGCGDEPQRRSCDVRGRSTLWALFHQDDRERVRDGTAFGAFPASSSAAAAALASEVQPQPPPPPPPCVPEVFLEEEIAMAEESDEITPVVEPILVVDTSGEMETEANGGREAKAMKDHIDLECSQAKKPQPKDLKEIAGSFWLAASVFSKKWQKWRRKQKLKKQDAAGSKAAAAAMPPPEKPSKPSFLRRSRLRGEACSEFAGGRRSCDTDPRFSLDAGRMSVDDVGFSWDEPRASWDGYLFGAGTGIGLGRAPPPLSRLPPILSAMEDSPAGIVERSDGQIPVEDDSQPEPDPDADTPGGSVQTRDYYDTSSSSRRRRSLERTSSVRRPSFEVTDAKPVLPAAAAITSVKDSPLIGSSEFYHFQHAEDLLEHHRFSTSSLIEDFPMSLDAAFPGPDKKPRRWRKAWSLWGLIHRRAAGRRGGASDVADRAFSEPWPELRVRGCNARMQRCNSNASARSSFSSNSGGLGSSRRSYVDGNGNVVKRRREECALERNRSARYSPGHADNGMLRFYLTPMRSASGRRAPGLPAKGGRQLRSQSFARSMLRLY

SEQ ID NO: 46694 - protein, 159 aa, Rickettsia conorii str. Malish 7
MINYLKSFFLYEIVRGMVLTLKYFFKPKVTINYPYEKSPISPRFKGEHALRRYENGEERCIACKLCEAICPAQAIVIEADEREDGSRRTTRYDIDMTKCIYCGLCQEACPVDAIVEGPNFEFASLTHTALIYDKERLLQNGDRWEQALASKLHKDYEYR

SEQ ID NO: 46695 - protein, 393 aa, Oenothera elata subsp. hookeri
MNVTTTRKDLMIVNMGPHHPSMHGVLRLILTLDGEDVIDCEPILGYLHRGMEKIAENRTVIQYLPYVTRWDYLATMFTEAITINGPEQLGNIQVPKRASYIRIIMLELSRIASHLLWLGPFMADIGAQTPFFYIFRERELVYDLFEAATGMRMMHNYFRIGGVAADLPYGWIDKCLDFCDYFLTAVSEYQKLITRNPIFLERVEGVGIIGGEEAINWGLSGPMLRASGIEWDLRKVDRYECYGELDWEIRWQKEGDSLARYLVRMSEMTESIKIIQQALEGIPGGPYENLEIRCFDREKDPEWDGFEYRFISKKPSPTFELPKQELYVRVEAPKGELGIFLIGDQSGFPWRWKIRPPGFINLQILPQLVKRMKLADIMTILGSIDIIMGEVDR

SEQ ID NO: 46696 - protein, 320 aa, Azoarcus sp. BH72
MGIRLYDERPEALLEAMLLIRAYEEKAAALQAESGTPGTCTAVGQEAAAVGVVAALGADELILTNHRSAGHLLARGADPGRLLAEVMGRRGGYCKGKSGSLHVSARELGVVLTSTIVGGELALATGVALAQKQLRRPGAVVCFFGDGAACEGRFHESLNLAALWGLPVLYVCENNEWQAFVHRRETMLAEGIAGWAGNYGIDHATVDGNDVEQVRAVAAAALESVRGRGRPFLLEARTYRLRGHFEPDDQAYVDTDELAAWRARDPLPRMEARLLASGRCDAGAITAMKAAVAAQVAAAHAFAIDSPYPALEELTTDVYA

SEQ ID NO: 46697 - protein, 126 aa, Pseudomonas syringae pv. phaseolicola 1448A
MTKTVITSDKAPAAIGPYSQAIKAGNTVYMSGQIPLDPSSMELVEGIEAQITQVFENLKSVAEAAGGSFKDIVKLNIFLTDLGHFAKVNEIMGTYFTQPYPARAAIGVAALPRGAQVEMDAILVIE

SEQ ID NO: 46698 - protein, 318 aa, Azoarcus sp. BH72
MARITVQEAIEQALAEEMSLDANVLLMGEGVATKRPGLVQAFGGERVRNTPLAEGIIAGTAAGAAAMGLRPVIDLLFAPFLCYAMDELVNSAGKLRYLSGGQFEFPLVALAMTGAGWGVGAQHNHNVEAWFAHAPGLKMVMPSTVADFKGLLKSAIRDPNPVLFFVDIALAYAAGEVPEGEVLVPIGRAATRREGEDLTLIGYAKTVDTCLRAAETLAGEGISAEVIDLRSIKPLDEAAILASVRKTGRAIVVHEASRTCGVGAEVAALVAEHAFDALKAPVLRLTGPDAPTPASYPLEQAFVPQAEAVVAAARRLVR

SEQ ID NO: 46699 - protein, 532 aa, Arabidopsis lyrata subsp. lyrata
KTTLVELGRTLALEECALWMPTRTGLELQLSYTLRHQHPVEYTVPIQLPVINQVFGTSRAVKISPNSPVARLRPVSGKYMLGEVVAVRVPLLHLSNFQINDWPELSTKRYALMVLMLPSDSARQWHVHELELVEVVADQVAVALSHAAILEESMRARNLLMEQNVALDLARREAETAIRARNDFLAVMNHEMRTPMHAIIALSSLLQETELTPEQRLMVETILKSSNLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDTRDADFFVVPTGSHFYLRVKVKDSGAGINPQDIPKLFTKFAQTQSLATRSSGGSGLGLAISKRFVNLMEGNIWIESDGLGKGCTAIFDVKLGISERSNESKQSGIPKVPAIPRHSSFTGLKVLVMDENGVSRMVTKGLLVHLGCEVTTVSSNEECLRVVSHEHKVVFMDVCLPGVENYQIALRIHEKFTKQRHQRPLLVALTGNT

SEQ ID NO: 46700 - protein, 532 aa, Arabidopsis lyrata subsp. lyrata
KTTLVELGRTLALEECALWMPTRTGLELQLSYTLRHQHPVEYTVPIQLPVINQVFGTSRAVKISPNSPVARLRPVSGKYMLGEVVAVRVPLLHLSNFQINDWPELSTKRYALMVLMLPSDSARQWHVHELELVEVVADQVAVALSHAVILEESMRARNLLMEQNVALDLARREAETAIRARNDFLAVMNHEMRTPMHAIIALSSLLQETELTPEQRLMVETILKSSNLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDTRDADFFVVPTGSHFYLRVKVKDSGAGINPQDIPKLFTKFAQTQSLATRSSGGSGLGLAISKRFVNLMEGNIWIESDGLGKGCTAIFDVKLGISERSNESKQSGIPKVPAIPRHSSFTGLKVLVMDENGVSRMVTKGLLVHLGCEVTTVSSNEECLRVVSHEHKVVFMDVCLPGVENYQIALRIHEKFTKQRHQRPLLVALTGNT

SEQ ID NO: 46701 - protein, 708 aa, Candida glabrata CBS 138
MDSDKGFFHREKVTRSNGKKSNLSLAIQESESRQISGSDAEEAKLVPVPGGMMDLSGSSMKSGHSGGASSGADIDLQDVINNGSLNSAINNNGNSSNSNDNGVCGSTFPTVTARMYNDGGNGEDEDDDDCSSCDERNEESLKDYKPGGYHPAYKGEHYKEGRYVLVRKLGWGHFSTVWLAKDVTTGSHVAMKIVRSDKVYTEAAEDEIKLLQKLTDGQDDQLGAKYTLNLLDNFVHTGPNGRHVVMTFEVLGENLLALIKKYEHRGIPLVYVKQISKQILLGLDYMHRKCGVIHTDIKPENVLMEIGDVEAIVKMVELLDEQKKNLKRLQRSGSVLDHNQSFEFQRTIGHGANHSQTGMNDYTRSNEGTPLQRIPSRKPRRNTIITGSQPLPSPISSSNFNDMKTQLLGTSISNTMLTTNITSTQYPISNTPQRGSSINIHQGPIASSLQSSISNRSIKNNLMSHMSESSTSIANDLNGQQQQLAHSLSSFEISNIDETQDMDGNDTNIIQVKIADLGNACWYDEHYTNSIQTREYRSPEVLLGAPWGCSADIWSTGCLIFELITGDFLFEPNEGHSYTKDDDHIAQIIELLGDFPSYLLNNGRYTRTFFNSRGQLRNISKLKFWPLKDVLREKYKFDKEEAQEIADFLLPMLTLDPRKRCDAGGLANHPWLNDTLGMENVSVPERKLYGNGSDIPGWYNEVPSHQRH

SEQ ID NO: 46702 - protein, 431 aa, Burkholderia pseudomallei K96243
MSRSAGDFATAGDASSRTVRAARDALEGRRKGVAAALPFVGPAVIASIGYMDPGNFATNIQAGAAYGYELLWVVLAANVIAMVFQAMSAKLGIVTGRNLAELCREHFPRPVVWGMWATSEIAAMATDLAEFLGGALAFGLLLHLPLIAGMAATAVLTCAILTLEKRGFRPLEAAIAALVGVIGASYLGELLIAPQDWHAAAYHLVVPQLRDGTALTLAVGIIGATIMPHTLYLHSGLTQRRTTPRDARERRLLLRFSNREVAVALGVAGFVNIAMVMMASSAFHRAAPGMADIGDAYHTLIPLLGPAAGALFLVALFASGVSSSVVGTLAGQVVMQGFLRRRVPIWMRRLVTIAPAFAIVALGCDVTRAMVLSQVVLSLVLPLPMAALLLLSSRRALLGEHALRAPTLVAASAAAAAIVALNVYLIWAAFN

SEQ ID NO: 46703 - protein, 325 aa, marine gamma proteobacterium HTCC2207
MLLIKIKIKKRKDKTMPLESATAAILAHIAAEAGPELYDMAVTESREMYREMQPDLPEIVVYSVADTTIEGPAGPIPVRIYRPSAAPAPVHVHFHGGGWVIGDLDTHDRDCREICAGADCIVVAVDYRLAPEHIFPAAPEDCYAALCWATANKGLLGGLPGPVSVGGDSAGGNLAAAVALMARDRNGPAIAMQLLIYPVIDATMESESYRDNADGYLLSRTMMAWFWDLYCPDVDLRADPLASPITAEDLSTLPPALMMTAEFDPLRDEGEAYAQRLKAAGVEVEVRRFDGLVHGFFSQAGIIEAAREGVDLAVKALRKAHNRAS

SEQ ID NO: 46704 - protein, 494 aa, Salmonella typhimurium LT2
MSDVTLLAEVTTFLRQRHGQFIAGERQAGNGTNFSVTNPATGKIIADVVSATPAQAEEAMQSARRAFDVWRKMPTLQRGALLLKLADTLAAHREELAQLESVCSGKTIMLSRGLELDQSVAFLRYFAGWAGKITGETLNVSLPSMGEERYTAFTQRQPIGVVVGIVPWNFSIMIAIWKLAAALVCGCTIVIKPSEYTPLTLLRVAELAKEAGFPDGVINVVNGAGGEIAQQLIAHPDCAKVSFTGSVATGEKVRRSATSSGKRVTLELGGKNAALFLNDLTAQAMVNGILEAGYLNQGQICAAAERFYLPQEKLDTVMTLLRQRLSEIVPGSPLDEKTVMGPLANQVQLEKVLRLIQRAREEGDTIVYGGETLPGEGYFLQPTAVKVRSKNSTLMHEETFGPVCSFIGYQNEKEALSHINDSPFGLAASVWSENISKALRYAEDIDAGMVWVNMHTFLDPAVPFGGMKGSGIGREFGSAFIDDYTELKSVMVRY

SEQ ID NO: 46705 - protein, 525 aa, Candida glabrata CBS 138
MSSIEQVNEVFDTILVLDFGSQYSHLITRRLREFNIYAEMLPCTQKIADLHFKPKGVIMSGGPYSVYAEDAPHVDHAIFDLGVPILGICYGMQELAWINGKQVARGEKREYGPATLNVLDKEDALFKNVDHSTVWMSHGDKLHGLPTGFKVIATSDNSPYCGIVHESKQIYGIQFHPEVTHSSNGKTLLKNFAVDLCHAKQNWTMKNFIGTEVQRIRDLVGPTAEVIGAVSGGVDSTVASKLMTEAIGDRFHAILVDNGVLRLNEAATVKKTLVDGLGINLTVVDAADEFLDNLKGVTDPEKKRKIIGNTFIHVFEREAEKIKPKDGKAIEFLLQGTLYPDVIESISFKGPSQTIKTHHNVGGLLENMKLKLIEPLRELFKDEVRELGELLGISHELVWRHPFPGPGIAIRVLGEVTREQVEIARKADHIYIEEIRKAGLYDKISQAFACLLPVKSVGVMGDQRTYEQVIALRAIETTDFMTADWYPFEHSFLRKVASRIVNEVDGVARVTYDITSKPPATVEWE

SEQ ID NO: 46706 - protein, 495 aa, Arabidopsis thaliana
MVFSVSIFASLAPYLISAFLLFLLVEQLSYLFKKRNIPGPFFVPPIIGNAVALVRDPTSFWDKQSSTANISGLSANYLIGKFIVYIRDTELSHQIFSNVRPDAFHLIGHPFGKKLFGDHNLIYMFGEDHKSVRRQLAPNFTPKALSTYSALQQLVILRHLRQWEGSTSGGSRPVSLRQLVRELNLETSQTVFVGPYLDKEAKNRFRTDYNLFNLGSMALPIDLPGFAFGEARRAVKRLGETLGICAGKSKARMAAGEEPACLIDFWMQAIVAENPQPPHSGDEEIGGLLFDFLFAAQDASTSSLLWAVTLLDSEPEVLNRVREEVAKIWSPESNALITVDQLAEMKYTRSVAREVIRYRPPATMVPHVAAIDFPLTETYTIPKGTIVFPSVFDSSFQGFTEPDRFDPDRFSETRQEDQVFKRNFLAFGWGPHQCVGQRYALNHLVLFIAMFSSLLDFKRLRSDGCDEIVYCPTISPKDGCTVFLSRRVAKYPNFS

SEQ ID NO: 46707 - protein, 542 aa, Bradyrhizobium sp. BTAi1
MLGLMQDWPLLCHRIIEHAATIHGSQEVVTRSVEGPIVRTTYGEIHKRALKVSQQLTRHGIKLGDRVATIAWNTGRHLEVWYGIMGIGAICHTVNPRLFPEQIAWIINHAQDRVVITDLTFVPLLEKLADKLPSVERYVVLTDAAHMPQTTLKNAVAYESWIGEADGDFAWGTFDENTAAAMCYTSGTTGDPKGVLYSHRSNVLHALMANSRDSLGTSAADTMLPVVPLFHANSWGIAFSAPSMGTKLVMPGPKLDGASVYELLDTEKVTYTAGVPTVWLMLLQHMQAHNLKLPHLKMVVCGGSAMPRSMIQAFLDMGIGVRHAWGMTEMSPIGTLATLKPPFLDAEGDAKLDVLQTQGFPPFGVEMKITDDAGNKLPWDGKTFGRLKVSGPAVSKAYYKVDTNILDGEGFFDTGDVATVDPHGFMRITDRSKDVIKSGGEWISSIDLENLAVGHPAVAEAAVIGVYHPKWDERPLLIVQLKQGQTATREDILKYMEGKIAKWWMPDDVAFVDGIPHTATGKILKTALRDQFKAYRFPNAAA

SEQ ID NO: 46708 - protein, 415 aa, Oryza sativa (japonica cultivar-group)
MEDEGSGGSYIGGDASPVHVGSATELAVWPGHRTVTEELTGYSLAKGMGIGKYIASETFTVGGCQWAIYFYPDGKNPEDNSAYISVFIALISDGIDVRVLFELKLLDQSGKAKHKGHSQFDRSLESSPYTLKNRGSMWGYKRFFRRTALETSDFLKDDCLKINCTVGVVVSTMDYSKPHSIHVPESDIGYHFGTLLDNQEGVDVICNVAGEKFHAHQLVLAARSSFFRSELFEHESDEEKNEVDTSNEIKEIVIDDMEPKVFKAVLHFMYRDNLVGDDELSASSSDCSIFDTLAGKLLAAADRYELPRLRLLCESYLCKHISVNSVATTLALADRHHAMELKSVCLKFAAENLSAVIRTDGFDYLKDNCPALQSEILRTVAGCEEECSSGGKSQSVWGQLSDGGDTSGRRVRPRV

SEQ ID NO: 46709 - protein, 336 aa, marine gamma proteobacterium HTCC2207
MSINYKQYYLHQRPVGDTTDSDVRVRTVEVDGLADGQLLIKNEYFSLDPAIRGWMSDEPSYMPPIDLGDVIRSSTVGTIVESKHPDFAAGEVVYGLNGWEEYSVSDGYFLTKVPEDNQFPLHYYLSAFGAVGLTAYFGITDAAKLKPGDTLLMSAAAGAVGSLGGQLAKNMGCRVVGLAGSDEKCQWLTDDLGFDAVINYKTEQGNLNAAIAAACPEGVDVYFDNVGGEILDAALLNINSNARIVFCGSISSYNASEPVPGPYNWWQILAKSATVQGFLISNYFPQFEAGAAAIAELLTDDKLQFKYEIVDGFDNTLTAFHKLFDGSNKGKLMLKV

SEQ ID NO: 46710 - protein, 369 aa, Synechococcus elongatus PCC 6301
MKSRAAIAWAAGQPLTIEEVDVQAPQAGEVMVKLVATGVCHTDAFTLSGADPEGIFPCILGHEGAGIVVEVGEGVTSVAVGDHVIPLYTPECGECKFCKSGKTNLCQAIRATQGKGLMPDGTSRFSLNGQPIYHFMGTSTFSEYTVLPEIAIAKINPAAALDKVCLLGCGITTGIGAVLNTAKVEPGSTVAVFGLGGVGLSVIQGAVLAKASRILAIDINPDKAEFAKQLGATDFINPKDYDRPIQEVIVELTDGGVDYSFEAIGNVNTMRAALESCHKGWGESTIIGVAGAGQEISTRPFQLVTGRVWRGSAFGGVKGRSQLPGYVEQYLNGQIKVDEFVTETRPLEEINEAFEDMHAGKVIRTVITF

SEQ ID NO: 46711 - protein, 337 aa, marine gamma proteobacterium HTCC2207
MPTNRQVVLASYVTDAAQPENFALSEGPMPEPSEGEFLLRNMYFSMEPAIRGWVDGKANYFEPIPIGGVIRGPSVGQVIKSKNPDFAEGEYVYALNQWEDYSLCHSEAILLEKLKPEPGIPLSYYVGSLGGAGATAYIGLREVGLIQAGQTVIVSAAAGATGSMAGQIARLTGCKVIGIVGSDDKAELIVEQFGFDAAVNYKTEDVTEAVMAIAPEGVDIYFDNVGGPVLNAMLKTMKTYGRIVACGMISDYNRTDNPNPITNLWEMVSRQLTMQGFLLPTYQDEVPAAMAELEGWIRSGDIKVLENITEGFDNTPRAFCELMSGGTVGKALVRVDI

SEQ ID NO: 46712 - protein, 204 aa, Kluyveromyces lactis NRRL Y-1140
MNTEYDYLFKLLLIGDSGVGKSCLLLRFADDTYTNDYISTIGVDFKIKTVELDGKTVKLQIWDTAGQERFRTITSSYYRGAHGIIIVYDVTDQESFNNVKTWLQEIDRFGTAGVLKLLVGNKNDLTDKKVVDTEVAKEFADSIGIPFIETSALDSSNVEEAFLIMTKQIKESVAKQQKDNGRAEDKSNVNLKGQSLTGSNGGCC

SEQ ID NO: 46713 - protein, 461 aa, Chlamydophila pneumoniae CWL029
MTQEFDCVVIGAGPSGYVAAITAAQSKLRTALIEEDQAGGTCLNRGCIPSKALIAGANVVSHIKHAEQFGIHVDGYTIDYPAMAKRKNTVVQGIRQGLEGLIRSNKITVLKGTGSLVSSTEVKVIGQDTTIIKANHIILATGSEPRPFPGVPFSSRILSSTGILELEVLPKKLAIIGGGVIGCEFASLFHTLGVEITVIEALDHILAVNNKEVSQTVTNKFTKQGIRILTKASISAIEESQNQVRITVNDQVEEFDYVLVAIGRQFNTASIGLDNAGVIRDDRGVIPVDETMRTNVPNIYAIGDITGKWLLAHVASHQGVIAAKNISGHHEVMDYSAIPSVIFTHPEIAMVGLSLQEAEQQNLPAKLTKFPFKAIGKAVALGASDGFAAIVSHEITQQILGAYVIGPHASSLIGEMTLAIRNELTLPCIYETVHAHPTLSEVWAEGALLATNHPLHFPPKS

SEQ ID NO: 46714 - protein, 333 aa, Pseudomonas putida KT2440
MTQTNRRFLLAKRPVGAVRRDDFSFETVPAEQPGEGQVLVRNLYLSLDPAMRGWMNEGKSYIPPVALGQVMRALGVGEVVASNHPGYQPGDHVSGALGVQDYFTGEPQGLHKIDPKLAPLPRYLSALGMTGMTAYFALLEVGQPKAGDTVVISGAAGAVGSIVGQIAKIKGCRVVGIAGGAEKCQYLKDELGFDGVIDYKAEDVLAGLKRECPKGVDVYFDNVGGDILDAVLTRINFKARIVICGAISQYNNKEAVKGPANYLSLLVNRARMEGFVVMDYTKDYGKAAQEIAGWLANGQVKSKEDVVEGLETFPETLLKLFSGENFGKLVLKV

SEQ ID NO: 46715 - protein, 382 aa, Oryza sativa (indica cultivar-group)
MATSSLLPLHLPTRPSAVKASAAPTAAAAPTPQSLEESFGRKGLRFAADPATGAPTAELSVRNGSSLQLRLADGLVTSYRPKVYWKDDGCREVLHTVAGAGAGGEVRGGVGLALSEVSSSGAAESLLVGSEWSVVDADSDSYDAVQLVNDNWVLDLHPVLSRQAQTELDSLMTILASQQLQHTEQDVELGCTKGSGTLEVTTTGKKPVSLTSAMLSHIKFDKRRGTAVEGLRGCPYCSHPPPAAGFALLTPAEAMKREDGGWFGGGGGEEPRQGVWTVEDNLYTILKKKVSRVYAAPPEERKKRIYSTAPSKFTTIDQNSGLGFRVVRMGYEDMYLCSPGEMYKKFGKDYFLCTGTASMLVPVVVNPGEEWRAAQVIEHDNL

SEQ ID NO: 46716 - protein, 331 aa, Medicago truncatula
MSTSSINGFSLSSLSPTKTSIKKVTLRPIVSASLNSSSSSSSTSNFPSLIQDKPVFASSSSPIITPVLREEMGKGYDEAIEELQKLLREKTELKATAAEKVEQITAQLGTTASADGVPTSDQASERIKTGFLHFKKEKYDTKPALYGELAKGQAPPFMVFACSDSRVCPSHVLDFQPGEAFVVRNVANMVPPYDQAKYAGTGSAIEYAVLHLKVSNIVVIGHSACGGIKGLLSFPFDGAYSTDFIEEWVKIGLPAKAKVKAKHGDAPFGELCTHCEKEAVNVSLGNLLTYPFVREGLVNKTLALKGGYYDFVKGSFELWGLEFGLSSTFSV

SEQ ID NO: 46717 - protein, 172 aa, Oryza sativa (japonica cultivar-group)
MEHQGQHGHVTSRVDEYGNPVGTGAGHGQMGTAGMGTHGTTGGMGTHGTTGGMGTHGTTGTGGGQFQPMREEHKTGGVLQRSGSSSSSSSEDDGMGGRRKKGIKEKIKEKLPGGNKGEQQHAMGGTGGAYGQQGHGTGMTTGTTGAHGTTTTDTGEKKGIMDKIKEKLPGQH

SEQ ID NO: 46718 - protein, 509 aa, Arabidopsis thaliana
  misc_feature (260)..(260): Xaa can be any naturally occurring amino acid
MLLHLLLLLCLSSSLKVQASVHEYRSERFVSKGNAFVFHGGSEGIYSSSPSDNFTSDSDSVSFIRFEKIKFQRPEEVSNRSSLSIHAVVFEVEDRENIGGSAYGGQRAVCCTSDLAKLGVCSHGDVIYRPSAKDSGWPQVFGVSLAENEFSVILPTRSIQVTRTGMYNLYFIHCDSDLKDLVVEGKTIWKNPTGYLPGRMAPLMYFYGFMSLAFVLLGIFWFSQCARFWREVLPLQNCLTLVITLGMCEMALWYFDYAEXNETGIRPTVITIWAVTFGSIKRTSARIIILMVSMGYGVVRPTLGGFTSKVIMLGVTFFIASEILELMENVGAVSDLSGKARLFFVLPVAILDAFFIIWIFKSLSATFKKLQTRRLLVKLDIYRKFTNALAVDILVSLGWICYELYFKSKDVYNEHWQNAWIIPAFWQLLSFSLLIVICSLWAPSQNSTRYAFSGSSGDTSAEFEKDDYTLTLIKPSPIPSHEVKNLSETRLLPADEGEPEKDLEEDKRE

SEQ ID NO: 46719 - protein, 418 aa, Xanthomonas axonopodis pv. citri str. 306
MTTGNLLYAQSGGVTAVINATAAGVIAEARARKIKVLAARNGILGALREELIDTSKESAAAIAALAQTPGGAFGSCRYKLKSLEEDSAKYERLLDVLRAHDVRWFLYNGGNDSADTAWKVSQLAKAYGYPLHCIGVPKTIDNDLAATDTCPGFGSAAKYTVVSVREAALDVAAMADTSTKVFIYEAMGRHAGWLAAAAGLAGQGPDDAPQIILLPERAYDQAAFLAKVKQVVEKVGWCVVVASEGIQDAHGKFVADAGGAADSFGHAQLGGVASFLAAQVKQELGYKVHWTLPDYLQRSARHLASKTDWEQAQAVGKAAVQYAIKGMNAVIPVIERVSDAPYRWKIVPAPLHKVANHEKKMPPSFLRKDGFGITERARRYFAPLIKGEAALAYGSDGLPKYVSLKNVAVAKKLPAWEG

SEQ ID NO: 46720 - protein, 675 aa, Xanthomonas axonopodis pv. citri str. 306
MLEHYGLWLALGCAVLAIVYGIVSARWVVAQPSGNARMQEIAAAIQEGARAYLNRQYLTISVAGAVLFVLVGLFLSWYTAIGFALGAVLSGLAGYIGMNVSVRANVRTAEAARHGIGKAMDVAFRGGAITGMLVVGLGLLGVAGYFAVLQGMGLPLEQNLHALVGLAFGSSLISIFARLGGGIFTKGADVGADLVGKVEAGIPEDDPRNPAVIADNVGDNVGDCAGMAADLFETYAVTVIATMLLGSLTLADTGSHAVLYPLVLGGVSIIASIVGAAFVKVKDGGSIMGALYKGVIVSGVLAALAYWPITQSLMRDNIHGATALYACALIGLVLTGLIVWITEYYTGTQYTPVQHVASASTTGHGTNIIAGLGISMKSTALPVIAVCAAIWGAFHFGGLYGIAIAATAMLSMAGMIVALDAYGPITDNAGGIAEMAELPPEVRNITDPLDAVGNTTKAVTKGYAIGSAALAALVLFADYTHNLQAANPDQVYAFDLSDHTVIIGLLIGGLIPYLFGAMAMEAVGRAAGAVVEEVRRQFRELPGIMAGTAKPQYDRAVDMLTRSAIGEMIVPSLLPVVVPIIVGLLLGPRALGGLLIGTIVTGLFLAISMTTGGGAWDNAKKYIEDGHFGGKGSEAHKAAITGDTVGDPYKDTAGPAINPLIKIINIVALLLVPLL

SEQ ID NO: 46721 - protein, 125 aa, Desulfitobacterium hafniense Y51
MSLKVLNTEKAPGAIGPYSQGIQAGNLIFTSGQLPLNPTTGELTSDIRSATKQSLENVKNILESAGSSMDKIVKTLIFLKDMNDFAEMNEVYGSYFPTNPPARSAVQVARLPKDAIIEIEAIALV

SEQ ID NO: 46722 - protein, 506 aa, Glycine max
MPSNYFSRLGVSIRRSVVGKEGRIRDSAEVLIGQGKLWFGSSKFFHSVQSSYFVELQLLVRPGIALASSSELAGKRRTLSVVDTLSRTFSVPSVSGPSFQVCGYHIGSALAGPDQFSSGTKFRIKTMVAHLPRIVVGESCLDNPTLKGSCRSLSTKNSYSICLSTKLRNGGKVSMSLRNHQQPDNSAVYGYFIYNAAKTWCNSHPYMQSGSGDFHTLSSSCYSVGPAHDVPFDTAAREEQLSSSADSSEQKTPSGKTLKLISGSCYLPHPDKEETGGEDAHFICSEEQAIGVADGVGGWADLGVNAGYYSRELMSKSVEAIQEEPKGSVDPARVLEKAHSSTKARGSSTACIIALTDQGLNAINLGDSGFMVVRDGCTIFRSPVQQHDFNFTYQLECGSNGDLPSSGQVFTIPVAPGDVIVAGTDGLFDNLYNNEITAVVVHAMRAGLSPQVTAQKIAALARQRAMDKDRQTPFSTAAQDAGFRYYGGKLDDTTVVVSYITGSGDA

SEQ ID NO: 46723 - protein, 168 aa, Brassica napus
MGRAARWFKGIFGMKKSKEKEYRVSGDGGGEAGESLIHRKVLQADNLWLRTYLAETDKEQNKHAIAVAAATAAAADAAVAAAQAAVAVVRLTSNAKTGGYSGGNVVYGITMERWAAVKIQSVFKGYLARKALRALKGLVKLQALVRGYLVRKRAAETLHSMQALIRAQ

SEQ ID NO: 46724 - protein, 239 aa, Oryza sativa
MPAHGNMSWGCVLWAGKDDKDEVEMLNHGGGLETVKEQLQRVLERITLQSQAQHGDGELLVQSKTAPRILLLPFLNLPTVREPSPVPVLTTYAVAHRAVAGAGQPLTAASRSPTTSSPSALSPVREDLLGQNKKAADDMSRVAGLDNQGIVGLQRQIMKEQDEGLEKLEETVLSTKHIALADDLEDHVDVTNSRLQRVQKRLAILNKRTKGGCSCMCLLLSVVAIVILAVIVWLLIKYM

SEQ ID NO: 46725 - protein, 370 aa, Zea mays
ALLLPGLLARSLVHHINNQVGTSGGSRRAPTEAKLKVAINGFGRIGRNFLRCWHGRGDASPLDVIAINDTGGVKQASHLLKYDSTLGIFDADVKPVGDNAISVDGKVIKVVSDRNPSNLPWGELGIDLVIEGTGVFVDREGAGKHIQAGAKKVLITAPGKGDIPTYVVGVNADQYNPDEPIISNASCTTNCLAPFVKVLDQKFGIIKGTMTTTHSYTGDQRLLDASHRDLRRARAAALNIVPTSTGAAKAVSLVLPNLKGKLNGIALRVPTPNVSVVDLVVQVSKKTLAEEVNQAFRDAAANELTGILEVCDVPLVSVDFRCSDVSSTIDASLTMVMGDDMVKVISWYDNEWGYSQRVVDLADICANQWK

SEQ ID NO: 46726 - protein, 459 aa, Rickettsia conorii str. Malish 7
MEQYDVAVIGGGPGGYVAAIRAAQLKKKVVLIEKEHLGGVCLNWGCIPTKSLLKSAEVFEYIKHAKDYGIDAKGAEINIKKIVERSREISNKLAGGVKLLLKKNKVTVIDGVASLAGNKVININDKPIVKAGNIIIATGARSRVLKGFKPDGKQIWTSKEAMIPQHVPKSMIIVGSGAIGIEFASFYNSIGVDVTVIEAHNRILPAEDMEISGIARKNFEKKGIKIITNAKLIKQTKSKDKIEVELELADKTQKLQAEILLMAVGITANTENLGLEKTKIKVENGYITTNGLMQTAASGIYAIGDVAGVPCLAHKASHEGIIAAESIAGLKPHTINKHNIPGCTYSSPQIASVGLTEEAATTLGYELKIGRFPFIANGKALVSGDSDGLIKTIFDAKTGELLGAHMIGSEVTELIQGYVVSKNLEGTELDLINTIFPHPTLSEMMHESVFSAYDRAIHI

SEQ ID NO: 46727 - protein, 848 aa, Bacillus cereus ATCC 10987
MQMIKRLINKSVLLLTIIVMLSSVFSFQSVKAVSNSKTTEVIIHYKEQSGNTKDWNLWIWGENANGNSYEFTGEDEFGKYAKINIDGDYNRVGFIIRTNEWEKDGSDRWIENIKDGRAEVWILSGDEKVYNSKPSSDLSIQKASIDSFNEITVTTNVPFHIKERNIEIEGIKIKNISPYDRNSGNITNKFKIITEQKIDLKQTYKVKIENVADTNTEIGKVIRSEEFDHSFYYGGNDLGNIYTPQHTKFRVWAPTASEAKLVTYKKWNDKIGTEINMQQSEKGTWKAELKGNQKGLYYTYKVKIGDKWIEAVDPYARAASVNGDKGAVVDLEETNPKKWKANKKLKFINPEDAIIYELHVRDLSIQPESGIKQKGKYLGVTEKGTKGPEGVKTGLDHIKDLGVTHVQFLPIFDYASVNEENVNEPQYNWGYDPKNFNVPEGSYSTNPYEPTVRITELKQMIQTLHDNNLRVVMDVVYNHMYSATESNFHKLVPGYYYRYNEDGTFANGTGVGNDTASERKMMRKFMIDSVTYWAKEYNLDGFRFDLMGIHDYETMNEIRKAVNQIDPSIILHGEGWDLNTPLAAELKANQKNAEKMKGIAHFNDNIRDGLKGSVFEEKENGFINGKENMEDRIKKGITAGIDYDTNSSTYQDPEQVLTYVEAHDNHTLWDKLELTNPSDSEEVRKQMHKLSSSILLTSQGIPFLHAGQEFMRTKYGDHNSYKSPDSINQMDWLRRATFNNEVDYMKGLIELRKKYSAFRMTSAEQIKTHVSFIDAPKNTVAYTIEGNKNEYFTVAHNANREAVEITLPSKGPWKALVDGKQAGSKPLYVVHDNKIKVPALSSFVLKLK

SEQ ID NO: 46728 - protein, 357 aa, Mesembryanthemum crystallinum
MTAYRGKYADELIANAAYIGTPGKGILAADESTGTIGKRFAGINVENVESNRRALRELLFTTPGAVQYLSGVILFEETLYQKTAAGKPFVEVLKEGNVLPGIKVDKGVVELAGTNGETTTQGLDGLGARCAQYYAAGARFAKWRAVLKIGPTEPSPLAILENANGLARYAIICQENGLVPIVEPEILVDGPHDIDRCAEVTERVLAACYKALNDHHVLLEGTLLKPNMVTPGSESKKVAPEVIAEYTVRALQRTVPPAVPAVMFLSGGQSEEEATVNLNAMNKLQGKKPWTLSFSYGRALQSSTLKAWSGKEENVEKAQAVFLARAKGNSEATLGKYQGGAGGADASESLHVKDYKY

SEQ ID NO: 46729 - protein, 438 aa, Oryza sativa (indica cultivar-group)
MTRPAARGIVAGAAASTVPLPRAGFASPCPTARSLGFAARGTDPRLAIHVSSRRRAASASAGSRLARAVATMAKKSVGDLAAADLEGKRVLLRADLNVPLDASQNITDDTRVRAAIPTIKHLIGNGAKVILCSHLGRPKGITPKFSLAPLVPRLSELLGIQVQKADDVIGPEVEKSVSVLPNGSVLLLENVRFYKEEEKNDPEFAKKLASLADLYELDYLVGAVSNPKRPFAAIVGGSKVSCKIGVIESLLEKCDILLLGGGMIFTFYKAQGFPVGASLVEDDKLELATSLLAKAKEKGVSLMLPTDVIVADKFAPEANCQVVSAYAIPDGWMGLDIGPDSVAAFSSALETTQTVIWNGPMGVFEFEKFAVGTEAIAKKLAELSGKGVTTIIGGKDSVAAVEKVGVANVMSHISTGGGASLELLEGKELPGVVALDEA

SEQ ID NO: 46730 - protein, 460 aa, Yarrowia lipolytica CLIB122
MADATTAAATAGSSAASAPAAAPSGNFLTSMLGENSGFLENPLFTGGMGLMVLGAVVALGRTGIVQGSQFLQRQLLVDLEIASKDRSYAWFLEWMSHHPQRSSRHLAVQTTVKQHASGSFTTQFSLVPGPGRHLIRYKGAFMLVKRERSNRLLDMNSGSPFETITLTTLYRDRYVFQELLAEAQQRAQKMQAGKTVIYTSFGPEWRPFGQPRRKRELDSVILDKGVSESIVEDVNDFLKNSQWYHDRGIPYRRGYLLYGPPGSGKSSFIQALAGELDYNICILNLAEATLTDDRLNHLMNHVPERTFLLLEDIDSAFNERKQSADQGYHSGVTFSGLLNALDGVASAEERIIFMTTNHPERLDPALIRPGRVDFKECIDNATEYQAEKMFMRFFPGEEKLCNEFIQTLKANNKLVSTAQMQGLFVMNKTDPVGAIHMAQYLPENEGTPSPASEPPVHKGV

SEQ ID NO: 46731 - protein, 400 aa, Azoarcus sp. BH72
MLIEVKVPQLSESVSEATLVTWHKKEGDAVTRDENLIDIETDKVVLETPAPADGVLVKIIKGDGGTVTSGELIAQIDTEAKAAAGGAKAAEPVQAVTPPPAAPAAAPSAAAGAASPAARKILEEKGIAAGDVAGSGRGGRVTKEDAVGASAKPAAAAAAAPAVVIAGERPEERVPMTRLRARIAERLLQSKNENAILTTFNEVNMAPVMALRKQYGDKFEKAHGVRLGFMGFFVKAAVAALKKFPILNASVDGNDIVYHGYIDIGIAVGSPRGLVVPILRDAESMSIADIEKKIAEFGQKAKDGKLSLEELSGGTFSISNGGVFGSMLSTPIINPPQSAILGIHATKDRPVVENGQIVIRPINYLAMSYDHRIIDGREAVLGLVTMKEALEDPARLILDV

SEQ ID NO: 46732 - protein, 504 aa, Bordetella parapertussis 12822
MKEHDAAQGGTRTETEVLLIGTGFSGLGMAVALKREGRRDFIVLERAGDVGGTWRDNHYPGAACDIQSHLYSYSFRPNPRWSRVYAPQPEILQYLRDTARDEGILDHVRFGANVVRAAWDAAQAAWLVDTTAGRFKAQVLISAAGHLSDPSFPDIEGLASFRGAVFHSANWDHSYDLAGKRIGVIGTGASAIQIVPELARDAGQLTVFQRSAPYVIPRRDHVYSEAEKGLFARFPEAAQELRDELFWGNESRFPQRRQVPAFIEQVTAMALSHLRKQVPDEALRAQLTPHYAIGCKRVLISNDYYPALQQPNVALETAGIARIDEQGVVLKSGGRVDLDLLVVATGFEAAELPIAERIHGRQGRRLSDQWRAGGQAFACTAVSGFPNFFLMLGPNTGLGAGSMIFMVETQINYIKGAVAFIFEHGAIVDPDPDAQRDYVESIYRRSAGTVWLDGGCSSWYLHPQSGKLTTLWPDFMTQFRKENGTFSRQGYQVALRAPHAAEQA

SEQ ID NO: 46733 - protein, 465 aa, Lactobacillus plantarum WCFS1
MGIFQRIFQKEDLERYLQKDSHFERTLSAVDLIALGIGAVIGTGIFILPGTVAATKAGPGIILSFVLAAIVCAVAAMCYAEFASVLPIAGSAYSYGNIVYGEMIGWIIGWALVLEYVLAVATVAVGWAAYFNSFIAGFGLKLPKAITGSFDPAHGTYINVIAILIVCLIAWIIDTGLKTSIRLNNIIVVVKLAIIVLFLLVGSFYVKPSNWTPFAPFGGTEILKGAAVVFFAYLGFDAVSSSAAEVKNAKRNMPIGIIGTLVICTIFYILVSGVLTGMVSYKQLNVDDAVAFALQLVHQNFVAGIISIGALAGMFTMMVTMIYSSSRLLYSIGRDGLLPRFLGKIDKHHAPKNAMLTVTIVNSILAGLIPLDQLANLVNIGTLIAFAFVSFGILLLRRNPKLNAIKGFRVPLYPVLPIISGLLCLFMMTQLSMETWLASLVWFLLGLIIYFGYGIRHSRMNKADE

SEQ ID NO: 46734 - protein, 418 aa, Pseudomonas aeruginosa PAO1
MAVPADASPLRKLALFVGPGLLVSVGYMDPGNWATAIEAGSRFGYALLFVVVLASFSGMLLQSLCSRLGIATGRDLAQLSRERYRPGVARGQWLLAELSIVATDLAEVLGAALAFHLLLGVSITTGVVLTAFDTLIVLALQGANFRRLEAIVLGLIATIGACFFVELVLIGPYWPDVAAGLRPSWDTLSSQEPLYLAIGILGATVMPHNLYLHSSVVQTRVSGDDAASKRSAIRFSRLDTIGSLSLALLVNAAILILAAAAFHGSGHTEVVEIQDAYHLLDPLVGGALASFLFGFALLAAGQSSTFTGTIAGQVVMEGFLRAKIPCWQRRLITRGLALVPALIGVLWLGEAAVGKLLVLSQVVLSLQLPFALWPLIRFSSDRGLMGEFVNPRWVSALAWSLFGLISAANLTLLYFWFG

SEQ ID NO: 46735 - protein, 474 aa, Azoarcus sp. BH72
MSKEFDVLVIGGGPGGYVAAIRAAQLGFKTACCESNPYADPKGEPRLGGTCLNVGCIPSKALLHTSHLFEEAGHGFEAQGITVGTPKIDVAKMIARKSGIVDQLTGGIKGLFKKNKVTLLNGHGSFVAQAGEGWQVKVGDEVVTAKQVIVATGSKARHLPGIPVDNKIVCDNVGALDIDAVPKKLAIIGAGVIGLEMGSVWRRLGADVTILEAMPDFLAAADLDVAKEALKVFTKQGLKLQLGVKIGEVKAAKKGVSIAYTDKDGAEQKLDADRLIVSVGRVPNTDGLNAEAVGLKLNDRGMIEVDGHCRTNLPGVWAVGDVVRGPMLAHKAMEEAVMVAELMAGQAGHCNFDTVPWVIYTSPEIAWVGKTEQQLKGEGVAYKVGKIPFLANGRALGMGETTGFVKMIADAATDRILGVHIIGAGASELISEAVVAMEFAGCSEDLARICHAHPTLSEVVHEAALACDKRPLHF

SEQ ID NO: 46736 - protein, 496 aa, marine gamma proteobacterium HTCC2207
MTNEIKPINMPKWGMEMSEGDINAWYFAVGDEVNAGDDLVDIETSKIINTVTATDSGILRAILGATGETHAVGALLGVIASAETSDADIQAFINSNSSAAAEPKAVTEASAPVAAAVETAPAPAPAPATIPQAASGLSKLAEGEDDSLVAASPVARRLAAEYGVNLNNITGTGRHDRVSKRDLEAAVVAAGGQLIGNNRSASSAVRYGDDSNVKATPVARRIATQLGINLLECRVSGDRGRVCKADVEAVAALKNKIPTQTDSNTTVSSNTVASQPISGMRKTIAARLQASKQTAPHFRVHIDAEIDALLAVRKQINSSNTDAKVSVNDFIVKACASALIKVPALNVQFDGEQLSYFSNADISVAVAIDDGLITPIVSDANHKGLVEISNTTRDLATRAKLGRLKPEEFQGGSFCISNLGMYGIKQFDAIINPPQGAILAVGAGEQRPVVKDGELAVATVMSLTLSSDHRIIDGAVAAQFMSVLKGYLEQPATMLG

SEQ ID NO: 46737 - protein, 363 aa, marine gamma proteobacterium HTCC2207
MSTAHTKDTEMTNHSNNPAIGGKTSLKTIREAINDALREEMRRDPTVIVLGEEVSGGAGCEGEDDAYGGVFGVTKGLMPEFGRERVIDTPISEAAIIGAAAGAANNGLRPVAELMFFDFIGVSFDQIFNQAAKFRYMFGGKSKTPMVIRGTVGGGWRAGAQHSSMLHSIVTHIAGLKVVMPANAYDAKGLMVQAIRDDDPVIFLEHKVMYDIACEVPDEQYAIPFGEAAFPRQGSDVTIVAISNMVTHAITVADILAKEGISCDVIDPRTVSPLDHEAILESVEVTGRLVIIDEGNPRCGLATDIAGIVAEHGFYSLKAPIRTVTAPHTPVPFAPELEDAYLPNAEKLMVAVREVLAAGPSGA

SEQ ID NO: 46738 - protein, 323 aa, marine gamma proteobacterium HTCC2207
MPYSTEFLLSAYRTMKTIREFEERCVKEFEGGNVPGFTHVSNGQEAIAVAACIDLSDKDIIGSTHRGHGHCIAKGCDVGGMMKEIMGRSTGLCKGKGGSMHIADIDKGMLGANAIVGGGPPLVNGAALAAKTLGTKNVALSFNGDGSANQGTVFEAMNMAVVLKLPHVFVYENNGYAEGTAANYAVGSNSLTERNAGFGMPAECIDGLDFFATYEALKIATERARNGDGPTAIEAMCVRFDGHFIGDPQLYRPKDEVKNARKNQDCIKIFRERVIAEGWLKAAAMNAIDKEVMVEIETAVVNALAAPHPDPATDLMSDVYCSY

SEQ ID NO: 46739 - protein, 409 aa, marine gamma proteobacterium HTCC2207
MAAKSRCIILGASHAAAQLAPTLRQQGWTGSISMISNEYALPYHRPPLSKDYLAGTKTAEQILIRPAAVYSKCNVGITMGVTAAAIDRSNKQLLLDDGMALDYDKLVLTTGARVRKIDIPGVDLNGVFYLRDLNDAQQIKMFTGANKRAVIIGGGYIGLETASALRKLGMQVTVLEAMPRILQRVTAPEVAAFYSRIHAEEGVEIVADVQAVSISGAKQVESVQCHDGTEYEADIVIIGVGVIPNTELAEQAGLKIDNGIVVDEYARTSDEDILAAGDCTSHYNPIYQRHLRLESVQNALDQASVAANTICGNLKPYSALPWFWSDQYDLKLQIAGLSQGYTDVVVRGDIDGSRSFAAFYMREGKLLAVDAVNRPQEFMFGKKLIMQGNQLDTAQLADDSLSLKTLLTS

SEQ ID NO: 46740 - protein, 629 aa, Oryza sativa (indica cultivar-group)
MDPKLVEVTQLFSRFKAAFARNDFDTCVDLLSQLKVRLTKFPSLPPSFQQTPNAVEELKIARDIYEHAVVLSVKIEDQDAFERDFCQLKPYYMDTCGIIPPSPQEYPILGLNLLRLLVQNRIAEFHTELELLPVTALENPCIKHAVELEQSFMEGAYNRVLSARQAVPHETYVYFMDLLAKTVRDELAGCSEKGYDYMSIAEARQVLMFSSDKELHQYIAEEHPEWEIKDGSVFFQKAKETQPCKEIPSLQCTLMEAHTDTSEQCWDRKCARQGGTLTSTESIGIGPPAVASGLAARRPPGIAPCSTCLPLLASLTTSSAVHTSTCACRMLAVTGSSELATSNGIVGEFGALALASAVAPSLPLPSPPRYTGSKKIVDSKATQEDLQPQMQTIFSSTGEHSVSKLKSCRDSVAGTTTEEDEGALEARHAACELAARVLEYAGTLVKPWVTTDEIDRAVHQMIIDAGAYPSPLGYGGFPKSVCTSVNECICHGIPDSRVLQNGDIINIDVTVYLNGYHGDTSRTYLCGEVDESTMQLVKVTEGCMLRGISACKHGASFKTIGQRISDSPASTNNFMISDFKPTLSMGGTQCTLWDDGWTAVTVDGSLTSQFEHTILVTGDGAEILTMHPR

SEQ ID NO: 46741 - protein, 160 aa, Glycine max
  misc_feature (64)..(64): Xaa can be any naturally occurring amino acid
TLRGKFTTLRSYLTPGQLLCFSTAFGASLWVTFIGGIIIYSNLSSYHLGHPRSKMFSAYFSDEXRCLDARVYTLLISCLIPRKTAFITDRCQPGYWLHYLACNRTDMYASTPQTLEMMKLMHYVERGDHIWEDSLWPNHVESAESNPDLAAMNNIFGMTH

SEQ ID NO: 46742 - protein, 625 aa, Xanthomonas axonopodis pv. citri str. 306
MNAAPTVLQQQAQSLSEAVTQPIPGSRKIFVRGSRADLQVPMREIALTRTPTLFGGEENPPLSVYDTSGPYTDPRVAIDLAAGLAPLRAQWIAERGDTLALDGLSSSFGRGREHDARLDAVRFPARRLPRVARQGANVTQMHYARRGIITPEMEYVAIRENQRLEAVTDASLRKQHPGQAFGASIQQRITPEFVREEIARGRAILPNNINHPESEPMIIGRNFLTKINANIGNSAVSSGIAEEVEKLVWSIRWGGDTVMDLSTGKHIHETREWIIRNSPVPIGTVPIYQALEKVDGRAEELTWDIFRDTLIEQAEQGVDYFTIHAGVLLRYVPLTAKRVTGIVSRGGSIMAKWCLAHHKENFLYTHFEDICQIMKAYDVAFSLGDGLRPGCIADANDAAQFGELETLGELTKLAWQHDVQTMIEGPGHVPMQLIKENMDKQLRECGEAPFYTLGPLTTDIAPGYDHITSAIGAAMIGWFGTAMLCYVTPKEHLGLPNRQDVRDGIMAYKIAAHAADLAKGHPGAQVRDNALSKARFEFRWDDQFHLGLDPEKAKEFHDETLPKDAHKLAHFCSMCGPHFCSMKITQDVRDYANEHGVSEAQALSTGMQEKSAQFVAQGAQVYRAT

SEQ ID NO: 46743 - protein, 340 aa, Synechococcus sp. RS9917
MTLRVAINGFGRIGRNFMRCWISRGANTDIEVVGLNDTSDPKTNSHLLTYDTMLGRIQGAEIGYTDDTLIVNGKTIKCYSDRNPLNLPWKEWDIDLVIESTGVFNTDEKASMHLQAGAKKVILTAPGKGDGVGTFVVGVNADQYRHEDFNILSNASCTTNCMAPIVKVIDQEFGIVKGSMTTVHSYTGDQRILDASHRDLRRARAAAMNIVPTTTGAAKAVALVYPAVKGKLDGLALRVPTPNVSLVDMVFNVSKTTTSEEVNAVLKAASEGSAKGIIKYCELPLVSTDHAGTDESTIVDAELTKVMGGDQVKILSWYDNEWGYSQRVVDLAEIVAKNWK

SEQ ID NO: 46744 - protein, 202 aa, Phaseolus vulgaris
MAEETQNKYETAESSEVEVQDRGVFDFLGKKKEEEKPQEEVIVTEFEKITVSEEKKEEEGEKKHSLLEKLHRSDSSSSSSSEEEGEDGEKKKKKKKEKKEKKKIEEKIEGYHKEDTSVPVEKVEVVESEEKKGFLEKIKEKLPGHKKSEEAAAPPPPPPAATSSEHEGEAKEKKGILEKIKEKLPGYHSKTEEEKEKESGGH

SEQ ID NO: 46745 - protein, 160 aa, Nostoc punctiforme PCC 73102
  misc_feature (118)..(118): Xaa can be any naturally occurring amino acid
MYKRYIGRDVFVDISVFTSERSTGHRNRAMAHLMLNFGMIDRNIEESLDLYFQQCAVIVNCEDLAVMAATLANKGMNPITKEQAVDKRYIKDILSVMYTCGMYNFAGEWAYKIGIPAXAEFVVGYRRCTHRWFWGFFALLMSVYTVRAEGLKTFHGWFLF

SEQ ID NO: 46746 - protein, 375 aa, Synechococcus sp. RS9917
MADYYEMLGVGRDADADTLKRAYRRLARQYHPDVNKDPGAEDRFKEIGRAYEVLSDPQSRARYDQFGEAGLGGAAGMPDMGDMGGFADLFETFFSGFGGAGSGGRQRRRGPQQGDDLRYDLTIDFEQAVFGQEREIRIPHLETCTTCNGSGAKTGSGPTTCTTCGGVGQVRRATRTPFGSFTQVAECPSCNGSGQVIADPCTACGGQGVQQVRKKLRINIPAGVDTGTRLRVAGEGNAGLRGGPAGDLYVFLTVKPHPSLRRDGLTVLSEVKVSYLQAILGDTIEVETVDGPADLEIPAGTQPNAVLTLENKGIPKLGNPVARGNQRISVTVQLPTRLNDDERRLLEDLAGHHSARGEQHHHHKSGLFARLFGQR

SEQ ID NO: 46747 - protein, 331 aa, Photobacterium profundum SS9
MNIQEIQLASRPTGIPSAENFALAQNTLPEIQDGEVLVKNLWMSVDPYMRGRMMDRASYIAPFQIGEALEGGAIGEVIESKNTEFPAGTKVNSMQGWRSHYISNGNGLTALPVTPLPDQSFLGIMGMPGMTAWTGLFRIANLKPTDTVFISAASGAVGSVACQIAKMHGCTVVGSTGSDDKVALLKSLGVDVVINYKKESNLTEALAKAAPQGIDVYFENVGGEHLEAALANMSDYGRIAVCGMISQYNATEPQPGPTNLAMLIIKKLKVEGFIVFDHWAHYGEFAQQMGQWIAEGKIKWEETVYEGLAEAPNAFIGLFEGKNKGKMLVKL

SEQ ID NO: 46748 - protein, 309 aa, Glycine max
MAQQEVVEGFKFEQRHGKERVRVARVWKTRQGQHFIVEWRVGITLFSDCVNSYLRDDNSDIVATDTMKNTVYAKAKECSDILSAEEFAILLAKHFVSFYQKVTGAIVNIVEKPWERVTVDGQPHEHGFKLGSEKHTTEAIVQKSGSLQLTSGIEGLSVLKTTQSGFVNFIRDKYTALPDTRERMVATEVTALWRYSYESLYSLPQKPLYFTEKYQEVKKVLADTFFGPPKGGVYSPSVQNTLYLMAKATLNRFPDIAYVSLKLPNLHFIPVNISNQDGPIVKFEDDVYLPTDEPHGSIQASLSRLWSKL

SEQ ID NO: 46749 - protein, 428 aa, Oryza sativa (japonica cultivar-group)
MAPLRGAKRRKRQPEKALPAAGQAMPAPAPGGDWWDGFARRLAAGGGIVRCSEAANHLGRGGCSGLETTMDVDCSEGQFSKDCQNFESVFKMSRKTFDYLCSLISGDFTRKTQSFRNFRFGDKAILGVEDQVGVALLRLTTGESLLSIGNRFGMNHSAISNITWKFIEALEERAANHLKWPTPEEMATVKSKFEKIQGLPNCCGAIDTTHILMCSSAQPNSNVWLDGENRNSMVLQAIVDADMRFRDVVSGWPGSLNDSCILRTSGFYRLCEKGARLDGQTELPGEPAGSVVRDYILGDASYPLLPWLMTPYREKDLSPAKADFNKRHAATIMVVQGALAKLKERWQVLKGELWRPDKHRLPRIIYVCCLLTNIMIDLEDAARGGMPPSHNHDDGYRQQFSDVADVGAAALRDQLCQYVSRIGSSLPA

SEQ ID NO: 46750 - protein, 156 aa, Fagus sylvatica
MNSRAFIFLALLFASVLLISSAVATKTSKDEEKPEESNPVDDTKYGGYGGHYGGGHGGGYGGGHGGGYGGGHGGRGGGGGGRGGGGGYGGRREHVAEESIGRDTKYGGYGGGHGGHGGHGGGHGGGHGGGGGGPSRKLKAKLYNSLKSFASSYVPK

SEQ ID NO: 46751 - protein, 331 aa, Rhizobium leguminosarum bv. viciae 3841
MNRRAINLVENSVLESAKRTIESERRGLEALEQAFDNGLAGPFTRAVEVIGDISGRVIVTGVGKSGHIGAKLAATFASTGTPAFFVHAAEANHGDLGMIARDDVVLAISKGGESAELKSIISFTRRFSIPLIAITCSEGSSLAAAADIVLLIPNEQEACPNGLAPTTSTLMQLAIGDALAVALLEARGFTATDFHVFHPGGKLGASLMHVADIMHTGERLPLVAKGTPMPEAITVLSRKHFGCVGVLDEDGRLCGIVTEGDMARNLTRNLAELSVDDIMTRTPKTVRPTVLATAALALLNQHHIGALIVIDDDRRPVGLVHFHDLLRIGVA

SEQ ID NO: 46752 - protein, 143 aa, Oryza sativa
DNSPAKPTPSGHARRAPPASKSKQKRKSGGGDDSKASGGAASKKAKDTKTSVAKDETPSSSKPASKATAASKTSANVSPVTEDEIRTVLLAVAPVTTQDLVSRFKSRLRGPEDKNAFAEILKKISKIQKTNGHNYVVLRDDKK

SEQ ID NO: 46753 - protein, 125 aa, Burkholderia xenovorans LB400
MIPSAPTPVGPFSHAAEADGWVFLTGQMPTSPTDDAAPLPEGVVAQTKRVMDNLVLVLQGLGLGLRHVVATRIFLTEFKRDYAPMNEIYRAYFPADALPARTCIGVTGLARDALVEIDFVVKRPA

SEQ ID NO: 46754 - protein, 345 aa, Oryza sativa (indica cultivar-group)
MGERRSGYRDRGGGEQGRYWRPPRSHVPRWGNGNFSVPLWEKKFCTDACAIPWGKLCETKKLMSLYKNVVDWDDSAALETFNDAKARFCAVYHGQPCDIPLPDPNMYIDMVNQDEHVDPELVADLEKSRRSYPKRDNTAPDGWDSFIFTDKPVPATGWGDGETSNTPGQQYPTNWNNHVKQPTEANCMQSSVNWDNYVSQPPQATVQQSSGNWDMYVKQQDQANNWEAPTMPGTWDMKGDSLDAWKRDSGWGSAAIDSWDNHRENCYVPDSQGWSYGHWKRRNNESSRRNSRGRDRVGPISSKAMKPKYHSEERNGANNGWRHCRVRNNMQYSYENPGCNQSLAM

SEQ ID NO: 46755 - protein, 391 aa, Streptococcus agalactiae 2603V/R
MTLEKRFNKYLDRIEVSLIRQFDQSISDIPGMVKLTLGEPDFTTPDHVKEAAKSAIDANQSYYTGMSGLLALRQAAADFAKDKYNLTYNPDCEILVTIGATEALSASLIAILEAGDVVLLPAPAYPGYEPIVNLVGADIVEIDTRENDFRLTPEMLETAIIQQGEKLKAVLLNYPTNPTGITYSRQEIAALAEVLKKYDIFVISDEVYSELTYTGQQHVSIAEYLPNQTILINGLSKSHAMTGWRVGLVYAPEAFIAQIIKSHQYMVTAASTISQFAGVEALSVGKNDTLPMRQGYIKRRDYIIDKMSKLGFKIIKPSGAFYIFAKIPDSYPQDSFKFCQDFAYQQAVAIIPGVAFGKYGEGYIRLSYAASMEVIETAMARLKVFMESYEG

SEQ ID NO: 46756 - protein, 532 aa, Yarrowia lipolytica CLIB122
MLRVLRTPKTGVFRQCRLISTNYVTTPIFYPNAEPHVGHLYSMVLADVIKRYNGLNGKDTYLLTGIDEHGLKIQTAAEKLNLQPKILCDQLAEKFKQLAEVGNIDNNRFMRTTDADHVNTVNDMWDRLTKAGYIYKGSHSGYYCVSDETYYPRDKCHEVNGRLVSIETGKEVEWTEEENYFFRLSAMRDKLLEFYNANPEFVMPKEVYRGIVDEVSRDLPDLSISRPTNRLSWGIPVPGDDSQVIYVWLDALVNYATAQGFDTVSEAVHIVGKDIQRFHAIYWPAFLLAAGIKPPKSVLVHSHWISEGQKMSKSIGNVVDPMHVISKYGSDSVRFLLMCDGHLHKDNDFTETKIAEKHNTMLVNKLGNLLMRITSAKFNLVDSLEQPRQKTVEDMAEFFGPEFTTTRNELIRALKELPDVYKADMARGSTPKTITDLYYVINLANKHVEETKPWSFKEKEIPAMILREAAETARIALILMQPFTPEFATKGLDRLGVKKERRTMEWAGLYVDGEYGEGKNYKGGYPIQRIQE

SEQ ID NO: 46757 - protein, 844 aa, Solanum tuberosum
KVKGTVVMMNKNVLDFTDLASSLTGKIFDVLGQKVSFQLISSVQGDPTNGLQGKHSNPAYLENSLFTLTPLTAGSETAFGVTFDWNEEFGVPGAFIIKNMHITEFFLKSLTLEDVPNHGKVHFVCNSWVYPSLNYKSDRIFFANQPYLPSDTPELLRKYRENELLTLRGDGTGKREAWDRIYDYDIYNDLGNPDQGKENVRTTLGGSAEYPYPRRGRTGRPPTRTDPKSESRIPLILSTDIYVPRDERFGHLKMSDFLTYALKSIVQFILPELHALFDGTPNEFDSFEDVLRLYEGGIKLPQGPLFKALTAAIPLEMIRELLRTDGEGILRFPTPLVIKDSKTAWRTDEEFAREMLAGTNPVIISRLQEFPPKSKLDPEAYGNQNSTITAEHIEDKLDGLTVDEAMNNNKLFILNHHDLLIPYLRRINTTITKTYASRTLLFLQDNGSLKPLAIELSLPHPDGDQFGVTSKVYTPSDQGVESSIWQLAKAYVAVNDSGVHQLISHWLNTHAVIEPFVIATNRQLSVLHPIHKLLYPHFRDTMNINALARQILINAAGVFESTVFQSKFALEMSAVVYKDWVFPDQALPADLVKRGVAVEDSSSPHGVRLLIEDYPYAVDGLEIWSAIKSWVTDYCSFYYGSDEEILKDNELQAWWKELREVGHGDKKNEPWWPEMETPQELIDSCTTIIWIASALHAAVNFGQYPYAGYLPNRATVSRRFMPEPGTPEYEELKKNPDKAFLKTITAQLQTLLGVSLVEILSRHTTDEIYLGQRESPEWTKDKEPLAAFDRFGKKLTDIEKQIIQRNGDNILTNRSGPVNAPYTLLFPTSEGGLTGKGIPNSVSI

SEQ ID NO: 46758 - protein, 861 aa, Solanum tuberosum
MIGQITSGLFGGPDDSKKLKGTVVMMNKNALDFTDLAGSLTDKAFEFLGQTVSFQLISSVQGDPTNGLQGKHSNPAYLENSLFTLTPLTAGSETAFGVTFDWNEEFGVPGAFIIKNTHINEFFLKSLTLEDVPNHGKVHFVCNSWVYPSFRYKSDRIFFVNQPYLPSKTPELLRKYRENELLTLRGDGTGKREAWDRIYDYDIYNDLGNPDEGKENVRTTLGGSAEYPYPRRGRTGRPPTRTDPKSESRIPLILSLDIYVPRDERFGHLKMSDFLTYALKSIVQFILPELHALFDGTPNEFDSFEDVLRLYEGGIKLPQGPLFKALTAAIPLEMIRELLRTDGEGILRFPTPLVIKDSKTAWRTDEEFAREMLAGVNPVIISRLQEFPPKSKLDPEAYGNQNSTITAEHIEDKLDGLTVDEAMNNNKLFILNHHDVLIPYLRRINTTTTKTYASRTLLFLQDNGSLKPLAIELSLPHPDGDQFGVTSKVYTPSDQGVESSIWQLAKAYVAVNDSGVHQLISHWLNTHAVIEPFVIATNRQLSVLHPIHKLLYPHFRDTMNINAMARQILINAGGVLESTVFQSKFAMEMSAVVYKDWVFPDQALPADLVKRGVAVEDSSSPHGVRLLIEDYPYAVDGLEIWSAIKSWVSDYCSFYYGSDEEILKDNELQAWWKELREVGHGDKKNEPWWPEMERPQELIDSCTTIIWIASALHAAVNFGQYPYAGYLPNRPTVSRRFMPEPGTPEYEELKKNPDKAFLKTITAQLQTLLGVSLIEILSRHTTDEIYLGQRESPEWTKDKEPLAAFDKFGKKLTDIEKQIIQRNGDNILTNRSGPVNAPYTLLFPTSEGGLTGKGIPNSVSI

SEQ ID NO: 46759 - protein, 565 aa, Aspergillus oryzae
MESTVIDHSSRGGFALIYQNPYLLGVASFSTLGGLLFGYDQGVVSGVITMESFGARFPRIYTDSSFKGWFVSTLLLAAWFGSLINGPIADRLGRKLSMNVAVVIFVIGSAIQCGAVNIPMLFVGRAIAGLAVGQLTMIVPLYISEVSIPEIRGGLVVLQQLSITIGILISYWIDYGTNYIGGTRCAPNTPYTGHTKTTPTFNPYTDVPPNGCTGQSEASWRLPLAIQILPALILGLGIIFFPDSPRWLAMKERDDEALTALSKLRRQTRDSPALVNEFLEIKASIMLENTFARDHFPGLSGLRLHAAQYVSFLTTWARFKRLAIGCCVMFFQQFMGCNAMIYYAPTIFAQLGLDGNTTSLLATGVYGIVNCLSTLPALFLIDKIGRRVLLMSGAVGTCISLVIVGALIGAYGSDLVNHKSAGWAGIAFIYIYDINFSYSFAPIGWVLPSEIFNLSIRSKAISITTSATWMCNFIIGLITPDMLESITWGTYIFFAAFCLLALAFTFFCIPETRGKTLEDMDLIFGDTAAHEEKQRIVQIEAELRGTQGPNKDTLVKPSVQQEEYV

SEQ ID NO: 46760 - protein, 354 aa, Kluyveromyces lactis NRRL Y-1140
MSGTQKAVVLQKKGEITFEDIPAPEITDSHYVKIHVKKTGICGSDIHYYTHGSIGEFVVKKPMVLGHESSGVVVEVGKDVTLVQVGDRVAIEPGVPSRYSDETKSGHYNLCPHMAFAATPPYDGTLVKYYLAPEDFLVKLPDHVSFEEGACAEPLAVGVHANRLAETSFGKNVVVFGAGPVGLVTGAVAAAFGASAVVYVDVFENKLERSKDFGATNTINSTKYKSEDELTEVIKSELKGEQPEIAIDCSGAEICIRTAIKVLKAGGSYVQVGMGKDNINFPIAMIGAKELRVLGSFRYYFNDYKIAVKLISEGKVNVKKMITHTFKFEEAIDAYNFNLEHGSEVVKTMIDGPE

SEQ ID NO: 46761 - protein, 724 aa, Bacillus anthracis str. A2012
MYNSKPSSDLSIQKATIDSFHEITVTTNVPFNIKEKKIEMEGIKIKSISPYDINSGDITNKVKIITEQKIDLKQTYKVKIENLADTNTEIGKVIRSEEFDYLFYYGGNDLGNIYTPQHTKFRVWAPTASEAKLVTYKKWNDKIGTEINMQQGEKGTWKAELKGNQKGLYYTYKVKIGDKWTEAVDPYARAASVNGDKGAVVDLEETNPKKWNTNKKPKLKNPEDAIIYELHVRDLSIQPESGIKQKGKYLGVTEKGTKGPEGVKTGLDHMKDLGVTHVQLLPIFDYASVNEEKVNEPQYNWGYDPKNFNVPEGSYSTNPYEPTVRITELKQMIQTLHDNNLRVVMDVVYNHMYNAAESNFHKLVPGYYYRYNEDGTFANGTGVGNDTASERTMMRKFMIDSVTYWAKEYNLDGFRFDLMGIHDYETMNEIRKAVNQIDPSIILHGEGWDLNTPLAAELKANQKNAEKMKGIAHFNDNIRDGLKGSVFEEKENGFVNGKENMEDRIKKGITAGIDYDTNSSTYQDPEQVLTYVEAHDNHTLWDKLELTNPGDSEEVRKQIHKLSSSILLTSQGIPFLHAGQEFMRTKYGDHNSYKSPDSINQMDWLRRATFNNEVDYMKGLIELRKKYPAFRMTSAEQIKTHVSFIDAPKNTVTYTIEGNKHEYFTVAHNANREAVEITLPSKGPWKVLVDGKQAGSKPLYVVHDNKIKVPALSSIVLKSEKPIK

SEQ ID NO: 46762 - protein, 395 aa, Bradyrhizobium sp. BTAi1
MPHYDVIVIGCGAVGSAAMLHLAKAGRRVLGIDRFQPPHRFGSTHGETRITRAAIGEGVDYTPLARRSHQIWRELERETGTHLFQQCGCLFIPSQHGGAVHGVSSGQFFANIEAAARLHGVDGETLSAERLRADYPAFATAPGDRAFLDREGGYLLVEDCVRTELVVAARHGAELVTGRRVTAFRRAAGVLSVTLEDGTTTSATTLIVTTGPWITEMIAPLRRRVHITRQVLYWFEILSNPQRFGPDAPVFIWDVTGRAGAASDIYGFPWLGSPGNGVKLANEVMTGETDPDHVGREVTADEIAATYETYVRPFVPDLGPKCLRSEVCLYTNASGGRFIIDRDPGAPEVIYASACSGHGFKHSPAVGEALAAMALGQAPLVDLSGFTLDRLAAAP

SEQ ID NO: 46763 - protein, 357 aa, Xanthomonas axonopodis pv. citri str. 306
MSKQILILPGDGIGPEIMAEAVKVLKRIDAQHGLGFQLVYDELGGTAYDKYGSPLADETLERARGADAVLLGAVGGPQWDTIDPALRPERGLLKIRSQLGLFANLRPALLYPQLADASTLKPEVVAGLDLLILRELTGGIYFGQPRGNRTLDNGERQAYDTLPYSESEIRRIAKAGFDMARLRGKKLCSVDKANVLASSQLWRAVVEEVAKDYPDIALSHMYVDNAAMQLVRAPKQFDVIVTDNMFGDILSDQASMLTGSIGMLPSASLDANSKGMYEPCHGSAPDIAGKGIANPLATILSVAMMLRYTFARATAADAIEHAVGKVLDQGLRTADIWSEGTTKVGTVAMGDAVVAAL

SEQ ID NO: 46764 - protein, 507 aa, Arabidopsis thaliana
MAVVISSNGNSKSFDAKMTVYVFICVIIAAVGGLIFGYDIGISGGVTAMDDFLKEFFPSVYERKKHAHENNYCKYDNQFLQLFTSSLYLAALVASFFASATCSKLGRRPTMQLASIFFLIGVGLAAGAVNIYMLIIGRILLGFGVGFGNQAVPLFLSEIAPARLRGGLNIVFQLMVTIGILIANIVNYFTSSIHPYGWRIALGGAGIPALILLFGSLLICETPTSLIERNKTKEGKETLKKIRGVEDVDEEYESIVHACDIARQVKDPYTKLMKPASRPPFVIGMLLQFFQQFTGINAIMFYAPVLFQTVGFGNDAALLSAVVTGTINVLSTFVGIFLVDKTGRRFLLLQSSVHMLICQLVIGIILAKDLDVTGTLARPQALVVVIFVCVYVMGFAWSWGPLGWLIPSETFPLETRTEGFALAVSCNMFFTFVIAQAFLSMLCAMKSGIFFFFSGWIVVMGLFALFFVPETKGVSIDDMRDSVWKLHWYWKRFMLEEDEHDVEKRTD

SEQ ID NO: 46765 - protein, 168 aa, Synechococcus sp. RS9917
MSIFVGNLPFRAEQEDVIELFAAYGEVTNCALPLERDTGRKRGFAFIEMADEAAEAAAIEALQGAELMGRPLRINKAEPRGSAPRRGGGGYGGGGYGGGGYGGGGRGADRGGYGDGGGSGARGWEDRSYGGGAPQAGADDDGRSRRRRGGAAPAPQSDDYGDYGGAEG

SEQ ID NO: 46766 - protein, 215 aa, Fagus sylvatica
MARRADEEYDYLFKVVLIGDSGVGKSNLLSRFTRNEFCLESKSTIGVEFATRTLQVEGRTVKAQIWDTAGQERYRAITSAYYRGAVGALLVYDVTKPTTFEQVWLKELRDHADSNIVIMLIGNKTDLKHSRAVRTEDAQGFMLRKKALSFIETSALKATNVEKAFQTILCLRFTGIISKKSLSSDEPAPSVIKEAVKHIVVGGSEANTKKPCCSN

SEQ ID NO: 46767 - protein, 584 aa, Candida albicans SC5314
MDVKRPKKIFTRSQIIDLIADGKVIVIYKNNVLNLTSWIKKHPGGDKAAYHMVGKDATDEMHAYHCDETVDTFTRFKIGEIEGPRWENLLPPIQGGIYAKGGHYGSLNNKNTSNKKTLDSKLDNDSSNSTSDLECLTTTNSCDSAISETEIANYKGIGFVPSVKPVVPQNQLVTKSNMDIVFPIIDEETKKKVIRNPKTLLNNYDNKLSQEDVMSLPALDYDSQQVLRDKYNELHQTIIDYGLYECDLWDYVREVTKIGSLFLYSLSFLKINQLFLSAVFMGMAWHQGTFIAHDAGHIGITHNYQIDNIFGMLIADWFGGLSLGWWKRNHNVHHLITNDPVHDPDIQHLPFFAVSVRLFQNVYSTYYDKILPFDKFSQFLIPLQKYLYYPILCFGRFNLYRLSWTHVLCGQGPRQGKAAWFRYFEFFGLSFFFYWFFYLLVFKTIEGGWNRFNYVMVSHITTMLVHVQITLSHFAMSTADLGVSESFPSRQVRTTMDVDCPEWLDFLHGGLQFQAIHHLFPRLPRHNLRKAQPFVIKFCEEVGLSYSIYGFGEGNEIVISRLADIGKQCSIFLDATKHYEGDLY

SEQ ID NO: 46768 - protein, 117 aa, Tortula ruralis
ARATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRGERA

SEQ ID NO: 46769 - protein, 532 aa, Arabidopsis lyrata subsp. petraea
KTTLVELGRTLALEECALWMPTRTGLELQLSYTLRHQHPVEYTVPIQLPVINQVFGTSRAVKISPNSPVARLRPVSGKYMLGEVVAVRVPLLHLSNFQINDWPELSTKRYALMVLMLPSDSARQWHVHELELVEVVADQVAVALSHAAILEESMRARNLLMEQNVALDLARREAETAIRARNDFLAVMNHEMRTPMHAIIALSSLLQETELTPEQRLMVETILKSSNLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDTRDADFFVVPTGSHFYLRVKVKDSGAGINPQDIPKLFTKFAQTQSLATRSSGGSGLGLAISKRFVNLMEGNIWIESDGLGKGCTAIFDVKLGISERSNESKQSGIPKVPAIPRHSSFTGLKVLVMDENGVSRMVTKGLLVHLGCEVTTVSSNEECLRVVSHEHKVVFMDVCLPGVENYQIALCIHEKFTKQRHQRPLLVALTGNT

SEQ ID NO: 46770 - protein, 294 aa, Salmonella typhimurium LT2
MSHLYDPTTQYYTGEYPKQKQPAPGVQAKMTPVPDCGEKSYVGSGRLKDRKALVTGGDSGIGRAAAIAYAREGADVAINYLPAEEEDAQQVKALIEECGRKAVLLPGDLSDESFARSLVHKAREALGGLDILALVAGKQTAIPEIKDLTSEQFQQTFAVNVFALFWITQEAIPLLPKGASIITTSSIQAYQPSPHLLDYAATKAAILNYSRGLAKQVAEKGIRVNIVAPGPIWTALQISGGQTQDKIPQFGQQTPMKRAGQPAELAPVYVYLASQESSYVTAEVHGVCGGEHLG

SEQ ID NO: 46771 - protein, 307 aa, Zea mays
YYTSLLSEGTNPQDYDDLVDLYPEEQPQRVEVNTYAPSARPNHKRSKNFSDVEDELLVSAWLNISLDPIIGYNQTRSSYWTRIYDYFHANKTFSSTRSQNSIMHRWTSIQEGVNRFTGCLAQVERRRQSGATMQDKLRTHRKWEMKLEELAVGKSSNKKQKMNSNETSPSHLPSVTETSGPTTPNETVTTRPPVKKKAKAAAFQAEKKGYTETLNKLFEKKKETDEFKEMKKDERFRLALAVEQERAANEKLNMQLRSKELELRQQEVEQHKKREEERIMTLDLSVMPADQKQYYMRLRSKILSENA

SEQ ID NO: 46772 - protein, 495 aa, Taxus canadensis
MDAMDLTVAKFKEFTQLQSSAILLTVVSGIIVIVILLLRSKRRSSLKLPPGKLGLPLIGESLSFLWALRSNTLEQFVDKRVKKYGNVFKTSLLGQPTVVLCGAAGNRLILSNQEKLLSRTVSDRVAKLTGDTSISVIAGDSHRIIRAAVAGFLGPAGLKIHIGEMSAHIRNHINQVWKGKDEVNVLSLARELVFAISASLFLNINDREEQHQLHKTLETILPGYFSVPINFPGFAFRKALEGNSKRRKHFSVLQEKRRRDLSVGLASRTQDLLSVLLAYEDDKGNPLTDEEVLDNISALIDGSYESTSSQMAMLLKLLSDHPECYEKVVQEQLEIASHKKEGEEITWKDVKAMRYTWQVMQETLRMFAPVFGPRGKAITDIHYDGYTIPKGWQLSWATYSTHQNDTYFNEPDKFMPSRFDEEGGRLAPYTFVPFGGGRRKCPGWEFAKTEILLFVHHFVKTFSAYTPIDPHESIWGRPLPPVPANGFPIKLISRS

SEQ ID NO: 46773 - protein, 284 aa, Zea mays
MAIISEVEDESSTRPRILPFRATLDSSNPSSFLEKVFDFLAEQSDFLKKPSAEEEISAAVRAAKEKLGKAEKKAEKESVEKKKPVEKESVKPATAASSSEPIQVEEKKQEASPIAPNKGNGYDLENYSWVQTLQEVTVNIPVPTGTKARSVVYEIKKNRLKLGLKGQDPIIDGELYRSVKPDDCYWNIEDQKMISILLTKQDQMEWWKCCVKGEPEIDTQKVEPENSKLADLDPETRSTVEKMMFDQRQKQMGLPTSDELQKQDILKKFMSQHPEMDFSNAKIN

SEQ ID NO: 46774 - protein, 182 aa, Zea mays
MVVPRAPEQTQQDQDEEMLVPHQDAIEGLQKDVLEGPQPMEEFASAVENQIIPDTSTSRFTWYIENFSKRNVRKHYSDDFIVGGYKWRVLVFPRGNNVDYLSMYLDVADSNLMPPGWSRNAQFSLAVVNQLDSKASLRKEATHQFNSRESDWGFTSFMPLLDLYDSSKGYVVNDKCIIEAEV

SEQ ID NO: 46775 - protein, 532 aa, Arabidopsis lyrata subsp. petraea
KTTLVELGRTLALEECALWMPTRTGLELQLSYTLRHQHPVEYTVPIQLPVINQVFGTSRAVKISPNSPVARLRPVSGKYMLGEVVAVRVPLLHLSNFQINDWPELSTKRYALMVLMLPSDSARQWHVHELELVEVVADQVAVALSHAAILEESMRARNLLMEQNVALDLARREAETAIRARNDFLAVMNHEMRTPMHAIIALSSLLQETELTPEQRLMVETILKSSNLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDTRAADFFVVPTGSHFYLRVKVKDSGAGINPQDIPKLFTKFAQTQSLATRSSGGSGLGLAISKRFVNLMEGNIWIESDGLGKGCTAIFDVKLGISECSNESKQSGIPKVPAIPRHSNFTGLKVLVMDENGVSRMVTKGLLVHLGCEVTTVSSNEECLRVVSHEHKVVFMDVYLPGVENYQIALCIHEKFTKQRHQRPLLVALTGNT

SEQ ID NO: 46776 - protein, 319 aa, Kluyveromyces lactis NRRL Y-1140
MRVKVSISGKSDKVLTVEAECDLETFQGLILSSYEDDLSLQSMRYGFPPQSILFQGNEAKTLEELGICNGERIIVSLSKADEAIATRTQPSINASKANTLPNKEVKKKPTGKSESVQIDSTRALQLHEVPDDNSCLFHAISYAVYKNISLSSELRGVVASEVRRDPFEYSDAILGRPNHEYSEWIMKHSSWGGGIEIAILSKHFQYAIYVLDVDARKFEKFNEDLYDKFIIIAYNGVHYDTVEIFDGTQHQTVFDIGEKDTEFLLQKTQEIAKKMKREGKSFNTARDSILCNTCGTTLIGEREVSKHAEKTGHVDFRQK

SEQ ID NO: 46777 - protein, 356 aa, Brassica napus
YSNRRVVFISVPLLFSFLGFIVTQEMATVVSLQAIIGSIASPHSTSNSKASLFPKESFNLPIKFRQNRCFKIEATTASQTPVLDTLLSPSKTTTTPHKKKSNEASLILIRHGESLWNEKNLFTGCVDVPLTEKGVAEAIQAGKRISTIPVDLIFTSSLIRAQMTAMLAMTQHRCKKVPIILHDESEKAQTWSHVFSEETRKQSIPVVAAWQLNERMYGELQGLNKEETAERYGTQQVHEWRRSYHIPPPKGESLEMCAERAVAYFEDNIQPELALGNNVLIAAHGNSLRSIIMYLDKLTSQEVTSLELSTGLPLLYIFKDRKFMRRGSPVGPTEAGVYAYTKRLAQYRQKLDESLN

SEQ ID NO: 46778 - protein, 352 aa, Pseudomonas aeruginosa PAO1
MASHWMIYGANGYTGRLVAEQAQREGLTPLLGGRNPAALHALGSQLGLECRVFDLGDPQACREALDQVKVVAHCAGPFSATSTPMIAACRAAGTHYVDITGEIAVFEQAHAGDAEAREAGIVVCPGVGFDVIPTDCLAACLKEALPDAQRLALGFDTGSGLSTGTAKTSVEGLKFGGKIRENGRLRDVPLGYKRRDIDFGRGLRHAVTIPWGDVATAYYSTGIPDIEVYLPAPPLLALGMRLIDPLRPLLGRQRVQDWLKGQVDKRIAGPDQAARERLRTWVWGEARNARGERRTARLETANVYDLTLHGVLLAVRHLLDYQGPGGYFTPSRLLGARCVESLPGSGRITVIG

SEQ ID NO: 46779 - protein, 103 aa, Coccidioides immitis RS
MTGRGKGGKGLGKGGAKRHRKILRDNIQGITKPAIRRLARRGGVKRISAMIYEETRSVLKTFLEGVIRDAVTYTEHAKRKTVTSLDVVYALKRQGRTLYGFGG

SEQ ID NO: 46780 - protein, 403 aa, Corynebacterium glutamicum ATCC 13032
MNPLRTNQWGIKYSSCMSNDFVVSRLRPFGETIFATMTQRAVEAGAINLGQGFPDEDGPRRMLEIASEQILGGNNQYSAGRGDASLRAAVARDHLERFDLEYNPDSEVLITVGATEAITATVLGLVEPGDEVIVLEPYYDAYAAAIALAGATRVAVPLQEVENSWDVDVDKLHAAVTKKTRMIIVNSPHNPTGSVFSKKALKQLAGVARAYDLLVLSDEVYEHLVFDDQKHVSVAKLPGMWDRTVTVSSAAKTFNVTGWKTGWALAPEPLLEAVLKAKQFMSYVGATPFQPAVAHAIEHEQKWVSKMSKGLELKRDILRTALDKAGLKTHDSMGTYFIVADIGDRDGAEFCFELIEKVGVAAIPVQAFVDHPKKWSSKVRFAFCKKEETLREAAERLKGIKKL

SEQ ID NO: 46781 - protein, 366 aa, Zea mays
MTFLFPAKNQQGTMEGRPSAPARVSMFRRLMVRVTPAERLAGDGKERDKDERPPASGAGADAEVGSVGLDKMVLSFMEDSSAAAERPPRGRCSSCFNGNNQDGSDDEDFDFLPSASAPAAAPAAAGDALELLKGLVQCASTPERNLLADASRIAERCGSGSGSGRKKADVRRAVADGLRALGYDAAAVPGATDGVRVRLVVEVDFRAEFEVARPTKAYRAALQALPPLFVGTPERLGRVVAVVADAARQSLRKRGLHLPPWRKHEYMRAKWLSPHARSGGGGGPDETPALATPVPAFSGVFEPRFGEKPKAAGGDGIPDGGDDKKATVVVSPSPWRPEAASKLSPQPPQARRKVVTGLASLLLLAS

SEQ ID NO: 46782 - protein, 764 aa, Oryza sativa (japonica cultivar-group)
MASRSSRGERVGVVFVLVVVVLCVDVSTLVAAQPLVSSQAKTLLWVRRLLGFPPALDALAGAPDACALPPTPSLTVACAGGQVTELSVLGGRAPGAALPANFSADALFTTLTRLPALSRLTLASLGVWGELPGAKLHRLQALRVLNLTGNCLYGAVPEHFSRMYSLQSLVLSRNRLNGAVPNLSGLAFLDELDLGHNRLGPAFPEVGNAVVRLVLADNNFTGRIPAAMSSLGQLQFLDVSGNRLQGWIPSSIFALPALRHIDLSRNQLAGQLPASTACADALAFVDVSDNLLAGARPACMRGNSSARTVLDAGNCFRDARSQRPSTYCNPGALAAVLPPAQGTGGEQGSGGKGGQVGMALGIVGGVVAGAALIALVMMAVLRRARRQNPEVSVLPKSPLASTPAAKKKAAADGGKAPAKVTQRIVTPAEKRHASQAARVNTLEVPAYRVYTLEELQEATNNFGSSNLIKSSPVVKHYNGQLQDGSRVSLRCLKLKPKYSPQSLTQYMEIISKLRHRHLVSIIGHCIVEDQENPNIASSLCLLSECVTNGSLRSHLTEWRKREMLKWPQRVSAAIGVARGIQFLHDVTAPGIVHNDLSIENILLDKTLTSKISNFNLPLISTSKNGKIFSESPFATSEDNDLGSVPSTEQGDKDDIYQFGLILLEVITGKPTESPKDLDSLKTQISEAIAEDPDLLKDMADPTIRGTFAVESLSTVAEIALNCIASDTSSRPSIEDVLWNLQYSMQVQDGWASSESLSLSTRSQG

SEQ ID NO: 46783 - protein, 440 aa, Oryza sativa
  misc_feature (393)..(393): Xaa can be any naturally occurring amino acid
MPPVGEVAAAEARSGMVLGGGAAAAAVGGGEDAVVMQVAGAEGQDSVITINCPDQAGLGCDLCRTILEFGLRITRGDVSTDGQWCFVVFWVVPRTPSIKVRWANLKNRLMSMCPSNYPMTFYPEITQPGPSQFYLLKLFSADRKGLLHDVTHILSELELIIHRVKVSTTPDGRVIDLFFITDGMELLHTKERQEETCSMLIATLGPSISCEILLAEGFQQGFSSLPPTISEELFRLELADGDNCSRSICAEMKRVQKATINFDNTLSPAHTLLQINCADQKGLLYDILRTMKDCSIQVTYGRFWSDKKGFREVDLFIKQADGKKIIDPEKQDVLSSRLRSEMLHPLRVMIVNRGPDVELLVANPVELSGKGRPRVFYDATFALKALGICIFSXLKLGGRQHQSVNGRSTDSSWMIAVSSHCQTALSIGTVLSTGKSWQYV

SEQ ID NO: 46784 - protein, 1237 aa, Arabidopsis thaliana
MAKATKTVVPATQPSCAIAQANDSTPEPMTAVIMCALAVQNVPVLFSRPSSSTLFTAASPDSTAEGLLYASIILIRQLPVPSSRGVDKLVWLPVKSGEYTSRSGYGVTSLTVLPTAQVRFNWQANLWKLHTMPKIKLFLWKAAAGALPVGAQLVRRHISSTWDCARCGAPETSTHMLFHCDFAAQVWNLAPLQLGHIPIGTPILEALNLLKKTIVLPPVGIHTATLFPWICWHIWKARNQLIFQNSHFSVIETVTKAVQDALAWQSAQLALPKVRVATPRPNSTTTLTHDFLCYVDAAWQQQSSLAGSGWVFQATSHSEKEITTFSAGCRRFPSPLAAEAWAIKSAMLHALQLERSDLLVLSDSKSIVDALNSNVSLNEIFGLLVEIRSIRNRFRSISFQFIPRLVNSIADAAAKLSLCISGNIGLDPAAWLALRFHFKEFASANVDKQTKSIDAEPYVARVKPVLMIDTVQEIAIYIHRFHNLDLFQQGMRWEDGDNNSCGIPSRVVQYEALDSTSNDSYGVWKIDDKDSSFLTQPFRIKYARQDVRLCMMVSFTMPLERYEGSATSAVILKFELLYSPIMEDIPVTHSDACAAAVHEFRIPPKALSGVHSYCPVHFDTFHAVLIDVSVHVSVMKSAAYKRPAILSSDASNGKNLTSGNIQSSKKAFTQIASADKKLVSFVKALLGARDTLLEEMQRLSKAVGQTVDLSEFVSSMDNALLSDSGSTGKSVEVEGSGQGKLQNNLEKLNGPFDLASDDWLHNFSKEHLSRTFHLLGTQLHYLWNTFLTLHRDNYTKILEYLRDIWTKDRRAEWSIWMVYSKVEMPHHFISGMEDISNHSSHKRVSTGLKLNDPAQVASTRAELHRRSIAQMRINNRAIQDMHIFGDPMRVPIVIIERVWNAPRRTFSDNSYMRHVDRIDSSLLNGHDDESGTKKHINPQHTGRELKIVVFVHGFQASIFLMFSECGHHLDLRLIRNQWLLIDPKIEFLMSEANEERTHGDFREMGQRLAQEVVSFFKRKKDKHARYGRLKNIKLSFVGHSIGNVIIRAAIADSLMDPYRKYFHTYISLSGPHLGYLYSSNSLFNSGLWLLKKLKSTQVIHQLTLTDDPDLQNTFFYKLCKQKTLCSFKNIILLSSPQDGYVPYHSARIESCQPASFDNSKRGVAFLEMLNNCMDQIRGPSPETPHHQRVFMRCDVNFDTTLYGRNLNSFIGRAAHIEFLESDVFARFIMWSFQDLFR

SEQ ID NO: 46785 - protein, 532 aa, Arabidopsis lyrata subsp. petraea
KTTLVELGRTLALEECALWMPTRTGLELQLSYTLRHQHPVEYTVPIQLPVINQVFGTSRAVKISPNSPVARLRPVSGKYMLGEVVAVRVPLLHLSNFQINDWPGLSTKRYALMVLMLPSDSARQWHVHELELVEVVADQVAVALSHAAILEESMRARNLLMEQNVALDLARREAETAIRARNDFLAVMNHEMRTPMHAIIALSSLLQETELTPEQRLMVETILKSSNLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDTRDADFFVVPTGSHFYLRVKVKDSGAGINPQDIPKLFTKFAQTQSLATRSSGGSGLGLAISKRFVNLMEGNIWIESDGLGKGCTAIFDVKLGISERSNESKQSGIPKVPAIPRHSSFTGLKVLVMDENGVSRMVTKGLLVHLGCEVTTVSSNEECLRVVSHEHKVVFMDVCLPGVENYQIALCIHEKFTKQRHQRPLLVALTGNT

SEQ ID NO: 46786 - protein, 521 aa, Azoarcus sp. BH72
MSHQKILILDFGSQVSQLIARRVREQHVYCELHPYDVSEAFIRDFKPQGIILSGGPNSVYEAVDWRAPQVVFELGVPVLGICYGMQTMAEQLGGKVESSAKREFGYAELRARGHSKLFQGIEDRTNAEGHGLLDVWMSHGDKVTELPAGFKVIGSNESCPVAAMADEERGFYGVQFHPEVTHTIKGKEMLARFVHEICGCGNDWNMPDYISEAVEKIRAQVGDEEVILGLSGGVDSSVAAALIHRAIGDQLTCVFVDNGLLRLNEGAQVMETFNRSLGVKVIHVDATEQFMGHLKGVSDPEQKRKIIGREFVEVFQAEAAKLPKARWLAQGTIYPDVIESAGAKTGKAHAIKSHHNVGGLPETLNLKLLEPLRDLFKDEVRELGVALGLPHDMVYRHPFPGPGLGVRILGEVKKEFADLLRRADAIFIDELRAADWYDKTSQAFAVFLPVKSVGVMGDGRTYEYVVALRAVQTQDFMTAHWAELPHSLLGKVSNRIINEVRGINRVVYDISGKPPATIEWE

SEQ ID NO: 46787 - protein, 204 aa, Zea mays
MASSMLSSAAVATSPAQATMVAPFTGLKSSAAFPVTRKSNTDITSIANNGGRVSCMKVWPPVGKKKFETLSYLPDLTDVELAKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGGLFSFQKQPKKNPNPFPFPMAGFT

SEQ ID NO: 46788 - protein, 427 aa, Pseudomonas syringae pv. phaseolicola 1448A
MSRSETLFANAQKHIPGGVNSPVRAFKSVGGTPLFFKHAAGAYVTDEDDKRYVDYVGSWGPMILGHSHPEVLDAVRSQLEHGLSYGAPTAMETEMADLVCALVPSMEMVRMVSSGTEATMSAIRLARGFTGRDSIIKFEGCYHGHSDSLLVKAGSGALTLGVPSSPGVPAAFAKHTLTVPFNNLDAVRDLLAEVGQEVACIIVEPVAGNMNCVPPAPGYLQGLRDLCDEHGVVLIFDEVMTGFRVALGGAQAYYGVTPDLSTFGKIIGGGMPVGCFGGKREIMSHIAPLGPVYQAGTLSGNPLAMAAGLTTLRLISRPGFHDELSDYTRRLLEGLQQRADAAGIAFVTTQAGGMFGLYFSEAREIVTFEDVMTSDAERFKRFFHLMLEGGVYLAPSAFEAGFTSIAHGDAELKLTLDAAEKAFAALK

SEQ ID NO: 46789 - protein, 315 aa, Gluconobacter oxydans
MLACNRAIIARMESPVPLIPQLGAHLVAAGGKRLRPLLTLASARLCGYQPGPDHQRHVGLAACVEFIHTATLLHDDVVDESTLRRGLASANAVFGNKASVLVGDFLFARSFQLMTADGSLKVMAILSDASATIAEGEVLQMVVQNDLTTPVERYLEVIHGKTAALFAAACRVGAVVAERPEAEEEALERFGTNLGMAFQLVDDALDYAADQQVLGKTVGDDMREGKITLPVLAAYEAGSPEDRIFWERVIGEGEQTEDDLPHALNLIAKTGAINTTIARAQVYADAAVEALSIFPDSELRRLLIETVQFTVNRAR

SEQ ID NO: 46790 - protein, 378 aa, Triticum aestivum
STAMEEEVAALVIDNGSGMCKAGFAGDDAPRAVFPSIVGRPRHHGIMIGMGQKDSYVGDEAQSKRGILTLRYPIEHGVVTNWDDMEKIWHHTFYNELRVAPEEHPVLLTEAPINPKSNREKMTQIVFETFNAPAFYVSIQAVLSLYASGRTTGIVLDSGDGVTHVVPIYEGFALPHAIARVDMAGRDLTDYLMKILAERGYTFSTTAEREIVRDIKEKLCYVALDFEQEIQTAAQSSSLEKSYELPDGQVITIGNERFRAPEALFQPSVLGLESGGIHVTTFNSIMKCDVDVRKDLYGNIVMSGGTTMYPGLSDRMQKEITALAPSSMKVKIIAPPERKYSVWIGGSILASLSTFQQMWISKQEYDESGPSIVHRKCF

SEQ ID NO: 46791 - protein, 136 aa, Coccidioides immitis RS
MARTKQTARKSTGGKAPRKQIAAKAARKAAPSTGGVKKPHRYKPGTVALREIRRYQKSTELLIRKLPFQRLVREIAQDFKSDLRFQSSAIGALQESVEAYLVSLFEDTNLCAIHAKRVTIQSKDIQLARRLRGERS

SEQ ID NO: 46792 - protein, 347 aa, Bradyrhizobium sp. BTAi1
MAAAHGLPVLDLSAFDAGAEERSVFLRSLREAALGPGFFYLTGHGIGPALTRDVLKLSRQFFALPEPDKLAIEMIKSPHFRGYNRAGFEHTRGKPDWREQVDIGAEREALPVDRSAPAWLRLQGPNQWPAALPDLNPVLLHYQAEVTALAIRVLRAFAAALDQPDDIFEPIYTPVPNQLLKIIRYPGRDPDQSDQGVGAHKDSGFVTILLQDEVAGLQVEADGGWIEAPPLPGSFVVNIGEILEIASNGLLRANVHRVVSPPAGSDRLSVAFFLGARLDATVRPLQLSPELSRLARGVTQDPLNPLFRDVGKNYLKSRLRSHPDVARRHHADLLEGEPASSEPASAY

SEQ ID NO: 46793 - protein, 982 aa, Oryza sativa (indica cultivar-group)
MSLVYRLPLIHECGLVMFCRTLKIDVLGQVRIGVLQMTRVIHDSGEGMQKEALAMVSSDVNFPKGHFPDYEIGPNNQIIDPEEIHEAVPLKEIVAKETAQLLEQRRGLSVRDLKEKFEKGLSGASKLSEEAKRREAASLDRQVLLKKLRDVLDTLKGRVAGRNRDDADEAISLVEALAVQLTQREGELIYEKAEVKKLASFLKQATEDARKVAEEERALALAEIEKARTAIAIVEKGLQEHDAASSSREKEEIEGLRKEVREARRIKMLHQPSKVMDMEFELKALRTLIAEKNQLCNQLMKELAMIKRLEEDSSDLYDLEGSDILGSQFCIIPRFDDAPDISSCPTQWYRVISGGNRNLILGATKPTYAPEPFDVGRLLQAEIVLNAEKVTIQTMGPINPAAGLEHYVESLMKRADVEFNVVVTQMNGNDYSSNSVHAFHIGKMRIKLRKGWSTKARESYSTTMKLCGSRGGGNAAATAVFWQARKGLSYTLAFETDRDRNAAIMLARKFASNCNITLTGPGDEVHAELAGAAVAAALDGGEEGSRAARLHSFFASVISGIFGQGEEEEEGEMATRSQNVAAAPQPPQNRGNVAALGKQKAVVAGRPDAKNRRALGEIGNVMNVRLPEGKPLQQAPAGRTANFGAQLLKNAQANAAANKQNAVAPAAVARPAQRQARKAPVKPAPPPPEHVIEISSDSDQSMRQQSEGSASSVRKCSRKKVINTLTSVLTARSKVACGITDKPREVIEDIDKLDGDNELAVVDYIEDIYKFYKVAENECRPCDYIDTQVEINSKMRAILADWIIEVHHKFELMPETLYLSMYVIDRYLSMQQVQRRELQLVNDFILISDSAYTREQILAMEKGILNKLQWNLTVPTAYMEHMAFFFAELALMQYGLVASLPSKVAASAVYAARLTLKKSPLWTDTLKHHTGFTESQLLDSAKLLVTSHSTAPESKLRVVYKKYSSEQLGGVALRSPAVELCK

SEQ ID NO: 46794 - protein, 370 aa, Desulfitobacterium hafniense DCB-2
MTDLYNEGTEELLLNMGPQHPSMHGVFRMVVRLQGETVTGIEPKIGYLHRGLEKIAESRTYPQFIPYTDRLDYLASPHNNLAYVQTVEKLMGLEIPERAEYLRIILAELARFASHQVFIASAALDMAGWTAWGYPFRDRERILDLFEMMSGSRLTVNCMRIGGVSAEPPAEFWPALESFLDDMPEKLEEYFNIYMGNEIAQARMKKVGILSKEVAENLCITGPALRASGVQYDVRKAEPYGIYDRFDFEVPVLYGCDTYDRNLIRFMEMNESLKIIRQAVRDIPEGPIMAKVPKIIKPPAGEVYHRVENPKGELGFYIVSNGTPKPERVKIRAGAFVNLQCLNEIGVGTYIQDLIASFASLDAVLGEVDK

SEQ ID NO: 46795 - protein, 1543 aa, Coccidioides immitis RS
MAAPTTIKILGRDSIVADFGIWKRHVADDLLTNCSSSTYILISDTTLTPLYVPSFQAAFENAASGLTPKPRLLTYAIPPGELSKSRQTKADIEDWMLSRQPPCGRDTVIIALGGGVIGDLIGYVAATYMRGVRFVQVPTTLLAMVDSSIGGKTAIDTPHGKNLIEKNADAILSAVKSENTPERPRFGGIQEILKLTILASARFKADVVSKDEREGGLRNLLNFGHSIGHAIEGILAPQILHGECVAIGMVKEAELARHLGLLKNVAVPRLVKCLANYGLPTSLKDSRIRRLSAGKHCSVDQLLAFMAVDKKNAGPKKKVVLLSAIGRTHEQQASVVSNEDIKIVLAPSIEVSPGVPKSLQVTCTPPGSKSISNRALVLAALGSGTCRIKNLLHSDDTEVMLNALERLGAATFSWEEEGEVLVVHGNGGALKASPEELYLGNAGTASRFLTTVATLANNGTVSSTVLTGNARMKQRPIGALVDSLRANGAGVEYLETNGCLPLKIDASGGFAGGEISLAAKISSQYVSSLLMCAPYAKEPVTLKLVGGKPISQQYIDMTTAMMRSFGIDVKRSTTEEHTYHIPQGKYMNPAEYIIESDASSATYPLAVAAITGTTCTIPNIGSKSLQGDARFAVDVLRPMGCEVSQSEYSTTVTGPKDGVLKPLPNVDMEPMTDAFLTASVLAAVATGSPNRTTRIFGIANQRVKECNRIRAMKDELAKFGVICREHDDGLEIDGIDRSTLLQPPHGVHCYDDHRVAMSFSVLALTAPKPTLILEKECVGKTWPGWWDTLAQLFKAKLEGVELKSSTKQKAEKPAASIFIIGMRGAGKTTSGLWAAKALKRPFIDLDVELESTIGKTIPEIIKERGWEGFREAELALLQKVIREKPTGYVFACGGGIVETQEGRDVLVQYHKANGNVLLLMRDIKEVMDFLKIDKTRPAYVEDMMGVWLRRKPWYQQCSNFQFYSQQSTQDEMGRALESFSRFLRVITGEVDHLSLLKKKPQSFFVSLTLPDLRPSADILGDVTLGSDAVELRVDLLVDPSSANDIPSVDYVAEQISMLRSRVSLPLVFTIRTKSQGGRFPDDAHDAALDLYRLAVRMGSEFVDLEVTFPEHMLRAVTEMKGFSKIIASHHDVSGSLSWANGSWGQFYNKALQYGDIIKLVGVAKCLDDNIALRKFKTWAQDAREIPVIAINMGEKGRLSRILNGFMTPVSHPKLPFKAAPGQLSAQDIRKGLSLMGEIEPRKFAIFGKPVSASRSPTMHNALFAQVGLPHAYSRLETDNVEDVREFIHAPDFGGASVTIPLKLDIMPLLDEISPEAQVIGAVNTIVPIPRGPGDMTGHPRLIGYNTDWQGMVRCLRRGKAISPSFADTAVPGLVIGGGGTARAAIHALYSMGYSPIYLIGRSEAKVAEMASTFPEKYSVQVLKDATSLENLPMVAIGTIPGDRPIDPSMREVLCRLFENAARVDSELSAKGEVPAKRVLLEMAYKPDITPLSQLASDSGWSTIPGLEALVGQGVHQFELWTGITPVYQDARAAVMNPDTDNRG

SEQ ID NO: 46796 - protein, 159 aa, Pyrococcus abyssi
MCENEKERTLVIIKPDAVIRGLIGEIISRFEKRGLKIVGMKMIWISKELAEKHYAEHREKPFFKSLVEYITRTPVVVMVVEGRCAIEVVRKMAGATDPKNAEPGTIRGDFALEVSDAICNVVHASDSKESAEREIKLYFRDDEIFDYPRAEDWFYRKGI

SEQ ID NO: 46797 - protein, 313 aa, Magnetospirillum magnetotacticum MS-1
MYGREHLGPWWGYVAGWGFVVGKTASCAAMALVLAAYAAPPGWERPVAAAAVVVLTAVGYRGVTRTARLARGIVAVALLAIATAVVASLAGTTPRWSVVLDADGAHGGWYGVLQAAGLLFFAFAGYARVATLGEEVRDPRRTIPRAVLVSLGTVVALYAVVAVTLLAVLGPARLAASAAPLADAVAAGSWSWAGPVVSVAAVAASAGALLALLAGVIRTGLAMARTGDLPGWFAAAHPVHRVPHRAELTVGAAVVLLVLATDLRGAIGFSSFGVLVYYLVANLSALRQTAPHRLYPRVLPVLGALGCVALVVT

SEQ ID NO: 46798 - protein, 246 aa, Oryza sativa (indica cultivar-group)
MKKGILRPFRYISNMMDGKEAAQDMQIGFPTDVKHVAHIGWDGPSVPNNNNTAGAPSWMKDYHSAPLDSASFRSDRGGSAAANPWASQEIVVDGGSLGDTSFSETRSEAGGSMDITAGDSPPSSDSRRSRRHRSRGSAATSSMDCTAADGGAAPEKKDKAKKSSRGKNRKKDKSDKSAAAGAGDDASGATCQDLPAVPKKSNRRKNKGGSEGTGAAAASKADGAGAGGEDAAAPEPPATEEAQDHD

SEQ ID NO: 46799 - protein, 416 aa, Magnetospirillum magnetotacticum MS-1
MLRKHPRYVEAAVLERVCEPERQIIFRVPWVDDIGRVQINRGFRVEFNSALGPYKGGLRFHPSVYLGIVKFLGFEQIFKNSLTGMPIGGGKGGSDFDPRGRSDGEVMRFCQSFMTELYRHIGENTDVPAGDIGVGGREIGYLFGQYKRITNRYESGVLTGKGISWGGSLVRTEATGYGTVLFAQNMLETRGQELDGRRVVVSGSGNVAIYATAKAQQLGANVVAFSDSSGYVVDEAGVDLELLRQIKEVERGRVADYAARRPGARVVTDGSIWDVPCDVALPCATQNELDEAAAKQLVANGVVAVAEGANMPTTPSAVALLQEAGVLFAPGKAANAGGVATSALEMQQNASRDAWSFEYTEDRLAQIMAGIHDRCVETADEYGTPGNYVLGANIAGFTKFADAILAGDPLDRLTAC

SEQ ID NO: 46800 - protein, 146 aa, Glycine max
MPQGSLEVFLVNAKGLENTDYLCNMDPYVILICRTQEQKSSVASGQGSEPEWNEAFVFNVSEGVSDLRLKIMDSDSTTAHDLVGEATIPLDGLFIEGNIPPTSYNVVKDGHYCGEIRIGLTFTPQDRSERCPEENFGGWKESGYRD

SEQ ID NO: 46801 - protein, 344 aa, Oryza sativa (japonica cultivar-group)
MESLPVPSVQSMVAADGGAHVPPRYIRPRDEAVATDGETEIPVIDFQRLQLGHDEEMARLDRACQDWGFFQLINHSVPEDVVDGMKANARGFFELPAETKKQFAQERGQLDGYGQLFVVSEDQKLDWADILFLNTLPVQNRNFRFWPNQLAKFRSALDKYSAAVKSIVDFLLVTVANNLGVDPEVIANKCGTDGIQAVRMNYYPPCVQADKVIGFSPHSDSDLLTLVLQVNEVDGLQIKRNETWFPVRPLEGAFIVNVGDILQIFTNGRYKSAEHRAVVDMKKERLSIAAFHSPSVHAVIGPLKEMVAHEHEAVYRSIGHDEFMKLFFSSKLEGKSFLDRMKKL

SEQ ID NO: 46802 - protein, 527 aa, Hordeum vulgare
MSSMQFSSVLPLEGKACVSPVRREGSACERLKIGDSSSIRHERASRRMCNGGAGAPPPPVRSACSPPTPARPTPLFSGRPSGGITPIRTRSRPSVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFRGTADAVRKFIWVLEDYYKHKSIEHILILSGDQLYRMDYMELVQKHVDDNADITLSCAPVGESRASEYGLVKFDSSGRVIQFSEKPKGDDLEAMKVDTSFLNFAIDDPAKYPYIASMGVYVFKRDVLLNLLKSRYAELHDFGSEILPRALHDHNVQAYVFTDYWEDIGTIRSFFDANMALCEQPPKFEFYDPKTPFFTSPRYLPPTKSDKCRIKEAIISHGCFLRECKIEHSIIGVRSRLNSGSELKNAMMMGADSYETEDEISRLMSEGKVPIGVGENTKISNCIIDMNARIGRDVVISNKEGVQEADRPEEGYYIRSGIVVIQKNATIKDGTVV

SEQ ID NO: 46803 - protein, 459 aa, Bacillus cereus ATCC 10987
MSKLVVIGGGPAGYVAAITAAQSGKEVTLIDEADLGGTCLNVGCMPTKSLLESAEVHDIVRKANHYGVMLNEGSISVDWKQMQARKSQVVTQLVQGIQYLMKKNKIKVIQGKAKFETDHRVRVTHGGKEIVVDGEQFIIAAGSEPTELPFATFDGKWILNSSHAMSLENIPKSLLIVGGGVIGCEFASIYSRLGTKVTIVEMAPQLLPGEDEDIAHILRGKLENDGVEIFTGAALKGLNNYKKQASFEYEGSTQVVNPEFVLVSVGRKPRVQQLDLEKAGIQYSNKGISVNEHMQTNASHIYAAGDVIGGIQLAHVAFHEGTTAALHASGEDVKVNYHAVPRCIYTAPEIASVGLSEKLAREQYGDILIGEFPFSANGKALIIGEQTGKVKVIVEPKYQEIVGISIIGPRATELIGQGTVMIHTEVTADIMRDYIAAHPTLSEAIHEALLQAVGHAVHA

SEQ ID NO: 46804 - protein, 399 aa, Bacillus cereus ATCC 10987
MAVEVVMPKLGMAMKEGIITSWNIKAGDHVSKGELIASINSEKIETEIEAPADGTVLDIAVSEDEGVPPGTVICYIGKLNEKVEINESINVVEEKAPNLEPKKVQHPEPYAKEVAKQRIKISPVAKKIAKSENLDIKALVGTGPGGRITKVDVLKAIEERVTIPEVLEQEESKVIPVTGMRKAIANRMHASLQNSAQLTLTMKVDVTDLVALHKEIAAVVQKRYDNKLTITDFVSRAVVLALGEHKEMNSAYMDDTIHQFEHVHLGMAVALEKGLVVPAIRFANNLSLVELSKQIKNVAQKAREGSLSSDDMQGTTFTISNLGSFGIEYFTPVLNTPETGILGVGAIEHVPVYKGKKIKKGSMLPLSLTFDHRVLDGAPAAAFLRTIKRYLEEPVTILL

SEQ ID NO: 46805 - protein, 255 aa, Azoarcus sp. BH72
MCLILFGWQARADFPLVVAANRDEFHDRPAAAAHWWADRPGLLAGRDLEAGGTWMGVSRRGRFAALTNYRDPARRRPGAPSRGMLVRDALESDRPALDVLHEIGARSADYVPFNLLVGDGDTLGILESTTGVVQELPPGIYGLSNHLLDSDWPKVKRARAAFGAALATLPDEGAFLALLRDTTVADDADLPATGVGLEWERWLSPAFVQAPGYGTRCSTLLTVDGSGEHCLTEWSWNAAGESSASVTHRFRPSVC

SEQ ID NO: 46806 - protein, 689 aa, Triticum aestivum
  misc_feature (588)..(588): Xaa can be any naturally occurring amino acid
MAPRRFLLLLPVLLVLLGADGFGRGAGQNTDQFAYNGFASANLTLDGLAAVAPNGLLALSNGTRQAAGHAFLSTPLCWYRSGIPGISSTHGSVQSFSVAFVFAIVSNFTVLSDNGMAFVVAPSTRLSTFNAGQYLGILNVTDNGKPDNGVFAVELDTMLNPEFQDMNSNHVGVDLNSLRSVQNHSAGWYDDATGVFNNLSLISRRPMQVWVDYDGATTRLDVAMAPLDVPRPKKPLISAPVNLSAVVTDTAYVGFSAATGVIFTRHYVLGWSFALNGPAPPLDTSKLPSLPRFGPKPRSKVLEIVLPIATAAFVLALAIAFFMFVRTRIRYAEVREDWEVEFGPHRFAYKELYKATKGFKNRRLLGTGGFGRVYKGVLPRSNLEIAVKRVSHDSKQGMKEFIAEVVSLGHLRHRNLVQLLGYCRRQGELLLVYDCMPNGSLDKYLHDKTRPVLDWSQRFQIIRGVASGLLYLHEDWDKIVIHRDIKASNVLLDADMNGRLGDFGLARLYDHGVDPQTTHVVGTMGYLAPELVRTGKATPVTDVFAFGVFVLEVTCGRRPLGCIAADDQNVLLDWVQEHERRRAGLDTXVTPRLCGKYDADEARLAIKLGLMCAHPLPDARPGMRQVTQYLEGEATVPEVVPTFLSYTTLALMQNDGFDSFAMSFPSTVTTDASPTSGDVSAVSGLSGGR

SEQ ID NO: 46807 - protein, 272 aa, Oryza sativa (indica cultivar-group)
MSPLRPPPTPRTPLGGAATTPDHLPPPSPHTPRPAITLTAPPSKKKRRGGAAARSLRAIRAVRALFRSLPILAPACRFHGAIRAPGGASRAHDGHVSGASRTTGTLFGYRKARVTLAVQETPGSVPILLLELAMQTGRFMQEMGAEHLRVALECEKKPPGAGAGIGRTRLLDEPLWTAYVNGRKIGYAMRREPTEGDLTVMQLLRTVSVGAGVLPTDVMGGDAGAEVQDAGDLAYMRARFDRVVGSRDSESFYMLNPDGNNGPELSIFFIRI

SEQ ID NO: 46808 - protein, 471 aa, Brassica napus
  misc_feature (294)..(294): Xaa can be any naturally occurring amino acid
MHPFNAMMAARMLTAVGKSNGLESETIPFGSLWWSIYAGVSCFLVLFAGIMSGLTLGLMSLSLVDLEILQRSGSPKEKKQSAAIFPVVQKQHQLLVTLLLFNALAMEGLPIYLDKIFNEYVAIILSVTFVLFVGEVIPQAICSRYGLAVGANLVWLVRILMILSYPISFPVAKMLDWVLGHGDPLFRRAQLKALVSIHGEAAGKGGELTHDETTIISGALDSTAKTAREAMTPIESIFSLDINSKLDWEAMYKIRTRGHSRIPVYSENPKNVVGLLLVKSLLTVRPESDTLVSXVGITHIPRVPADMPLYDILNEFQKGSSHMAAVVKVNVKRKGSLSTLLEEENTNDSKLTTPLLLKREGNQDNVVVDIDKISNSGFSHTSEEIEDGEVIGVITLEDVFEELLQEEIVDETDEFVDVHKRIRVATVAAVAISSLARAPSSRRLLGQKGTGGPKTPKASSTTPKTGQDKPI

SEQ ID NO: 46809 - protein, 282 aa, Brassica napus
  misc_feature (150)..(150): Xaa can be any naturally occurring amino acid
MAEEKKVAPIGVWNTVKPFVNGGTSGMLATCVIQPIDMIKVRIQLGQGSAASVTKNMLKNDGIGAFYKGLSAGLLRQATYTTARLGSFKMLTAKAIEANDGKPLPLYQKALCGLTAGAIGACVGSPADLALIRMQADNTLPLAQRRNYTXNAFHALYRISADEGVLALWKGCGPTVVRAMALNMGMLASYDQSAEYMRDNLGLGETSTVVGASAVSGFCAAACSLPFDFVKTQIQKMQPDAQGKYPYTGSLDCAMQTLKSGGPLKFYTGFPVYCVRIAPHVM

SEQ ID NO: 46810 - protein, 267 aa, Kluyveromyces lactis NRRL Y-1140
MTPATPPSSRNKRSNKTDLLLATPERAAESDSSGMVTPGTVRVKDRLQPPTRPMNLTSPCPALKTPEYTPHKNKHTKRRIEFDQEKLQPVSRVLFGSDFQVEETSNNRTLLPPKRTGIMESFKGVQSYNINDEYAVNNKFKLAKQEPGTPSDKITTFELARKWHNESGLNTSQSENEEENIHIEQQPTAVNQHSNLENPFLSNNIADEKLRKERKEKMLLEDPDLEDTITYVNKGGKVVSKRHLTDDEKQRFKPTRLFAEEIDRHDG

SEQ ID NO: 46811 - protein, 119 aa, Triticum aestivum
MASLDSDVTMVPAGESSSSVAPSSSSTKKAKKFEVKKWSAVALWAWDIVVDNCAICRNHIMDLCIECQANQASATSEECTVAWGVCNHAFHFHCISRWLKTRQVCPLDNSEWEFQKYGH

SEQ ID NO: 46812 - protein, 518 aa, Lactobacillus plantarum WCFS1
MAKTDTASFDSILVLDFGSQYNQLITRRIRDFGVYSELLPNTITAEEIKARHPKGIIFSGGPNSVYDDGAFRVDPEIFKLGLPILGICYGMQLMTYTLAGGKVESADNREYGKANIDVTSDSATLFKDTPAEQSVWMSHGDLVTQAPDGFDVVATSKNCPIAAIQDVDRKLYGIQFHAEVRNTDYGNDILRHFAFDVCQAEANWSMDDFIDMQIEKIRAEVGDKKVLLGLSGGVDSSVVGVLLHKAIGTQLTSIFVDHGLLRKGEADQVMASLEGKFGLNIIKVDAKDRFLSKLAGVSDPERKRKIIGNEFIQVFDEEATKLNGMEFLAQGTLYTDVIESGTSTAQTIKSHHNVGGLPEDMQFKLIEPLRTLFKDEARELGEKLGMPSDLVWRQPFPGPGLGIRVIGEITEDKLEIVRDSDFILRDEIKKAGLDREIWQYFTVLPGIKSVGVMGDGRTYDYTVGIRAVTSIDGMTADFARIPWDVLQKISVRIVNEVDHVNRIVYDVTSKPPSTIEWE

SEQ ID NO: 46813 - protein, 388 aa, Desulfovibrio desulfuricans G20
MTQFTLADRLATLPPYLFAQIDKVKAEVAARGVDIISLGIGDPDMPTPDFVIEALKKAAEKPANHQYPSYTGMLAFRQEVANWYKRRYAVELDPKTEVLTLIGSKEGIAHFPTAFVNPGDLVLVCPPCYPVYAIASRFMGGVVQELPLLEENDFLPDLDAVDEATWEKARCIFVNYPNNPTAAMAPRSFFEKLIGIARKHNVIVVHDAAYTEMYYNENNRPLSIMEIPGAMDVAIEFNSLSKPYNMTGWRIAMAVGNASLVAGLGKVKENMDSGAFQAVQEAAIVALRDGDAFLAEIRDIYRKRRDTVIAALNKIGITCRVPEASLYVWARVPEGYTSSDFVTRVLQETGVVMTPGNGFGAAGEGYFRISLTVNDERLEEAVSRIASL

SEQ ID NO: 46814 - protein, 406 aa, Xanthomonas campestris pv. vesicatoria str. 85-10
MSGMVIVGAGQAGLQTAESLRSGGYTGSIVLLGDEPCAPYHRPSLSKGFLLGEVSDTQLYIRAPGALNRKGIQWHASARVMRIEHATRTLHLDDGSTLGYTGLCLATGARARRLEVPGAGLGHVCMLRGMADTRALAAILPHTSRVVVIGGGFIGLEFASIARRLGKQVVVLEAADRLMARVVSPQLADFFLRLHRDNGATIELGSNVSALSGNRGVVTAVHTADGRVFPADLVVVGIGVIPNGELAQQAGLACDRGALIVDACARSSSPGIVGAGDCTVRQRAGSGLLRLESVQNAIEQAKSAAASLLGEHRPYPALPWFWSEQYEVRLQMAGFAAGHTQAVVRGDLATSTFSLFYYVDGELCAVDSINRPQDHLAARKLLELGRSPTPQQAADPNFALTSLIPA

SEQ ID NO: 46815 - protein, 735 aa, Arabidopsis thaliana
MSSNMGTELIDLETVKADSDAFGETNLMELVGSNDPPSLQHISVSEIEQEPMEISVSGPLSFQFEPEAVSFQSSMLVDTQSLMPQLQLPYSVERSVAACSNSVTGKRKSPPESTLSGSATSEKLDASNKRVEPVHHRPWLEQFYSECIQRGHMPPPATLSTKTEHLPTPAKKVRQMEPASQKSGKQVMNKKQAGLSQGSVKTLNDGNESLRSKMKESLAAALALVHEHEESPKEKKNSETEEASVPVADSNEPASACGTSVTVGEDITPAMSTRDESFEQKNGNGRTLSQESSKDTKMNYVNQSDVQKTQFDEVFPCDDVRFSDSIFTGDELLQGNGLSWVLEPVSDFGENETQKSFEDPELLASKIELELFKLFGGVNKKYKEKGRSLLFNLKDKNNPELRESVMSGKISPERLCNMTAEELASKELSQWRQAKAEEMAEMVVLRDTDIDVRNLVRKTHKGEFQVEIDPVDSGTVDVSAEITSNSKPRAKAKSSKSSTKATLKKNDSNDKNIKSNQGTSSAVTLPPTEEIDPMQGLSMDDEMKDVGFLPPIVSLDEFMESLNSEPPFGSPHEHPPGKEDPASEKSDSKDGSHSKSPSRSPKQSPKEPSESVSSKTELEKTNVISPKPDAGDQLDGDVSKPENTSLVDSIKEDRIWDGILQLSSASVVSVTGIFKSGEKAKTSEWPTMVEVKGRVRLSAFGKFVKELPLSRSRVLMRLGFSLAKTWNPESKKAHC

SEQ ID NO: 46816 - protein, 435 aa, Chlamydophila pneumoniae CWL029
MKRAIIIGAGISGLAAGWWLHKKFPQAEILVLDKEAYAGGFVRTESPQGFSFDLGPKGFLTRGDGEYTLKLIHELGLQNSLIFSDRAAKNRFVYYRGKAHKISTWTLLRKGLLPSLIKDFRAPCYTQDSSVQDFLKRHSSQNFTSYILDPLITAIRAGHSSILSTHMAFPELAKREASSGSLLRSYLKNRSPKKSKTDRYLASLSPSMGTLITTIQEKLPATWKFSTSVTHIDCSPKEACVTTPSETFFADMVIYTGPLQQLPVLLPNYGIENLSKRVLPWNLSSISLGWHHANFSLPKGYGMLFADELPLLGIVWNSQIFPQATPGKTVLSLLIEGKWRESEAHAFAIAALSEYLNINQKPDAFALFSSQDGMPQHAVGFLERKERILPHLPGNLKIVGQNIAGPGLNRCIASAYHAICDLHTEETLAQPQSSL

SEQ ID NO: 46817 - protein, 697 aa, Cenarchaeum symbiosum
MTAPPEYSESGLSDLVRSFIAQHKDRQGAYPYVEQIDQMMPLGTQYITVDYNDLVSSPEIDSRFNENPDEVLAAFSRAIAEVLQERFPWYAASVREDIRARVTNYPVQRSLREINADIINKMTSVSGMVVRASEVKPLAKELVYSCPEGHRTTVVLLKGMGVKPPTRCSDPKCSHRELEPKPESSKFIDFQILRMQELPEDLPPGQLPHYIEVAIKQDLVDSARPGDRIILSGVVRIEQEHVTGLGMNSGLYRLRIDGNNVEFLGGRGAKASRRSEREEISPEEEKQIRLLSRGEDIYKDLINSFAPHIKGQELIKEAILLLIVGSTQRHLGTGSKIRGDINIFLVGDPGTAKSEMLKFCALIAPRGLYTSGRGSTAAGLTAAVVRDKSGIMMLEAGAVVLGDQGLVCIDEFDKMKPEDRSALHEVMEQQSASIAKGGIVATLNARTSILAAANPMYGKYDTYKNITDNVNLPVPLLTRFDLIFVVKDTPSEERDRNIAQHIINLHTPGGTDARSLIDPDTLTKYLSFAKRHDPLLSPGAEKKIIDYYLEMRHVDSPDMITVTPRQLEGLIRLSTARARLLMKSRVEEEDAERAIQLMKIMLNDAGVDVTTGKVDVGVLHGKPRSEVSKMQLFMDVLSELEKPGAGEATKRPVQEKDLVAELVRSGKFNDKEAQRYIERMSRESAIYESSPGCYNRT

SEQ ID NO: 46818 - protein, 375 aa, Cryptococcus neoformans var. neoformans B-3501A
MSNTIAYFDITIANEPAGRLTFELFDDVVPKTANNFKHLCIGDKTNEAGVKLAYAGSSFHRCIKGFMLQGGDFTRGDGTGGESIYGEKFEDENFELKHDKPMLLSMANAGPGTNGSQFFITTVPTPHLDGKHVVFGRVIYNRSLVRRIENIPTTSDRPDQEVTISSAGVLSPDEFAQLEAERQAKQAGSDGGDIWEDWPQDEEGVDAEKPEEALVVAGKLKEVGTKEFKAGNFAVALDKYQKALRYLDVHPVLPNDSPAELVESFRSLRLPLLTNAALCALKLPASPNTSSLVVSLTSRALTLPNLSASEKGKALYRRAQAYVLKKDDEAAEKDLKGALECVPGDAGVIKLLKDVEAKRKARREKERQAFAKMFG

SEQ ID NO: 46819 - protein, 184 aa, Zea mays
  misc_feature (95)..(95): Xaa can be any naturally occurring amino acid
ISSKVQCCQLVEWKKLLGVGGTPQELGHQVALIRQVANKVFTSMGKTIGYKIGTMIEIPRAALVADEIAEQAEFFSFGTNDLTQMTFGYSRDDVXGKFIPIYLAQGILQHDPFEVLDQRGVGELVKLATERGLKARPNLKVGICGEHGGEPSSVAFFAKTGLDYVSCSPFRVPIARLAAAQVLV

SEQ ID NO: 46820 - protein, 344 aa, Bacillus cereus ATCC 10987
MTRTVSMSTAINEAMKISMRRDENVILIGEDVAGGAQVDHLQDDEAWGGVLGVTKGLVQEFGRNRILDTPISEAGYMGAAMAAAATGLRPIAELMFNDFIGSCLDQVLNQGAKFRYMFGGKAKVPVTVRTMHGAGFSAAAQHSQSLYALFTSIPGIKVVVPSTPYDAKGLLLAAIEDDDPVIFFEDKTLYNMKGEVPEGYYTIPLGKADIKREGSDVTIVAIGKQVHTALAAAEQLSKKGLEVEVIDPRSLSPLDEDTILASVEKTNRLIVIDEANPRCSIATDIAAIVADKGFDLLDAPIKRITAPHTPVPFSPPLEKLYLPTPEKVIETVSEMIGDQSLLHV

SEQ ID NO: 46821 - protein, 332 aa, Bacillus cereus ATCC 10987
MLKTTESKGNGITKEQARWMYEKMLEIRKFEDKVHELFAQGVLPGFVHLYAGEEAVAVGVCAHLTDRDSITSTHRGHGHCIAKGCDLNGMMAELFGKATGLCKGKGGSMHIADLDKGMLGANGIVGGGFPLACGSALTAKYKGTKDVSVCFFGDGANNEGTFHEGVNLAAIWKLPVIFIAENNGYGEATTFEYASSCDSIADRAKAYNIPGVQVDGKDLLAVYKAAEEAVERARNGGGPTIIECMTYRNYGHFEGEAQTYKTSEEKEEHLNEKDAIVNFRKHLIHEALLTESELVDMEKAVDEAVQKSIEFSENSPYPEDEELLKDVYVSYK

SEQ ID NO: 46822 - protein, 343 aa, Anabaena variabilis
MAKLKVGINGFGRIGRLVLRAGINNPNIEFVGINDLVPPDNLAYLLKYDSTHGKLRSQVEAKDDGIVIDGHFIPCVSVRNPAELPWGKLGADYVVESTGLFTDSEGASKHLQAGAKRVIISAPTKDPDRVRTLLVGVNHDLFDPSKDVIVSNASCTTNCLAPIAKVINDNFGLTEGLMTTVHAMTATQPTVDGPSKKDWRGGRGAAQNIIPSSTGAAKAVALVLPELKGKLTGMAFRVPIPDVSVVDLTFKTAKATSYKEICAAMKQASEGSLAGILGYTDEEVVSTDFQGDTHSSIFDAGAGIELNSNFFKVVAWYDNEWGYSNRVVDLMLSMIQKEQLAAV

SEQ ID NO: 46823 - protein, 306 aa, Synechococcus sp. RS9917
MTNPTTAKPTTANAQTALVGLLGDPVHHSLSPVMHNAALEAMGLNWIFLALPTPANDLETVVRGLRAVGCRGLNVTIPHKHSVVPLCAELSPLAQRLGAVNALVPRVDGGWFGTNTDVEGFIAPLREAQSDWQGRRALVLGCGGSARAIVAAITSLGCDQIQIAGRRPDALAAFQQDCGAWAPSLTGLDWHHQAALEQALEAADLVVNTTPLGMASTHNPDAVLASPLSPGDIQRLKPECWVYDIIYTPRPTRLLTDAAAHGCRTLDGLEMLVQQGAAALRLWSERSDVPVAVMRHAAEAALADRG

SEQ ID NO: 46824 - protein, 420 aa, Rhizobium leguminosarum bv. viciae 3841
MVEKRVQPLARDAMAYVLAGGRGSRLKELTDRRAKPAVYFGGKARIIDFALSNALNSGIRRIGVATQYKAHSLIRHMQRGWNFFRPERNESFDILPASQRVSETQWYEGTADAVYQNIDIIQDYGVEYMVILAGDHVYKMDYEWMLQQHVDSGADVTIGCLEVPRMEAVGFGVMHVNDKDEIIAFVEKPADPPPIPDKPDFALASMGIYVFHTKFLLDALRRDAADPNSSRDFGKDIIPYIVKNGKAVAHRFAKSCVRSDFEHEPYWRDVGTIDAYWQANIDLTAIVPELDIYDKSWPIWTYAEITPPAKFVHDDEDRRGSATSSVVSGDCIISGAMLNNSLLFTGVRANSFSKMEGAVILPNVKIGRRAQLKNVVIDHGVVIPEGLVVGEDAELDAKRFRRTESGICLITQPMIDKLDI

SEQ ID NO: 46825 - protein, 543 aa, Rhizobium leguminosarum bv. viciae 3841
MIKSVPTTPYLDQKPGTSGLRKKVPVFQQPNYAENFIQSIFDSLEGYQGKCLVIGGDGRYYNREVIQKAVKMAAANGFGKVMVGKGGILSTPAASHIIRKYKAFGGIILSASHNPGGPTEDFGIKYNINNGGPAPEKITDAIYARSKTIDSYKIADFADVNLDRIGKDELPGGTILSVIDPVEDYATLMEELFDFGAIRNLISLGFRIAFDGMSAVTGPYAKEIFENRLGAPSGSVRNFMPLPDFGGHHPDPNPVHCKELFDEMMGDDAPDFGAASDGDGDRNLIIGRGIFVTPSDSLAILAANANLAPGYSGGLAGIARSMPTSGAADRVAEKRGIGMYETPTGWKFFGNLLDAGMATICGEESSGTGSSHVREKDGLWAVLLWLNILAVRGESVADIVTQHWQTYGRNYYSRHDYEGLDTDAANGLVDNLRSQLPTLPGKSFGSLKVEKADDFAYHDPIDKSVSEHQGVRVLFEGGSRVVFRLSGTGTSGATLRVYIERYEPDSTRHNIETQEALADLIAAAESIASIRERTGRDAPTVIT

SEQ ID NO: 46826 - protein, 658 aa, Rhizobium leguminosarum bv. viciae 3841
MRGNSSAQAGAIVFETGVEFAVWSHHAAQIELCLFEDDGNREFARLPMARDSNYFHRLFVDGLKAGARYGYRADGIYAPDNGLWYDPSKLLIDPYAKEIDRPFRYDPRLGIYGEDSQDLMPKAIVTTDTRAAIRKPLFKPGGFIYEVAVRPFTILHPDVPEAERGTVAALAHPSVVAHLKRIGVDAVELMPITAWIDERHLPPLGLTNGWGYNPVAFMALDPRLVPGGMTELRETVAALHAEGIAVILDLVFNHTGESDRYGATLSLRGLDNLHYYRHAQNCPGELVNDTGTGNTLACDHPEVRRLVIDSLRHFVLNAGVDGFRFDLAPVLGRTATGFERDGTLAAILSDDVLADRIMIAEPWDIGPGGYQLGNFPPHFLEWNDRVRDDLRCYWRGDGWKTGALATALAGSSDIFSRNEGKETRSVNFLAAHDGFTLIDLVSYAGKHNDANGEHNRDGHNENHSWNNGVEGETVYPTIRKRRRDDVMALISTLFVTRGSIMLTAGDEGGRSQHGNNNAYCQDNEITWLDWKALDGDLIAHTTFVAGLRRRFTVFSERDFLSGNGDVEWISLSGEPMTVAEWETPSLSTLGMLLSTGDRSSSGRQTRLGVLFNRSGSRQFFTLPSEGEPGWRQLTPDGAKKTGGRATVEPRSIAFFVEN

SEQ ID NO: 46827 - protein, 303 aa, Bartonella bacilliformis
YIDGDEGILLYHGYSIDQLAENGDFLETCYLLLYGELPNKQQKIDFDRCIMRHTMVHEQFARFFHGFRRDSHPMAVMVACLGAMSAFYHDSINITDPQQRMIASIRLISKVPTLAAMAYKYSIGQPFVYPRNDLNYATNFLHMCFSVPCEEHKISPVIARAMDRIFTLHADHEQNASTSTVRLAGSSGANPYACIAAGVACLWGPAHGGANEACLKMLQEIGSVKKIPEFIARAKDKNDPFRLMGFGHRVYKNYDPRAKIMQKTCHEVLQELNIQDDPLLDIAMELEHIALNDEYFINKKLYP

SEQ ID NO: 46828 - protein, 501 aa, Oryza sativa (indica cultivar-group)
MGNCCPGSGDAEPASSDASTGNGSSSFKAGASPSSAPAQNKPPAPIGPVLGRPMEDVRSIYTIGKELGRGQFGVTSLCTHKATGQKFACKTIAKRKLSTKEDVEDVRREVQIMYHLAGQPNVVELKGAYEDKQSVHLVMELCAGGELFDRIIAKGHYTERAAASLLRTIVEIIHTCHSLGVIHRDLKPENFLLLSKDEDAPLKATDFGLSVFKDIVGSAYYIAPEVLKRSYGPEADIWSVGVILYILLCESEHGIFNSILRGQVDFTSDPWPRISASAKDLVRKMLNSDPKKRISAYEVLNHPWIKEDGEAPDTPLDNAVMNRLKQFRAMNQFKKAALRVIAGCLSEEEIRGLKEMFKSMDSDNSGTITVDELRKGLSKQGTKLTEAEVQQLMEAADADGNGTIDYDEFITATMHMNRMDREEHLYTAFQYFDKDNSGCISKEELEQALREKGLLDGRDIKDIISEVDADNDGRIDYSEFAAMMRKGNPEANPKKRRDVVI

SEQ ID NO: 46829 - protein, 307 aa, Oryza sativa (japonica cultivar-group)
MKPAPSNATLAAAAACCFVLAHGDAAAPVDEPALSAPNEEEREDEAVAAEALLLSPDAAVVAVGVGRGLVVHARRLGPFRLGPKGEPSRFIAQHGPPCAYTVLMETDRSQPAPIDPRRARFPCCIVWTPLPLISWLIPFIGHIGICREDGVILDFAGPNFVSVDNFAFGAVARYIQVNSDECYKLLEPEGASTWDDALRKGVQEFQHRGYSLFTCNCHSFVVNNLNRLFYSGHDKWNVVSLAAVMFLRGRWVSTASVVKTFFPFALVITIGTLLGGATFLIGLLAFAAVMTGWFLVGTYCIKSLVEL

SEQ ID NO: 46830 - protein, 377 aa, Arabidopsis thaliana
MADGEDIQPLVCDNGTGMVKAGFAGDDAPRAVFPSIVGRPRHTGVMVGMGQKDAYVGDEAQSKRGILTLKYPIEHGIVNNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDHLMKILTERGYSFTTTAEREIVRDMKEKLSYIALDYEQELETSKTSSSVEKSFELPDGQVITIGAERFRCPEVLFQPSMIGMENPGIHETTYNSIMKCDVDIRKDLYGNIVLSGGTTMFGGIGDRMSKEITALAPSSMKIKVVAPPERKYSVWIGGSILASLSTFQQMWIAKAEYDESGPSIVHRKCF

SEQ ID NO: 46831 - protein, 415 aa, Desulfovibrio desulfuricans G20
MHHFTYRDNELFVENVAVQELVATYGTPLYIYSKATFQRHFTAFDSAFGALPHLTCYSVKACSNMHILRFLGKMGAGMDIVSGGELFRALRAGIQPAKIVYSGVGKTRTEILQALEAGILMFNVESMGELEKISEVANQTGHTANVALRINPDVDPHTHPYISTGLKENKFGLDMEQSYAAYMRAMELPAITPMGIDCHIGSQLTSLSPFREAVEKILLFREKLCSAGLCIDYIDLGGGLGIPYDTEEPPHPQEFGKLLTDMLSGLGITLILEPGRVIAGNAGILVTKVQYTKKTATKEFVIVDAAMNDLIRPSLYQSHHHIAEVSPRGRAKHTVDVVGPICESGDFLARDRLMPAVEPRELLAVFSAGAYGFTMSSQYNSRPRAAEVLVRGDTAHLIRRRETYEDLIAPEETRS

SEQ ID NO: 46832 - protein, 1027 aa, Arabidopsis thaliana
MEANKKAKPSYGDVISNLPNDLLCRILSYLSTKEAALTSILSKRWSNLLLSIPILDFDDSVLLKPQKGQRKNVFFKAFVDRLLSQRVETSSHVQRVSLKCRQGGVEPDCVIKWILTTVRDLGVLDLSLCIDFGIFHLPFNVFRSKTLVKLRIGTMIRLSQFPSDVVSPTLNSLVLDLVEFRDGDKVEFRQILLAFPSLQSLRVHESNKWKFWNGSASSRTLKSLVYRSDDDSSAPKPCVSFDTPSLVYLDYSDMVADKYENLKFDSLVEARLDLHLTAFQIMRKPNNIGIVSGDVTTLFKGIRNVKILCLSPDALEALYYRGEKIPMFNNLITLSLGSDKPHGSPFIFWKLLPSLLNNSLKLETLIIKGLVHYVAEGWEGLSPMTPMSRLCFSWDTVSDSLSSSAMKVLEISGYKGTWQELNQMKRFLGNLSRLEVVRVYHKAMDDKERINVMFDLFLLPKVSSECDIQALRMVDSKRMDSGSKDMINDLPDALLCHVLSYLTTKEAASTSLLSRRWRYLLAFVPNLEFDDSAYLHRDKRVKNPLHEKGLVGFVLTVDDKRKKLSTSFPDFVDRILDLQGNSPLDKFSLKMVDDHDPVDPDCVAPWIHKVLVRGVSDLHLVIDMNEWTSLPAKIFLTETLVKLTLKIRDGPPIDVKHVHLPKLKTLHLESVMFDEEDIGFSKLLSGCPELEELVLHHIWSCVWTSCSVSVATLKRLTFCCNNMKFCGMHEENPNNVSFDTPNLVYLEYAEVIANNYPKVNFDSLVEAKIDIWMTNDQLDEVRIRDIYEKNVMVGNATDLIVGIRNVRVLCLSADTLEVLTYCCKQIPIFNNLTHVTIQSTPKVGWKSLLKLLKNSPKLQTLVFQGLLHRDTKEEGVAIIKIEKQIEKVKHFLETMPHLEQLVLHYDSSIDGDMKQLLMLSSLASPKCKFYQTLVVELIPNTKINVNSEKPFPYLFLRDFITKNVLKRMQTGVCVCVCKPWEGTPICLSSSPVKILKVLKFGEVCSYKDDMDRQTEVIKYFLETMPNL

SEQ ID NO: 46833 - protein, 341 aa, Bacillus anthracis str. A2012
MNKKIGGLDMLKTTESKENEITKEQARWMYEKMLEIRKFEDKVHELFAQGVLPGFVHLYAGEEAVAVGVCAHLTDSDSITSTHRGHGHCIAKGCDLNGMMAELFGKATGLCKGKGGSMHIADLDKGMLGANGIVGGGFPLACGSALTAKYKGTKDVSVCFFGDGANNEGTFHEGVNLAAIWKLPVIFIAENNGYGEATTFEYASSCDSIADRAKAYNIPGVQVDGKDLLAVYKAAEEAVERARNGDGPTIIECMTYRNYGHFEGEAQTYKTSEEKEEHLNEKDAIVNFRKHLIHEALLTESELVDMEKAVDEAVQKSIEFSENSPYPEDEELLKDVYVSYK

SEQ ID NO: 46834 - protein, 211 aa, Oryza sativa (indica cultivar-group)
MEMRVPAAVTGGCGCDVDGGGGGFCRGGGKLADWEEGKDEIKSVVVKGWTMAQVVPVHGNVSAEDDDEEDDDEDDDNEDDEEEAEAEAAPPPYVMAVDDSSVDRAVITALLRRSKYRVTAVDSGKRALEILGSEPNVSMIITDYWMPEMTGYDLLKKIKESSELKQIPVVIMSSENVPTRISRCLEEGAEDFLLKPVRPADISRITSRMLQ

SEQ ID NO: 46835 - protein, 219 aa, Lupinus albus
MAEENQNKSYETTSEVEIKDCGVFDFFGNKKEEEKPQEVNVHGEPVYKVEEKKEEGHGEEKKQSLLEKIHRSNSSSSSSSDEEEIGEDGEKKKKKKEKKGLKEKIKEKITHDDDKEEKKHEDTTVPVEKIEVDPEHQKGFLEKIKDKLPGQHKKTDEVAVPPASSTVYGDAHTETDAAVAHEGEAKEKKGLLEKIKEKIPGYHPKSGEEKEKEKESGAY

SEQ ID NO: 46836 - protein, 485 aa, Oceanospirillum sp. MED92
MPIQLKDSGLLKTNAYINGQWVAGEAGETFPVINPATGEELAQVASVTAVQTKEAINAAEKAMKAWRALPAKERSDLLERWYGLILDNQEDLAQLMTAEQGKPLFESRGEVMYGASFLKWFAEEGKRVYGDVLPATQDRRSIVIKQPVGVVAAITPWNFPNAMITRKVAPALAVGCAMVLKPAAETPLSALALAELGERAGLPAGLFSVLTTADAVAVGGEMTSNPVVKKVTFTGSTGVGKLLMKQCADTVKRTSMELGGNAPVIIFDDADLDKAVAGALVSKYRNSGQTCICANRIMVQAGIYDAFVEKFSAAVAEFRIGDGLEEATTHGPVITEKAVGDIHSKVTAAVESGATVVQGGQPSELGSYFYEPTVLTNVTRDMSLFKEEIFGPVAPIFKFETEEEAIDMANDTEFGLASYVYTNDLGRIWRVSEGIEYGMVGVNETMISSEVIPFGGVKESGQGREGSKYGLDDYLETKYICMGGL

SEQ ID NO: 46837 - protein, 450 aa, Oceanospirillum sp. MED92
MSTIIYPTTNLKATETLTLERGDGAYVYDNQGKQYFEALAGLWCTSLGYNNRELIDTVNQQMGQLSYSHMFGGKTHQVGMDLSEKLSAMVPVENAKVFFGNSGSDANDTHIKMLRYYFNAIGKPEKYKIIARDRAYHGVTVAAASLTGLVPNHTHFDLPFEALGILRTDAPHYYRGALPGETEEQFVDRITNNLEQMILAEGADTIAAFIAEPITGASGVIVPPKGYYEKVQAILNKYDILFWADEVITGFGRTGNDFGSRTMGIENPAMMTLAKQLSSAYMPISASVIRGDMYEAMIEPSAQVGVFGHGYTYSGHPVACAVALKTLEIYERDNIFGHAAEMGDYMQKRLREFADHPLVGEIRGEGMIAAIEMVANKATGKAFEGGAVGGFAMQACQNHGMITRAVAGSSLAFCPPLIINKDQVDEMIEKLSKGLDDTLDFVTREGLLEA

SEQ ID NO: 46838 - protein, 301 aa, Triticum aestivum
MEAALNMSLDDMIKNRSGRGRGRGRGQRVGRGRGDGQRSGRGDGQRLGRGLGRGRGAGTFRGRGVPYQRPLGVNTRSSSYAIAKSFNKTKDFAWTHDRFGDSMVAAGLPGIETGTKLYVSNLHYGVTKEDLQELFSEMGHLKNCIVHYDNNRHPTGSAEVIFTRRSEAVQALKRYNNVRLDGKEMRREMIGANLGLAAAPAPRVNVVSGARGRGQREVVMSHPNGFGRGATDSSSFLPGWKRNNGFAQRGGSVLGRGRGRGRSSFGRGRGRGVYVRKGSVKSADQLDKELDTYHSGAMNVD

SEQ ID NO: 46839 - protein, 489 aa, Mycobacterium avium subsp. paratuberculosis K-10
MALLADGVSELFIDGKMSAGNAGTFPTVNPATEEVLGVAANADAADMDRAIDAARRTFDETDWSRNTELRVRCVRQLRDAMREHIEELRDITIAEVGAPRMLTSAAQLEGPVGDLSFAADTAESYEWNQDLGQASPMGIPTRRTIAREAVGVVGAITPWNFPHQINLAKLGPALAAGNTVVLKPAPDTPWCAAVLGQLIAEHTDFPPGVVNIVTSDDHGVGALLSKDPRVDMVSFTGSTATGRSVMSDAAATIKRVFLELGGKSAFVVLDDADLGGACSMSAFTAAMHAGQGCAITTRLLVPRDRYDEAVAAAAGTMGSIKPGDPNDPGTVCGPVISARQRDRVQSYLDLAIAEGGTFACGGGRPADKDVGFFIEPTVIAGLTNDARPAREEIFGPVLTVIAYDGEEDALRIANDSPYGLSGTVFSADPERAANFASRMRVGTVNVNGGVWYSADAPFGGYKQSGNGREMGLAGFEEYLEIKTIATAVQ

SEQ ID NO: 46840 - protein, 359 aa, Zea mays
  misc_feature (253)..(254): Xaa can be any naturally occurring amino acid
MSSDGRLRRALAAFGGDVWDLVDAALAAAARDSPGDLRARRDGIVQRLYAGAARCRNCDADATPAPAQPRKANDAVAAAAAASPAAAASAFPASPEQEVDADGLDDVDDAADAGMESKILAIRDFLEDPDQSEDDIVSLLQNLADMDITYKALQDTDIGRHVNGLRKHPSSEVRQLVKLLVRKWKEIVDDWVRLHNSCGDGSGSIISMAMVTHLTKFQSKYHQNTHASDFKYPPSPQRHNVLSSERSSNHNLXXSTMEKRRTSPAPAYNNTKQNNSNNYSSISSSAPARAIREQKNTLLDSEKLDSARKRLQENYQEAQNAKKQRTIQVMDIHDIPKPKNRNTFVRKSGSSAGFPAKHR

SEQ ID NO: 46841 - protein, 444 aa, Glycine max
MGRAIRWLKGLFGIRTDRERKENSNHSDRDSRGLCHNPTTIPPNISPAEAAWLQSFYSETEKEQNKHAIAVAAATAAAADAPAAAAQAAVAVVRLTSHGNSRDTTFGGAGQERLAVVKIQTVFRGYLARKALRALKGLVKLQALVRGYLVRKQAAATLHSMQALIRAQATVRSKKSHGLSSTKNEAHRFQTQARRSMQRFDDIKSVYIAPIQSRRLSSSFDATMNNANSVDGSPKIVEVDTGSGRPKSRSRRSNTSMSDFGDDPSSFQALPSPLPFAHLSIPNLRNYHNSEWGLTGEECRFSTAQSTPRFTTNSCSCGGSVVVAAPTNMSMSMTPKSVCTENNFFYGQYHDNFPNYMASTQSFKAKLRSHSAPKQRPDPAGPKKRLTLNEMMESRCSLSGTRMQRSCSQIQEAISFKNAVMSKLQKSAELGRDTELNFSNQRRW

SEQ ID NO: 46842 - protein, 192 aa, Zea mays
  misc_feature (72)..(72): Xaa can be any naturally occurring amino acid
ALQKPEFALGPPDFGIVLLPNSKVLFSPKVYFPLPSFSGFPDGTKTFVGAQNGELRIFSPRGDTLSKKALLXKPRGAFPSLPFSPKGFMFGFAEAPKETFLWGRARKKIQLKNLLFPPARINSLGWSPAHRLVAPGSLGPWAIVFEINKPVARWVPIKGGPLGGGPGLTLLEKKTLVAPREEACLCVLKGVE

SEQ ID NO: 46843 - protein, 280 aa, Phaseolus vulgaris
GEGTYGVVYKARDRVTNEAIALKKIRLEQEDEGVPSTAIREISLLKEMQHRNIVRLQDVVHSGKRLYLVFEYLDLDLKKHMDSSPEFAKDLRQVKMFLYQILCGIAYCHSHRVLHRDLKPQNLLIDRSTNSLKLADFGLARAFGIPVRTFTHEVVTLWYRAPEILLGSPRYSTPVDIWSVGCIFAEMVNQRPLFPGDSEIDELFKIFRILGTPNEDTWPGVTSLPDFKSAFPKWQPKDLKTVVPNLDPAGLDLLSRMLHLDPSKRITGRSALEHEYSERH

SEQ ID NO: 46844 - protein, 891 aa, Glycine max
  misc_feature (22)..(22): Xaa can be any naturally occurring amino acid
MNRYYVCVPLFVCLVLAIELVXAEDFQPTDKILLNCGGPPSSTDTDGREWTTDNGSKFGSSTAKSATSPAATQDPAVPQVPYMTARVFHAPYTYTFPVASGWKFLRLHFYSASYSSLNASDALFAVAANSYTVLRNFSVAQTTLALNYAYIMREFAIHVEGESLNVTFTPSTNASNAYAFVNGIEIVSMPEIYTSTDGTLMMVGSNSPFPIDNSTALECVYRLNVGGNDISPSHDTGMFRSWSDDMPFLYGAAFGVTEPADPDVKFEYPPGTPSYIAPLDVYSTARTMGPNPEINTNYNLSWIFNIDSGFSYLVRLHFAEVSSNITKINQRVFDIFLNNQTAMPEADVIAWAKEFDLSHSNGVPVHKDYVVFVPNGEPRQDLWLALHPDKTEKPMYYDAILNGVEIFKINDTAGNLAGTNPIPPPVQDIIDPSMARASHHGKSKNHTGIIAGVAGGVVLVLVIGLFAFAASRRRRQGKDSGTSEGPSGWLPLSLYGNSHSAASAKTNTTGSYASSLPSNLCRHFSFAEIKAATNNFDEALLLGVGGFGKVYKGEIDGGTTKVAIKRGNPLSEQGVHEFQTEIEMLSKLRHRHLVSLIGYCEENTEMILVYDCMAYGTLREHLYKTQKPPRPWKQRLEICIGAARGLHYLHTGAKHTIIHRDVKTTNILLDENWVAKVSDFGLSKTGPTLDNTHVSTVVKGSFGYLDPEYFRRQQLTDKSDVYSFGVVLFEVLCARPALNPTLAKEQVSLAEWAAHCYKKGILDSIIDPYLKGKIASECFKKFAETAMKCVADQGIDRPSMGDVLWNLEFALQLQESAEESGNGFGDIHCEVEPLYTDSKGKDSNPGYDGNATDSRSSGISMSIGGRSLASEDSDGLTPSAVFSQIMNPKGR

SEQ ID NO: 46845 - protein, 220 aa, Bacillus cereus ATCC 10987
MNLKQLAGEYAATFVKDGMKIGLGTGSTVYWTIEKLGERVKEGLSFQAVPTSKETEVLAQQLNIPLISLNDIQSLDLTIDGADEIDSNLHLIKGGGGALLREKIVASSSKELLIIADESKLVTHLGTFPLPVEIIPFSWKQTESKIQSLGCQTTLRLKNNETFITDNNNMIIDCVFPHNITNPANLHNHLKMITGVVETGLFVNMTSKAIIGTKNGIQEL

SEQ ID NO: 46846 - protein, 609 aa, Rickettsia sibirica 246
MTSIRNIAIIAHVDHGKTTLVDHMLKQSGTFRANQAVAERAMDSNDLERERGITILAKCTALMWNDIRINIVDTPGHADFGGEVERILSMVDGVVLLVDASEGPMPQTKFVLSKALNLGLKPIVVINKIDRDDQRIKEVIDEVFELFVALEANNDQLDFPIVYASGRAGRASLTFDDKINPLDNLADDLAPLFDLIVQHVPKPLADDKAPFSMLVTTREYNSFFGRVLTGRVQSGTVKINQNVKVLNRENKVLETGRITKILAFRGLERIAINDATAGDIIAVAGVENANVADTICSPEVTEAVPSLPIDPPTLSMTFSVNDSPLAGSEGTKVTSSLIGARLMRELESNVALKVTEAAEKNAFQVAGRGELQLGILIETMRREGFELSISRPEVLFQTDEKGNKQEPMEEIQVDVDDDYVGVVVKSLALRKAEMTDMRPSGGGKSRVTFIGPSRGLIGYHSQFLTETRGTGIMNRIFHGYADYKGNIEGRRNGVLISNGDGAAVAYALWNLEERGKMFINPSDKVYRGMIIGEHNRDNDLEVNPLKAKQLSNVRATGKDEAIRLTPPMLLTLEQAISYIQDDERVEVTPKSIRLRKALLDPNDRKRAAK

SEQ ID NO: 46847 - protein, 320 aa, Bartonella quintana
IDGDKGILLYCGYPIDQLAEKGDFLESCYLLLYGELPTKQEKIDFDRCIMQHMMVHERFTRFFHGFRRDSHPMAVMVACLGAMSAFYHDSIDIKDAQQRMIAAIRLISKVPTLAAMAYKYSIGQAFVYPRNDLSYAANFLHMCFSVPCEEYKINPVLSRAMDRICTLHADHEQNASTSTVRLVGSSGANPFACIAAGVACLWGPAHGGANEACLKMLQKIGSVERIPEFIARAKDKNDPFRLMGFGHRVYKNYDPRAKIMQQTCHEVLKELNIQDDPLLDIAIALENTALNDEYFIEKKLYPNVDFYSGITLKALGFPTE

SEQ ID NO: 46848 - protein, 326 aa, Rickettsia sibirica 246
MQITVREALRDAMQEEMIRDDKVFVIGEEVAEYQGAYKVTQGLLEQFGPKRVIDTPITEYGFAGLAVGAAFAGLRPIVEFMTFNFAMQAFDHIVNSAAKTHYMSGGQVKCPIVFRGPNGAASRVAAQHSQNYTACYSHIPGLKVVAPYSAEDHKGLMLTAIRDDNPVVFLENEILYGHSFDVPKTIEPIPFGQAKILREGSSVTIVTFSIQVKLALDAVNVVQNDNIDCEVIDLRTIKPLDTETIIESVKKTNRLVVVEEGWFFAGVGASIASIVMKEAFDYLDAPIEIVSGKDLPLPYAVNLETLALPSESDVIEAVKKVCYYSI

SEQ ID NO: 46849 - protein, 326 aa, Rickettsia sibirica 246
MDIKLGKYKPTKEEYIKSFKDMLLLRRFEEKCGQLYGMGEIGGFCHLYIGQEAVISAVDMVKQKGDSTITSYRDHAHIILAGTEPKYVLAELMGRATGCSKGKGGSMHLFNVPNKFYGGHGIVGAQVPIGTGLAFAEKYNDTHNICFTFLGDGAVNQGQVYEAFNMAALWGLPVVYIIENNEYSMGTSVARSTFMRDLYKKGASFGIKGFQLDGMDFEEMYDGSKQAAEYVRENSFPLILEVKTYRYRGHSMSDPAKYRSKEEVEQYKERDPLVIIRKTILDNKYVTEADLKAIEQSVKEIVKEAVEFSENSPLPDEGELYTQVYC

SEQ ID NO: 46850 - protein, 149 aa, Oryza sativa
  misc_feature (83)..(83): Xaa can be any naturally occurring amino acid
MASEKEAALAAVPNDNPTIFDKIIKKEIPSTVVFDDEKVLAFRDINPQAPTHIVIIPKVKDGLTGLSKAEERHVEILGYLLYXAKVVAKQEGLEDGYRIVINDGPSGCQSVYHIHVHLLGGRQMNWPPGLTSARLLNCLHGKDVTLPLR

SEQ ID NO: 46851 - protein, 319 aa, Bartonella sp.
ITYIDGDKGVLLYRGYPIDQLAEKGDFLESCYLLLYGELPTKQEKNDFDRCIMQHTMVHEQFARFFHGFRRDSHPMAVMVACLGAMSAFYHDSIDITDPQQRMIASVRLISKVPTLAAMAYKYSIGQAFVYPRNDLSYAANFLRMCFSVPCEEYKTNPVLTRAMDRIFILHADHEQNASTSTVRLAGSSGANPFACIAAGVACLWGPAHGGANEACLKMLQEIGDVKRIPEFIARAKDRNDPFRLMGFGHRVYKNYDPRAKIMQKTCHEVLKELNIQDDPLLDIAIELEKIALNDEYFVEKKLYPNVDFYSGITLKALG

SEQ ID NO: 46852 - protein, 315 aa, Bartonella sp.
DGDKGVLLYRGYPIDQLAEKGDFLESCYLLLYGELPTKQEKNDFDRCIMQHTMVHEQFARFFHGFRRDSHPMAVMVACLGAMSAFYHDSIDITDPQQRMIASVRLISKVPTLAAMAYKYSIGQAFVYPRNDLSYAANFLRMCFSVPCEEYKTNPVLTRAMDRIFILHADHEQNASTSTVRLAGSSGANPFACIAAGVACLWGPAHGGANEACLKMLQEIGSVKRIPEFIARAKDRNDPFRLMGFGHRVYKNYDPRAKIMQKTCHEVLKELNIQDDPLLDIAIELEKIALNDEYFVEKKLYPNVDFYSGITLKALG

SEQ ID NO: 46853 - protein, 500 aa, Bordetella parapertussis 12822
MDTPSDLLRKLGLDPAALAQGSLRARSPIDGALLARVPEHSVAQAHAAITRARQASQQWRDVPAPRRGELVRRFGDVLREHKEALGRLVSLEAGKILAEGAGEVQEMIDICDFAVGLSRQLYGLTIASERPGHRMMETWHPLGVVGVISAFNFPVAVWSWNAALALVCGNAVVWKPSEKTPLTALACQALLARALQDYGEAPAGLAEVLIGGRQLGEALVDSHDVALVSATGSTRMGRQVGPRVAQRFGRVLLELGGNNAIIVAPSADLEMATRGIVFGAIGTAGQRCTTTRRLIAHTDIADTLVARLKQAYASATVGDPLQPGTLVGPLIDRAAYDAMQAALTAAREQGGQVSGGERLLAERYPDAWYVRPAIVEMPGQTDVVCHETFAPILYVMRYGDFPAALAMHNGVPQGLSSAIFTNDLREAEAFLSSAGSDCGIANVNIGTSGAEIGGAFGGEKETGGGRESGSDAWKHYMRRATNTVNYSRALPLAQGIRFGE

SEQ ID NO: 46854 - protein, 132 aa, Zea mays
MPVPLAPYPAPPAPFTPPNGAQSQLVCTGCRNLLMYPAGATSVCCAVCSTVTAVPAPGTEMAQLVCGGCHTLLMYIRGATSVQCSCCHTVNLAMEGKSCDFDSCTKEEEEEKKSCFLYIVWSGKLSNLPIAF

SEQ ID NO: 46855 - protein, 517 aa, marine gamma proteobacterium HTCC2207
MSHIVIQDALFKAESVRKLDQLATEQLVASAGGPAEAATSNSQSIKLMKRAGRAAFNELLEAFGTASLITVFCGSGNNAGDGYIVATLAAEKSLAVRVVELSTPGKLSADAALARDYAVNAGVIFAPYNDAIDLSEGVVVDALLGIGATGPMREPYGAAIEMINQAALPVLAIDLPSGLYADSGAAAEVAISADVTVTFVAAKQGMFSGRGPALCGEVIYHSLEVDEDIFHQVAPSAQLMDLHELIENLPTRNSEAYKNQFGHSMVIGGDHGFGGAAMMAAEAALRTGSGLVSMATRPAHVAGALARQPEVMVSGIVSGQELEPLLDKPSILIVGPGLGRSPWSEQLLQKAVATGLPMVVDADALNIIAEGRVVSQPNGSGWVMTPHPAEAARLLNISVQDVQADRFSAVRQLQEKYNAVVLLKGAGTLIAAPGDEIIAVCPYGNPGMATGGMGDALSGIIGALLAQGLEPKLAAQLGCCLHSAAADMAVEDQGMHGLTATDVLAYLRKLLNGEFTG

SEQ ID NO: 46856 - protein, 250 aa, Desulfovibrio desulfuricans G20
MKKLMAANWKMYKTPQEAALTAGELVKAVGTVPDDREVLVFPPFVGLAQVAQAFSGVAGFYCGAQNVYPADEGAYTGEISPGMIVSTGAAWALTGHSERRSVLGESSAFVGQKTAFCLEKGLNVVLCIGETLEEREGGQLEKVLRGQLSEGLSGVPAGIAPERLAIAYEPVWAIGTGKVAGTAEIAATHAVVRGMLRELLPAAADSMRILYGGSVKPDNAAAIISLDNVDGVLVGGASLQAESFSRIILA

SEQ ID NO: 46857 - protein, 258 aa, Agrobacterium tumefaciens
MKYGSLLNKFRLDGKVALITGGTRGIGLATAYAFGEAGAKLYLSARREEYEDAGAILTAGYDVTFYPADLKTREAACALVKRVADDAGRLDILINNAGIANGGDTPLFTEQQWRDVIATNVETVFWCSQAAIPVMREGGRGAIVNVGSMSGIVSNIPQNQVAYNSSKAAVHMMTKSLASELALDNIRVNAVAPGYIDTDMSRGGMVHPVRGPIWLEMTPMKRFGRPDEIATAILFLASEASSYVTGDILVVDGGYTTR

SEQ ID NO: 46858 - protein, 444 aa, Xanthomonas campestris pv. vesicatoria str. 85-10
MSANTAASAPSPATATGGLGDHQASVSVPKGGHWWFRLLAFLGPGYMVSVGYMDPGNWATDLAGGSQFGYLLLSVILLSNLMAIVLQGLSARLGIATGLDLAQACRVRYPRGVNLALWGICELAIIACDLAEVIGTAIALKLLFGIPLTLGAIITAVDVVLVLLLMNRGFRALEAFVIALLLIIFVCFGIQIALAAPPVAAVLGGFIPRAQVVTDPQALYLAIGIIGATVMPHNLYLHSSIVQTRAYPRTDVGRKSALRWAVTDSTVALMFALFINASILILAAAVFHAQGRTDVQEIEQAHALLAPMLGVGLASTLFAVALLASGINSTVTATLAGQIVMEGFLQLRLPPWIRRLLTRGIAIVPVVIVTWLYGEAGTARLLVLSQVVLSMQLPFAVIPLVRFVSDRQLMGALVAPAWLVRIAWVIAAVIVCLNLKLLWDTALH

SEQ ID NO: 46859 - protein, 148 aa, Mesembryanthemum crystallinum
MEQTFIMIKPDGVQRGLVGEIISRFEKKGFSLKALKFINVDRPFAEKHYADLSAKPFFNGLVEYIVSGPVVAMVWEGKGVVLTGRKIIGATNPLASEPGTIRGDFAIDIGRNVIHGSDAVESATKEIALWFPEGVVNWQSSLHSWIYE

SEQ ID NO: 46860 - protein, 389 aa, Chlamydomonas reinhardtii
MAAMMMRQKVAGAIAGERRSAVAPKMGRAATAPVVVASANASAFKGAAVTARVKASTRAARVQSRRTAVLTQAKIGDSLAEFLVEATPDPKLRHVMMSMAEATRTIAHKVRTASCAGTACVNSFGDEQLAVDMVADKLLFEALKYSHVCKLACSEEVPEPVDMGGEGFCVAFDPLDGSSSSDTNFAVGTIFGVWPGDKLTNITGREQVAAGMGIYGPRTVFCIALKDAPGCHEFLLMDDGKWMHVKETTHIGEGKMFAPGNLRATFDNPAYERLINFYLGEKYTLRYTGGIVPDLFQIIVKEKGVFTNLTSPTTKAKLRILFEVAPLALLIEKAGGASSCDGKAVSALDIPILVCDQRTQICYGSIGEVRRFEEYMYGTSPRFSEKVVA

SEQ ID NO: 46861 - protein, 1135 aa, Nicotiana plumbaginifolia
MASGSRTKHSHQSGQGQGQVQAQSSGTSNVNYKDSISKAIAQYTADARLHAVFEQSGESGKSFDYSQSVKTTTQSVVPEQQITAYLTKIQRGGHIQPFGCMIAVDEASFGVIAYSENACEMLSLTPQSVPSLERPEILTVGTDVRTLFTPSSSVLLERAFGAREITLLNPIWIHSKNSGKPFYAILHRVDVGIVIDLEPAKTEDPALSIAGAVQSQKLAVRAISHLQSLPGGDVKILCDTVVESVRELTGYDRVMVYKFHEDEHGEVVAESKRPDLEPYIGLHYPATDIPQASRFLFKQNRVRMIVDCHATPVRVVQDESLMQPLCLVGSTLRAPHGCHAQYMANMGSIASLTLAVIINGNDEEAVGGRSSMRLWGLVVGHHTSARCIPFPLRYACEFLMQAFGLQLNMELQLASQLSEKHVLRTQTLLCDMLLRDSPTGIVTQSPSIMDLVKCDGAALYCQGKYYPLGVTPTEAQIKDIVEWLLTYHGDSTGLSTDSLADAGYPGAALLGDAVCGMAVAYITSKDFLFWFRSHTAKEIKWGGAKHHPEDKDDGQRMHPRSSFKAFLEVVKSRSLPWENAEMDAIHSLQLILRDSFKDAEASNSMAVVHAQLGEMELQGIDELSSVAREMVRLIETATAPIFAVDVDGRINGWNAKVAELTDLSVEEAMGKSLVHDLVHEESQETAENLLFNALRGEEDKNVEMKLRTFGSEQPKKAVFVVVNACSSKDYTNNIVGVCFVGQDVTGQKVVMDKFIHIQGDYKAIVHSPNPLIPPIFVSDENTCCSEWNTAMENLTGWSRGEIIGKMLVGETFGSCCRLKGPDAMTKFMIVLHNAIGGQDTDKFPFSFSDRNGKYVQALLTANKRVNMEGQIIGAFCFIQIASPELQQALRVQRQQDKKCYSQMKELAYLCQEIKSPLNGIRFTNSLLEATDLTEDQKQYLETSTACERQMSKIIRDVDLENIEDGSLTLDKEEFFLGSVIDAVVSQVMLLLRERSVQLIRDIPEEIKTLTVHGDQVRIQQVLADFLLNMVRYAPSPDGWVEIQLQPNMKQISDEVTVVHIEFRIVCPGEGLPPELVQDMFHSNRWVTKEGLGLSMCRKILKLMNGEIQYIRESERCYFLIILDLPMTGRGSKSVG

SEQ ID NO: 46862 - protein, 393 aa, Triticum aestivum
METVAAAGYAHGAATRSPACCAAMSFSQSYRPKAARPATSFYGESLRANTARTSFPAGRQSKAASRAALTTRCAIGDSLEEFLTKATPDKNLIRLLICMGEAMRTIAFKVRTASCGGTACVNSFGDEQLAVDMLADKLLFEALEYSHVCKYACSEEVPELQDMGGPVEGGFSVAFDPLDGSSIVDTNFTVGTIFGVWPGDKLTGVTGGDQVAAAMGIYGPRTTFVVALKDCPGTHEFLLLDEGKWQHVKDTTSIGEGKMFSPGNLRATFDNPDYDKLVNYYVKEKYTLRYTGGMVPDVNQIIVKEKGIFTNVTSPTAKAKLRLLFEVAPLGFLIEKAGGHSSDGKQSVLDKVISVLDERTQVAYGSKNEIIRFEETLYGSSRLAASATVGATA

SEQ ID NO: 46863 - protein, 792 aa, Xanthomonas campestris pv. vesicatoria str. 85-10
MNENILWLHELRLADLARVGGKNSSLGEMIGNLAGLGVSVPGGYATTAEAFKDFIAHNDLSKRIFDKLATLDVEDVNALTLAGKEIRGWVIDAPLQPELDRDIRTAYAQLCAENGGGDVAVAVRSSATAEDLPDASFAGQQETFLNVTGADDVVHKVKEVFASLYNDRAIAYRVHHGFKHEDVFLSAGVQLMVRSGVGAAGVLFTLDTESGFRDVVFVTSSFGLGEMVVQGAVNPDEFYVYKPTLTAGKPAILRRSLGSKAIRMVYSDVPGERVRTEDTPVELRNTFSISDEDVHELSKQALVIEKHYGRPMDIEWAKDGVSGKLFIVQARPETVKSRSHATQIERFALEAKDAKILAEGRAVGAKIGSGVARVVRSLDDMNRVQAGDVLIADMTDPDWEPVMKRASAIVTNRGGRTCHAAIIARELGVPAVVGSGNATAVIKDGQEVTVSCAEGDTGFIYEGKLAFERTTTDLGNMPPAPLKIMMNVANPERAFDFGQLPNAGIGLARLEMIIASHIGVHPNALLEYDKQDADVRKKIDAKIAGYGDPVSFYVNRLAEGIATLTASVAPNTVIVRLSDFKSNEYANLIGGSRYEPHEENPMIGFRGASRYVDPSFTKAFALECKAVLKVRNEMGLDNLWVMIPFVRTLEEGRKVIEVLEQNGLKQGENGLKIIMMCELPSNALLADEFLEIFDGFSIGSNDLTQLTLGLDRDSSIVAHLFDERNPAVKKLLSMAIKSARAKGKYVGICGQGPSDHPELAEWLMQEGIESVSLNPDTVVDTWLRLAKLKSEG

SEQ ID NO: 46864 - protein, 153 aa, Spinacia oleracea
AEFERTFIAIKPDGVQRGLISEIVARFERKGFSLVAIKVVIPSRPFAQKHYADLKDKPFYVGLVAYWSSGPVVAMVWEGEGVIKYGRKLIGATDPQKSEPGTIRGDLAVVNGRNIIHGSDGPETAKDEIKLWFKPEELVNYTHNAEKWIYGDN

SEQ ID NO: 46865 - protein, 556 aa, Arabidopsis thaliana
MADSKSGDTEVAHRSSDPSEKRGGWITLPFMLGMSITSFGWGMNLIVFLIEEFHIKNIAAAQISNVVNGVVNMLPVVAAILADSFFGNIPVISTSTFISLAGTSLLTLITSLNYLMPRPCETGSILCQSPSKLQLGILYVALALVIIGSAGTRFTLAAAGANQYKKPKEQGRFFNWFFLALYIGAITGTTAIVYTQDNASWKLGFGLCAVANLISFIVFIAGVRFYKHDKPLGSPYTSLIRVLVAATMKRKAVISSKDEDYHQYGLGKEAKTYTTMPSKSFRFLNRAALKNKEDLNTSGDSSNNMWRLCSVQEVEDFKAILRLVPLWAAVMFLSTPVAVQMSMTVLQALVMDRKLSPHFEVSAGSLQVIVLVFGCVFIMLNNWIIYPMYQKLIGKPLTPLQQVGIGHVFTILSMAISAVVEAKRLKTVENGGHPMSVLWLVPALVMVGIGEAFHFPANVAVFYGEFPESLKNTATSLTSVVIGISFYLSTAVIDVIQRTTSWLPNDINHGRVDNVYWVVVIGGVLNLGYFLVCSWFYKYRNLKDDDHEQDPKDVKT

SEQ ID NO: 46866 - protein, 554 aa, Ehrlichia chaffeensis str. Arkansas
MKIDFNTLFPSSTKEYISGTIYNNIKVGMRRIHINDNSESILTYDTGGPHTDQKIKIDINQGIEKIRLNWIVDRQDVEYHKRQEVNTNSEYAFPLQSNNILKANSNKPITQMYYARNNIITPEMEYVAIRENALRQKILSYKPTVMAPEITPEFVRQEIASGRAIIPANVNHPESEPMIIGKNFLVKINANIGNSVVSSSIEDELQKMIYAIIYGADTVMDLSTGNNIHNIREWIIRNSPVPIGTVPIYQALNKVNGVVGDLDFNIFKKTLIEQAEQGVDYFTIHAGVLKNYIDYTDNRLTGIVSRGGAIMAHWCTIHNKENFLYTNFEEICDIMKHYDITFSLGDGLRPGSIADANDTAQFLELKTLGELTDIAWKHDCQVMIEGPGHVPMHLIKENVEKQVHFCKEAPFYTLGPLTTDIAPGYDHITSAIGAAIIGWYGTSMLCYVTPKEHLGLPNIQDVKDGVIAYKIAAHAADLAKGNPSAYIRDYALSYARFNFKWYDQFNLSLDPETAKSLHDESLPSENAKSAHFCSMCGPKFCSMKLTHQIKSIEE

SEQ ID NO: 46867 - protein, 466 aa, Novosphingobium aromaticivorans DSM 12444
MAEYDYDVLFIGAGPGGYVGAIRTAQLGLKTACAEGRETLGGTCLNVGCIPSKALLHGSEKFDEARNGTFASYGIKTGAVELDLDAMQAQKADSVKSLTGGIEFLFKKNKVTWLKGYAAFEDAHTVTVAGQKVTAKNIVIATGSSVTPLPGVTVDNDAGVIVDSTGALALNRVPQHLVVIGGGVIGLELGSVWRRLGAKVTVVEFLDQLLPGMDGDVRKEAAKIFKKQGMELKLGTKVTGVAVNGGTATLTVEPSKGGEASTIEADCVLVAIGRRPNVDGLGLDKIGLELNARGQIETDHDFATKIPGVWAIGDVIPGPMLAHKAEDEGIAVAENIAGLTGIVNHDVIPGVVYTMPEFAGVGLTEEAAKERGEIKVGKFPMLANSRAKTNHEPDGFVKVISDAKTDRVLGVWCIASVAGTMIAQAAQAMEFGATSEDIAYTCHAHPTHSEALKEAAMAVTGKPIHM

SEQ ID NO: 46868 - protein, 408 aa, Novosphingobium aromaticivorans DSM 12444
MSIEVKVPTLGESVSEATVGQWLKKPGEAVALDEPIVSLETDKVAVEVPAPAAGVLGALVANEGDTVAVGALLALIEDGVAAAGAQAPAPRTEAPVPPASASEAPAAPAGDAAVLSPAVRRAVLEYGIDPSTVKGTGKDGRLTKEDVMAAAAAKQAAPAAAVSAQAATPAAAPAGGRNEERVKMTRLRQTIAKRLKSAQETAALLTTFNDVDMSAVMEARAKYKDVFEKKHGVKLGLMSFFAKASVLALKDIPSVNAQIQGDEIVYFDYVDISVAVSAPNGLVVPVVRDVDKMSFADIEKSIADYGKKARDGALTMADMAGGTFTISNGGVFGGLMSTPIINPPQSAVLGLHRIEDRPVVRNGEIVIRPMMYIALSYDHRIIDGREAVTALKTIKEAIEDPTRLLIDL

SEQ ID NO: 46869 - protein, 194 aa, Clostridium difficile 630
MSAVNKSQYPAEGIPEIALAGRSNVGKSSIINTLLNRRNFARTSQTPGKTRTINFYLINNEFYFVDLPGYGYAKIAKSEKEKWGGIMERYLESRQELCSIFLLVDIRHEPTADDKLMYEWIKHFGYNCVVIATKADKISRGQYQKHISIIRKKLQMESSEKVIPVSSLKKTGVEELWEEIVNQYNQHGYEITVD

SEQ ID NO: 46870 - protein, 351 aa, Oryza sativa (japonica cultivar-group)
MADESWRAPAIVQELAAAGVEEPPSRYLLREKDRSDVKLVAAELPEPLPVVDLSRLDGAEEATKLRVALQNWGFFLLTNHGVEASLMDSVMNLSREFFNQPIERKQKFSNLIDGKNFQIQGYGTDRVVTQDQILDWSDRLHLRVEPKEEQDLAFWPDHPESFRDVLNKYASGTKRIRDDIIQAMAKLLELDEDYFLDRLNEAPAFARFNYYPPCPRPDLVFGIRPHSDGTLLTILLVDKDVSGLQVQRDGKWSNVEATPHTLLINLGDTMEVMCNGIFRSPVHRVVTNAEKERISLAMLYSVNDEKDIEPAAGLLDENRPARYRKVSVEEFRAGIFGKFSRGERYIDSLRI

SEQ ID NO: 46871 - protein, 663 aa, Ehrlichia chaffeensis str. Arkansas
MDNEYNDMVNMANAIRVLSVDAIQKAASGHPGMPLGMADVATVLFAKFLKFNPKDPNWFDRDRFVLSNGHGSMLLYSILYFLGCLDIEEIKRFRQIHSLTPGHPEYGYTPGVDATTGPLGQGLACAVGMAIAEKILSEKFGSEIVNHTTYVMVGDGCLMEGISHEAASLAGHLQLNKLIVLFDDNNISIDGPISLSVSDDVKARFLSYQWDVFEIDGHDFGQIESSIKNAQKSEKPSLICCKTVIGKHLSSKENTCAAHSWPFSEEEVMLMKEKLNWQCNPFNIPEEILQLWKNVSSRSEDEYNMWLDRSAKYSKTFDDFVDMMKEGVPDSVFLGLKEFKKELYALNLSEATRRTSGRVLEVIAKHTSKLIGGSADLTNSNNTKPQLISIINRSNFNGSYLHYGIREHAMAGCMNGMALHGGMIPYGGTFLVFSDYCRPAIRLSALMKKQVIYVMTHDSIGVGEDGPTHQPIEHLSSLRSIPNLYVFRPADAIEVLECWEIALKLTSSPSVFILSRQNVGSVRSVSVDENLSNKGAYVIREYEKDLDVTIFATGSEVEIALKASDILKSKGLGTRVVSIPCWELFVQQDKKYIFNLLNNKSIKAAVEAASSFGWHRYIGENGIFVGLEDFGISAPYKDLYKHFGITAEGLVNKILDKLKINTN

SEQ ID NO: 46872 - protein, 587 aa, Zea mays
MAMIDEPLYPIAVLIDELKNEDIQLRLNSIRRLSTIARALGEERTRKELIPFLSENNDDEDEVLLAMAEELGVFIPYVGGVEHAHVLLPPLETLCTVEETCVRDKAVESLCRIGAQMKETDIVDWFIPVVKRLAAGEWFTARVSSCGLFHIAYPSALDQLKTELRTIYGQLCQDDMPMVRRAAASNLGKFAATVEQNHLKTEIMSIFDDLTQDDQDSVRLLAVEGCAALGKLLEPQDCVAHILPVIVNFSQDKSWRVRYMVANQLYELCEAVGPEPTRADLVPAYVRLLRDNEAEVRIAAAGKVTKFCRILNPQLSIQHILPCVKELSSDSSQHVRSALASVIMGMAPVLGKDATMEQLLPIFLSLLKDEFPDVRLNIISKLDQVNQVIGIDFLSQTLLPAIVELAEDRHWRVRLAIIEYIPLLASQLGVGFFDDKLGALCMQWLEDKVFSIRDAAANNLKRLAEEFGPEWAMQHIIPQVLEKINNPHYLYRMTILQAISLLAPVMGAEITCQKLLPVVINSSKDRVPNIKFNVAKVLQSLVPILDQSVVEKTVKPCLVELSEDPDVDVRYYANQALQACDQMMVSS

SEQ ID NO: 46873 - protein, 134 aa, Brassica napus
TGSTRAGLMVQQQVSARFGKCLLELSGNNAIIVMDDADIQLAVRSVLFAAVGTAGQRCTTCRRLILHENIYQTFLDQLVEVYKQVRIGDPLEKGTLLGPLHTPASKENFLKGIQTIKSQGGKILFGGSAIESEG

SEQ ID NO: 46874 - protein, 471 aa, Bacillus cereus E33L
MANLFKKKSVTQLLGESKSKTLTKTLGAFDLTMLGIGAIIGTGVLVLTGLVAARDAGPAVIFSFMIAAIVCGFAALCYAEVASTLPVSGSVYTYSYATIGEFIAHLMGWTLLSVYVVTTAAVAGGWTGYFNNLVSGFGLEIPTELLKIPSQGGIVNLPAVVITLVLTWLLSRGTKESKRVNNIMVLIKIGIVILFIAVGAFYVQPENWTPFAPYGISGIFAGGAAVFFAFLGFDALATSAEEVKNPQRDLPIGIIASLIICTIIYVVVCLVMTGMVSYKELDVPEAMAYVLEVVGQDKVAGVIAVGAVIGIMAVIFAYIYATTRVFFAMSRDGLLPKSFAKINKKTEAPVFSTWLTGIGSALIAGFIDLKELSNLANIGALLTFAMVGVSVIILRKTHPNLKRGFVVPLVPTLPIISIACCLFLMFNLPLTTWIYFGIWLAIGVVVYFVYSKKHSHLKDDGSSQDNLEQAN

SEQ ID NO: 46875 - protein, 294 aa, marine gamma proteobacterium HTCC2207
MTPAEQQFLTRNKLPESYLDSAEKWFSPLLEHYKTVGDRPLIIGINGSQGSGKSTLADYLCTLLSERYALRCVSLSLDDFYLTKLERQQLAATVHPLLATRGVPSTHDIPLAMETIAKLANGSADTLIPRFDKSRDDRMPEAQCERISGAVDIIVFEGWCVGAQPQTDEQLAESLNSLEAEQDADKIWRTTVNQALSGEYQELFDLLDELIMLQAPSFETVFNWRLEQEEKMRARLGDLASGEHLSGIMSASQISQFIAHYQRITEHSLGEMPQRADHLYKLDNQRQIVDCSHK

SEQ ID NO: 46876 - protein, 414 aa, Medicago truncatula
MDSSEKVVAVIMVGGPTKGTRFRPLSFNTPKPLFPLAGQPMVHHPISACKRIPNLAQIYLIGFHEEREFALYVSSISNELKLPVRYLKEDKPHGSAGGLYYFRDIIMEDSPSHIFLLNCDVCCSFPLPSMLDAHIKYGGMGTMLVIKVSAESANQFGELVADPETHELLHYTEKPETFVSDLINCGVYIFTPDIFAAIEDVSINREGRGNLRRLSSFEALQSATRTLPKDFVRLDQDILSPLAGKKKLYTYETNDFWEQIKTPGLSLKCSELYLAQFRYTSPHLLASGDGKKNAKIVGDVYIHPSAKVHPSAKIGPNVSISANVRVGAGVRLIGCIVLDDVEVKENAVVINSIVGWKSSLGRWSRVQADGDYSAKLGITILGEAVTVEDEVVVINSIVLPHKILNVSVQDEIIL

SEQ ID NO: 46877 - protein, 354 aa, Bipolaris oryzae
MAEFVRAQIFGTTFEITSRYTDLQLVGMGAFGLVCSAKDQLTNQAVAVKKIMKPFSTPVLSKRTYRELKLLKHLRHENIISLSDIFISPLEDIYFVTELLGTDLHRLLTSRPLEKQFIQYFLYQILRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITELLGTPPDDVIQTICSENTLRFVQSLPKRERQPLANKFKNAEPDAVDLLENMLVFDPRKRVRAEQALAHAYLAPYHDPTDEPVADEKFDWSFNDADLPVDTWKIMMYSEILDYHNVDAAVQEQENGS

SEQ ID NO: 46878 - protein, 455 aa, Methanothermobacter thermautotrophicus str. Delta H
MEMIIDGEGVSGEKIFTVRNPFNGDEVDRVPLAGRSDVERAIRAAHRARDAMADLSARKISEKLYDVADELKTELDEFARLITLESGKPIRFSRDEVKRSVETARLSAEEAGRLYGESIPMDAGIGGKGLTGFTVRIPLGVVAAITPFNYPLNLAIHKVGPALAAGNTTILKPSLEAPLSALKLAWILSEHFPAGAVNAVTGRGSEVGDVIIDSPLVDKITFTGSVEVGRYISARASMKKITLELGGNDPLIVMDDADIDSAVEAAVRGSYLYSGQVCIAVKRMIVHEDVADEFADKLVNITGSLRAGDPMDVRTDVGPLINEDAAIEVERVIGAAVEDGAELLCGGSRRGNFVEPTVLDHVVPGMEVIERETFGPVSPIIRFNGADEAIRIANGTCYALQAGVFTENIRTALRMAREIEAGTVLVNKQSTFRVDHMPFGDSGAVEWVRRVSSTP

SEQ ID NO: 46879 - protein, 512 aa, Catharanthus roseus
MALEKLVLFDFLAAISILILVQKFIQIVFLRSSSRIRLPPGPKGWPIIGALPYLGTMPHSILANMAKKYGPIMYLKLGTNGMVVASTPDAVKAFLRTLDMNFSNRPIDAGATHLAYNAQDMVFAHYGPKWKLLRKLSNLHMLGGKALENWSNVRATELGYMLQAMYESSRKGETVVVPEMLTYAMANMIGQVILSRRVFVTKSLESNEFKDMVVELMTTAGYFNIGDFIPSIAWMDLQGIERGMKRLHKKFDALLTKMLEEHKSSSHKRKEKPDFLDYVLANRDNSEGERLTTTNIKALLLNLFTAGTDTSSSVIEWAISEMLKNPTILKRAQEEMDQVIGRNRRLMESDIPKLPYLQAICKETFRKHPSTPLNLPRIAQKDCQVNGYYIPKGTRLSVNIWAIGRDPNVWENPLEFNPDRFLSGKMAKIEPRGNDFELIPFGAGRRICAGTRMGIVLVEYILGTLVHSFDWKLPFDDINELNMDESFGLALQKAVPLVAMVSPRLPINAYSP

SEQ ID NO: 46880 - protein, 513 aa, Synechococcus sp. RS9917
MHTSAPSRPYLEGKKLNKIEQNKAAKDGLLVGPELEYFARIGWEEVDETDLQLRLKWYGMFWRPKTPGLFMLRLRIPNGVLSAHQLRVVASIVERYGDNGSCDITTRQNLQLRGVLLSDLPDILKRLNHAGLSTIQSGFDNPRNVTGNPLAGIDPHEIVDTRPYTQALNDFLTSNAEGNSNYSNLPRKWNTAVAGSRDNFLLHNDIVFHPVEHNGELGFGVWIGGILSSQMNAYALPLNAWVKPDQLCAITDAVISIWRDNGERDKRPKGRFRLYLDQVGLETFRAMVEERFGPLTPDPGSTFEAAPRSHYGIHPQKQHGLHFAGLHVPVGRLTADDLHDLASASLEHGCGEVRFTEDQNVILPGIPTDQLGALEADPLLQRFPLAPGSIAAGTVSCTGSTYCGFALTNTKDQALQAARALDAELDLPEELKIHWTGCPNSCGQAYMGAIGLTGTKAKNANGAMGEGYTLTLGGSQGANPQIGSIAEKAIPAEQIQSVLRQVLIEHFGARPRH

SEQ ID NO: 46881 - protein, 110 aa, Arabidopsis thaliana
  misc_feature (83)..(83): Xaa can be any naturally occurring amino acid
MPSSMLSSATMVASPAQATMVAPFNGLKCYAAFPATLKANNDITSITSNGGRDNCIAVWPALGKKKFETLSYRSDLTDSELAXGVHYLIPNQGVSCVKFEVEHGFVYPEH

SEQ ID NO: 46882 - protein, 113 aa, Nocardia farcinica IFM 10152
MNTLDFVDEKSLRSDVPDFRPGDTLNVHVKVIEGSKERIQVFKGVVIRRQGGGIRETFTVRKVSFGVGVERTFPVHSPNIDHIDVVTRGDVRRAKLYYLRDLRGKAAKIKEKR

SEQ ID NO: 46883 - protein, 379 aa, Triticum aestivum
MLRLAAARSRALLLPRPAAAALPSSSSYSSYARGAPSPSSYAYRAASSAAAAEEAAAAAAGAATGAGAEAAAAAAPPPAARKGWVRGLLKFGVFTTLVGAIGGAGYATHAYSLSEIDKKTLEFRKEMTTPIPVAEDASELEKFRARAYETAMKVPVAAIELYLEIRARIEDHVVGFTEPASDKLLPDLHPDDQNIFTLVVDLTDTLVCNDWQRERGWKTFKRPGVEAFLQHMANMYEVVVYSDQLQMYVDPVVERLDSTGQIRKLSRPATKYQDGKHYRDLSKLNRNPAQVLYVSAHALESCLQPENCVTVKPWKLETDDTELLDLIPFLEYLAIARPSDIRAVLASYQGHDVAKEFRKRSKELERHKQQKQRTSIWRR

SEQ ID NO: 46884 - protein, 65 aa, Brassica napus
MLIKRIELCIEIVKKTMDFAVVVAEAAKVFLRNAPQAPPALLRQGPYYYSASTPRPSPYMIGYLP

SEQ ID NO: 46885 - protein, 978 aa, Bacillus cereus E33L
MAEQTVRVTVDGKEFSASGEKTILQLFNESNLEHPQICHVPEVDPIQTCDTCIVEVDGKLMRACSTQIENGMHIERQSQRAKEAQTEAMDRILENHLLYCTVCDNNNGNCKVHNTVHMMGIEEQKYPYEPKVSACEVDMSHPFYRYDPNQCIACGQCVEVCQNLQVNETISIDWSLDRPRVIWDHGVSINDSSCVSCGQCVTVCPCNALMEKSMLGEAGFMTGLKPDVLDPMIDFVKDVEPGYSSILAVSEVEAAMRKTKVNKTKTVCTFCGVGCSFEVWTKDRHILKVQPVSDAPVNGISTCVKGKFGWDFVNSEDRITKPLIRQGDMFVEASWEEALEVVASNMQHIKSEYGSDAFGFISSSKVTNEENYLMQKLARQIYGTNNVDNCSRYCQSPATDGLFKTVGMGGDAGTVKDIAEAGLVIIVGANPTEGHPVLATRVKRAHKLHEQKLIVADLRKHEMAERADLFIHPRQGTDYVWLAGITKYIIDQDWHDKKFIAENVKNFDEYSKMVEKYTLDYTEEITGISKENLKEMARMVYEADGTCVLWGMGVTQNTGGSTTSAAISNLLLVTGNYRRPGAGAYPLRGHNNVQGACDMATLPNWLPGYQAVSDDTLRAKFEKAYGTTIPKAPGLNNIAMLLAAEEGKLRGMYVMGEEMALVDSNANHVQHILANLDFLVVQDMFLSKTARFADVILPAAPSLEKEGTFTNTERRIQRLYEVLKPLGDSKPDWWILQKVARALGGDWNYESPSEIMDEIASLAPIYSQATYDRLEGWNSLCWGSHDGSDTPLLYVDGFNFPDKLARLSLDEWIPPVVAPDEYDLLLNNGRMLEHFHEGNMTNKSAGILSKVSEVFVEISPELAIERNVKDGGLVELASPFGKIKVQALITDRVTGKELYLPMHATINEEAINILTGTATDLYTCTPAYKQTMVKMRVLREKGNRPLPSSNPRDKNRNPQNGVEIEQKWQRKQYVSLVD

SEQ ID NO: 46886 - protein, 410 aa, Bordetella parapertussis 12822
MEQQHTIVIIGAGQAGGWAARTLRAEGYAGRVLLCGDETAPPYERPPLSKEQLAAQAPALPSLMDAAQLAELHIDWLGGAAATRIDRAGRRVLLGDGQALRYDALILCTGGRPRLPPLPGADLPCVHTLRTIDDAARLRAAFDGTPRVAVLGGGWIGLEVAAAARQRGGAVVLLEAADRLCARSGPGLLSETLARLHAGQGVDLRLNARVQRIDAHGRGCRLALADGQGIEADIVVAGVGLVRNDELARQAGLACDHGVIVDGACRTSDPDIYAAGDVAVMARPDGKLAGLESWQNAQDQGIAAARAALGQAVRYAPLPFFWSQQYDTLVQMAGASEPGAALVLRQGGPAQLLCVEMRADGRAAAVLGVNAAREFRQLRKYIAEGARLDARRLADPRSPLAGAVLGEAAA

SEQ ID NO: 46887 - protein, 264 aa, Archaeoglobus fulgidus DSM 4304
MMPEIEILEEKDFKIKFILKNASPALANSFRRAMKAEVPAMAVDYVDIYLNSSYFYDEVIAHRLAMLPIKTYLDRFNMQSECSCGGEGCPNCQISFRLNVEGPKVVYSGDFISDDPDVVFAIDNIPVLELFEGQQLMLEAVARLGTGREHAKFQPVSVCVYKIIPEIVVNENCNGCGDCIEACPRNVFEKDGDKVRVKNVMACSMCGECVEVCEMNAISVNETNNFLFTVEGTGALPVREVMKKALEILRSKAEEMNKIIEEIQ

SEQ ID NO: 46888 - protein, 107 aa, Triticum aestivum
MAKLMCLCFIILTIAVAVSADECEGDRQTMIKECAKYQKWPANPKLDPSDACCAVWQKANIPCLCVGVTKEKEKIWCMEKVAYVANFCKTPFPHGYKCGSYTFPPLA

SEQ ID NO: 46889 - protein, 306 aa, Arabidopsis thaliana
MGNLDDNKFTWVIKNVPTLNSDMLFSNYFVIGGCSWRVVAHSKENNFKESLSLTLIVAEDSAQKMGCGWSRYAKIIFTLVNQISEILSQRIETMFDQKSSVFSSETMFSIGKFDEHFAGFIVNGEIKIVVEFLEIIDKLVLSKESNPPFKKTKLNNDGEVSKDLIREVPVIMESIVVNGFHVLPSQVEFVKRIFEKHPDVAKEFRPTNRIVKTAYMNVLLSLIETLRQSPREISKNDLDGACGLLRSMKEAGFKLDWLEKKLNEVLEKKEKEESYETRMREIEEEMKDLKAKALDVGAPLRLDDVV

SEQ ID NO: 46890 - protein, 399 aa, Bacillus cereus E33L
MLENQINERSLLLHKELVGKIEITSKVEVNSADDLSLTYTPGVAESCKAIAADEETVYDYTARGNMVAVVSDGTAVLGLGNIGPKAAMPVMEGKSILFKKFANVDAFPLCLGTTDVDEIVSLVKNLEPTFAGINLEDIAAPRCFEIEKRLKEETNIPVFHDDQHGTAIVVLAAVINALKVVSKQMDHVKIVINGAGSAGIAIGKLLLKAGAQHITLVSLEGIVCEGEAWMNEAQIEVSKKTNREHVRGTLKEAIHQADIFIGVSAPNVLTKELVQMMNEKAIVFAMANPIPEIFPEDALEAGAAVVGTGRSDYANQVNNVLAFPGIFRGALDVRATDITEEMKLAAAYGIANIITDEERNANYVIPNPLDKRVVPSVAEAVAKAAIDSGVAQIMKIPSY

SEQ ID NO: 46891 - protein, 393 aa, Saccharomyces cerevisiae
MLQRHSLKLGKFSIRTLATGAPLDASKLKITRNPNPSKPRPNEELVFGQTFTDHMLTIPWSAKEGWGTPHIKPYGNLSLDPSACVFHYAFELFEGLKAYRTPQNTITMFRPDKNMARMNKSAARICLPTFESEELIKLTGKLIEQDKHLVPQGNGYSLYIRPTMIGTSKGLGVGTPSEALLYVITSPVGPYYKTGFKAVRLEATDYATRAWPGGVGDKKLGANYAPCILPQLQAAKRGYQQNLWLFGPEKNITEVGTMNVFFVFLNKVTGKKELVTAPLDGTILEGVTRDSVLTLARDKLDPQEWDINERYYTITEVATRAKQGELLEAFGSGTAAVVSPIKEIGWNNEDIHVPLLPGEQCGALTKQVAQWIADIQYGRVNYGNWSKTVADLN

SEQ ID NO: 46892 - protein, 100 aa, Zea mays
  misc_feature (51)..(51): Xaa can be any naturally occurring amino acid
  misc_feature (64)..(64): Xaa can be any naturally occurring amino acid
  misc_feature (77)..(77): Xaa can be any naturally occurring amino acid
GEHAIRRYESGQEPPAAGELCEAICPSNAITIEAPQREDRSRHTTRDDIDXTKCIYWGFCQEAXTIPCIFRAEPNFXCATETHEELLYDKNKLFQNGDPM

SEQ ID NO: 46893 - protein, 437 aa, uncultured crenarchaeote 4B7
MTNTQEIYKKKTKNSAKLFTKSKKVHINGVHHNIRFFEPYPFITKSADGKFLKDVDSNKYVDYWMGHWSLILGHAQKQIQKKASGQLKKGWMHGTSNENAISLSEKISKAVPVAEKIRYASTGTEATMYSVRLARAVTGKKIIAKIDGGWHGYTTDLLKTVNWPFDVSESQGLTDEEHIISLPLNNLQESLKILNSIKNDLAGVLVEPILGGGGAIPATQEYLKGIQEMVKTNNALFMLDEIVTGFRFRYGCIYSKMKLDPDIVTLGKIIGGGFPIGVICGKDEIMEHANTSLNSKKNRTYIGGGTFSANPLTMIAGDTTLDVLKNKTNTLYKKLNGLGDNTSKMLKKIFSDDVIVTGKGSLFMTHFPRDEMTEINNAADAAKCDSTKLFNYHFEMITKNGIFFLPGKLGAFSDAHSTVDVKDMKKATEDFVSNFKK

SEQ ID NO: 46894 - protein, 421 aa, Brucella suis 1330
MPVEVVLPALSAGMEDAVIARWLKAEGDAVSKGDLIAEVETDKATMELEAEVDGRIGQLLVKDGARANVNQVIALLLKEGEDASAMAGFAVGSSPVAVAEAETPVAASPVPAAPAVSAPASGEVRHKASPLARRLAAELGVSLDGLAGSGARGRIVRIDVERAAASKPVPVAAAAAPVAAPAEASSKAIPVGIGEYEAVPHTSMRRTIARRLLEAKITVPHFYLNVDCEIDALLALRSQINEKREGSARISVNDFVIKASAAALRRVPDANVIWTDEALLKLKDVDIAVAVATEGGLITPIIRSADQMSLGAISAQMKSLAARARENRLKPEEFQGGGFSISNLGMYGVKSFSAIINPPQSAILAVGAGERRPIERNGELAFATMMSVTLSVDHRAVDGALGAQLLAAFKAGIEDPMSLLV

SEQ ID NO: 46895 - protein, 325 aa, Desulfovibrio desulfuricans G20
MANESATIPVTCIEGYDTMDEETGAFLAAAAGSGVPLARQDIADIRNDYEQRLRTGIEQAPAMAAVEEHAVPVFRGSIPLRIYRPVADSCLPVILFLHGGGFVKGSIDSHEAMCRELALRSGLAVAAAGYRLAPEHRYPVAQDDCICALHWLGAHAAEAGVNGGRMVVAGDSAGGQLAAALAVYARDAGLEALRGQILFYPCVDMASSGASHNQCATGFGLTEESVRWYYNAYLPQGMACDDPAVSPLYTENLQGVAPAAVFNAVYDPVRSDGELFVQRLRAAGVSARLALYPTVHGFVSTYTRFHAGRRALAAAGAFAAEVTAG

SEQ ID NO: 46896 - protein, 127 aa, Brassica napus
  misc_feature (84)..(84): Xaa can be any naturally occurring amino acid
RTIYKGTLSTGAEIAVVSIAAGSRANWSTDMEIQLLQKIRKLAKVDHKNFLNVIGYCHENEPFHRMLVFEYAPNGSLSEHLHSXHTEHLDWPTRLRIFMGIAYCLEHMHNLNPPILHTNLDSSCIYL

SEQ ID NO: 46897 - protein, 555 aa, Nocardia farcinica IFM 10152
MTTATTTTATRALPSYDSGPSPTPLLGDTIGANLDRTAAAHPDREAVVDIPSGRRWTYRELVAAVDALAAGLDARGIRKGDRVGIWAPNCAEWFLTQYATAKIGAILVNINPAYRTSELAYVLRQAGVRMLIAAREFKTSDYVAMIDEVRGECPGLEQVLILGDDQWQQVTSTTPDPVRLAELGAELTMDDPINIQYTSGTTGFPKGATLSHHNILNNGFFVGELCGYTEQDRICVPVPFYHCFGMVMGNLAATSHGAAIVIPAPSFDPAATLAAVAAEKCTSLYGVPTMFIAVLAELDTELEKSGAAPDLSTLRTGIMAGSPCPVEVMKRVIDRLGMSEVCICYGMTETSPVSTQTRRDDDIDRRTATVGRVGPHLEVKIVDPATGRTVPRGEPGELCTRGYSVMLGYWDEPEKTAEAIDAARWMHTGDIGVMDEDGYVAVTGRIKDMVIRGGENIYPREIEEFLYTHPDILDAQVIGVPDERYGEELMAWIRMREGAEPLDAAAVREFCTGKLAHFKIPRYVHVVEEFPMTVTGKVRKAEMRELAREMLQSGT

SEQ ID NO: 46898 - protein, 562 aa, Geobacillus kaustophilus HTA426
MENIRSFMSFPESRKVYIEGSRPDVRVPMREIALSPTKTPQGMVENKPVRVYDTTGPYTDPDFEPDVEKGLPPLRRRWIVERGDVEEMERSSVAIQRSLPFVRRPLRAKPGKTVTQMHYAKRGIITPEMEFVAIREQIDPEIVRQEVAAGRAIIPANINHPESEPMIIGRRFHVKINANIGNSAVSSSIEDEVEKLLWAVRWGADTVMDLSTGKHIHETREYIIRNSPVPVGTVPIYQALEKVGGVPEKLTWDVYRETLIEQAEQGVDYMTIHAGVRLHYIPLTANRTTGIVSRGGSIIAQWCLAHHEENFLYTHFEEICEILKQYDVAISLGDGLRPGSIADANDEAQFAELKTLGELTKIAWKHDVQVMIEGPGHIPMHKIRENVEREQEICHGAPFYTLGPLVTDIAPGYDHITSAIGAAIIGAYGTAMLCYVTPKEHLGLPNKEDVRAGVVAYKIAAHAADLAKGHPAAQQRDDALSKARFEFRWNDQFNLSLDPERAREYHDETLPAEAAKTAHFCSMCGPKFCSMNISHELQRKIKEEGMKEKAQQFIRQGSSLYQ

SEQ ID NO: 46899 - protein, 403 aa, Aspergillus oryzae
MPPSYLLYTYGTKPLYPNRKLWLDVFNVAVKDLKQQKFVIDAEPSETVGQVKEKISKEKGWEVPQLKLIYSGKILQDDKAIESYNIEEKGFIVCMVSKPKASSSTATPSQAPSTPSRAATSTPAAPPAPAPSTNASATAPPATPSPAAATQPSDAAFNDPSALLSGSQGEAVISHMESMGFPRDDINRAMRAAFFNPTRAIEYLLNGIPENIQQEQEQQQQQQQAATATAASPQPPAASAGGNAPATTGGEEPVNLFEAAAQAGTQEGPHGARSGSAAGEGLPNLDFLRNNPHFQQLRQLVQQQPQMLEPILQQVAAGNPQIAQLIGQNEEQFLQLLSEEGDGALPPGTHQIHVTEEERDAIERLCRLGFSRDMVIEAYFACDKNEELAANFLFENTDDPEDQ

SEQ ID NO: 46900 - protein, 394 aa, Geobacillus kaustophilus HTA426
MGLNTFSDIVQTMPPYLFSRFQKKKEELLKLGVDVIDLGIGAPDLPPPSFVIEELKEALDAPEHYTYSPYGGCREYREAVARFYEREYGVKLDPETEVLALIGSKEGIVHLLQAVLNPGELALVPDPGYPVYRTAVHFARGQSLSLPLDAQHGYIPRFDALPSSVYDQAKIMFLNYPSNPTAAAVDLDVFAEAVSLARQHQMFIAHDAAYSFVTFAGFQAPSILQVDGAKEVAVEFGSLSKSYNMAGCRIGYVVGNRDMIRALSVIKSNTDTCQFIPIQKAAVAALTNGRTFIRENSRIYEQRMNMMVERLRELGIDVQRPKATFFLWIPVYDGYSSERFAAKLLEEAGVIVTPGTAFGSAGEGYVRVSLSAPMERLQQAVERWKQVDWEESAR

SEQ ID NO: 46901 - protein, 306 aa, Glycine max
  misc_feature (225)..(225): Xaa can be any naturally occurring amino acid
GSRFSLGQKKGWCFTCEFEYLIQKAKEGISPLSPIGILSKIHKIGSHLGRGKEEDAHEFLRCVVDTMQSICLKEVGVSSPLAEETTLVSYTFGGYLRSKIKCLRCLGKSERYERMMDLTVEIDGDIGTLEEALGQFTAPEILDKDNKYNCSRCKTYVKARKKLTVLEAPNILTIVLKRFQSGNFEKLNKSVQFPEVLNMAPYMSGTKDKSPLYSLYAVVVHLDWXIMNAAFSGHYVCYVKNIQGEWFRTDDSRVEPVELSRVLSERAYMLLYARHSPKPLGLVSSNVISSAGKFKRREPGSHSCYF

SEQ ID NO: 46902 - protein, 713 aa, Clostridium difficile 630
MEKKILTVCPYCGAGCQLYLVVKDNKILRAEPANGRTNQESLCLKGRYGWDFLNDPKILTPRLKKPMIRKQGVLEEVEWDEAINYTASRLNEIKEKYGPDSIMGTGSARGPGNEANYIMQKFMRATIGTNNVDHCARVHAPSVAGLAYSLGSGAMSNSIPEIENADVLFIFGYNGADSHPIVANRIVKAKKNGAKLIVTDPRVTESARIADIHLPIKGGTNMVLVNAFGNVLIEEGLYNKEFVQNHTQGFDEYKEIVKPYTAKYAEKITGIPEELIRKAMREYAKGKKAMILYGMGVCQFGQAVDVVKGLASIALLTGNFGRESVGIGPVRGQNNVQGACDMGALPNVYPGYQNVTDDKIREKFEKAWGVKLSPNNGYSLTQVPNLVLKEKKLKAYYIFGEDPVQSDPDASEVREALDELEFVIVQDIFMNKTALHADVILPATSWGEHEGVYTCADRGFQLMRKAIEPQGDVKPDWQIISEISTAMGYPMNYKNTKEIWDELRQLCPSFLGATYEKIETQGCVQWPCKSESMEDKGTMYLYEGQKFSTPNGKGNLFAAEWRPPMEVEDDEYPFSLCTVREVGHYSVRTMTGNCRTLSSLEDEPGRVQINSNDAEKLGIEDDELVRISSRRGSVITRATVTDRVKEGATYMTYQWWVGACNELTIANLDPISKTPEYKYCAVKLEKLEDQELAEKCVREEYQSLKDKMTATNI

SEQ ID NO: 46903 - protein, 316 aa, Myxococcus xanthus DK 1622
MNLDPSTQKFVSDLAASNSPPLYTLTPEQAREVLLEAQSIPVPMPDADVEERKLPVGPRGSVRTLLFRPKGSKERLPVLMFVHGAGWVMGDARTHERLVRELVKGANVAAVFVDYGRSPENKFPVAIEEAYAATKYVAEHPDEFNVDARRMALVGDSVGGNMATVVSMLAKERGGPSIRFQVLFYPVTDANFDNGSYQEFAEGPWLTRKAMKWFWDAYLPEAGKRVDPHVSPLRASLDQLNGLPPALVITDENDVLRDEGEAYAAKLSEAGVNVTQVRFLGTHHDFVMLNALAQTPAARGAIALTTTKLREWLHAN

SEQ ID NO: 46904 - protein, 493 aa, Geobacillus kaustophilus HTA426
MKIQNYINGEWKEPSTGQFAPVINPATGETIAEVAMSGPNDIDEAVQAAKEAQKQWALVPAPKRAEILYKVGMLLKERKEQLARMLTMEMGKVIEEARGEVQEGIDMAFYMAGEGRRLFGDTTPSELKDKFAMSVRVPVGVVGIITPWNFPIAIATWKSFPAIVAGNAVVWKPAPETPIMAQELARIFEEAGLPPGVFHVVHGDGPTVGNALVEHPDVKVISFTGSNEVGRMIAEKCGRLLKKVSLEMGGKNAVIVMDDADLTLAVDGIIWSAFGTSGQRCTACSRVIVHERVKQELERRLLEAVKTLKIGNGLDETVKVGPVIHEEALQKIDRYVRIGVEEGAKLLVGGYILREGDYARGFYYAPTIFTDVTPNMRIAREEIFGPVVSIISVRSLDEAIAVNNSVDYGLSSAIFTRDVNNVFRAMRDLDTGIVYVNAGTTGAEIHLPFGGTKGTGNGHRDSGVAALDVFTEWRSIYVDFSGKLQRAQIDTDD

SEQ ID NO: 46905 - protein, 377 aa, Rhizobium leguminosarum bv. viciae 3841
MTTQRIRDFLATRRPDGPCLVVDLDVVRDNFDAFRHAMPDSAIYYAVKANPAPEVLKLLAGLGSNFDCASVAEIEMALEAGATAARISYGNTIKKERDVARAHALGVSLFAVDSHEEVEKISRAAPGARVFCRVLTDGEGAEWPLSRKFGCVPQMAVDVLVYAHQLGLQSYGVSFHVGSQMTKVDAWDSALADAKRVFVSLAKQGIHLQMVNMGGGFPTKYLRDVPSAEAYGKSIYQALRTHFGNQIPQTIIEPGRGMVGNAGVIKAEVVLISKKSDNDDARWVFLDIGKFGGLAETMDEAIRYPIRTEHDGDEMEPCVIAGPTCDSADVLYEKNLYPLPISLSIGDEVLIEGTGAYTTTYSAVAFNGFDPLKAYII

SEQ ID NO: 46906 - protein, 379 aa, Streptococcus agalactiae 2603V/R
MNNTEFYDRLGVSKDASQDEIKKAYRRMSKKYHPDINKETGAEEKYKEVQEAYETLSDTQKRAAYDQYGAAGANGGFGGFDGGGFGGFDGGGFGGFEDIFSSFFGGGGMRNPNAPRQGDDLQYRVNLSFEEAIFGAEKEVSYNRESSCHTCSGSGAKPGTSPVTCQKCHGSGVINVDTQTPLGTMRRQVTCDVCQGSGQEIKEKCPTCHGTGHEKKTHKVSVKIPAGVETGQQIRLTGQGEAGFNGGPYGDLFVIINVLPSQQFERNGSTIYYTLNISFVQAALGDTIDIPTVHGAVEMSIPAGTQTGKTFRLRGKGAPKLRGGGQGDQHVTVNIVTPTKLNDAQKEALHAFAEASGDKMVHPKKKGFFDKVKDALDVD

SEQ ID NO: 46907 - protein, 339 aa, Hypocrea jecorina
MAPIKVGINGFGRIGRIVFRNAVEHPEIEVVAVNDPFIETSYAAYMLKYDSSHGLFKGDVTVDGKDLVVNGKKVRFYTERDPANIKWSETGAEYIVESTGVFTTTEKAKAHLAGGAKKVIISAPSADAPMYVMGVNEKDYDGSADVISNASCTTNCLAPLAKVIHDNYGIVEGLMTTVHSYTATQKTVDGPSAKDWRGGRGAAQNIIPSSTGAAKAVGKVIPSLNGKLTGMSIRVPTANVSVVDLTVRLEKGASYDEITETIKKAADGPLKGILAYTNDAVVSTDMLGNTNSSIFDIEAGISLNPNFVKLISWYDNEWGYSRRVLDLLAHVAKVDASKK

SEQ ID NO: 46908 - protein, 207 aa, Azospirillum brasilense
MDQSLANGVGGASIERNTTETRIRVAVNLDGTGVYDVKTGVGFLDHMLEQLSRHSLMDLSVAAEGDVHIDAHHTTEHSGIAIGQAVAKAVGDRKGIQRYGHAYVPMDETLTRVALDFSNRPYLIWKVSFSRDKIGDMDTELFREWFQAFAMAAGVTLHVECLYGENNHHIVESCYKALARALRAGIEIDPRKRDAVPSTKGTLGGSL

SEQ ID NO: 46909 - protein, 414 aa, Archaeoglobus fulgidus DSM 4304
MTIDDVLSLLEKAESEDLNPRTGRLFAYVYETGDENIRKVAEKALVRFAEKNLLDFTVFRSAVFFEKEVVGFARNLMHGDAAVGSFTFGGTESIMLAVKAARDYYRKKEGTAEVPEILAPISIHPAFLKAADYLGLKVVRLPVKDAKGDVDAFAEAVSGKTALIALSAPNWPFGTIDPVEEIAEIAAERNVLLHVDACLGGFILPFFEMLGEKIPKFDFRVEGVTSISLDAHKYGYAPKGASVVLFRDAELKKCSMFVDVTSPGYVFVNQAVLSSRPEGPLAAAFAVIKYLGVEGYKELASKILSARDKIYRGLKSLGFESVGEVESSVLAMTNPDVDLMGFVNNMKKLGWQLHLQKGLKEYDIPDNIHLTLSPVHDGVAEKFVEDAAKALEMEPELTLSRFTQWLKGGSLPKS

SEQ ID NO: 46910 - protein, 419 aa, Ralstonia eutropha JMP134
MTAFFHRQDGALMAEQVPLAQIAAEFGTPAYVYSRAALTAAYQGYAAACKGRKAQVQYAMKANSNLAVLQVFAKLGAGFDIVSGGELKRVLAAGGDPRKVVFSGVGKNAAEMELALAHDVRCFNVESIPELDRLNAVAGQIGKRARVSLRINPDVDAKTHPYISTGLKGNKFGIAFEDVLPTYRAAAALPNIEVTGIDCHIGSQITEVAPYLEALDKVLDVVEALEREGIVLEHIDVGGGLGITYTDETPPDITGFATTLLDRVAARGHAHREVLFEPGRSLVGNAGVLLTQVEFLKPGAAKNFCIVDAAMNDLARPAMYEAYHRIEPVKANGGSQVVYDIVGPVCESGDWLGRDRALAVQPGDLLAVMSAGAYGFVMSSNYNTRPRAAEVMVDGGKVHLVRERELVEDLFRDERLLQD

SEQ ID NO: 46911 - protein, 221 aa, Oryza sativa
MATASDGSGSGGEQRRLLSIPKEGERIIAPTRRPDGTLRKAIRIRAGYVPQEEVAIYQSKGAQMRKSGPDVPPGYDPALDAKPKTKAAKRNERRKEKRRQQASTTNDKGKGLHIEDDAGETDNPKDAVDSVTKQISGIAISESLVVATSSTDATDNSKSESSAPDIDKKIRALKKKIRLAEAQVQGDPENLKPEQLEKMKKIEGWKEELKLLENKSSPAAS

SEQ ID NO: 46912 - protein, 452 aa, Phytophthora parasitica
  misc_feature (405)..(405): Xaa can be any naturally occurring amino acid
MASPVQALLLDMDGVMAEVSQSYRQAIIDTARHFGVSVTHEDIDHTKLAGNANNDWQLTHRLVVDGLNGASSAPTLEAVTAQFEALYQGVGNTLGLCELETLLTPKGLLRELHRRQPKGMAVVTGRPRKDCAKFLTTHGIEDLFPVQIWLEDCPPKPSPEPILLALKALGVEACHAAMVGDTVDDIIAGRKAGAVAYGVLTPQTYAKSILEQTPAAIGKVLEQVGASVVLTPGLGELLDLVPAVPTASKAPTVNGKSGVREANISRVTKETSISVKLSLDGTGKSKVSSGIGFLDHMLTALAKHSRFDLELDCKGDTWIDDHHTTEDCALTLGEAFDVALGDRAGIARFGSACVPLDEALSRAIVDISSRAHSEINLQLVRPSVGELSSEMITHFFESFASAALXTLHVDVLRGRNDHHRAEASFKALAVALRTAVKHDATAGVPSTKGVLA

SEQ ID NO: 46913 - protein, 633 aa, Lactobacillus plantarum WCFS1
MCGFAGCLTDRTKADNAAYDQTIHEMTKMIVHRGPDDDGYFADDNITMGFRRLSIIDLAGGHQPLSYDNERYWMTFNGEIYNYVELREQLKQEGYEFKTSSDSEVILAMYAKYHADATKYLRGMFAFVIWDKQEKTLFAARDQFGIKPFYYAISGDDFYYASESKAIYKILKDKTFDKNALQDYMTFQFVPEPETLTKEIKMLAPGCSLTKKLGSAPRIDRYYHREFHPVERSEDEYAQKIKDALIDSVKIHMRSDVPVGSFLSGGIDSSIIVAIAKNFNPNLETISVGFEREGYSELDVAQETAEKLGVKNYSMTITPEAFMKAFPHFVWSMDDPLADPAAVPQYFLAKEAVKHVKVCLTGEGADELFGGYTIYHEPESLKPFRYTKPINGALKRIALMMPEGMRGRSFLLRGTTPLENRYVGNAFIFGEQEKQAFFKNYNQNHPFQSITQPLYDESVDYDPISRMQFIDMHTWLNGDLLHNADRTTMAHSLELRTPFVDREVYNLAAEIPADLRISHGTTKYILRKAVEDIVPAHVLHRKKLGFPVPIRFWLKDEMYDWAKQIINDSQTDQYFNKDYFLKLLDDHKAGVRDNSRKLWTVLTFMMWHRLYVESDHLMDSPEANAVAEKVEEF

SEQ ID NO: 46914 - protein, 273 aa, Thermoplasma volcanium GSS1
MKLIENWFSERYSDNLQLSFRVSDQLLSIKTDYQRIDLFDTYDFGKLLAIDGTVQLTERDEYIYHELITMIPYHMTKNPPQSALVIGGGDGGAARRLLDLGLNKIVNVEIDGQVVEVSKRFFPDLSSAFTDKRVNLIIDDGIKYVRKCNEKFDLVIIDSTDPEGPAEGLFSMEFYSDITKILSDGGVIVSQSGSPFYQPKALKLAYTGMRRLFKDVKVYTGFIPTYPSGFWSFTIASEDAMNPRKPAIKGKYFNEDVLDGVFKLPQFVKDLIT

SEQ ID NO: 46915 - protein, 385 aa, Geobacillus kaustophilus HTA426
MKVLVLGAGLMGKEAARDLVQSQDVEAVTLADVDLAKAEQTVRQLHSKKLAAVRVDASDKQQLSAFMKGHDVVVNALFYQFNETVAKTAIAAGVHSVDLGGHIGHITDRVLELHEQAQAAGVTIIPDLGVAPGMINILSGYGASQLDEVESILLYVGGIPVRPEPPLEYNHVFSLEGLLDHYTDPALIIRNGQKQEVPSLSEVEPIYFDRFGPLEAFHTSGGTSTLSRSFPNLKRLEYKTIRYRGHAEKCKLLVDLNLTRNDVEVEINGCRVKPRDVLLSVLKPLLDLKGKDDVVLLRVIVGGRKDGKETVLEYETVTFNDRENKVTAMARTTAYTISAVAQLIGRGVITKRGVYPPEQIVPGDVYMDEMKKRGVVINEKKTVRL

SEQ ID NO: 46916 - protein, 516 aa, Aspergillus oryzae
MTPQSASPVPSAVSSAAASQISYDPRDGEPSVTRALAGMNLSAANGDILPTPPPPAKTARPTMANRISRMFSNTGKTTSKEPDAHRDFSDSSTDSVKPSSNGSGRQSKPTSRPSSRAPSRQTSTKEDNERKPKSSSGKDQKDSSAAAHKRFEALPDHAHCHHLKSTRRQEKLTDLLRDMLGGGRKKDDHVDDQQLSLMSTWIDQFKNERDKLAADKKGGPNATASLVDKYGKCQEIVGRGAFGIVRISHKVDPKDSRVEQLYAVKEFRRRPQETTKKYQKRLTSEFCISSSLRHPNVIHTLDLLQDAKGDYCEVMEYCAGGDLYTLVLAAGKLEVAEADCFFKQLMRGVEYMHEMGVAHRDLKPENLLLTTHGALKITDFGNGECFRMAWEKEAHMTAGLCGSAPYIAPEEYIEREFDPRAVDLWATGVIYMAMRTGRHLWRVARKDEDEFYQRYLEGRKHEDGYAPIETLHRARCRNVIYSILDPNPSRRINASQVLKSEWVREIKLCKAGEEGF

SEQ ID NO: 46917 - protein, 544 aa, Oceanospirillum sp. MED92
MPANESVAWNDLQSHAYYMSQSHISTLFREETDRFSLYTFEQNKFLLDLSKQRITEETLALLIKLAEEKGLQQWIQKLFDGDHVNDSEDRPALHTALRTPADRILSINDKNIIDEVHSNLSRMEEIVERIHSGQWRGFTGHSIDTVVNIGVGGSDLGPFMACKALAENQADTAKSLKIHFVSSMDGSQLAELLSELNPARTLFVISSKSFTTIDTLANAQTAKEWLKKSSYAASEETLISRHFIGVSANPDKVCEWGIPKSNQLEFWDWTGGRYSMWSTIGLPIALKLGMSGFREFLNGAHEMDEHFRNAAFSENLPVLLAMAGIWNINFLNINAHAILPYDGRLSHIPAYLEQLEMESNGKSVDRQGNNVDYKTCPILWGEVGTNAQHAFYQLLHQGTEAVMCDFIVAARRYHDTNNPELQHQHQLNLANCLAQSRILALGDSVLEGAESAPAFKRYKGNQPCTTIMLDELNPFSFGQLIALYEHKVFVQSVIWDINPFDQWGVELGKKVATSLLDALGTERKQPDFDSSTNGLINRITERGE

SEQ ID NO: 46918 - protein, 232 aa, Oryza sativa (japonica cultivar-group)
MDYWKTKVLPKIKVVFAKGGNAKKAAAAELIKSFDESKEGINGEFEEKKADLQPKVVEIYEAAPAPLKVLIKDRAKVSGIKKNSAAVTKFVDDLAKIEFPGAKQLSEGIAKVGPALLSGPVFATFEKVSTLLPADEEEIKPKEATAAAAEEEKKEEAAAAAAATDAAGEEKKEEAEEKKEEEAAAPADEPAAAAGESAPAAAEAEPPVEAAATPAAAEAAPAKAEEEEAPKA

SEQ ID NO: 46919 - protein, 458 aa, Myxococcus xanthus DK 1622
MSIHPAGASTAAPLPPLSPGAPLIGHLRALRKDPLHFLQAQAREYGDVVRLPMGPADLVLVAHPDGVRHVLQDHARNYSKQSRGFRVLQELLGHGLLTSDGDHWLRQRRLAQPAFHRQRVAGFTRTMVDAAADLAATMEARADTGAAFNVAEDFTRLTLRIASSTLFGADVSSATHDIATVMSRLQVFVYKRLTQPVPLSLRLPLPAHRQFERDVGSLNRVVHGIIAKRRRESGEHHDLLQMMMEAHDDDTGERMSDSQLRDEVLTLLLAGHETTASALAWTIMLLSQHPGVRRDMESELARELGGRNPTHEDLPRLELTHRVVDESLRLYPPAWALSRIATKEDLVGGFRIPKGAHLLIAPWVTHRHPSIWDNPEGFDPDRFLPEREQARPRFAWFPFGGGPRQCIGNQFALMELVLVLATLLQRVRLNLTPGQVIHPTPAITLRPRPGVWVTASRP

SEQ ID NO: 46920 - protein, 462 aa, Oryza sativa
MSRRTTTTTARWVPRQGQKGEPGGSGHAAAPVDRLSALPDTLLHHVMSFLKAWEVVRTCVLSRRWRDLWASAPCVDIRLRGSGRDGAPPEDFGRFVYRLLLAREVSAPVDTLRLRSSNGEEYAETYDNDDVNIWICSAIKRNVRVIHLNGHRKDELVLEHTAFVSHHLKILKLSHIKLDGKILKQLSSQCTSLEDLELNNCPVNGGEILSVSLKKLTMVKCSITMDLSICAPNLELLCCITPYYHVPLFENLSSLVAATIMLDDSFLRRDEFLYEVEEETSDDEDDNKTTSDHCDSKMDADSDAYDDDDNDDILYDEYLNSRHGNLVDDYNYGSDIDSDDDLHEYSQIAHECRGGRYGYCHDSKRRGSYYETCKLADSFSGKYLLRSLSSARSLELLAHSGEEAINIGFELKERSFACKNLEVVNIRCSKDDERVHMLAEIFVANGLPIEKIYVRRTGSTCE

SEQ ID NO: 46921 - protein, 420 aa, Aspergillus oryzae
MTGDPSSEPHQQKESSTRQRIGSTDQTSRADDDMEPRLKHGIPMQVFRSLLLATWFNCCCVVILVTQVLGAPLYLISKDYYYAYMAYTKQSFGLVITALTQWGCPTFVRVSGDKSVQGQIHLTEDGRLKTEFPERLVLIANHQVYTDWIYLWWVAYTNIMHGRIFIILKESLKYIPIVGQGMTFYGFIFMARKWLSDKPRLQHRLEKLKTRHSGSKSESSEYDPMWLLIFPEGTNLSINTKRRSDEYGQKQGFPPLKHEVLPRSTGLFFCLQHMRGTVDWVYDCTVAYEGPPKGSYPDKYFTLRSTYLQGRPPTSVNMYWRRFAVSDIPLNDQKEFDAWLRARWTEKDQLLDEYFETGRFPSDLAGFVDNVDVSESLKAAAAAGYVEVFVRLGHWSEIGRIFMVLIGAALLCKVPKLLGF

SEQ ID NO: 46922 - protein, 369 aa, Myxococcus xanthus DK 1622
MKSRAAVAFEAGKPLSIVELDVAPPQKGEVLVRITHTGVCHTDAFTLSGDDPEGLFPVVLGHEGAGVVEAVGEGVTSVKPGDHVIPLYTAECGQCLFCKSGKTNLCVAVRATQGKGVMPDGTTRFSYNGKPVYHYMGCSTFSEYTVVAEVSLARINPNANPEQVCLLGCGVTTGLGAVKNTARVQEGDSVAVFGLGGIGLAVIQGAQMAKAGRIIAIDTNPAKFELAKAFGATDFVNPKDHDRPIQQVIVEMTGWGVDHSFECIGNVGVMRAAIECSHRGWGQSIIIGVAGAGQEISTRPFQLVTGRTWKGTAFGGVKGRSELPGMVEDAMAGKIQLAPFVTHTRSLTDINEAFDLMHEGKSIRTVVRY

SEQ ID NO: 46923 - protein, 294 aa, Allium cepa
MDQYEKVEKIGEGTYGVVYKARDRLTNETIALKKIRLEQEDEGVPSTAIREISLLKEMQHANIVRLQDVVHSEKRIYLVFEYLDLDLKKHMDSCPDFAKDSRLAKTFLYQLLRGIAYCHSHRVLHRDLKPQNLLIDRRTNSLKLADFGLARAFGIPVRTFTHEVVTLWYRAPEILLGARQYSTPVDIWSVGCIFAEMVNQRPLFPGDSEIDELFKIFRIMGTPNEDTWPGVTSLPDFKSAFPKWPAKDLATIVPKLDSAGIDLLYKMLHLEPSKRITARKALEHEYFRDLGTIP

SEQ ID NO: 46924 - protein, 254 aa, Synechococcus sp. CC9311
MSLQPLLVFDFDGVILDGMDEYWSSSRAACRSLLQGVLLPEQTPTSFRHLRPWVHHGWEMVLIAALLQESDGPLQCLGVDAFAADYDQQLRAGLDRFGWQSSQLQDSLERVRRQAVSDDRAGWVALHRPFDGVTERLLRLEDEGVAWSVLTTKGRDFTAELLEAFQLRPIRLDGRESGPKPEVLLRLCREWVLKGFVEDRRATLEAVLETPGLEDMNCFLADWGYLRPADREGLPQGIDLLSTSKFASPLAIWL

SEQ ID NO: 46925 - protein, 228 aa, Ralstonia eutropha JMP134
MSLLHQARFFTTVNHLRDLPATAVPEVAFAGRSNAGKSTAINILCNQKRLAFSSRTPGRTQHINYFTVAPVKAPDPIAFLVDLPGYGYAEVSGSAKYHWQGLLSDYVQTRSQLSGLILMMDARRPFTDLDCQMVEWFLPTGKPVHVLLTKADKLTNSENAKALRETRKMLEGYAEQLATPVPLTAQLFSSLKRRGIEEAQRVIAGWLSLPEAQAAAPAEQPAAPGASE

SEQ ID NO: 46926 - protein, 125 aa, Brassica napus
ATTAPRPSSALSARTKASSSATMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 46927 - protein, 326 aa, Rhizobium leguminosarum bv. trifolii
MILCCGEALIDMLPRDTTLGEKGFAPYAGGAIFNTAIALGRLGIPTAFFTGIADDMMGEILLETLKASNVDYSPCAITPRPSTIAFVKLVNGQATYAFYDEGTAGRMITTADLPDLGDDCEALHFGAISLIPSPCGETYEALLDREAASRVISLDPNIRPGFIKDKPSHMARIKRMAAKSDIVKFSDEDLDWFGLQGDHDALAAHWLNHGAKLVVITKGAEGASGYTKDRKVTVPSERVTVVDTVGAGDTFDAGILASLKMDNLLTKRQVASLDEQALRNGPDPRRQSRRRHRLPRRRQSTLGARDWSLRLEQDSDPHPPDDTFSP

SEQ ID NO: 46928 - protein, 338 aa, Arabidopsis thaliana
MADKKIRIGINGFGRIGRLVARVVLQRDDVELVAVNDPFITTEYMTYMFKYDSVHGQWKHHELKVKDDKTLLFGEKPVTVFGIRNPEDIPWGEAGADFVVESTGVFTDKDKAAAHLKGGAKKVVISAPSKDAPMFVVGVNEHEYKSDLDIVSNASCTTNCLAPLAKVINDRFGIVEGLMTTVHSITATQKTVDGPSMKDWRGGRAASFNIIPSSTGAAKAVGKVLPSLNGKLTGMSFRVPTVDVSVVDLTVRLEKAATYDEIKKAIKEESEGKMKGILGYTEDDVVSTDFVGDNRSSIFDAKAGIALSDKFVKLVSWYDNEWGYSSRVVDLIVHMSKA

SEQ ID NO: 46929 - protein, 560 aa, Medicago truncatula
MVEDGVAVDILSTEDWLLHAKELVPIALDKAKEVKGFSTRWKMIISRLEQVPSMLSNLSSHPCFSKNALCKEQLQALSKSLEGTIESAELCVKEKYEGKLHMQSDLDALIGKMDLNLRDCGLLIKTGMLGEATLPLNASSVSGSATESDAAIHNNIRELLARLQIGHLEAKHKALDSVVEVMKEDEKNVLAVFSRSNIAALVQLLTATSTRIREKTVTVICSLAESGSCEDWLVSEGVLPPLIRLVESGSAVGKEKAAISLQRLSMSAETSREIVGHGGVCPLVELCRTGDSVSQAAAACTLKNISAVPEVRQVLAQEGIARVMINLLTCGMLLGSKEYAAECLQNLTASNESLKKSVISEGGVRSLLAYLDGPLPQESAVAALRNLVGSVSETALVSLGLLPRLVHVLKSGSPGAQNAAASAICRVSSSTEMKKLVGEAGCIPLLVKMLEAKQNSAREISAQALASLLTVSQNRRETKKDDKSVPNLVQLLDPSPQNNAKKYAVTCLGLISSSKKCKKLMISYGAIGYLKKLTEMDTPGAKRLHERLERGKLRSLFGKK

SEQ ID NO: 46930 - protein, 195 aa, Aminomonas aminovorus
MRNAEVSRNTLETKIAVAINLDGTGVSKLNSGVGFFDHMLDQIARHGMMDISVECQGDLHIDAHHTVEDVGIALGQAFSRALGDKKGIRRYAHAYVPLDEALSRVVLDISGRPGLEFNVEFTRARIGEFDVDLVREFFQGFVNHAALTLHVDNLRGKNAHHQAETIFKAFGRALRAAVELDPRMVGIMPSTKGSL

SEQ ID NO: 46931 - protein, 113 aa, Medicago truncatula
MNFRFQNLLGAPYRGGNAVISNNTLLLSPVGNRVSVTDLRKSQTTTLPIQSSSNISRIAVSPDGTFLLAIDENNRCLFINLRRRALLHRITFKHRVGAVKFSPDGKLIAVAAG

SEQ ID NO: 46932 - protein, 737 aa, Cryptococcus neoformans var. neoformans JEC21
MFCNMGQPIHDDGPSTSTHVGGNISNGHSTVQPGSLPPSILSSIIPVRPPGTLMYEDDQDWASVQEKLKEQGDVEGRMEVDGDIDGKGKGTSLVIGRPGAGGGKRMPVEREEVVRLVLQGLRDIGYHQSADVLEAESGYQLCAGAATDFQNAILGGRWSEALGLLPELGIPVSNSPAEAGPSSESSSVTSDKAGNGVMSGSSPGDQARFLISQQKYLEYLEVGQQKKALNVLRGELARVAKDQDVLHTLSGFMMCLDKEDLYERAGWDGSRGISRRQLLEHLQEFISPRLMVPSRRLATLFDQARQQQQSTALYLDHPEANSLYSDYRNKPDQFPSVTTHVLVDHTDEVWRIEWSPDGTRLASAGKDRIVVIWNVEPTTREDGSVRYNVTPSHHFSDHNDPIDSMAWSPDGKLLITGADKNVHIWDTEKGIQIPKQTPGWQHTDTISSIQWTSDGSEFLVTSMDCRIVFYNRAGKLLRQWSTFPLQFNDCCLVPDGSILIAITTPLKRVAHNDRLKQAMSGRPVDSNSSGLGSGAAGSGNVAAATAGGGLTLLGGPEFGFATMEHSIVMVRMSDHEIIDWSQDLRCEMTSIRLSSDGKRALVSCSPDEIQEWSIYPGLKYLRRHTGHIQGNFLIRSCFGAVKDQFVLSGSEDGHVYVWQGKATHPIEVLSGHSDVVNAVAWNPVSTRKIFASCSDDKTVRIWQPPTSAVDVPAESDLSEKVKAENGFTDSAGDGMVL

SEQ ID NO: 46933 - protein, 120 aa, Aspergillus oryzae
MADVEMKEASAGASAKGKGASKASEGASDGKKKFEVKKWNAVALWAWDIVVDNCAICRNHIMDLCIECQANQGSSTTEECTVAWGICNHAFHFHCISRWLKTRQVCPLDNRDWEFQKYGR

SEQ ID NO: 46934 - protein, 209 aa, Triticum aestivum
MGEQGTSGSEGGGSMVEAQAPAKKGDGRAADPRLQGISDAIRVVPHFPKPGIMFNDITALLLRPGVFKDAVDMFVERYRGMGIAAVAGIEARGFIFGPAIALAIGAKFIPLRKPGKLPGEVISETYTLEYGTDCLEMHVGAIEPRERVLIVDDLVATGGTLCAAINLLERAGADVVECACLIGLPKFKDFYKLNGKPVYVLVESLEYEK

SEQ ID NO: 46935 - protein, 349 aa, Cryptococcus neoformans var. neoformans JEC21
MVAKEMNALLYSEPRNFKITKVPVPEIGPEEILLKVDICGVCGTDQHIHEGEFIAKFPLVPGHEAVGRIVSMGDKVKGFDIGDRIAADVGETCGYCHYCRKGTDLFCENFAPAGVARDGGFADYIKYHFAKCYKIKNLTDEEATLLEPASCAIHGMDVLKMPFGARVLLIGAGPTGLILAQLMKMGGASHITIAANTGIKMEIARKVEAADEYIDLDRSNPGPQWAKLKEDNPYGFDVVAEATGVESLVNDAINYVTRGGTLLVYGVYEDKARLSGWSPTDIFVNEKRIIGSFSQTYCFPRAIDLLDSGKIKTTGMVTDVFPLSDYQGALDKMASRKALKIAIKPEHKD

SEQ ID NO: 46936 - protein, 204 aa, Paracoccidioides brasiliensis
MAQQQLQQLQTENVMRRKLVIIGDGACGKTSLLSVFTLGYFPTHYVPTVFENYVTDCRVDGRSVQLALWDTAGQEDYERLRPLAYSKAHVLLIAFAVDTPDSLENVRNKWIEEANERCPDVPIILVGLKKDLREDPLAIEEMRKKSLRFVSSKEGHDTAAQVGARKYLECSSLTGEGVDDVFEAATRAALLTFEKDRGSCCVIL

SEQ ID NO: 46937 - protein, 836 aa, Rhodococcus sp. RHA1
MSRKSAVVIGHGMVGHRFVEALRARDESDDWSVTVLCEEPLPAYDRVGLSSYVGAWDPKELALVGNDYPDDAHVDLRIGRRAATIDRESRKVTTDSGEVVAYDALVMATGSYPFVPPIPGHDRPECFVYRTLDDLDGIRKRADAAGPGAVGVVVGGGLLGLEAANALKLMGMTPHVVEFAPRLMPLQVDEGGGALLANLVTDLGLTVHTGVGTAGITEGPDGISVELSDGSVIEAALLVFSAGVRPQDQLARDAGLEVAERGGIITDLGCRTSDESIYAVGECAAVEGRCYGLVAPGYTTAEIVADRLLGGAAEFPGADLSTKLKLMGVDVASFGDAHAQTPGALEVVLSDAAKGTYAKLVVSDDAKTLLGGILVGDASAYASLRPLVGRELPGDPASLISPAGEKPGAGSLPDDAEVCSCNGVTKGSICGAIVDGACDIAQVKSCTNAGTTCGGCLPTIKQLLASSGVVMSKALCEHFEQSRAELFEIVQVTDTRTFSALISKYGKGSGCDICKPVVASILASTDSDHILHRNQAGLQDTNDHFLANIQKNGTYSVVPRMPGGECTPEQLIVIGEVARDFGLYTKVTGGQRIDLFGARVEQLPAIWKRLVDAGMESGQAYGKSLRTVKSCVGSTWCRYGVQDSVGMAVDLENRYRGLRSPHKIKFGVSGCARECAEARGKDVGVIATENGWNLYVGGNGGQSPKHAQLLAGGLDDETLVRYIDRYLMFYIRTADRLQRTAPWVESLEGGLDHLKAVVCEDSLGIAADLEAAMAKHVLGYKDEWAGVLEDPEKLSRFVSFVNAPEEADPTVSFDDTGVRKVPVLMGMPKFAASTSE

SEQ ID NO: 46938 - protein, 585 aa, Arabidopsis thaliana
MASQLDLIGGDYIAGISINPPTNSRVTSVYSEVQASRIDHTLPLPSVFKTPFKIIDGPPSSSAGHPEEIEKLFPNLFGQPSALLVPNQSNEVSSDQKLKIGVVLSGGQAPGGHNVICGIFGFKNLICDCIFVVGLIDYLQEYARGSSLFGFRGGPAGIMKGKYIELTSEFVYPYRNQGGFDMICSGRDKIETPEQFKQAEETVTKMDLDGLVVIGGDDSNTNACLLAEHFRAKNMKTLVIGCPKTIDGDLKSKEVPTSFGFDTACKIYSEMIGNVMIDARSTGKYYHFVRLMGRAASHITLECALQTHPNITIIGEEVFEKKLTLKNVTDNIVDVIYKRAENGYNYGVILVPEGLIDFIPEVQQLISELNEVLAEGNVDEEGQWKKNLKKETLEIFEFLPQTIQEQLMLERDPHGNVQVAKIETEKMLIQMVETELEKKKTEGTYEREFMGKSHFFGYEGRCGLPTNFDATYCYALGYGAGSLLQSGKTGLISSVGNLAAPVEEWTVGGTALTSLMDVERRHGKFKPVIKKAMVELEGAPFKKFASQREEWALKNRYISPGPIQFKGPGSDARNHTLMLELGAQA

SEQ ID NO: 46939 - protein, 371 aa, Ipomoea purpurea
MLSTITATVPSRVERLAGSGIQRIPKEYIRPEEERRSIRDIFEEEKIAGGPQVPTVDLKGINSEDLEVREKCREELRKAAVDWGVMHLVNHGIPEELTGRVKAAGEGFFGQPIEEKEKYANDQAAGNVQGYGSKLANNASGQLEWEDYFFHCIFPEDKTDLSIWPKNASDYIDATREYAKQLRALATKVLAVLSLGLGLEEGRLEKEVGGMEELLLQMKINYYPKCPQPELALGVEAHTDVSALTFILHNMVPGLQLFYGGKWVTAKCVPNSIIMHVGDTVEILSNGKYKSILHRGVVNREKVRVSWAVFCEPPKDKILLQPLPETVSEAEPPRFPPRTFARHIKHNLFRQSDQEAAHTPKPDNDDDHQSN

SEQ ID NO: 46940 - protein, 509 aa, Zea mays
MSTIAASRRSSSSSSSATAKRPAIADGPGGPKATAAQAKKRVALGNITNVAARGGRASVGGSLGNVMAPTSSAKLNPTVPLKKPSLATSARSVSSSIRGSADKPASIKPAPPVARHGSATQRHNNVPPPKVPTIADVPSRAPALVSCTGLVSPGRSGDSVSSDETMSTCDSMKSPDFEYVDNQDTSMLASLQRRTSEHLRISEDRDVEENKRKKNAVAPMEIDRICDVDSEYEDPQLCATLASDIYMHLREAETKKRPSTDFMETIQKDVNPSMRAILIDWLVEVAEEYRLVPDTLYLTVNYIDRYLSGNEISRQRLQLLGVACMLIAAKYEEICAPQVEEFCYITDNTYFRDEVLDMEASVLNYLKFEMTAPTAKCFLRRFARAAQACDEDPALHLEFLANYIAELSLLEYSLLSYPPSLIAASAIFLARFILQPTKYPWNSTLAHYTQYKPSKLSECVKALHRLCSVGSGSNLPAIREKYSQHKYKFVAKKQCPPQIPTEFFRDTTC

SEQ ID NO: 46941 - protein, 179 aa, Pectobacterium carotovorum subsp. carotovorum
MTDLTTHDLAQPGWQTRDHLNDPVVGELCNRFGPDAFTVQATRTGIPVVWVKREQLLDVVAFLKKQPKPYVMLFDLHGMDERLRTHREGLPAADYSVFYHIISIERNRDIMLKVALAENDLHLPTVTKLFPNANWYERETWEMFGMTFDGHPHLTRIMMPQTWEGHPLRKDYPARATEF

SEQ ID NO: 46942 - protein, 411 aa, Vitis vinifera
MNALAATNRNFRHASRILGLDSKLEKSLLIPFREIKVECTIPKDDGSLATYVGFRVQHDNARGPMKGGIRYHPEVDPDEVNALAQLMTWKTAVVDIPYGGAKGGIGCTPKDLSMSELERLTRVFTQKIHDLIGTHTDVPAPDMGTNAQTMAWILDEYSKFHGHSPAVVTGKPIALGGSLGREAATGRGVVFATEALLAQHGKSIKGLTFVIQGFGNVGSWVARLIGERGGKIIAVSDVTGAVKNQNGLDIVDLLRHKEETGCLTNFSGGDHMDPNELLTHECDVLIPCALGGVLNKENAADVKAKFIIEAANHPTDPEADEILSKKGGVILPDIYANAGGVTVSYFEWVQNIQGFMWEEEKVNNELQKYMTKAFHNIKAMCQSHNCSLRMGAFTLAVNRVACATTLRGWEA

SEQ ID NO: 46943 - protein, 457 aa, Agaricus bisporus
MVLPHEPEFEQALHELETSLQPFLTTNPQYKKALEIIQVPERVLQFRVTWEDDQGKPQVNRGFRVQYNSALGPYKGGLRLHPTVNLSILKFLGFEQTFKNALTGLSMGGGKGGSDFDPKGKSDNEIRRFCVAFMSELFRHIGQDTDVPAGDIGTGAREIGFLFGAYRRLKNEFTGMLTGKGINWGGSFIRPEATGYGLIYYVEHMIAHACPEYSLDRPSTLVAISGSGNVSQFTALKVIELGATVLSLSDSKGSLISEKGYTKEAIEKIAELKLKGGALEAIVDDLGAGYTYHAGKRPWTLLPQVHIALPGATQNEVSQEEAEALVKAGTRIVAEGSNMGCTEEAIAIFENSRRASRAGVWYAPGKASNCGGVAVSGLEMAQNSQRLAWSTQEVDAKLKSIMAECYQICYTAGSRWSGEKVAEGVAEGEALPSLLSGANLAGFIKVADAMKEQGDWW

SEQ ID NO: 46944 - protein, 418 aa, Neisseria meningitidis FAM18
MANKLRNYTINFGPQHPAAHGVLRMILELEGETIVRADPHIGLLHRGTEKLAETKTYLQALPYMDRLDYVSMMVNEQAYCLAVEKLAGIDVPIRAQYIRVMFAEVTRILNHLMGIGSHAFDIGAMTAILYAFRDREELMDLYEAVSGARMHAAYFRPGGVYRDLPDFMPKYESSKFRNAKVLKQLNESREGTMLDFIDAFCERFPKNIDTLETLLTDNRIWKQRTVGIGVVSPERAMQKGFTGVMLRGSGVEWDVRKTQPYEVYDKMDFDIPVGVNGDCYDRYLCRMEEMRQSVRIIKQCSEWLRVNPGPVITTNHKFAPPKRTEMKTGMEDLIHHFKLFTEGMHVPEGETYTAVEHPKGEFGVYIISDGANKPYRLKIRAPGFAHLQGMDEMAKGHMLADVVAIIGTQDIVFGEVDR

SEQ ID NO: 46945 - protein, 375 aa, Shewanella sp. MR-4
MRILETIMNKPPIIWLNVTLFSLTFLSAIILVPWYGLAHGYGASEWIAFVVLAFASGLSITAGYHRLWSHKAYKAHPAVRFLYALGGALALQNSALHWASDHRVHHKHVDDNDKDPYSANMGFWYSHIGWMLREYQAQRYHDYQNVRDLQNDRIVMWQHKHYLALVILMNIGLPALLGWFTGNIAGMLLMAGLLRLVVVHHCTFFINSLAHVWGSQPYTDKNTARDNGFLAMLTYGEGYHNFHHIFENDYRNGIKWWHYDPTKWLIKALSWVGLATDLRTSPQERIESARLQMQLLHAKNKVIHLPNADEIIEKIQQEYELMKEHLLEYYQAKKALLEAKRKQLVDQQLLLQVEELKTRFLTQQKSWKSLTASYS

SEQ ID NO: 46946 - protein, 492 aa, Arabidopsis thaliana
MWKQILSKLPKKSSSKNHSSSSSSTSKSSDNGASKSGNSQTQNAPPVKPSADSGFKEGNLKGNGNGFTPYEALPGFKDVPNAEKQNLFVRKLSLCCVVFDFSDPTKNVKEKDIKRQTLLELVDYVASPNGKFSETVIQEVVRMVSVNIFRTLNPQPRENKVIDALDLEEEEPSMDPTWPHLQLVYEILLRLIASPETDTKLAKKYIDQSFVSRLLDLFDSEDPRERDCLKTVLHRIYGKFMVHRPFIRKSINNIFYRFVFETEKHNGIAEFLEILGSIINGFALPLKDEHKVFLVRALVPLHKPKSLQMYHQQLSYCITQFVEKDCKLADTVIRGLLKSWPVTNSSKEVMFLNELEEVLEATQPPEFQRCMVPLFRQVARCLNSLHFQVAERALFLWNNDHIENLIMQNRKVILPIIFPALERNTQKHWNQAVHSLTLNVQKIFNDIDAELFKDCLAKFREDESKEAEIGAKREATWKRLEEIGNQKQKSSL

SEQ ID NO: 46947 - protein, 450 aa, Laccaria bicolor
MVLPVEPEYEQALSELPNSLKPFLAANPDYGKALEIVPIPERVLQFRVIWEDDQGKAQVNRGFRVQYNSALGPYKGGLRLHPSVNLSILKFLGFEQTFKNALTGLSMGGGKGGSDFDPKGKSDGEIRRFCTSFMSELFRHIGQDTDVPAGDIGTGAREIGYLFGAYKKLQNEFVGMLTGKGLAWGGSFIRPEATGYGLIYYVEHMIAKAAPEYSLSKPETLVAISGSGNVGQFTALKVIELGATVLSLSDSKGSLIAEKGYTKEFIKEIGQLKLKGGALESLAQREGYTYHAGKRPWSLLPVVHVALPGATQNEVSKTEAEDLIKAGVRIVAEGSNMGCTEDAIAVFEESRKAGAGGVWYAPGKASNCGGVAVSGLEMAQNSQRLAWTTDQVDQKLKKIMAECYEICLSAGTKWSGEEIKDGVLPSLLSGANVAGFIKVADAMREHGDWW

SEQ ID NO: 46948 - protein, 285 aa, Zea mays
  misc_feature (119)..(119): Xaa can be any naturally occurring amino acid
  misc_feature (205)..(205): Xaa can be any naturally occurring amino acid
  misc_feature (213)..(213): Xaa can be any naturally occurring amino acid
MASSSTCVLKKNYRCDRSLQQFYTGGPFAVGLAPGGDGEGGAEAEAFLACACRGEVRVVSSADASAIGEPVDGDSEAITALALSPDSRLLFAAGHSRLIRAWDLASRACIRSWKGHDGXPIMAMACHVSGGLLATAGADKKVCVWDVDGGFCTHFLRGHTGEEDGTVRVWNLETQKCVAVLKEHFSAVTSLALSDDGQTLLSAGXDKIVTAWXIRKYSSKKTIPTYEMIEAVSFIGSGSELLACLGIELANIKEKSAGYFLTVGERGVVRVWCLESCVCVFEQQT

SEQ ID NO: 46949 - protein, 175 aa, Oryza sativa (japonica cultivar-group)
MAPTVMASSATSVAPFQGLKSTAGLPVSRRSTNSGFGNVSNGGRIKFMQVWPIEGIKKFETLSYLPPLTVEDLLKQIEYLLRSKWVPCLEFSKVGFVYRENHRSPGYYDGRYWTMWKLPMFGCTDATQVLKELEEAKKAYPDAFIRIIGFDNVRQVQLISFIAYKPPGCEESGGN

SEQ ID NO: 46950 - protein, 548 aa, Desulfovibrio desulfuricans G20
MFLPLPTPQEMNRWDQAAVDEAGMPAEMLMENAAREAFRVLCGCFEKSSATGAHTAEDPAWCLAEKRILCFMGGGNNGGDTAALARLLCGAGATVLVVHTRPLEDFRQEAAWHIERALQAGVLFVQYDASCPAVIPAVLSTKELSNWNDDACPVPVMPDIVVDGLLGTGLRGEVSDSLLALIRHINALARTAFVFSLDIPSGMDGLTGLPSPECVCARCTVTFQAPKTGLLHPEAKEYTGRLHIRDIGIPPAIQNRYPTRLRRATCAVAALPPPPSAAMHKGTAGRVLVIGGSAGLCGAPLLAAAGALRAGAGLVTVAVPARLEACVRHGNPDIMTLPLACGDDWAAFDARMLEGLDERYDAVIVGNGMGRSAHAGEALAEILKTPRPPSVIDADALFHLRHPTQMLALMRETDILTPHPGEMAFLTGLTIEQVQADRLAALEMLTRRTAATCILKGAGTLVGSTQSFTAFIDAGGPSLAVGGSGDVLAGICAAFAAQGLGAFNAAAAAAFIHGKAGELLLQEFPLRGTTASEIADTIPRTRKELYHA

SEQ ID NO: 46951 - protein, 150 aa, Desulfovibrio desulfuricans G20
MLSAKDIMSADPVTVAPDMDIIEATKLMLEYKFNGLPVVDDAGKLVGVLCQSDLVAQQKKVNLPSLFTILDGFIPLKSLSDMDSEMRKVAATRVSDAMTDNPATVTPDTPLDEVATLMVDSKYYTLPVVKDGILVGVVGKEDVLRTLVGV

SEQ ID NO: 46952 - protein, 291 aa, Oceanospirillum sp. MED92
MITGSIVALVTPMQSNGDVDWENLDKLVDMHLDKGTDSIVAVGTTGESATLNCDEHCQVIKRVVDRVAGRIPVIAGTGANSTSEAIELTEEAKKVGADACLLVTPYYNKPTQEGLYQHFKAIAEAVDIPQILYNVPGRTACDMQTETVVRLAEIDNIIGIKEATGDVERGIDLVKRVPEDFAVYSGDDPTAVELILGGGKGNISVTANVAPAEMSNLCELALAGKADEARALNDRLMPLHEKLFVEANPIPVKWALADMGLMGLGIRLPLTVLADEYHEVVREALRSSEII

SEQ ID NO: 46953 - protein, 481 aa, Helicobacter pylori J99
MVVRTQNSESKIKEFFEFCKENEVEFVDFRFSDIKGTWNHIAYSFGALTHDMFKEGIPFDASSFKGWQGIEHSDMILTPDLVRYFIDPFSADVSAVVFCDVYDVYKNQPYEKCPRSIAKKALKHLRDLGLGDVAYFGAENEFFIFDSIKIKDASNSQYYEVDSEEGEWNRDKSFENGVNFGHRPGKQGGYMPVPPTDTMMDIRTEIVKVLNQVGLETFVVHHEVAQAQGEVGVKFGDLVEAADNVQKLKYVVKMVAHLNGKTATFMPKPLYGDNGSGMHTHVSIWKNNENLFGGETYKGLSEFALYFLGGVLRHARGLAAFTNASTNSYKRLIPGYEAPSILTYSASNRSASVRIPYGISKNSARFEFRFPDSSSNPYLAFGAILMAGIDGIKNKMDPGEAMDINLFKLTLDEIREKGIKQMPHTLRRSLEEMLADKQYLKEGQVFSEEFIQAYQSLKFHSEVFPWESKPHPFEFITTYSC

SEQ ID NO: 46954 - protein, 374 aa, Mycoplasma synoviae
MSTKYKYLVDKDGKDVVMTDPSKLIRVLDVNGNLIDKKYKPQLTDKQLVEGYKWMVLSRQQDTYMLQLQRQGRMLTFAPNLGEEALQVATAFALDKKKDWFLPAFRSNATMLALGVPMVNQMLYWNGNERGSKIPEGVNVTPINIVIGTQISQAAGVAFALKQNKTGGVALCFIGNGGTAEGEFYEGMNFASVRSWPAVFCVNNNQWAISTPNHLESISSTIAAKAVAAAVPGVVVDGNDLLASYDVIKEAVEFARKESRPVLVEFVTWRQGPHTTSDNPRVYRTETEEKEQEVWEPMHRIEKYLLDRKLLTKKEIEKIWADSLEVAKKTYEESVKLNEATLDEVFDYTYAELTPELKEQKQEALDFFKAHGGK

SEQ ID NO: 46955 - protein, 161 aa, Glycine max
FGSRFWIWFPLLISSLPNWGERVMFVLASFAVCSIQHLQFCLNHFAADVYEGPPNGNDWFEKQTGGTLDISCSTWMDWFFGGLQFQLEHHLFPRLPRAQLRKISPLVIDLCKKHNLPYRSLTFVEANLWTLKTLRTAALQARNLSNPSSQNLLWEAFNTHG

SEQ ID NO: 46956 - protein, 554 aa, Shewanella oneidensis MR-1
MCSIFSILDIQSDAKELRQVALEMSKLMRHRGPDWSGIYASDKAILAHERLAIVDIEHGAQPLLTEDGSLILAVNGEIYNHKELKAQLGDKYSYQTNSDCEVILALYQEYGTEFLDKLNGIFAFVLYDKAKDAYLIGRDHMGIIPLYTGRDAAGNLYVASEMKALMPVCKTVEEFQPGQYLYSSDAAAVKYYTRDWQQYDAVKDNGASQEELREALEAAVKRQLMSDVPYGVLLSGGLDSSVISAITQTFAKRRIEDDGETGAWWPQLHSFAVGLKGAPDLIAAKKVADAIGTIHHEINFTFQEGLDAIKEVIYHLETYDVTTIRAATPMYLMARKIKAMGIKMVLSGEGADELFGGYLYFHKAPNAQAFHEELVRKLDKLHLFDCLRANKAMAAWGLEARVPFLDKEFMDVAMRINPEAKMSKDGRIEKHILRQAFEHKLPKEVAWRQKEQFSDGVGYSWIDGLKAHAAEQVDDLQLANAKFRFPYNTPETKEAYFYRCFFEEHYPLPSAAETVPGGKSVACSTPEALAWDESLRGIIDPSGRAVRSVHAASY

SEQ ID NO: 46957 - protein, 544 aa, Geobacillus kaustophilus HTA426
MLTVTVGKLLEERARQYADREAVVYADRGLRLTYRQFNDYCRLVARGLMRLGIEKGEHVAIWATNVPEWIACQFATGKMGAVLVTVNTNYRAAELEYLLRQSDSTTLFLIEQYRDSSYIDILYEIVPELRTSAPGQLQSKRLPKLKNVVFLGDKRHPGMFTWNDILAMAHDVSEEELDERMESLDPHDVINMQYTSGTTGFPKGVMLTHYNIVNNAHQVAQCMGLGEGDRLCIPVPFFHCFGCVMSTLACVTVGATMVPVVEFHPKRVLETVEAERCTALHGVPTMFIAELNDPDFAKYDLSSLRTGIMAGSPCPVEVMKAVIEKMGMKDITIAYGQTEASPVITQTRTDDPLELRVETVGRALPGVEVKIVEPGTNKEVPPGVQGELCTRGYHVMKGYYNNPEATNEAIDQDGWLHTGDLATMDENGYFRITGRLKDMIIRGGENIYPREIEEFLYKHPKILDVQVVGVPDEVYGEEVMAWIILKDGETATAEEIREFCRGHISRHKIPRYIEFTDSYPMTASGKIQKFKLREMAKQRLGLTT

SEQ ID NO: 46958 - protein, 282 aa, Shewanella oneidensis MR-1
MGSVTTKKHANGLDYVEVNTALCQARIFLQGAQIDHFQPVGKPPLLWVSSADDYQPGNGIRGGVPVCWPWFGMSSEANFPQHGFARTRVWALESVEMRNQLVDLRFSLTISEEDKVFWPHNTQVNVLFTLGETLSISLINTNLGDVPVSLTQALHSYFPIEDIHQLKATGFSGAQYIEFAKGPYPQTTDDVLFDRETDRVYTNLGPVQHLHTPKGIIEVSRENSRSAVLWNPWIEKSTRLARFNDNDYLTMVCLEAANVLEDKLTLAPGESHSLITHIRWAD

SEQ ID NO: 46959 - protein, 1112 aa, Bacillus cereus E33L
MLVAATLSLPFAVYATPILAATAATENMAVQSPKKHVFDAVIKAYKDNSDEESYATVYIKDPKLTIENGKRIITATLKDSDFFDYLKVEDSKEPGVFHDVKVLSEDKRKHGTKVIQFEVGELGKRYNMQMHILIPTLGYDKEFKIQFEVNMRTFVESDIEEDEEEQIEDTQNIIRDKRLQQAINKNVLNRKDVNEPIFEEDLKEIKELNIYAGQGIESLKGLEYMENLERITIQGSDVRNIAPISQLKRLKVVDLSFNKIENVEPLVNLEKLDILELQNNRIADVTPLSQLKKVRTINLSGNKISDIKPLYNVSSLRKLYVSNNKITDFTGIEQLNKLGTLGVGSNGLVNIEPISQMSGIVELNLEKNDIKDITSLSKLTGLQSLNLEENYVSDVSSLSNLINLYELKLATNEIRDIRPIQELGKRIKIDAQRQKVFLDEAYMNEEVKIPVYDVNGTALQNIEWKSEGGSITNGVIKWNSLGEKMYEFKMDAGESKIRFQGRVIQNIVEKREESSNVIQDMKLRQYMNKHNFERKNVNTPITKEDLLTVKALKITDGKKEGITDFSGLEFMTNMEELILQNANMKNVKFISSLRNLKSVDLSYNQIEDIKPLHSLENLEKLNISNNGIKNVPELFKMQTLKTLDLSNNKLDNAALDGIYQLENLDALLVNNNEINNLDEIGKVSKLNKLEMMGNKVRDISPLANLKNLQWLNLANNKIQDISSLSSILDLLSLKLAGNEIRDVRPIIQLAQWITVDIKNQKIVLEDGQMNQEIQIPIYDLEGEIFEDIELKSEAGIVTDRGTVVWKTPGEKNYVFSLNGNYHGLSLLFSGTVMQNIVAKEEPKEPVEEVEGSKEEPIKEAEGSKEEPKGPAKEVEGPKEEVKEPAKEVEGPKEEVKEPAKEVEGLKEEVKEPAKEVEGPKEEVKEPAKEVEGPKEEVKEPAKEVEGPKEEVKEPAKEVEGPKEEVREPTKEVEGPKEEVKEPMKEVEGSKEEVKEPTKEAEGSKEEVKEPTTEVEGSKEVKEPGKEVEGSKDAINQSAVAQETNVNNQVGKEKVVENQNMKENKPAVTKQEESKKSLGATGGQENTSTLLSGLALVLSALSMFVFRKRLFKK

SEQ ID NO: 46960 - protein, 223 aa, Gibberella zeae PH-1
MAEKDITKYLQQSHDRLFVNNREWAENKAKVNPDFFKNLVAGQAPEYLWIGCADSRIPAEQICGLEPGEAFIHRNIANLVCNTDLNAMGVINYAVKHLGVKHIIVCGHYGCGGVKAAMTPQDLGLLNPWLRNIRDVYRLHEKELDAIADESERYDRLVELNVIEQCRNVIKSADVQQSWHENKYPIVHGWVFGFKDGLLKDLKIDFEAVLGDIQKIYNLVDKK

SEQ ID NO: 46961 - protein, 446 aa, Staphylococcus aureus subsp. aureus MRSA252
MPKRTFTKDDIRKFAEEENVRYLRLQFTDILGTIKNVEVPVSQLEKVLDNEMMFDGSSIEGFVRIEESDMYLHPDLDTWVIFPWTAGQGKVARLICDVYKTDGTPFEGDPRANLKRVLKEMEDLGFTDFNLGPEPEFFLFKLDEKGEPTLELNDDGGYFDLAPTDLGENCRRDIVLELEDMGFDIEASHHEVAPGQHEIDFKYADAVTACDNIQTFKLVVKTIARKHNLHATFMPKPLFGVNGSGMHFNVSLFKGKENAFFDPNTEMGLTETAYQFTAGVLKNARGFTAVCNPLVNSYKRLVPGYEAPCYIAWSGKNRSPLIRVPSSRGLSTRIEVRSVDPAANPYMALAAILESGLDGIKNKLKVPEPVNQNIYEMNREEREAVGIQDLPSTLYTALKAMRENEVIKKALGNHIYNQFINSKSIEWDYYRTQVSEWERDQYMKQY

SEQ ID NO: 46962 - protein, 115 aa, Arabidopsis thaliana
MDGDGSSFEQCYRCYPVTFIDKAHLEKGDKIIMPPSALDRLASLHIEYPMLFQLSNVSVEKTSHCGVLEFTADEGLVYLPYWMMQNMSLDEGDVMQVKNISLVKGTYIKLQPHTQ

SEQ ID NO: 46963 - protein, 517 aa, Sorghum bicolor
MDVPLPLLLGSLAVSVVVWCLLLRRGGNGKGKGKRPLPPGPRGWPVLGNLPQVGSHPHHTMCALAKEYGPLFRLRFGSAEVVVAASARVAAQFLRAHDANFSNRPPNSGAEHVAYNYQDLVFAPYGSRWRALRKLCALHLFSAKALDDLRGVREGEVALMVRELARHQHQHAGVPLGQVANVCATNTLARATVGRRVFAVDGGEEAREFKDMVVELMQLAGVFNVGDFVPALAWLDLQGVVGKMKRLHRRYDDMMNGIIRERKAVEEGKDLLSVLLARMREQQSLADGEDSMINETDIKALLLNLFTAGTDTTSSTVEWALAELIRHPDVLKKAQEELDAVVGRDRLVSESDLPRLTYLTAVIKETFRLHPSTPLSLPRVAAEECEVDGFRIPAGTTLLVNVWAIARDPEAWPEPLQFRPDRFLPGGSHAGVDVKGSDFELIPFGAGRRICAGLSWGLRMVTLMTATLVHALDWDLADGMTAYKLDMEEAYGLTLQRAVPLMVRPAPRLLPSAYAAE

SEQ ID NO: 46964 - protein, 190 aa, Glycine max
MVALVSQDNVVALVSRTGRELQRYRKGRRQVVGCIPYRYKIGDQTSLEAQEELEVLVISSQKGKGMLFPKGGWELDESKKEAALRETMEEAGVRGTVEGKLGKWSFKSKTHDTFYEGYMFPLLVQEQLEFWPEQNVRQRIWMSVSEAREVCQHWWMKEALERLVNRKLGRVTQIEIVGSIHCIGDGNSDL

SEQ ID NO: 46965 - protein, 517 aa, Sorghum bicolor
MDVPLPLLLGSLAVSVVVWCLLLRRGGDGKGKGKRPMPPGPRGWPVLGNLPQLGSHPHHTMCALAKKYGPLFRLRFGSAEVVVAASARVAAQFLRTHDANFSNRPPNSGAEHVAYNYQDMAFAPYGSRWRALRKLCALHLFSAKALDDLRSIREGEVALLVRELSRHQHQHAGVPLGQVANVCATNTLARATVGRRVFAVDGGEEAREFKDMVVELMQLAGVFNVGDFVPALARLDLQGVVGKMKRLHRRYDDMMNGIIRERKAAEEGKDLLSVLLARTREQQSIADGEDSRITETEIKALLLNLFTAGTDTTSSTVEWALAELIRHPDVLKKAQEELDAVVGRNRLVSESDLPRLTYLTAVIKETFRMHPSTPLSLPRIAAEECEVDGFRIPAGTTLLVNVWAIARDPEAWPEPLQFRPDRFLPGGSHAGVDVKGSDFELIPFGAGRRICAGLSWGLRMVTLMTATLVHALDWDLADGMTADKLDMEEAYGLTLQRAVPLKVRPAPRLLPSAYAAE

SEQ ID NO: 46966 - protein, 581 aa, Oryza sativa (indica cultivar-group)
MAAPNGGRGGRRLLGNRARRGGAILLGIAGEAADGVEPVLANDLLPCTADCRPPLLSLPPIGRRAREPLARTTAAMVLHHFSVEGVVAFGGGGVAVRERRKLTTMAFCAGLNFPYHTTVTRMSPRSTAPPWVCFIVQTPKLIKARISPSTVCHITGGSYVYDSKGNKYLDTLAGLWCTALGGSEPRLVKAATDQLNKLPFYHSFWNSTAKPPLDLAEELISMFTAKEMGKVFFTNSGSEANDSQVKLVWYYNNALGRPNKKKIIAQSQALPAMHLKFDLPAPFVLHTDCPHYWRFGLPGEAEEEFATRLADNLENLILKEGPETVAAFIAEPVIGAGGVIPPPKTYFEKIQAVLQKYDVLFIADEVITGFGRLGTMFGSDLYNIKPDLVSLAKALSSAYVPIGATLVSPEISDVVHSQSNKIGFFAHGFTYSGHPVSCAVALEALKIYRERNIPAHVKQISPRFQEGIKAFAGSSIIGETRGVGLLLATEFANNKSPNDPFPVEWGVAQIFGAECKKRGMLVKVVGDEIAMSPPLIMSQREVDGMKIALSVILNCFQLVSIYGEALKATEERVAELRSKKK

SEQ ID NO: 46967 - protein, 478 aa, Oryza sativa (indica cultivar-group)
MPELCAVLSLSQTSDITTAVKAINLLKYVTSTGSLQGHTQNLCDASTRHFSSVPSPQSNSTEENGFKGHGMLAPFTAGWQSTDVHPLVIERSEGSYVYDIDGKKYLDSLAGLWCTALGGSEPRLAKAATEQLHKLPFYHSFWNRTTKPSLDLAKELLSMFTAREMGKVFFTNSGSEANDSQVKLVWYYNNALGRPDKKKFIARSKSYHGSTLISASLSGLPALHQKFDLPAPFVLHTDCPHYWRFHLPGTLNCKFTIAAFIAEPVMGAGGVIPPPKTYFEKVQAIVKKYDILFIADEVITAFGRLGTMFGSDMYNIKPDLVSMAKALSSAYVPIGAIMVSPEISDVIHSQSNKLGSFAHGFTYSGHPVACAVAIEALKIYQERNIPDHVKQISPRFQEGVKAFAGSPIVGEIRGVGLILGTEFADNKSPNDPFPAEWGVGAIFGAECQKRGMLLVSIYGDALKATEERVAELKSKKNN

SEQ ID NO: 46968 - protein, 515 aa, Sorghum bicolor
MHVPLLLGSLAVSVVVWCLLLRRGGDGKGKGKRPLPPGPRGWPVLGNLPQVGSHPHHTMYALAKEYGPLFRLRFGSADVVVAASARVAVQFLRAHDANFSNRPPNSGAEHMAYNYQDMVFAPYGSRWRALRKLCALHLFSAKALDDLRGVREGEVALMVRQLALHQHQHAGVPLGQVANVCATNTLARATVGRRVFAVDGGEEAREFKDMVVELMQLAGVFNVGDFVPALAWLDLQGVVGKMKRLHRRYDDMMNSIIRKRKAAEEGKDLLSVLLARMREQQSLADGEDSRINETGIKALLLDLFTAGTDTTSSTVEWALAELIRHPDVLKKAQEELDAVVGRDRLVSETDLPRLTYLTAVIKETFRLHPSTPLSLPRVAAEECEVDGFRIPAGTTLLVNVWAIARDPEAWPEPLQFRPDRFLPGGSHAGVDVKGSDFELIPFGAGRRICAGLSWGLRMVTLMTATLVHALDWDLADGMTADKLDMEEAYGLTLQRAVPLMVRPTPRLLPSAYAAE

SEQ ID NO: 46969 - protein, 333 aa, Brucella suis 1330
MEKLDITQKLADAEAAITSALRTIKTENAGLVALEEALNNGLSGPFVEAVERIVASRGRLVVTGVGKSGHIGSKLAATFASTGTSAFFVHSGEANHGDLGMIGLEDVILAISWSGETVELKGIVNYSQRFRIPLIAITSRQDSALGRAADVVLLLPKATEACPHGLAPTTSTMMQLAIGDALAIALLEARGFTPSDFKTFHPGGSLGASLIHIRDIMHRGNRLPLVKTGTPMPDAMKVLAQKSFGCVVVTDDAGELAGIVTDGDISRNLSRNLSALAVDDIMTRSPRTIDQNMLASAALKTINENHIGALIVVEANRPIGLVHFHDLLRIGAA

SEQ ID NO: 46970 - protein, 2237 aa, Oryza sativa (indica cultivar-group)
MEVEQAAEVGEVTAPKLPDKAVDKAQVHDDDKENLVNGNSNLQVKEAHNDEDDGTGSDGFELIDVKENFDSAKVVEEEKASPIEQGKTAALEEQALMRESAMLNQETKQLEELTRRIEELELEKEKLVKGVTEAENKQNLHYTSLQEAQRSLADKDKELADATQSLKELGFELESSKERIQEIEAELAASADKLHKLEELKDERSLHAAQEAKRASELDKTLETAQLNMKEMEAQISSLQEEIKGHQDKAIDHQQVEESLRSTLSELKMVQEALELSKSQVDDLEQKLASQDANISHLTEELSLHRSSEESLKEKTLKLENELSSAHEELQAKILNLQEMEIKLEEQAKEKQTWEATLEKQQEQILNLQTELDESKGGNETLRGTIADLNSKLAERDSLLRQAEDEHAKAQLLLSEALSHKDELEVNLKSINEQHGESRAAAENASQKILELEALLQTLHATEEALKLQLEEAEARVEVAEKKGSDLEQLLGESENKLVASSGELKLLEERVQQEAASSAEKEKLLEEATNSVEAYKEKINELQASLDSTTSKNQLLEQEVKDLSDKFTEHQEQAHSVHERSLELESLLHTSKSDAEVAHTRTQDLENELNTANEKFKEVEADLEQYRSKVSQLSDELEAYQTKAASLEAVMESASEKEKELVESLGQITEEKKKLELLVLEYEEKTEEYLKEKQSLEERLQSQESKVLALEESLVKMGEEKESHEGTIADLNLQLSNKNDMYMQLESQLSQAGDDHSKTRSLLSEAQLHKEELELNLKSLNDLHVESKTAAESALQRIAELETQVQELSAAEQSLKSHLTEFESKLASAEKKSMDLEQELKDATEECNSSRLRVDELSGELEEYKEKRTSLEASLLEAKQKEAELSEKLDQVNEEKEKFEELSKKATIKHLEAENQVQALQGELESARHKLEEVESDLEALGIRETSVLDKLKSAEEQLEHKGKALEHATSKKIDLEALYQSLLEDTEMKLQQAGENLTQKETECQELSEKLKAAEEQAASYQAKATAAAGEVESVKVELEAFETEISTLETTIEELKTKASNAESRAEQALVESAMMSETNQALKEDLDAKLAMLRELQEQFDSTHAEKEEVFTKLSAHEKTIEHLTEVHSRGLELHATAESKNAELEAQMHEALETIGKKDSEVKDLNERLAALESEIESLTHVNEAMKQEINAKLVKVDELQEKLSSISSEKEEVAEKVVVHEKTIEHLREEHSRGLELQSAAESRSAEIENELREVLETVAQKEAEVTDLKEKLVSLETENEKLVGINEALKGELDTKVAMFDELQEQFSSTHAEKEEAAEKLAVHERTISHLTEVHTRSLELHSAAESKNEEIESKLHEALEMAAQKEAEVKDLSKKLDALEIELGYYEEQATEAAAAEETHKIKFDEAVHKIKSLEEQLAVTENKVELFHTEKENLVIANSKLNEELELHQNKLNELQVALAAAVAEKEGSSEEIHSLRKTLDGMIQRKEELESQLYCYYIFCSFKKVISLSVSSTVEEHEELKSKYNITLEEKQLLNEKYESAKKELGEAIAKLEEQMNVDKSEKELHISKLERQITLSELKYMEEIQTMQVETTEKDEALTTKMQEHANLVHEKDALEQQLLEVRKELNDAYHTIANQEEQVSVREIKWDAYKKFSEDQLEAEQQHVAELEVQVSSLKQQLQEAEIHYKHKEEQVSLREVQWEADQEHSVSELKAQRQYAAELEKQIGALTQQLQLVEKQYEQKVTEEREKLALVNTEVSKLTQKLSKSAEMEKKIEHLEQKLQAKDSVESTSRDFSLDSSTLPSKQRDRSLAPETTPPNPTQQQELREPSGIMAFKFILGVALLSVLIVLTFFGGHVMHYFADKIMTHEKGEQSPWQGSYVYDSKGNKYLDTLAGLWCTALGGSEPRLVKAATDQLNKLPFYHSFWNSTAKPPLDLAEELISMFTAKEMGKVFFTNSGSEANDSQVKLVWYYNNALGRPNKKKIIAQSQALPAMHLKFDLPAPFVLHTDCPHYWRFGLPGEAEEEFATRLADNLENLILKEGPETVAAFIAEPVIGAGGVIPPPKTYFEKIQAVLQKYDVLFIADEVITGFGRLGTMFGSDLYNIKPDLVSLAKALSSAYVPIGATLVSPEISDVVHSQSNKIGFFAHGFTYSGHPVSCAVALEALKIYRERNIPAHVKQISPRFQEGIKAFAGSSIIGETRGVGLLLATEFANNKSPNDPFPVEWD

SEQ ID NO: 46971 - protein, 334 aa, Brassica napus
FISFLSLSLNGSRSRRGRRRRRTMSSSSSSKKQTLFISTLIISWYSSNIGVLLLNKFLLSNYGFKFPIFLTMCHMSACAFLSYISIVFLKLVPLQHLKSRSQFLKVATLSVVFCASVVGGNISLRYLPVSFNQAVGATTPFFTALFAYLMTLKREAWVTYGALVPVVAGVVIASGGEPGFHWFGFIMCISATAARAFKSVLQGILLSSEGEKLNSMNLMLYMSPIAVVALLPVTLVMEPDVISLTLTLAKQHQYMWILLLVNSVMAYSANLLNFLVTKHTSALTLQVLGNAKGAVAVVISILIFQNPVTVMGIGGYSITVLGVVAYGETKRRFR

SEQ ID NO: 46972 - protein, 527 aa, Saccharomyces cerevisiae
MSVQIFGDQVTEERAENARLSAFVGAIAVGDLVKSTLGPKGMDKLLQSASSNTCMVTNDGATILKSIPLDNPAAKVLVNISKVQDDEVGDGTTSVTVLSAELLREAEKLIDQSKIHPQTIIEGYRLASAAALDALTKAAVDNSHDKTMFREDLIHIAKTTLSSKILSQDKDHFAELATNAILRLKGSTNLEHIQIIKILGGKLSDSFLDEGFILAKKFGNNQPKRIENAKILIANTTLDTDKVKIFGTKFKVDSTAKLAQLEKAEREKMKNKIAKISKFGINTFINRQLIYDYPEQLFTDLGINSIEHADFEGVERLALVTGGEVVSTFDEPSKCKLGECDVIEEIMLGEQPFLKFSGCKAGEACTIVLRGATDQTLDEAERSLHDALSVLSQTTKETRTVLGGGCAEMVMSKAVDTEAQNIDGKKSLAVEAFARALRQLPTILADNAGFDSSELVSKLRSSIYNGISTSGLDLNNGTIADMRQLGIVESYKLKRAVVSSASEAAEVLLRVDNIIRARPRTANRQHM

SEQ ID NO: 46973 - protein, 117 aa, Zea mays
  misc_feature (110)..(110): Xaa can be any naturally occurring amino acid
MATVDLEKLRMSGAGKAIGVLTSGGDAQGMNAAVRAVTRMGIYVGAKVFLIYEGYEGLVEGGENIKPANWLSGSDIMQLGGTIIGSARCKAFTTREGRLAAGYTLLRRGXTNLCVIG

SEQ ID NO: 46974 - protein, 330 aa, Mycobacterium sp. MCS
MKRSAAAVIGGATAAVAAGRYLLAREALSAVARDLRSPVLPYVAAPSSRRSMLVTRAFTRLPTPAGDGVTVTESRVGETAVRVVITAPAGGGTSRPAVMWIHSGGFVVGSPQLERFITGQIARELGATVVSPDYRLAPEHAVPAALDDCMATLRWMRTNADRLGIDADRIVVGGASAGGGLAATVAQRSLDEGCPLRGQALAYPMLDDRSVLRADHGGRGRFVWTPASNRFGWTAYLGHPPDTSEAPAYAAAARRSELSGLAPAWIGVGQLDLLHDDCVSYAERLESSGVPCELITVPGMYHAADAIAARALSMQTFCASMLNFMRARLS

SEQ ID NO: 46975 - protein, 115 aa, Mycobacterium sp. MCS
MALDPEIASRLKRNADGLFTAVAQERGTGQVLMVAWMDDIALDRTMRTRNATYWSRSRGEHWVKGETSGHTQHVHSVRLDCDGDTVLLEVEQSGPACHTGTHTCFDADVLLAPEA

SEQ ID NO: 46976 - protein, 208 aa, Mycobacterium sp. MCS
MTDMLTGTRRARVERKTKESDIVVDLDLDGTGIVDIRTGVPFFDHMLTSLGSHASFDLTVHATGDIEIEGHHTVEDTAIVLGQALGQALGDKKGIRRFGDAFIPMDETLAHAAVDVSGRPYFVHTGEPDYMVEFTIAGSSAPYHTVINRHVFESLAFNARIALHVRTIYGRDPHHITEAQYKAVARALRQAVELDPRVTGVPSTKGSL

SEQ ID NO: 46977 - protein, 336 aa, Oceanospirillum sp. MED92
MTIKIGINGFGRMGRLAMRAAWEWPEFEFIQINDPQGDAATLAHLINFDSVHGTWGHEATADEGMMLIGDKQISVSRNEKIEDTDWSQCDLVIEASGVMKKKALLQSYLDQGVKHVVVTAPVKEEGVLNMVMGINHHLYEPGKYPIVTAASCTTNCLAPVVKVVHEKLGIKHGSMTTIHDITNTQTILDAPHKDLRRARACGMSLIPTTTGSAKAITQIFPELTGKLNGHAVRIPLANASLTDMVFELERATTVDEVNQLFAEAAANELHGILGYEERPLVSIDYRTDPRSSIVDALSTMVVNGTQLKIYAWYDNEWGYVNRTVELAKFVAIDSVK

SEQ ID NO: 46978 - protein, 103 aa, Ashbya gossypii ATCC 10895
MSGRGKGGKGLGKGGAKRHRKILRDNIQGITKPAIRRLARRGGVKRISGLIYEDVRAVLKSFLESVIRDAVTYTEHAKRKTVTSLDVVYALKRQGRTLYGFGG

SEQ ID NO: 46979 - protein, 221 aa, Arabidopsis thaliana
MQSIDEMRQNLQSTLFELETLKMEANEKSRTHREEVNQLLNLLKFTQQERDEARQQLSQFIFHTQQNPNSRSLTKSNSFSHSQDVSSSSSSELSTFLNIHPQPLTNLEDPTAHNHHQQIDPLDVLVMGKAFPETGKLLKAVVEAGPLLETLLLAGPLPKWINPPPQTQSQRFELPSISFRGSDVDSKCDSMTCSGSVNSFGFGSSLVIDQSMLTGKRQRLE

SEQ ID NO: 46980 - protein, 607 aa, Cryptococcus neoformans var. neoformans JEC21
MSYKAGSVYPCNPATSRSESTKLGVDPKGEKLVYTNGRAVVIRDLNHVGLSHIYTEHTQNTTVARISPSGYYCASADVAGNVRVWDVTQPENILKLATRPLGGKINDLAWDGESKRIIVGGEGKDRFGAAFFMDSGSSCGEIAGHAKPITALSIRQQRPFRAISGSDDNSLIFHTAVPFKYDKMINTHTRFVRDVAFSPNGDLFASVASDGKMFFYEGKTGEVKGEVDRDGSTASLMACSWSPDSSRVTTAGTDGIVAIWDSSTLKTIQSYNVGSDVAAQQNGVVYANTNTVVSASLSGTLNIFDIREPTSKWRTLHGPTKAITASAIFSNGNDKDTTFYAGSFDGTVKKFEIGEAYGEKEGTCDEIEGTGHSARIAAISANGKDKVWSAGWDDKVTAIEGSQFTSNPIPTKAQPTSIAATPDSVYIATASGVEVNGPSPTTLVTTPTSAVAAYPGPNSDLVATASGKIVTLFSTSPQTVLATFDDNKGDVLSLAFSPDGKYLASGDATGRIILIDVEKKETVVSSKWTFHTGRVVGLAWAIDSKRLASAGLDENIYVWDTNKQLKNISIKNAHPGGVNGVAWVDGNTRLVSAGADGCVRTWTVPEL

SEQ ID NO: 46981 - protein, 387 aa, Ostreococcus tauri
MLAVGSSAGATRASARAPTSSARSNTRRQAVVCAARRSTKTSAVTFGTTRDEGAIGRRRCVQRTTAAVWKPAARARVVAAAGKLSEMDVKTKTAVYFFLWYFFNIVFNVYNKSTLNVFPYPWLISTLQLAATSLWMLTVWATKIQPKPEVTKAFLLAVAPVAFFHTVGHVSACVSFSKMAVSFTHVIKAAEPVFSVILSGPLLGQTFAPAVWASLIPIVAGCSMAAMKEVSFNITGFQGAMISNVAMVLRNITSKKSLNDFKAIDGINLYGILGIIGLFYLAPAAYMIEGAQWSAGYAAAIAKVGEQKLWQMLFLSGIFYHLYNQVSYQALTNITPVTFSVGNALKRVAVIVASVIYFRNPVSPLNAAGSALALVGAYLYTKASEKK

SEQ ID NO: 46982 - protein, 376 aa, Populus tremula x Populus tremuloides
MASMYNPETSAVQDQQQNPTLLYDALYCSEENWVEEVREDWFQDELEGESYCSNNSNKLNTFPILLEQDLSWEDEELSSLFAKEEQNQLCKDLETNPSLARARCEAVEWILKVNEHYSFTALTAVLAVNYLDRFLFSVHLQKEKPWMAQLAAVSCLSLAAKVEETQVPLLLDFQVEDSKYVFEAKTIQRMEILVLSTLKWKMNPVTPISFLDYITRRLGLEHYLCLEFLKRCERMVLSILADSRSMPYVPSVMAAATMLYVIDNIEPSLAAEYQSQLLSILGIDKDKVEDCSKFLMEFALRDHFKLLSNKRKFCSLPGSPSGVVDVSFSSDSSNDSWSVASSVSSSPKPLSKKSRALQSLNNATTSDFSQHSSPVP

SEQ ID NO: 46983 - protein, 257 aa, Geobacillus kaustophilus HTA426
MFLPSFRLDGKTALVTGAGRGIGRAIAIGFAEAGADVALIARTEADLQETASHIEQFGRKAYIYPLDVIDRKAVHDAVANVKQQAGSLDIVVNNAGMNIRTPALDVTDHEWETIMNTNLKSAFLVSQEAGRVMKEQKQGGNIINIASVAGHVALRTGVVYAATKAALIQMTKVLAFEWGRYGIRVNAIGPWYFRTPLTKTLLEDEAYVNDILAVTPLKRIGELPELVGPAVFLASDASSYITGQTLFVDGGMTIHGF

SEQ ID NO: 46984 - protein, 460 aa, Oceanicola granulosus HTCC2516
MTKLSNSLGAADIATALHPYTNARRHEEAGPMVMRRGDGVRVEDAQGKTYIEALAGLWSVAVGFSEPRLVEAARRQMEALPYYHSFAHKAHEPAIRLGEKLVEMTPEGLDRVFFTNSGSEANDTVVKMVWYMNNALGRPEKKKFLARTKGYHGITVASGSLTGLPANHRDFDLPVIPVTHLTCPHHYRFGRDGESEADFTARLLAEAEEVIEREGPETIAAFIGEPLMAAGGVMPPPEGYWPGIEALCRKHDILLVSDEVICGFGRLGSPFGCTHYGFTPDIMVTSKQLTSSYMPLAAVIFSEKIYDAIADNSAKIGTFGHGFTGSGHPVATAVGLENLAIIEERDLMGNAARMGARLQEGLRRFAGHELVGEVRGTGLIAGLELVRDKATRESFDPVGKVGTLAFEIAHEEGMVIRNVGDTLALCPPLIVTEADVDEIVARMGRILDRTLEKVKAGALG

SEQ ID NO: 46985 - protein, 392 aa, Triticum aestivum
MANVGGALLRGAGESFRFFVRGDPPCSERIASKILPVVKNQHLLLCTLLICNAAAMEALPIFLDSLVTAWGAVLISVTLILLFGEIIPQSICSRYGLAIGASVAPLVRVLVWICFPVAYPIAKLLDHVLGHGKAALFRRAELKTLVTLHGNEAGKGGELTHDETTIIAGALELSEKKAKDAMTPLCDTFVIDINAKLDRKLMQEVIEKGHSRVPVYYEKDTNIIGLILVKNLLSINPDDEIPIKSVTIRKIPRVSEDMPLYDILNEFQKGHSHMAVVIKQNIPSYPAKQPSIDGGSLEVAIAIDEKQGEKVAKSLTPLRRWKSYPNTLNSNTGSRRGKWSKDQSDVLQVHEEPLPTLSEDEEAVGIITMEDVIEELLQEEIYDETDVHVEEQ

SEQ ID NO: 46986 - protein, 147 aa, Thermoplasma volcanium GSS1
MDRTLVLLKPDAVKRRLVGKIIERFEEKGLKIVAMKFMQMTKDQAKTHYSVHQNKPFFNDLVNYITSGPIVAMILEGAHAIEIVRLMSGATDGSKAQPGTIRGDYSMGIEKNIIHASDSLEAYNHEMPIFFSDNEIIEWAYGDEVIY

SEQ ID NO: 46987 - protein, 251 aa, Chlorella pyrenoidosa
NSIFFVGGNWKCNGTVKSNEELVKVLNAAEVPGTDVVEVVVAPAAVHIPQVLSSLRKDFSVAAQNCWVKAGGAFTGELSAEMLADLGLNWVVLGHSERRHIIGETDEFIADKVAYALSKGLGVIYCIGEKLEEREAGNTLDVNARQMKALADKIQDWSKVVVAYEPVWAIGTGKVATPEQAQEVHDAVRKWLADNVSADAAANTRIIYGGSVTAKNCGDLATQPDIDGFLVGGASLKPEFVDIIKSAALSK

SEQ ID NO: 46988 - protein, 286 aa, Chlorella pyrenoidosa
MTFGQALVHQRVQLPTVRRSSCHRASRCAVVMRGSGRFFIGGNWKCNGTLQSVTQLVDELNAGSVPDSVEIVVAPTFVHLDRVQRSLKSPFQIAAQDCWVSKGGAYTGEVSAEMLHDMGIPWVILGHSERRSLCREDDELVGMKCEYALSQGLKVIACIGETLEQRESGHMWDVLDAQLAAIARHTSLANWANMVIAYEPVWAIGTGVVATPEQAQEVHAYVRKWIAEHVSAEVADKLRILYGGSVNDANCATLANLEDVDGFLVGGASLKGPSFINICNAQNKHS

SEQ ID NO: 46989 - protein, 642 aa, Arabidopsis thaliana
MSSTFRAPAGAATVFTADQKIRLGRLDALRSSHSVFLGRYGRGGVPVPPSASSSSSSPIQAVSTPAKPETATKRSKVEIIKEKSNFIRYPLNEELLTEAPNVNESAVQLIKFHGSYQQYNREERGGRSYSFMLRTKNPSGKVPNQLYLTMDDLADEFGIGTLRLTTRQTFQLHGVLKQNLKTVMSSIIKNMGSTLGACGDLNRNVLAPAAPYVKKDYLFAQETADNIAALLSPQSGFYYDMWVDGEQFMTAEPPEVVKARNDNSHGTNFVDSPEPIYGTQFLPRKFKVAVTVPTDNSVDLLTNDIGVVVVSDENGEPQGFNIYVGGGMGRTHRMESTFARLAEPIGYVPKEDILYAVKAIVVTQREHGRRDDRKYSRMKYLISSWGIEKFRDVVEQYYGKKFEPSRELPEWEFKSYLGWHEQGDGAWFCGLHVDSGRVGGIMKKTLREVIEKYKIDVRITPNQNIVLCDIKTEWKRPITTVLAQAGLLQPEFVDPLNQTAMACPAFPLCPLAITEAERGIPSILKRVRAMFEKVGLDYDESVVIRVTGCPNGCARPYMAELGLVGDGPNSYQVWLGGTPNLTQIARSFMDKVKVHDLEKVCEPLFYHWKLERQTKESFGEYTTRMGFEKLKELIDTYKGVSQ

SEQ ID NO: 46990 - protein, 303 aa, Enterococcus faecalis V583
MNAVTIIGSINLDTTLRVKEMPKPGETIHAIEHFTAGGGKGANQAVAAKRSGAETYFIGAVGNDGAGAMMTDLMSQDEINLTGVTTLEKTATGQAFIMVDNAGENSIMIYAGANNAFTPKQVQEHQEIIEKSDFVIAQFESAIDSTIAAFKIAKKAGVKTILNPAPALEQVPEELLNVTDMIVPNETETEILTGIKITDEASMRKAAEALHQLGIEAVIITVGSKGAFYDVNGRSGIVPAFKVKAVDTTAAGDTFIGALSSILEKDFSNLEEAIRYGNKASSLTVQRFGAQPSIPYQHELADK

SEQ ID NO: 46991 - protein, 346 aa, Aspergillus nidulans FGSC A4
MPVQACYPITETVSKDGLVIPIINFAPFRNGTPADKHAVAMSVVHAFKTSGFLYLKNHGIPPSVTSRVFKSSASFFGRPQDQKDTLGWTTPQANRGYVRTGREKLSTVDDQADRTVPDIKESMEIGREGVEGLPNRWPDQLDEEGKDFKNVMLEFFEMCKELHIKVMQAIALGMNLPVHFFDEYVDKGDNNLRLLHYPAVHKDVFKKNPGQVRAAEHSDYGSITLLFQDRRGGLQARSPEGTWVDVTPFPDTVVINAGDLLARWSNDTIKSTKHRVIEPPKVPGAEDDDTDMYPERYSVAYFCNPNMDKFIEAIPGTYGEGEGLSKAKYPGITSGDYLVQRLSATY

SEQ ID NO: 46992 - protein, 501 aa, Arabidopsis thaliana
MAIPMPTRQLFIDGEWREPILKKRIPIVNPATEEVIGDIPAATTEDVDVAVNAARRALSRNKGKDWAKAPGAVRAKYLRAIAAKVNERKTDLAKLEALDCGKPLDEAVWDMDDVAGCFEFYADLAEGLDAKQKAPVSLPMESFKSYVLKQPLGVVGLITPWNYPLLMAVWKVAPSLAAGCTAILKPSELASVTCLELADICREVGLPPGVLNVLTGFGSEAGAPLASHPGVDKIAFTGSFATGSKVMTAAAQLVKPVSMELGGKSPLIVFDDVDLDKAAEWALFGCFWTNGQICSATSRLLVHESIASEFIEKLVKWSKNIKISDPMEEGCRLGPVVSKGQYEKILKFISTAKSEGATILHGGSRPEHLEKGFFIEPTIITDVTTSMQIWREEVFGPVLCVKTFASEDEAIELANDSHYGLGAAVISNDTERCDRISEAFEAGIVWINCSQPCFTQAPWGGVKRSGFGRELGEWGLDNYLSVKQVTLYTSNDPWGWYKSPN

SEQ ID NO: 46993 - protein, 347 aa, Zea mays
  misc_feature (105)..(105): Xaa can be any naturally occurring amino acid
MALSSSSPVVAPSPCRFLCPRATTASHDLLSFATTATRRRLLLSTATTTIAAAMAASSSCKVIDSHLHVWATPQQAKEEYPYFPGQEPTLRGDADFLLECMSEAXLDGAVIVQPINHMFDHSLVTSVLKKYPSKFVGCCLANPADDGTGIKQLEHLIVQEKYRAVRFNPNLWPSGQKMTNEVGRSLFSKAGELGVPLGIMTMKGVGPYIQEIEELCRDYPATTVILDHMAFCKPPTNDEEEKAFSSFLSLSRFPQVYVKYSALFRITREAYPYEDTAQLLSSVISHYGASRVMWGSDFPYVVPECGYKGGREAISHVASKIPVSQSDLEWILGKTVSQLFQGAWVTP

SEQ ID NO: 46994 - protein, 161 aa, Zea mays
MMMAEVANHSKRNHTDSYFSGKAVAVPAAAATSSEEFGSMSSKKPRNASPRLAPVSPKEKKDKIGERVAALQQLVSPFGKTDTASVLQEASGYIKFLHQQLEVLSSPYMRAPPAAGAAPEDPQRYSLRSRGLCLVPVDLTLQLTQSNGADLWAPAHTARRR

SEQ ID NO: 46995 - protein, 300 aa, Arabidopsis thaliana
MCDPTRDDGSSRSRVVSTMQKRAYFQRQWPLVDVVRASVVVIVHFLCLLAPFNFKWEALRFGLVLFALTTLSITFSFHRNLSHRSFKIPKWLEYPWAYSAVFALQGDPMDWVSIHRFHHQFTDSDRDPHSPKEGLLFSHILWIFDTQYIKYKCGGRDNVLDLKKQWFYKFLRRTIAVHILMFWTILYLYGGLPYLTCGGGVGIFIGYHVTWLVNSACHIWGSRSWNTKDTSRNVWWLSLFTMGESWHNNHHAFESSARQGLEWWQIDITWYLIRLFEVLGIATDVKLPSELQKQKMALVR

SEQ ID NO: 46996 - protein, 399 aa, Aspergillus oryzae
MPREATDIEEGTQVYRPEGFHPVYIGDVFKDRYKVLNKIGYGVYSTVWLVRDLEPAQSGLENQFRALKVLSADSYEGTNSPIFEREILTHLRDGDRDQIGYDYVCHLLDDFEHRGPNGTHVCLVFELMGETLRSFGAWFAESRLPNSVMRRFTIQLLLVLDFAHEHNVIHTDIKPDNIFVKFRDHSLIESGYLTDVAIPQQDRFEEQYSVVPSTPLRQYYFNDADSRRVDEFDIALGDWGVSSWANRHLSETIQPVALRSPEVLIQAPWDASTDFWNLGAVVLEIFQAVRMFSGSVPPDGHYELKEHLAEIVDLFGPFPNELLAKWDQNLVRDVFGDDGRIKDAPPMNRPGLASEAFMPGLDQELRDMFASFLHAMMKINPADRVSAEDLLRHPWLDAL

SEQ ID NO: 46997 - protein, 246 aa, Oryza sativa (japonica cultivar-group)
MSVYYETLCPFCSGFVVNDLARIFRDGLSPVVDLRLVPFGNGRVSPDGSITCQHGEEECQLNAIEACVIRLWPDAEQHFPFINCIEHLALTQKWNAWQSCFQETGLASQPVMDCYNSGYGTQLQLQYAAETNALQPPHQFVPWVTVNGRPLGDDYTNFEAYICRAYDGELPEACRGKHLAIAQQTRASRGGKIHKPDRCPCSCNAEGSTKVGRSTCLLHRGVVLTSLERHFVEKTQTVQDQMKLTK

SEQ ID NO: 46998 - protein, 351 aa, Rhodococcus sp. RHA1
MPTSPLIVPTVDISPYLAEGARAHNSAECARVAAELDTACREVGFVQIVGHRIPGATVDRLTSALDEFFGLPLETKKKYRRSSAENRGYSPPASESLSMSLGVESANMMNDFYEAFIVGTETTEYPELELPETSYATNTWPEDAPAFRSSVEEYFARAQVLARILLAAFADALRVEPGYFDAMVDHSINALKMNNYALPEGEAAFDGDATGMGAHTDFGILTILWTDQVPGLQVLGSDNTWHDTQPADDALLINLGDAMARWTNDRWRSTVHRVNPPITDGQIIRRRSAAFFFDGNHDAVIAPLPGTLVDGEPGYPPITVAENIAAKVAGLKAGVKPAAALREAARVRSAH

SEQ ID NO: 46999 - protein, 449 aa, Oryza sativa
  misc_feature (275)..(275): Xaa can be any naturally occurring amino acid
MSKAMQCFGFAGWERDERRGRSSAVASAAAATTRSLSARSNSSTSTDRDARRSGSECSLNVSSEISAESFGRYRQLSLPQRASNNLRIFTFQELKSATRGFSRSLVLGEGGFGCVYRGTIRSVLEPRRSVEVAIKQLGRKGLQGHKEWVTEVNVLGVVDHPNLVKLIGYCAEDDERGMQLLLVYEFMPNGSLADHLSSRSPRPASWAMRLRVALDTARGLKYLHEESEIKIIFRDLKPSNILIDENWNAKLSDFGLARLVSQDGSHVSTAVWIPXLQAIGYAAPEYIHTGRLSSKNDIWSYGVVLYELLTGRRPLDRNRPRGEQNLIEWVKPYSTDSKKLEIIMDPRLEGSYSLKSAANLASVANKCLVRHARHRPKMSEVLEMVQKIVDSTDLGTPEHPLISKSRELTRDEKKRKGLDLKRRFADIKAGGDQRWFTWQRWRPKLVRTQ

SEQ ID NO: 47000 - protein, 402 aa, Rhodopirellula baltica SH 1
MSDNKGVVYLGAGKVDVQSIDDPKLELSYRGKTRQCHHGVILKVISTNICGSDQHMVRGRTTAPAGMVLGHEITGEVIEVGRDVEFIKKGDICSVPFNIACGRCRCCKEGDTGVCENVNPDRPGAAYGYVDMGGWIGGQSRYVMVPYADWNLLAFPDRDQALAKIRDLTMLSDIFPTGYHGAYTAGVTTGSTVYVAGAGPVGLACAHAAQLLGAAVVIVGDMVEERLAQARSFGCETVDLKTDASLPDMIEQILGSREVDCAVDCVGFEARGHGGDSGVEKPATVLNQVMEVTRVGGGVGIPGLYVTDDPGGVDEAARTGNLSLRIGLGWAKSLHFTTGQCPVMKYNRGLMMAILHDRCQIAKAVNATVISLDDAPQGYADFDQGAAKKFVLDPHGVLAAST

SEQ ID NO: 47001 - protein, 297 aa, Oryza sativa (japonica cultivar-group)
MAGGVSSVEVVKDGATGLEKLVLREAHGCSVQVFLYGGQVIFWENEYREQLLFVSRKFGNHGVLEQHGFARNRLWSVDETPPPFPATTSNCHIDLILKQSPEDLKIWPHSFEFRLRVALSPTGDLMLTSRIKNTNADGKPFKFGFSYNTYFSVSDISEVRVEGLETLDYIDNLQCGKRCTEQGDAVVFESEAEKVYLSAPPKIVIIDHDKKRTFELRKEGLPDVVVWNPWDRKAKTILDFGEEEYKCMLCVGAANAEKPITLRPGEEWQGRQEISVVPSSYSSGQWDPEIIHRIQDI

SEQ ID NO: 47002 - protein, 432 aa, Bacillus cereus E33L
MKFTKSEALHKEALEHIVGGVNSPSRSFKAVGGGAPVAMERGKGAYFWDVDGNKYIDYLAAYGPIITGHAHPHITKAITTAAENGVLYGTPTALEVKFAKMLKEAMPALDKVRFVNSGTEAVMTTIRVARAYTGRTKIMKFAGCYHGHSDLVLVAAGSGPSTLGTPDSAGVPQSIAQEVITVPFNNIETLKEALDKWGHEVAAILVEPIVGNFGIVEPKPGFLEKVNELVHEAGALVIYDEVITAFRFMYGGAQDLLGVTPDLTALGKVIGGGLPIGAYGGKKEIMEQVAPLGPAYQAGTMAGNPASMASGIACLEVLQQEGLYEKLDELGAMLEKGILEQAAKHNIDITLNRLKGALTVYFTTNTIEDYDAAQDTDGEMFGKFFKLMLQEGVNLAPSKYEAWFLTTEHTKEDIEYTIEAVGRAFAALADNK

SEQ ID NO: 47003 - protein, 517 aa, Geobacter metallireducens GS-15
MLLKEIFNRGPKLFPTKSAIIDGDRRFTYREAGDRWNRLANVLVDCGLKKGDCLGFLLMNCAEIIDAYAAGAKAGVAVGGVNYRLAPEGIKKVIEDMGCRVLLVGAEFVDTINSLRPHLPFLETCISVGTKVTGMHEYESIIAKASTMEPDVSTSGEDLAHIIYTTGTTGAPKGAMATRQIAMNRISSELIELYVDVDDRFLNVFPLFHVGFYTSLAFLSRGATVAILREWDPQKFCSSVQDYKINKTNLAPVVVNFLVNWADAAKYDLNSLQLIKYGAAPMPMETLKKAMKLLPDCKFTQCYGCSESFGVVYLRPEEHAAALNGSSESVRRMGSCGREAAFCIVRVVNEKGQDVKPGEVGEILIGGGLVMTGYLNKPEETAEAIRSGWLHTKDMAMVDDEGYIYLVDRKAFMIITGGENVYPAQVENVLHDHPKIAEVAVIGVQDDTWGEAVKAVVVPKKGEILTEEEVIEFCRPRMANYAKPKTVVFTDALLHTATGKIDKLALKKKYESSKLKC

SEQ ID NO: 47004 - protein, 578 aa, Zea mays
MRSQFHTSTHLQSQKSRRWPAAKTHVGFRRRRQELGDKATPAGATFMRVPPGSHAYTSAAELNAPLRGKLICCSQVPPATAPSANGDCSDFYAGGVAVYSGLLWSTPCRDLPVLLAQPRSLPVIVTYRPNWEGGQYAGEDEPRFEALLLAMELGAEYVDVEFKVADKFMKYLSGKKPQNCKLIISAYDYKTTPSVHELLNLVAQIRATGADIVKIETTAADIVDTSRMFQVLAHCHEKQVPIIGLVRKEHGFISRIICAKYGGYLTFASLENGKESTTEQPTVADLINKYKIRQIGPDTKVFGIIGNPVSHSKSPIVQNQAFRSVGFDAVFLPFLSDDLVQFLYTFSAPDYAGFSCTMPHKETALRCCDDVDPIARDIGAINTIIRRPDGKLVGYNTDYSGAISAIEDGIRASQPTDSITSPLAGRLFVVIGAGGAGKALAYGAKEKGARVVIANRTFARAQELAHIIGGTALTLSELESYHPEKGMILANATSVGMHPNVDETPLSKHALKSYAVVFDAVFVPRETRLLREAAVCGATVIDGLEMLIRLVMVQFKLFTGGMTAPERLMREAILTKTH

SEQ ID NO: 47005 - protein, 142 aa, Triticum aestivum
MVRGKLEVLLVSAKGLDDSDFFNSMDPYVILTCRSHEQKSTVASGAGSEPEWNETFVFAVSGDAPELRVKIMDSDALSADDLVGEACIPLEAVLQEGSLPPAVHRVVKDEEYRGEIKIALTFTPAEENEEEEESYGGWNQST

SEQ ID NO: 47006 - protein, 407 aa, Gibberella zeae PH-1
MAPSAVETQDVNLTAAAIHKKEVAQPTTTTQAPLDASKLTYTYTQNPRSVPDEANAHSGDETIATDHMVLAAWKQSTGWAAPELKPYGPLSLMPTASVLHYATECFEGLKVYRGYDGKLRIFRPDRNAARLRMSSTRISLPSFEPSEIEKLMISLLSVDGTKWLPADRAGSFLYIRPTVIGTAPQLGVSAPKEALLYIIVTFMPRMDAPPGGMRLHTSPDDMVRAWVGGFGYAKVGANYGPSLLATADARTRGFHQILWLYGSQGECTEAGASNFFVVWKRKDGKKEIITAPLDDKLILDGVTRRSCLELIRERLGDEYEITERKYTISEVMEADAEGRLLESFAAGTAYFICPISQIHHRGKDINIPMGAEGEAGEVTSKVKGWLGDIMYGRTEHPWGVVIPEKKQ

SEQ ID NO: 47007 - protein, 506 aa, Sesamum indicum
MEAEMLYSALALTFAIFMVYRILSNSQDKRSLTKLPPSPPGWLPVIGHAHLMKNLLHRTLYDFSQKLGPIFSIRFGSRLVVVVSSSSLVEECFTKYDIVLANRPQASVDRRSLGFSTTSVIGAPYGDHWRNLRKLCDLEVFAPTRLASFLSIRLDERDRMISALYKISSAGFAKVNLEAKIVELTFNNIMRMVAAKRYYGEEAEDDEEAKRFRDLTKEALELTSASNPGEIFPILRWLGCNGLEKKLAVHSRKTDEFMQGLLDEHRRGERQNTMVDHLLSLQESQPEYYTDEIITGLIVALIIAGTDASVVTTEWAMSLLLNHPKVLEKARKELDTLVGHERMVDEHDLPKLRYLHCIVLETLRLFPSVPTLVPHEPSEDCKIGGYNVPKGTMVLVNAWAIHRDPKVWDDPLSFKPDRFEIMEVETHKLLPFGMGRRACPGAGLAQKFVGLALGSLIQCFDWERTSPEKIDLNEGSGITLPKAKTLEAMCKPRHVMEKVLRQVSNV

SEQ ID NO: 47008 - protein, 218 aa, Brassica napus
TEEYSHTAVNKFNVIPDSLPEWVFDFMPSHGGFFIGNVSPARMDFRWFALGNCIAILSSMATPEQSTAIMDLIESRWEELVGEMPLKVCYPAIESHEWRIVTGCDPKNTRWSYHNGGSWPVLLWLLTAACIKTGRPQIARRAIEVAEARLHKDNWPEYYDGKLGRYVGKQSRKCQTWSIAGYLVAKMMLEDPSHVGMVALEEAKQMKPVMRRSNSWTC

SEQ ID NO: 47009 - protein, 139 aa, Desulfovibrio vulgaris subsp. vulgaris str. Hildenborough
MVERTFSIIKPDAVERNLQGEVLAMIQGAGLKVVAMKMIHLTKAQAEGFYAVHRERPFFDSLTTYMCSGPVVCSVLEGENAISRYREIMGATNPANAAEGTIRKKYAVSLEANSVHGSDAPETAAFEISYFFNALEIVG

SEQ ID NO: 47010 - protein, 377 aa, Brucella suis 1330
MATQRIIDFLNTRRPEGPCLVVDTDVVRENYQGFEKALPYSRIFYAVKANPAPEILRLLASLGSSFDTASVAEIEMALEAGATPDRISYGNTIKKERDIARAFDLGIRLYAVDCVEEVEKIARVAPGSRVFCRVLTDGEGAEWPLSRKFGCVPAMAKDVLRRAKALGLDAYGVSFHVGSQQTDLTAWDRALADAAAVFRTLADEGIILRMVNMGGGFPTRYLKDVPTAQAYGMAIFDALSRHFGNRIPETIIEPGRGMVGNAGVIKTEVVLVSRKADNDNVRWVYLDIGKFGGLAETMDEAIRYQIVTPHDGSETEPCVLAGPTCDSADVLYEKTPYPLPVSLTIGDEILIEGTGAYTTTYSAVAFNGFEPLRSYVI

SEQ ID NO: 47011 - protein, 430 aa, Arabidopsis thaliana
MITDLPKDLIEEILSRVSMTSMRVVRLTCKSWNTLSNSESFKKMHIGKVTSTREGESRVIMLIDYNLFLMSAVLMDDVDPSIEFKGKLSCLKEQVKISQVFHCEGLLLCILKDDTRIVVWNPYRQETRWIIPRYSHRPYVMNNIRYALGYENNKSGRSLKLLRFIDYCYTEKHICWHEIYDFDSDLWTTLDVTPHWYILSNWSCVQGVSLKGNTYWCAREENSDGYNHIICFDFTRERFGPLLPLPVNVIDNEYEYVTSSCVREGKIAALFQHNDSYPYELEIWITTKIEAEMVSWNKFLRIDIEPNNNIMVPFIYGGFFIDEEKKKVALGFDEEFGRKTFNIIGEDGYFREFDRITFNIIEEAGERAGVNCGSYVCSYVPSLVRIKKPAQGKRKRQSSLEKLRFDQNTWIFDSIYQATASQIRRRRPTR

SEQ ID NO: 47012 - protein, 436 aa, Mycobacterium sp. MCS
MSIPVPALTPEQIRALDAAHVWHPYSTIGAGALPPVVALAAKGVWITIDHPAGGGPVDVIDAMSSWWTAIHGHGHPVLDAAITRQLATMNHVMFGGLTHEPAVRLAQLLVHITPPGLDTVFFSDSGSVSVEVAVKMALQYWRAAGRPGKTRLMTWRGGYHGDTFTPMSVCDPDGGMHSLWTDVLTRQVFAPPVPRDYDPGYVAAFERRLAEHADELAAVIVEPVVQGAGGMRFHDPRYLSDLRTLCDRHGVLLVFDEIATGFGRTGELFAADHVGVSPDIMCVGKGLTGGYLTLAATLCSAEIARVISTGEAGALMHGPTFMANALACAVGVAAVELLLAGDWRSTIATIERGLTEGLAPAREVSGVADVRVLGAIGVVELDRPVDMATATAAALSHRVWLRPFRNLVYVMPPYICTPEEIAQITSAVVGVARALA

SEQ ID NO: 47013 - protein, 151 aa, Brassica napus
  misc_feature (109)..(109): Xaa can be any naturally occurring amino acid
VDHASGPVFICSSDSIKPPCKFPSHSEDCPASYKPNSSQDGPVYVIVIENDKMSVQEFPASSTVSDLLSGAGPGSSRWSMYGIPAKEELRPRLNQRPVSDLKWKLKMGXDVVELTPPIPDESLPEYREEIQRMYDRGLAFSRPGTMVGWGS

SEQ ID NO: 47014 - protein, 722 aa, Mycobacterium sp. MCS
MTVVTPGSGPTSPTLHTVWPGEAYPLGATYDGAGTNFSLFSEVAERVELCLIAKDGSEERINLDEVDGYVWHAYLPTVTPGQRYGFRVHGPWDPSAGHRCDPSKLLLDPYGKSFYGDFRFGQALYSYDLDAEDLASGGDPPRIDSRGHTMTSVVINPFFQWGSDRAPRTPYHDTVIYEAHVKGMTRRHPAVPAELRGTYAGLCHPAIIDHLKSLNVTAIELMPVHQFMHDHRLLDLGLRNYWGYNTFGFFAPHNEYAANQHAGGAVAEFKAMVRSFHAAGIEVILDVVYNHTAEGNHLGPTVNFRGIDNAAYYRLLDGDLRLYKDFTGTGNSLNARHPHTLQLIMDSLRYWVLEMHVDGFRFDLASTLAREFYDVDRLSAFFDLVQQDPVVSQVKLIAEPWDIGEGGYQVGNFPGLWTEWNGQYRDTVRDYWRGEPATLGEFASRLTGSSDLYEATGRRPSASINFVTCHDGFTMHDLVSYNEKHNEANGEDNRDGESHNRSWNCGVEGPTDDPDVIALRGKQMRNMLATLMCSQGTPMIAHGDEIGRTQQGNNNVYCQDSELSWMDWSLCETNADLLEFTRKVVAFRKNHPVFRRRRFFEGKPIRSADQVRDIAWLTPAGTEMTPEDWGTGLGKCVAVFLNGEAIPAPNARGERVVDDSFLLCFNAHDHVQDFVTPDGDYAEMWTADLDTADPTGHTDVVVPAGEKISLQPRSLLVLRKTA

SEQ ID NO: 47015 - protein, 357 aa, Nostoc sp. PCC 7120
MRKRIGILTSGGDCPGLNCVIRAVVSHATLTYDWEVLGIPYATQGLRERQAIALNMHGWDLRGIDPLLNMGGTILGTINKGDTLAHVDEMLASYQALALDALIVIGGDGSLGILHELASRGNWNLVAIPKTIDNDVALTERAVGFDTAVNTIVDALNRLTFTAASHDRVMIVEVMGRSAGHLALHAGIAGGADVILIPEISYTISGLCQHIAELRDRWQRKFAIVVVAEGAKLCLEDVQENIASSCAPSKCGRGQYIADQIAQCSKNLIDTRVSVLGHIQRGGIPSALDRLTATVFGKTAVDLIAQGKFGQMVAWQNGEAIPVPIQDVVAQSPLHVNPQGSLVQSARCLGIYVGEKT

SEQ ID NO: 47016 - protein, 505 aa, Oryza sativa
MGHELWVLWATLAVSLLCYLYLTSHRLGSRRRRWPPGPRPLPLLGNLLDLRGGNLHHTLARLARAHGAPVMRLQLGLSPAVVISSPGAAREAFTAHDRRLAARAVPDANHALGFCDRSMIWLPSADPMWRTLRGVVAAHAFSPRALAAARAVHERKVRDLVAYLRGRAGREVDVKDAVYGGVLNLVSSALFSADVVDVGGESAQGFRELVEELIESIAKPNVSDLFPFLRPFDLQGWRRWTSGHLAKIYKVLDDIIDRRTAEDDAAMDKRGDFLDVLLELMSTGKIAREYLTNILFDVFTAGSDTMSLTVVWAMAELLRNPGVMAKARAEIDAALGGREAVEEADVARMPYVQAVLKEAMRLHPVAPVMLPRKAAEDGVEIGGFEVPRGCAVIFNTWAIMRDPAAWERPDEFVPERFVGRSRATEEMDFRGKDFGFLPFGSGRRLCPGVPMAERVLPLIMASLLHAFEWRLPDGMSAEQLDVSEKFTTANVLAVPLKAVPVVIAC

SEQ ID NO: 47017 - protein, 312 aa, Brassica napus
MASSLTAAGTQPSAPSFSGLRRTCLKLEAAVSFSHRVNSSIRLVSSSQRSPRGVVAMAGSGKFFVGGNWKCNGTKDSITKLVSDLNTATLEPDVDVVVSPPFVYIDQVKSSLTDRIEISGQNSWVGKGGAFTGEISVEQLKDIGCKWVILGHSERRHVIGEKDEFIGKKAAYALSEGLGVIACIGEKLEEREAGKTFDVCFDQLKAFADAVPSWDKVVVAYEPVWAIGTGKVASPQQAQEVHVAVRDWLKKNVSEEVASKTRIIYGGSVNGGNCAELAKEEDIDGFLVGGASLKGPEFATIVNSVTSKKVAA

SEQ ID NO: 47018 - protein, 403 aa, Oceanicola granulosus HTCC2516
MAHFVVIGAGQAGASLVAKLRAEGFEGDVTLIGAEPVPPYQRPPLSKAYLLGEMEESRLYLRPRGWYDAHDVTLRTATRAVGIDPEAKVVTLQGEEPLPYDELALTTGSNPRVLPADIGGDLERVYCMRDLQDADALAPELVAGRRVLVIGGGYIGLEAAAVAARKGLHVTLVEMAPRILQRVAADVTSDFFRALHAGHGVDVREGVGLDRLLGTDAVTGARLTDGTELDVDFVVVGVGIAPASILAESAGIACDNGIRTDEFGRTSAPHVWAAGDCASFPYRGGRIRLESVGNAIDMAETVARNMLGQQVPYDARPWFWSDQYDCKLQIGGLNMGFDNVHVKQGEGGAVSHWYYRGAELIAVDAMNDARNYMIGKKLIEMGKSPPPEVVVDPATDMKALLKA

SEQ ID NO: 47019 - protein, 493 aa, Ostreococcus tauri
MRGRHRSERLRSSPATSRPRAPQSRSRTSSARAWDDKRVGFAMEGFYVLTFIALAIGCAGIELSKRPSGKGAAGNLPANFLAFRNNYLVVYALMMAGDWLQGPYVYALYKHYGYGTGDIGKLFIAGFGSSMIFGTIVGSLADRYGRKLAGLTYVVTYIASCITKHWSDYGVLMLGRFFGGIATSLLFTAFESWLVSEHFSRSYDPEWLSGTFSKAIFIGNGLVSIIAGLLANYLVTDMELGPVAPFDAAATFLAVGGVIIALTWTENKGDVKDNASLQASFHAAWKAIFNDKKVLYLGAMQSLFEAAMYSFVFLWTPALSPNDEIIPHGMIFATMMVACMIGSSFAGQLLGDKDMRPEKYMQYVFLASAASLALPVVLKMFPFEQNYSSGQSITFEGKLIMMGFLVFECLVGIFWPSMMKMRATYVPEEIRSTVMNCFRIPLNLFVCVILYNVALFPLTSMFAMCSFFLIAAAYLQRKLEIITSVPTRGQTHV

SEQ ID NO: 47020 - protein, 131 aa, Secale cereale
MGGCVGKGRSIVEEKLDFKGGNVHVITTKEDWDQKIEEANKDGKIVVANFSASWCGPCRVVAPVYAGMSKTYPQLMFLTIDVDDLMDFSSTWDIRATPTFFFLKNGQQIDKLVGANKPELEKKVQALGDGS

SEQ ID NO: 47021 - protein, 184 aa, Saccharophagus degradans 2-40
MLSPEPKLKPEVKRPNLVVVMGVSGCGKSTIAQKIADTLSYRYLEADDYHSEEAKSRMASGIPLTNEMRKPWVRSICGHLRQLARLHIDCTLAFSGLRKEHRDQIREAGYNTIFVFLNGDKNTIKRRMDTRANHFMPTKLLDSQFDTLERPVNEDDVIAVPIDVPVGDVVTSSLKSISKKLLTT

SEQ ID NO: 47022 - protein, 335 aa, Xylella fastidiosa Dixon
MTQTITVIRGDGIGPEIMDATLSVLNALQANLNYEFADAGLSALEKHGDLLPEATLNSISKNKIALKSPLTTPVGEGFSSINVALRRKFDLYANVRPAKSFPNTKSRFSDNVDLITVRENTEGAYLSEGQTISPDGEVATSSARVTRKGSERIVRYAFDLARTTGRKKVTAVHKANIIKSTSGLFLKTARDVASQYPEIDFQEMIVDNTCMQLVMRPEQFDIIVTTNLFGDILSDLCAGLVGGLGLAPGANIGNEQAIFEAVHGSAPDIAGQGKANPCALLLGAVQMLDHIGQPQNAERLRNAIVATLNAKDSLTPDLGGNGNTMGFAKAIASRL

SEQ ID NO: 47023 - protein, 809 aa, Arabidopsis thaliana
MAATSPRPPPSTSLTSQQPPSPPSQLPLRTMPGSAEKYKSTVFRTNIPPTFPFFGNVNPNIVAVLDVKSFSHLFDMDLVDKRDVLIGDFRPSLGFYGGVRVGVYLDTTEPKHAKIKGFAMETLKRSSKVWLQELRSNLNIFWGTIESEISKNGAASYIFPLQRCIFSFLCASLAGVDASVSPDIAENGWKTINTWLALQVIPTAKLGVVPQPLEEILLHTWPYPSLLIAGNYKKLYNFIDENAGDCLRLGQEEFGLTRDEAIQNLLFVLGFNAYGGFSVFLPSLIGRITGDNSGLQERIRTEVRRVCGSGSDLNFKTVNEMELVKSVVYETLRFSPPVPLQFARARKDFQISSHDAVFEVKKGELLCGYQPLVMRDANVFDEPEEFKPDRYVGETGSELLNYLYWSNGPQTGTPSASNKQCAAKDIVTLTASLLVADLFLRSKTSKTETQQPSSYGQQQDAMYSSYGTVSDEVLLQIHGCRAHLINGSEAVELAAGDFELVQVLDSNVALAMVVRIGNDLQWPVIKDEPVVKLDSRDYLFTLPVKDGEPLSYGITFFPIDENDIVFVNSIELLDDFLRENSCFSSSPSSSSSSSSSSSSSVNNGIDWKEFAPKIEDYNNVVAKAIAGGTGHIIRGMFKCSNAYTNQVHKGGEIMITKAEKKNGASSKRNATTNKNQINKNLQRATEKLSKTMLNGVGVVSGSVMGPVVKSKPGKAFFSMVPGEVLLASLDALNKLLDAAEAAERQTLSATSKALQEWLVRGESAGEATKDVLGTVGHAAGTAWNVFNIRKAFSPSSSVTSGILKNASRK

SEQ ID NO: 47024 - protein, 131 aa, Lolium perenne
MGGCVGKDRSIVEDKLDFKGGNVHVITTKEDWDQKVAEANKDGKIVVANFSASWCGPCRVIAPVYAEMSKTYPQLMFLTIDVDDLMDFSSTWDIRATPTFFFLKNGQLIDKLVGANRPELEKKVQAIGDGS

SEQ ID NO: 47025 - protein, 388 aa, Bacillus cereus E33L
MIKNPKVLILTAHYGNGHVQVAKTLEQTFRQKGIKDVIVCDLFGESHPVITDITKYLYLKSYTIGKELYRLFYYGVEKIYDKKIASWYANFGRKRLKLLLQAEKPDIVINTFPIIAVPELKKQTGISIPVYNVLTDFCVHKIWIHREVDRYFVATDHVKKVMVDIGVPAEQIVETGIPIRSSFELKINPDIIYNKYQLCKNKKILLIVAGAHGVLGSVKELCQSFMSVPDLQVVVVCGKNEALKQDLVGVQETNPDALKVFGYVENIDELFRVTSCMITKPGGITLSEAAALQVPVILYKPVPGQENENAMYFERKGAAVVIRDDSEVFAKTEALLKDDMKLLQMKEAMKSIYRPEPADHIVDTILAENHVEPNHIPIKSPALAQSFT

SEQ ID NO: 47026 - protein, 131 aa, Phalaris coerulescens
MGGCVGKDRGIVEDKLDFKGGNVHVITTKEDWDQKIAEANKDGKIVVANFSASWCGPCRVIAPVYAEMSKTYPQLMFLTIDVDDLVDFSSTWDIRATPTFFFLKNGQQIDKLVGANKPELEKKVQALGDGS

SEQ ID NO: 47027 - protein, 474 aa, Bacillus subtilis
MATEYDVVILGGGTGGYVAAIRAAQLGLKTAVVEKEKLGGTCLHKGCIPSKALLRSAEVYRTAREADQFGVETAGVSLNFEKVQQRKQAVVDKLAAGVNHLMKKGKIDVYTGYGRILGPSIFSPLPGTISVERGNGEENDMLIPKQVIIATGSRPRMLPGLEVDGKSVLTSDEALQMEELPQSIIIVGGGVIGIEWASMLHDFGVKVTVIEYADRILPTEDLEISKEMESLLKKKGIQFITGAKVLPDTMTKTSDDISIQAEKDGETVTYSAEKMLVSIGRQANIEGIGLENTDIVTENGMISVNESCQTKESHIYAIGDVIGGLQLAHVASHEGIIAVEHFAGLNPHPLDPTLVPKCIYSSPEAASVGLTEDEAKANGHNVKIGKFPFMAIGKALVYGESDGFVKIVADRDTDDILGVHMIGPHVTDMISEAGLAKVLDATPWEVGQTIHPHPTLSEAIGEAALAADGKAIHF

SEQ ID NO: 47028 - protein, 478 aa, Pseudomonas putida
MTQKFDVVVIGAGPGGYVAAIKAAQLGLKTACIEKYTDAEGKLALGGTCLNVGCIPSKALLDSSWKYKEAKESFNVHGISTGEVKMDVAAMVGRKAGIVKNLTGGVATLFKANGVTSIQGHGKLLAGKKVEVTKADGTTEVIEAENVILASGSRPIDIPPAPVDQNVIVDSTGALEFQAVPKRLGVIGAGVIGLELGSVWARLGAEVTVLEALDTFLMAADTAVSKEAQKTLTKQGLDIKLGARVTGSKVNGNEVEVTYTNAEGEQKITFDKLIVAVGRRPVTTDLLAADSGVTIDERGYIFVDDYCATSVPGVYAIGDVVRGMMLAHKASEEGIMVVERIKGHKAQMNYDLIPSVIYTHPEIAWVGKTEQALKAEGVEVNVGTFPFAASGRAMAANDTGGFVKVIADAKTDRVLGVHVIGPSAAELVQQGAIAMEFGTSAEDLGMMVFSHPTLSEALHEAALAVNGGAIHVANRKKR

SEQ ID NO: 47029 - protein, 457 aa, Antirrhinum majus
MGEEYKKTHTIVFHTSEEHLNSSIALAKFITKHHSSISITIISTAPAESSEVAKIINNPSITYRGLTAVALPENLTSNINKNPVELFFEIPRLQNANLREALLDISRKSDIKALIIDFFCNAAFEVSTSMNIPTYFDVSGGAFLLCTFLHHPTLHQTVRGDIADLNDSVEMPGFPLIHSSDLPMSLFYRKTNVYKHFLDTSLNMRKSSGILVNTFVALEFRAKEALSNGLYGPTPPLYLLSHTIAEPHDTKVLVNQHECLSWLDLQPSKSVIFLCFGRRGAFSAQQLKEIAIGLEKSGCRFLWLARISPEMDLNALLPEGFLSRTKGVGFVTNTWVPQKEVLSHDAVGGFVTHCGWSSVLEALSFGVPMIGWPLYAEQRINRVFMVEEIKVALPLDEEDGFVTAMELEKRVRELMESVKGKEVKRRVAELKISTKAAVSKGGSSLASLEKFINSVTR

SEQ ID NO: 47030 - protein, 168 aa, Oryza sativa (indica cultivar-group)
MASRRRDLGRPLLVALCVVALFAVGSESHGLEDFREGNTEATPAMASFFGSKPEAAELPEALDASNAAAATAKPEAACKQAGIIKQWLLVSAVISVITQQLVAVVTVIPQKKNWIRATLSRIGEVKRVTKETNVHVKINLDGTGVADCSTGIPFLDHMLDVPVFTHAA

SEQ ID NO: 47031 - protein, 137 aa, Oryza sativa (japonica cultivar-group)
MAARVEARGFIFGPPIALAIGAKFIPLRKPNKLPGEVMSKEYELEYGADCLEMHVGAVQPGERALVVDDLVATGGTLCAAIVLLERAGAEVVECACVIELPELKATESVASHTCLTLPKGRERLNGKPLYVLVESHS

SEQ ID NO: 47032 - protein, 271 aa, uncultured archaeon GZfos24D9
MKVKDVMSGPVITEDEDTSITIIARDMELSEIGSVVITREDKAVGIVTDRDISIKICANMGTPGEVTAKGIMSSPLITIGPEAPVETACGLLAETDIRRLPVMENDKLVGIISVRNILTGAPEYVQRFYPAEGELVPEQLEVGDVMTVEVITVDEDTVVSKISKDMEESEIGGVVITRGGKPIGMVTDRDIASKVIMEDKKASEIKAKAIMSSPLITIGPDASVEKACGIMAAKDIRRMPVMDEDKLVGIISVRNILTRSPGHVYKFYPGE

SEQ ID NO: 47033 - protein, 453 aa, Arabidopsis lyrata subsp. petraea
MESSISQTLSKVSDPTTALLIVVSLFIFIGFITRRRRPPYPPGPRGWPIIGNMLMMDQLTHRGLANLAKKYGGLCHLRMGFLHMYAVSSPDVARQVLQVQDSVFSNRPATIAISYLTYDRADMAFAHYGPFWRQMRKVCVMKVFSRKRAESWASVRDEVDKMVRSVSCNVGKPINVGEHIFALTRNITYRAAFGSACEKGQDEFIRILQEFSKLFGAFNVADFIPYFGWIDPQGINKRLVKARNDLDGFIDDIIDEHMKKKENQNAVDDGDVVDTDMVDDLLAFYSEEAKLVSEAADLQNSIKLTRDNIKAIIMDVMFGGTETVASAIEWALTELLRSPEDLKRVQQELAEVVGLDRRVEEADIEKLTYLKCTLKETLRMHPPIPLLLHETAEDTSIDGFFIPKKSRVMINAFAIGRDPTSWADPDTFRPSRFLEPGVPDFKGSNFEFIPFGS

SEQ ID NO: 47034 - protein, 335 aa, Nocardia farcinica IFM 10152
MKLAVIPGDGIGPEVIAEALKVLDVVVPGVEKTEYDLGAKRYHATGEILPDSVLPELREHDAILLGAIGDPSVPSGVLERGLLLRTRFELDHHVNLRPSRLFTGVRSPLAGAPDIDFVVVREGTEGPYTGTGGAIRVRTPHEVATEVSTNTRFGIERVVRYAFAKAQARRKHLTLVHKTNVLTFAGSLWQRTVDEVGAEFPEVTVAYQHIDAATIHMVTDPGRFDVIVTDNLFGDIITDLAAAVSGGIGLAASGNIDASGTNPSMFEPVHGSAPDIAGQSKADPTAAILSVSLLLNHLGDTEAAARIDAAVAKDLAARSGTASTVEIGDRIAAAV

SEQ ID NO: 47035 - protein, 378 aa, Arabidopsis thaliana
MEVCGDLKSDNLKNRPLTPLRILRGLMILLVFLSTAFMFLLYFAPIAALGLRLLSVQQSRKVVSLIFGLWLALWPYLFETVNGTTVVFSGDIIPVEKRVLLIANHRTEVDWMYLWNIALRKGCLGYIKYVLKSSLMKLPIFGWGFHVLEFIPVERKREVDEPVLLQMLSSFKDPQEPLWLALFPEGTDFTEEKCKRSQKFAAEVGLPALSNVLLPKTRGFGVCLEVLHNSLDAVYDLTIAYKPRCPSFMDNVFGTDPSEVHIHVRRVLLKEIPANEAESSAWLMDSFKLKDKLLSDFNAQGKFPNQRPEEELSVLKCIATFAGVISLTVVFIYLTLYSHSCFKVYACLSGTYLTFATYYKFQPSPGCFREDSCKVKNH

SEQ ID NO: 47036 - protein, 339 aa, Oryza sativa
MESVVVAGDLAAAPAPATPMWFVALVAVGLHAAVVWAGTFLAWLRRAFLRPGKGLCRRYGEWAVVTGATDGIGRAVALELARRGLHLVLVGRNPGKLSGVCKEVRAAAPACKVRTVVFDLAAPGDDDVGGGELSRGVARVAAAVEGLDVGLLVNNAGATYPCAAYFHEVPDAVWGAVLRVNVVAATRIARALVPAMAAKGRGAVVNVGSGSSVVVPAFPLYAVYAATKAYVDQLSRSLHVEYKHHGVDVQCQIPLYVATKMSPVQGNSPFIPSPEEYAKAAVRCIGYEPRCVPYWRHSIQWFFASLLPDSVLNLWRLQVGIRKRNQMKVLLGESDHGFS

SEQ ID NO: 47037 - protein, 451 aa, Novosphingobium aromaticivorans DSM 12444
MAVSDHVDLPTFMEGVKKRNPYQPEFVQAVQEVAEDIFDFIEDKEEYHAQQILRRIAEPDRVVSFRVCWEDDNGNVRVQRGWRVQNNNAIGPYKGGIRFHPSVNESVLKFLAFEQTFKNALTGLPMGGGKGGSNFNPKGKSVREIMRFCQSFMTELYRHIGADVDVPAGDIGVGGREIGYMFGQYKRITNHFTGVLTGKGLEWGGSLIRTEATGYGAVYFLANMLATKGEDLRGKTAVISGSGNVATHAAEKIVQLGGKVLTLSDSGGFIHDPDGIDQEKIDWVKTHKTHRRGRIEEYVDAFPGASFHAGKTPWGVPCDVALPCATQNELLGEDARTLIANGCKGVAEGANMPTDLEGVHVFKAARILYAPGKASNAGGVAVSGLEMSQNSERRSWKEHELQQMLKDIMAGIHKSCLTYGDQGGGYIDYVKGANIAGFKKVADAMLAFGVV

SEQ ID NO: 47038 - protein, 1608 aa, Solanum lycopersicum
MPATTTRRTVDVGGSSIVNTVTADSFCKDGRKIRVGDCALFKPPHDSPPFIGIIRRLRLGKDNNLQLGLNWLYRPAELKLSKGILLDTTPNEIFYSFHRDETPAASLLHPCKVAFLPKGAELPTGISSFVCRRVYDISNKCLRWLTDRDYNNEQQKEVDQLLYKTQVEMHATVQPGGRSPKPMNGSISSSQLKTGSDNIQSSVASFPSQVKGKKRERGEQGSESIKRERSVKSDDSESVLKSEISKITEEGGLVDCEGAAKLVQLMQPDRVDRKMDLTSRSMLASVVAATDKFDCLARFVQLKGLPVLDGWLQDVHRGRIVEVSNSKDGDISIEEFLLVLLRALDRLPVNLQALQMCNIGKSVNHLRQHKNMEIQRKARSLVDTWKKRVEAEMNMIDSKSGSNQAVTWPSKARLPEASHSGEKNAGGSTDATRSSVTQFSASKTTSIKPTPVETNMKSACSSPGPIKQASPPSSGKVGQPRISAFGSSDVPLAREDKSSSSSQSHNHSQSLSGKEDARSSTAVSMSSIKISSGGSRHRKSINGGPGPSVSAGQKEGSTNRSSSLHRNPTTEKSLQSALSGEKTVDVPAVEGSCHKLIVKIPNKGRSPARSVSGGSCEDPSIMSSRASSPVLSEKNDQLDRNSKEKKDAYRSDVTINVNTESWQSNVLKDVLTGSDEGDGSPVAVLEEERRKTAGEGRKSAEVAKPGSSSSGTELKSGKLHEASFSSMNALIESCAKYSEANASMSLSDAVGMNLLASVATEEMSKSGRVSPFVSPQGDSPSGGETCTGDELKPKTSPVDSSSGNHSGRNDGDANGDKEKQFVVANTSWSEGKVHANRSAMTDFNRERRPSSSPSEETTTGECFNSSCTDSQMAGNLKSGVNEKLVEMAKSAAAPCNVFEKASDGEQSRQFHEEKVISTKTLDNVLDGESGGHGSSIGEDKVTNGLVSIEGLKRPVGISAFKYEGDDKNDVSRVLGVASTEVKPPSVVVKSEATERGDKEELQQTGSSRDTIAGKGGHSDEMDANSVLKSEQPNSDKKTVDTSVIEDKAASECNLAIRNLTKDEPKAEEMTKHDSGSGLLTKKETPGFSNAEVENLESRESKYSGVEADRPKECVSIKGENSSSSAAAAPDSASKMKFDLNEGFISDEGKYGESINSTGPGCLSNVQIMSPSTFAVSSVSSSLPASITVAAAAKGPFVPPEDLLRVKGEFGWKGSAATSAFRPAEPRKPPDMHSNSMTISVTEASSSKHGRPPLDIDLNVADERVLEDINSQDCALAIGSAVDHITNLVSSKNKCSGPLRSFGGLDLDLNRVDEPNDVGQCSLSSSHRLEGAVFPARASSSSILPTAEVRRDFDLNNGPGVDDSCAEQPLFHQSHQGNMRSQLNASSLRMNNPEMGNLSSWFAPGNSYSTMTIPSMLPDRGEQPPFPIIPPGAPRMLGPSAAGSPYTPDVFRGSVLSSSPAMPFPAAPFQYPVFPFGTTFPLPSGTYAVGSTSYIDSSSGGRLFTPPINSQLLGAVAPQYPRPYMVSLPDANSNGATDHNRKRSRQGLDLNAGPGAVDLEGKEESVSLVTRQLDEHGRMYPVAGGLLKRKEPEGGWDSESYRFKQSPWQ

SEQ ID NO: 47039 - protein, 452 aa, Geobacillus kaustophilus HTA426
MSKSFVSSTQTGLLEQIKETIQQKNVELLHLQFVDIEGILKHVTVTAEQLDDVVEGKIMFDGSSIKGFSPINRSDLYLLPDLNTFAVLPWTVEEGYAEARFLCSVTNPDGTLFEGDPRNVLKKTVERAAEKGYAISVGPELEFFLFKADENGNPTLELHDGGGYFEPSPKDLGERVRLEIYRALKAMGFTIEASHHEVAEGQHEINFKYADALGAADNATTYKWVVKTIASKFGLHATFMPKPVFGINGSGMHVNISLFKDGENAFFDPNDANQLSETAYQFIAGLLKNVKHFAAVTNPLVNSYKRLVPGYEAPCYIAWSASNRSALIRIPAKRGVATRVELRCPDPSANPYLAYAIIAAAGLDGVEKGLTAPAPIDEDIFHMSEERRAELGIDNLPENLGEAIAAFESGDIGRATLGEHVFNEYVAMKKDEWNSYRTAVHAWEVERYQGKF

SEQ ID NO: 47040 - protein, 361 aa, Burkholderia mallei ATCC 23344
MSEKVYRIAVIPGDGIGVEVMPEGLRALDAVSRRFGLRFAYEPIEWASCDYYAKHGQMMPDDWKTQLSGMDALLFGAVGWPETVPDHISLWGSLIKFRREFDQYVNLRPARLFDGVPCPLAGRKAGDIDFMIVRENTEGEYSAVGGTMFEGTEREFVVQQAVFTRHGTERVLKFAFELAQRRAKRLTVATKSNGIAISMPWWDARAAEMAARYPDVTWDKQHIDILCARFVMQPDRFDVVVASNLFGDILSDLGPACTGTIGIAPSANLNPERNFPSLFEPVHGSAPDIAGKHIANPIAMIWSAAMMVDFLGAGTGRAREAHDAIVAAIEHVLKHGPRTRDMGGRASTREVGDAIVAHLLG

SEQ ID NO: 47041 - protein, 443 aa, Oryza sativa (japonica cultivar-group)
MKLTVKTLKGTQFEIRVQPNDTVSLGDDNSIQNQYLKPWVQQGFRYLFLVCYVFYNYSKNGSATYITVPGFFCLYTMEQIMAVKKIIEEIQGKDSYPWGQQLLIHNGKVLKDESTLEENKVSEVGFLVVMLSKSKASGSSGALSSLTSSTPLTRQETPADASRAAPQPLVAPTRTPQPERPPAEAPSNAYGQAASNLLSGSNLDTTINQLMEMGGGSWDRDKVQRALRAAYNNPERAVEYLYSGIPITAEVAVPAGGQGANTTEPSSTREASLSGIPNASPLNLFPQQGDANDGGGAGGGTLEFLRHNQQHTLSSFVLEQRTTLYGFQALREMVHTNPQILQPMLQELSKKNPQLLRLIQENHDEFLQLINEPFDGADGDFLDQPDQDEMPHSINVTPEEQEAIGRLEGMGFDRARVIEAFFACDRNEQLAANYLLEHAADED

SEQ ID NO: 47042 - protein, 548 aa, Triticum aestivum
  misc_feature (229)..(229): Xaa can be any naturally occurring amino acid
MEGGKPSTQRHSSGAVRPIVLVVVAVSLVVVLFMATRVSPGCRPLLKAVYQQGLGRAGPSATADPLLGGLLSPDFDDRSCLSRYRASLYRQPSLHNLSSHLVSRLRRYESLHQLCGPGTPAYSRAVARLREAMDGHASSNSTSSSDTECSYIIWTPVEGLGNRILSTASAFLYALLTDRVLLVHHPADDLNDMFCEPFPGSNTTWVLPEEGFPIQGIKGLNVRTRESLXGNARGPLEGSRDPPAPWLYVHLQTDYKPDDRRFFCDDGQETLRGVRWLVLRSDNYFVPGLFFLPRYEEELVRLFPRRDTVFHHLGRYLFHPSNTVWGMATRYYSSYLAPAEERVGVQVREFKYARISADERYKQIISCASRESLLPAVENATLPSSASDHHQEQEQEQKKRKAVLIVSLNGDYYDKLSSLYYEHGAAAVTVSVFQPTHLGTQHSEKRQHNQKALAEIVLLSFSDVVVTSAQSTFGYVSQGLAGLRPWVLMLPVDGKVPDPPCRLASTIEPCFMKAPHYDCRTRGDSDNGKLVPYIRQCEDVSYGVQLVE

SEQ ID NO: 47043 - protein, 454 aa, Linaria vulgaris
MEDTIVFYTPSDHSQPTIALAKFISKHHPSISMTIISTAAFPSSAAVLPKTISYHPLPAVPMPPNLSSNPVEFLFEIPRLHNTKLREALERISETSKIKALVIDFFCNSAFEVSRSLNIPTFFEASLGASGLCEFLYHPTFHKTVPGDIADFNDFLEIPGCPPLHSADVPKGLFRRKTIAYKHFLDTANNMRMSSGILLHAFDALEYRAKEALSNGLCNPDGPTPPVYFVSPTVAETLAYRENTAALRHECLTWLDLQPDKSVIFLCFGRRGTFSMQQLHEIAVGLERSGRRFLWAIRSSGAGNGEPDLSVVLPEGFLERTKDIGLVITTWAPQKEVLSHVAVCGFVTHCGWNSVLEAVSFGVPMIGWPLYAEQRMNRVFMVEEIKVALPLEEEADGLVRATELEKRVRELTESVRGKAVSRRVEEMRLSAEKAVSKGGTSLIALEKFMDSITL

SEQ ID NO: 47044 - protein, 1379 aa, Oryza sativa (japonica cultivar-group)
MGCRALGPARFYWAVPGPIRMSSKKVPFHRHKENEEARKKREQDEAARVYEEFVESFKGDSTSGSKFVRGGVIDPNAKLRIDSEGGKSKDGGSVPKKGSRYVPSFLPPSFGKEPDKKKEEERPKEKERRKPRVIDEFMEELKFEKELRQKRNQEREQWREGRHTDTSASSSRFDELPDELDPIGKLPGSFDDGDPQTTNLYVGNLSPKVDENFLMRTFGRFGPIASVKIMWPRTEEERRRQRNCGFVAFMNRADGQAAKDEMEGVVVYDYELKLGWGKSVALPSQALPAPPPGHMAIRNKEGGTVILSGPGGPPLASVKPQTSELVLTPNVPDIVVAPPDDAHVRHVIDTMALHVLDGGCAFEQAVMERGRGNSLFSFLFDLKSKEHTYYVWRLYSFAQGSGDSILLEVNCDSKEGDTLQRWRTEPFIMITGSGRWVPPALPSSRSPEREKESTFAAGRSRRVEVERTLTDSQRDEFEDMLRALTLERSQIKEAMGFALDNADAAGEIVEVLTESLTLKETPIPTKVARLMLVSDILHNSSAPVKNASAFRTKFEAALPDVIESFNDLYRSITGRITAEALKERVLKVLQVWADWFLFSDAYLNGLRATFLRSSHLGVIPFHSLCGDTPEIEKKASSEDGSDGFRLNEDGALATGKAAATRELLGLPLAELERRCRHNGLSLCGGKEMMVARLLSLEEAEKERVYEKDAGIKYGQGESHRTGRDDIAVNARNASRPGEGTDSGESDMLGLSHYAMEAGYKRSNESTPAEPVPSKKPKVDPVLPASKWSREDDVSDDEDRKGGRGLGLSYSSGSDIAGDSGKADATEVSTDHSNHHQDTILDEEHRKKLRQIEIAVMQYRESLEEKGLRNTEEIEKKVASHRRRLQSEYGLSFSNDGANSRRSSERTSSDRRDRHDDSSRKRHRSLSRSRSPPRGSLERVREHNRNRDTDRSHGNDAGRERDRVREKSASRGRDDHYDRSRDREKDRRKGRLKVHYSHPLRLYNCILPVWSGLKCAKEKWMLRLETVSFCVLHGSSTDTCVMSVRFLFLFFSILLHQHWCFAYLLINMGIYLSTPKTDKFSEDGENDKLKLGLSSMQGWRANMEDAHSALLNLDNETSFFGVFDGHGGRVVAKFCAKYLHSQVLRSEAYSAGDLGTAVHRAFFRMDEMMRGQRGWRELSALGDKINKIGGMIEGLIWSPRGSDSNNGQDDWSFEEAYNLSRDHKPELEAERDRIVKAGGFIHMGRINGSLNLTRAIGDMEFKQNKFLPPEKQIVTANPDINVVELCDDDDFLVLACDGIWDCMSSQQLVDFIHEHIQKESSLSAVCERVLDRCLAPSTIGGEGCDNMTMVLVQFKKPITQNKKADVGEQSVKGVEEAEIK

SEQ ID NO: 47045 - protein, 670 aa, Candidatus Kuenenia stuttgartiensis
MKISAIQKETAELAVNTLKMLSADAVEKAQSGHPGLPMGCADVAFVLWTQFLQFNPEDPNWPNRDRFILSAGHGSMLLYSLLHLYGYDLSLDEIKQFRQLNSKTPGHPEYGHTPGVEVTTGPLGQGFANGVGMAIAERLLAARFNKVGKKIIGHTIYGVVSDGDLMEGISSEAASIAGHLGLSNIIYLYDNNHITIEGNTSLAFTEDVAKRFEAYSWKVFKIDGHNHNEIANAIQSAQNEKERPSLIIATTHIGKGSPNKQNNASAHGEPLGEKELALTKENIGWPKTPTFYIPDEVRQLCANRVKELKDVYENWQNAFHTRLKEDPDFSGEWNAYMNKAIPDNLESKLLETIKKDSVATRAASGDMMQIIAQQIPSFIGGSADLNPSTKTFIKGSPAISKNSFIGKNIHFGVREHAMGAVLNGMALYGGIIPHGSTFLIFSDYMRPSIRLAALMKLQVIYVFTHDSIFLGEDGPTHQPIEQLPSLRLIPNLLTIRPSDATETAAAWITALNHKNGPTALILTRQNIPVIDRSVYPSSEGLKHGAYILKDSMGTPDIILMASGSEVSIALEATLKLQEKGVAARLVSFPCLELFRNNPEAYKDNILPPSCTRRVSIEAAAKGIWHEFTGINGLIIGIDHFGASAPAKALAEHFGFTTKNILNEIEKKWGI

SEQ ID NO: 47046 - protein, 1489 aa, Gibberella zeae PH-1
MALPEANMSSTRSEQSSRSHDTIVGNEQPHSEKPAASAPGDQMSSDDEDEGPQTEEMIRRHSIVRDLARNYTNTSHHFTGSSADLFNAADANSPLNPSSENFNARAWARAMAKTMGENGSGFRQSGLCFQDMNVFGYGAETDYQKDVGNVWLGLPDMVHQMISPNANKRRIDILRGFDGVINAGEMCVVLGPPGSGCSTFLKSISGETNGIYIDDSTYFNYNGIPAEEMHKSHAGETIYTAEVDIHFPMLSVGDTLTFAARARCPQNLPPGIDHNLYSEHMRDVVMAMYGISHTINTQVGDNYIRGVSGGERKRVTIAEATLSNAPFQCWDNSTRGLDSANAIEFCKTLRLQSELFGQTCAVSIYQAPQTAYDLFDKALVIYEGRQIFFGPADEAKAYFINLGFECPDRQTTPDFLTSMTAPSERVVRPGWENKVPRTPDEFHARWKESQQYQIVRAEIESYKSLYPLNGSSADAFRENKHSAQAKGQRLKSPFTLSYMQQVQLCLWRGFRRLLGSPGVTIFQLIANTAVAFIASSLFYNMKPETGDFFKRGATLFLAVLSNAFASALEILTQYSQRPIVEKQARYAFYHPSAEAFASILVDMPYKITNSILFNVTLYFMTNLNRDAGAFFFFLLVSFIMVLAMSGVFRSIASLSRTLSQAMVPASLLILALVIFAGFVVPVDYMLGWCRWINYLDPVAYGFESLMVNEFSGRNFTCTAFVPNAQIPGYADVGGLNRACSTVGAIPGQSYVNGDAYINLEYKYFHAHKWRNVGILIAMTIFNHVVYIVATEFISAKKSKGEVLVFRRSNMPSKAKSDPEASSSRPIPTTEKNNNEVANIQGSTSVFHWNDVCYDIKIKGEPRRILDHVDGWVKPGTLTALMGVSGAGKTTLLDCLADRISMGVITGEMLVDGKIRDSSFQRRTGYVQQQDLHLETSTVREALTFSALLRQPASTPREEKIAYVDEVIKLLDMQEYADAVVGVLGEGLNVEQRKRLTIGVELAAKPPLLLFVDEPTSGLDSQTSWAILDLLEKLSKAGQSILCTIHQPSAMLFQRFDRLLFLAKGGRTIYFGDIGKNSETLTNYFVKHGSQECPNGENPAEWMLEVIGAAPGSHTDIDWHQTWRDSSEYQAVQTELQRLKAEGSANSVDQKSDPESYREFAAPFGQQLLIATKRVFEQYWRTPSYIYSKAALCIQVGLFLGLVFLNAPLSLRGLQNQMFAIFQMLTVFGQLVQMQMPHFVTQRSLYEVRERPSKTYSWKVFMLSQIIAEIPWNTLMSVFLFVCIYYPVGFNKNAEFAGQTAERGGLMWLLIWQFLIFTCTFAHAAIAITDTAEAGGNLANVVFMMSLFFCGVLAAPDKMPGFWIWMYRVSPFTYLVSAILSTGIANAEVKCAANELTTFNPTNGTTCGEYMDSYIKAAGGYLTNPDATSDCKFCTIKSTNVYLKALSASYDDRWRNFGIGMVYIVVNIVGALFLYWLIRMPKNKNKKKTA

SEQ ID NO: 47047 - protein, 428 aa, Xanthomonas campestris pv. campestris str. 8004
MTDPQWKPETIAVHGGYRPDPTTRAVAVPIYQTVAYAFDDTQHGADLFDLKVQGNIYSRIMNPTNDVLEQRVAALEGGIGALALASGQAAVTYAIQTIAEAGDNIVSSSALYGGTYNLFAHTLPQFGITTRFADYRDPQAFAGLIDERTKAVFVESIGNPRGNITDIEAVAAVAHAHGVPLIVDNTVATPSLLRPIDFGADIVVHSLTKYLGGHGNSIGGAIVDSGRFPWAAHKARFACLNEPDVSYHGVVYTEALGEAAYIGRARVVPLRNTGAALSPFNAFLILQGIETLPLRMERINANTLAIARYLQEHARVAWVNYAALPDHPEHALAQKYLGGHGSGVLTFGLPGGRAAGARFLDALQLFTRLVNIGDAKSLATHPASTTHRQLGPAELEHAGVSEDTVRLSIGIEHIDDLLADLEQALQGA

SEQ ID NO: 47048 - protein, 321 aa, Oryza sativa (indica cultivar-group)
MTTARFGVPLPLARVPLAGRPSLRVVVVVQGWGRPPRSAARSLAPPEAACYGLRRRRRERLSFRAGGLHRWILRRRLGFCSVALHVICYHAMLDISTSTLSRIGEVKRVTKETNVHVKINLDGTGVADCSTGIPFLDHMLDQLASHGLFDVCVKAKGDTHIDDHHSNEDIALAIGTALLEALGDRKGINRFGHFTAPLDEAAVEVILDLSGRPHLSCGLSIPTERVGTYDTQLVEHFFQSLVNTSGMTLHIRQLAGKNSHHIIEATFKAFARALRQATEYDLRRRGTVPRLQYSKETNGMASTAPRFLLTLGISVGCDNRT

SEQ ID NO: 47049 - protein, 561 aa, Aspergillus nidulans FGSC A4
MAQKYKLKDISSLTGINNFDKVEAEVEGVQDGKVLLVKYEDKVHAISPKCTHYGAPLKNGVVSPEGRITCPWHGACFNVKSGDIEDAPAPAALNTFELFEENGSVYIRGEESAIKSGQRISEHKCSSSGPGGLVIIGGGSGTLGVILAIRELGYNGAITIITREPSLIIDRTKLSKALIPDPEKIQWRSPQWYKDVGIETVSDEVSAVDFSQKIVVTRSGKTFPYTKLVLATGGVPRTLPLEGFQLLENVFKLRTVTDVQRILNAIGDGKNKKVVIIGSSFIGMEVGNALSKDNEVTIVGQESAPMERVMGTEVGHIFQRNLEKAGVKFKLSAGVAKATPSNEEARKVGAVHLQDGTVLPADVVILGVGVRPATDFLQGNPAITLEKDGSIKVDEHFSVPGLNNDVFAIGDIATFPYHGPGTDPKKGTYTRIEHWNVAQNAGRSVASSILHMLHNTTSSLQKVKPKVFIPIFWSALGSQLRYCGNTIMGWDDLVLKGEPENAKFAAYYCKGETVVAVATMGMDPIMVKCAELMRRNNMPSKKEIQDGVDVLSIDVPKGVRI

SEQ ID NO: 47050 - protein, 422 aa, Aspergillus nidulans FGSC A4
MRSWIRTLGLSALLAGTAVANEAELGPDLSHRLQCSGMYSRKAWGGSVDPFILTKFAKSSPSDDRDPLVSLAIFEWADGHLIGRRASDDPEEPPSLICDEASVQAELSTGRSYMFKTVTTSVCFFARFLFGCLRSPVPVQNYITAILVFLILEQLMTWGFYVCMGYGVVKPSLGRTMVYVRILAITHFVFAVIYAIASLSITPEAAGILILFIELPLAATLTAFYVWTLSSLNATMKDLIDRKQKTKAMMYKKLWYCLLGSIIVLFGFIFINALAFASRSEEDFLPEHWKNRWFVLDGWLSIVYLADLAFIAYLWRPTANNRRFAMSDELAQDDDGFEIRSFNGALDEEDALGGLDEHSASEPRRDLSPVPPKPVPSAARTRESLDGETIFAVGEDGDKWSDDEDESPRNSTERKALTKDVD

SEQ ID NO: 47051 - protein, 200 aa, Triticum aestivum
  misc_feature (167)..(168): Xaa can be any naturally occurring amino acid
MAARSENESDGDVGTNPAEGGSSLSLPPLAAGPAVCVLRSAGDFAGGAFVGSIFGYGQGLLSKKGLKGSLGNAGSSAKSFAVLSGVQSLVLCLLRKLRGKDDIINSGIAGCCTGLALSFPGTPQALLQNCATFAAFSCIMEGLNKQQTAMAHTLGGNALNFAHNGGXXRLLPPSPLPPSLDASDAFASCCQALVVKPKKH

SEQ ID NO: 47052 - protein, 549 aa, Enterococcus faecalis V583
MKIVIIGGVAGGMSAATRLRRLMEDAEIVVMEKGPFVSFANCGLPYYVSGEIAEREQLLVQTPEALKARFNLDVRPHHEVVAIDPIEKVITVKHETEILTEHYDKLILSPGAKPFVPPITGLAEAKNVFSLRNVPDLDQIMTALTPETKRAVVIGAGFIGLEMAENLQKRGLEVTLVEKAPHVLPPLDEEMAAFVKAELSKNNVQVITGQSAVAFEEEGQVIRLEDGQTLASDLTILSVGVQPENTLAVEAGVATGLRGGIVVDEHYQTNQPDIYAVGDAIVVKQQITQEDALISLASPANRQGRQVADVIAGLERKNQGSIGTAIVRVFDLTAASTGLSERAAKAAGLTTAVVHISGKDHAGYYPGATDLQLKLVFHPTTGEIYGAQGIGAKGVDKRIDILATAIKGQLTIFDLPELEFTYAPPFGSAKDPVNMLGYAAMNLVEGLSENVQWYELSNELANGAVLLDVRNPAERANGQFKNAVSIPLNELRERLEELDKSTEYIVSCHSGLRSYIAERMLKQAGISAKNLDGAFALYRMVKPEELENV

SEQ ID NO: 47053 - protein, 548 aa, Brassica napus
MKLLHGLALVFLLAAASCKADEEITCEENNPFTCSNTDILSSKNFGKDFIFGVASSAYQIEGGRGRGVNVWDGFSHRYPEKAGSDLKNGDTTCESYTRWQKDVDVMGELNATGYRFSFAWSRIIPKGKVSRGVNQGGLDYYHKLIDALLEKNITPFVTLFHWDLPQTLQDEYEGFLDRQIIQDFKDYADLCFKEFGGKVKHWITINQLYTVPTRGYAIGTDAPGRCSPMVDTKHRCYGGNSSTEPYIVAHNQLLAHATVVDLYRTKYKFQKGKIGPVMITRWFLPFDESDPASIEAAERMNQFFHGWYMEPLTKGRYPDIMRQIVGSRLPNFTEEEAELVAGSYDFLGLNYYVTQYAQPKPNPYPSETHTAMMDAGVKLTYDNSRGEFLGPLFVEDKVNGNSYYYPKGIYYVMDYFKTKYGDPLIYVTENGFSTPSSENREQAIADYKRIDYLCSHLCFLRKVIKEKGVNVRGYFAWALGDNYEFCKGFTVRFGLSYVNWEDLDDRNLKESGKWYQRFINGTVKNAVKQDFLRSSLSSQSQKKRFADA

SEQ ID NO: 47054 - protein, 376 aa, uncultured archaeon GZfos24D9
MEERGISKQELKSFLKEQRQKDLTYRKVLSSMCSYPHEMATYAHNLFLDSNLGDSGLFPGTKAMEDELIRMIGALLGNENAHGYISTGGTESNIQAIRAIRNRKRKERLQEMNIIVPKTAHFSFDKIEDLLSLEVKKAGLDDKLRVDVNLVEELIDDNTISIVGIAGTTEFGQIDPIKELADIAHDSDIFLHVDAAFGGFVIPFLDAEYQFDFSLDAVSSVSIDPHKMGMSTIPAGCILFRDESYLADLAVDTPYLTTNEQCSLIGTRSGAPVAATFAVLKYLGRSGLKAIVDDCMQLTRMLVRGAKAMDIYPVIEPVTNVVTLRFPDVDRVAKALEARGWRVSTTRAPKALRLVIMPHVTEDTIELFLNDLACVT

SEQ ID NO: 47055 - protein, 196 aa, Triticum aestivum
  misc_feature (125)..(125): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTXDATQVINEVEEVKKEYPDAYVRIIGFDNMRQVQCVSFIAFKPPGCEESGKGLNRFTHHGPHIKCHCGFVNS

SEQ ID NO: 47056 - protein, 299 aa, Humulus lupulus
ELTGGHRILSYLDPSEPKHAKLKSLIFFMLKARRDMVIPEFHATYTELFENLESDLAAKGKTSFGEANDQAAFKFLGRALYGVSPTDTKLGTDGPKLVQKWVLFNLHPILVLGLPKLVEELAIHSFRLPSFLVKSDYRRLYDYFYEAGGYVLDEAEQMGISREEACHNLIFATCFNTFGGMKILFPNMLKSIGRVRVKLHTQLAEEIRGAVRSNGGKVTMAAMEQMPLMKSVVYEAFRFEPPVPLQYGRAKKDLVIESHDAVFEVKEGEMLFGFQPFATKDPKIFDRAEEFVPDRFVGE

SEQ ID NO: 47057 - protein, 463 aa, Burkholderia vietnamiensis G4
MSGSNTGLGTGLKQRHVTMMSIAGVIGAGLFVGSGHAIAEAGPASILAYAIAGVLVVLVMRMLGEMAVAHPDSGSFSTYADRAIGHWAGFSIGWLYWWFWVLVIPIEATAAATILNAWFPGVATWIFALGITLLLTITNLFSVKNYGEFEFWFALIKVVAIVVFLCIGGAAILGIVPAPAVSGVSNLFAHQGFMPNGAGAVLAAMLTTMFSFLGTEIVTIAAAESDNPQRQIVRATNSVIWRITLFYLGSILVVAAIVPWNDPLLPKHGSYQRAMELIGVPNAKAIIDVIVLVSVASCLNSALYTASRMLFSLSKRKDAPAFLHRTDSTGTPRAAVLASTAFGFLTVIANYLMPEQVFGFLLATSGAIALLVYLVIAISQLRMRKTLESTGADLALRMWLFPWLTWAVILFICGTLTVMFVSEAHRMEVGATAVLALLVLFASWLNKRARDARAVAGGRVSAT

SEQ ID NO: 47058 - protein, 138 aa, Glycine max
EVRVEGLETLDYLDNLQKRERFTEQGDALTFESEFDRIYLSTPTKIAILDHEKKRTIVLRKDGLPDAVVWNPWDKKAKAISDFGDDEYKYMLCVEAAAIEKPITLKPGEEWKGRLELSTVSSSYCSGQLDPKRVIQGS

SEQ ID NO: 47059 - protein, 247 aa, Geobacillus kaustophilus HTA426
MDQIRQLAQWIKEANTIAVLTGAGMSTESGIPDFRSENGLYAQEDNVEYYLSEYYYKKDPVDFWRRFKRMFSLKMMGGFAPNDGHRFLRWLEEMGKTVTILTQNIDGLHTKAGSTNVIELHGTLQTATCPSCGNKYDLSFINRHEVPRCEKCQTIVKPDVVLFGGLVPRMEEAFAAAAASDLLLAMGTSLEVAPVNQIPFYVAAESPATRKVLINKTATRMDGMFDLVIYGGIGKTVASVRKQIQAE

SEQ ID NO: 47060 - protein, 248 aa, Neisseria meningitidis FAM18
MSTQDLSGKIALVTGASRGIGAAIADTLAAAGAKVIGTATSESGAAAISERLAQWGGEGRVLNSAEPETVENLIADIEKTFGKLDILVNNAGITRDNLLMRMKEEEWDDIMQVNLKSVFRASKAVLRGMMKQRAGRIINITSVVGVMGNAGQTNYAAAKAGLIGFSKSMAREVGSRGITVNCVAPGFIDTDMTRALPEETRQTFTAQTALGRFGDAQDIADAVLFLASDQAKYITGQTLHVNGGMLMP

SEQ ID NO: 47061 - protein, 521 aa, Neisseria meningitidis FAM18
MTQDKILILDFGSQVTQLIARRVREAHVYCELHSFDMPLDEIKAFNPKGIILSGGPNSVYESDYQADTGIFDLGIPILGICYGMQFMAHHLGGEVQPGNQREFGYAQVKTIDSELTRGIQDDTPNTLDVWMSHGDKVSKLPTGFTVIGDTPSCPIAMMENAEKQFYGIQFHPEVTHTKQGRALLNRFVLDICGAQPSWTMPNYIEEAVAKIREQVGSDEVILGLSGGVDSSVAAALIHRAIGDQLTCVFVDHGLLRLNEGKMVMDMFARNLGVKVIHVDAEGQFMEKLAGVTDPEKKRKIIGAEFIEVFDAEEKKLTNAKWLAQGTIYPDVIESAGAKTKKAHAIKSHHNVGGLPENMKLKLLEPLRDLFKDEVRELGVALGLPREMVYRHPFPGPGLGVRILGEVKKEYADLLRQADDIFIQELRNTTDENGTSWYDLTSQAFAVFLPVKSVGVMGDGRTYDYVVALRAVITSDFMTAHWAELPYSLLGRVSNRIINEVKGINRVVYDVSGKPPATIEWE

SEQ ID NO: 47062 - protein, 240 aa, Arabidopsis thaliana
MISRDNRTKPKTVAQVRDAKRKRTFDHVPRGTREPHAYLRNDPAPQVASVPKSVPEEKDVILDRILSNVPRRKKTTSYEFVPPKHPQEPQWLLQVMSRMNGAGDPKLIIEKNLDSNDVDPRQNRLSIPINTVIQNDFLTLDESRLIDEDEITNEGNMGVAAFLVDQRTKKWNMGFKQWFMTTDSGSSYWSFVLRGEWSNVVETNGLKEGDKISLWSFRSNDILCFALVPPTSSVVESLDK

SEQ ID NO: 47063 - protein, 307 aa, Arabidopsis thaliana
MTTNDDDHAAERNTMSMNYELAATLSDEEQRARKGKAKIVCKEEDHVFIKKKEKYEEESEKREFFSHVPRKIRPALRYPQPNFENPNGASSSLNLPFEEDYYMAEYYKKTETINPPNPYHQWSPSSFLTEYTHPRMLEVLHRCGFNRPVVTCYSRTAREMRWWLRQVMKDMRAEDLTLILEKTLSTTDVITTTHGRFSMHFNRLISNDFLKPEERSILEEDTYNDETMGVGAILVDQRSQKWSVILKRWGQNYFLSCGWNDVVKANKLKAGDDICLWAFRWRGILCFALVPPLTLRQSSSSNARRLC

SEQ ID NO: 47064 - protein, 293 aa, Anabaena variabilis ATCC 29413
MNKINRVAIIGGTHGNEFTGAFLVKKFQQFPEVIQKPSFETLTILGNPKAFEAGKRYIEKDLNRCFLTESLQNPNLSSYEDIRAKQIAGVLGEENQPKVDVVIDLHSTTANMGLSIILGNQDPFLLKLCAYLSEINPLVKVCYTIPEKGSNFLRSLNKLGFVIEVGAVAQGVLNAELFQKTEQLIYTILDYVEKYNQGNIPKINNLLSLYKFTGTIDYPRNGNGDIQAMIHPDIQFRDYAPLNPGDPLFLTLDGKAIAYEGTSIVYPIFINEAAYYEKGIAMLFTEKQLINFD

SEQ ID NO: 47065 - protein, 266 aa, Pseudomonas savastanoi
MTEPLTEPPELSAKYAWFFDLDGTLAEIKPHPDQVVVPDNILQGLQLLATASDGALALISGRSMVELDALAKPYRFPLAGVHGAERRDINGKTHIVHLPDAIARDISVQLHTVIARYPGAELEAKGMAFALHYRQAPQHEDALMTLAQRITQIWPQMALQQGKCVVEIKPRGTSKGEAIAAFMQEAPFIGRTPVFLGDDLTDESGFAVVNRLGGMSVKIGTGATQASWRLAGVPDVWSWLEMITTALQQKRENNRSDDYESFSRSI

SEQ ID NO: 47066 - protein, 371 aa, Saccharomyces cerevisiae
MFRSVATRLSACRGLASNAARKSLTIGLIPGDGIGKEVIPAGKQVLENLNSKHGLSFNFIDLYAGFQTFQETGKALPDETVKVLKEQCQGALFGAVQSPTTKVEGYSSPIVALRREMGLFANVRPVKSVEGEKGKPIDMVIVRENTEDLYIKIEKTYIDKATGTRVADATKRISEIATRRIATIALDIALKRLQTRGQATLTVTHKSNVLSQSDGLFREICKEVYESNKDKYGQIKYNEQIVDSMVYRLFREPQCFDVIVAPNLYGDILSDGAAALVGSLGVVPSANVGPEIVIGEPCHGSAPDIAGKGIANPIATIRSTALMLEFLGHNEAAQDIYKAVDANLREGSIKTPDLGGKASTQQVVDDVLSRL

SEQ ID NO: 47067 - protein, 179 aa, Helicobacter pylori J99
MNEMLKEELLQSIREVKDYPKKGILFKDITTLLNYPKLFNKLIDALKKRYLALNIDFIVGIEARGFILGSAFAYALGVGFVPVRKKGKLPAHTLSQSYSLEYGSDSIEIHSDAFRGIKGVRVVLVDDLLATGGTALASLELIKALQAECIEACFLIGLKELPGIQLLEEHVKTFCLLEC

SEQ ID NO: 47068 - protein, 833 aa, Mycobacterium avium 104
MVGHRFVEALRARDTEGRWRITVFAEEADAAYDRVGLTSYTESWDRALLALPGNDYQGDPQVRLVLNQRVTEIDRATKSVVTADGQRHHYDTLVLATGSYAFVPPVPGHELPTCHVYRTLDDLDAIRADAQRAAQTDHARAGVVIGGGLLGLEAANALRQFGLATHVVEMMPRLMAQQIDEAGGALLARMIGDLGISVHVGTGTEAIEPVEGPDGSTTVRVRLSDGQVIDAGLVIFAAGIRPRDELAVAAGLARAERGGVLTDLSCRTSDPDIYAIGEVAAIDGRCYGLVGPGYTSAEVVADRLLDGSAEFGEADLSTKLKLLGVDVASFGDAMGTTENCLEVAINDAVNRTYAKLVLSDDAKTLLGGVLVGDASSYGVLRPMVGSELPGDPLALIAPASSGGGTALGVGALPDSAQICSCNNVTKGDLKCAIADGCADVAALKSCTSAGTSCGSCVPLLKQLLEAEGVEQSKALCEHFSQSRAELFEIISATEIRTFSGLLERFGRGKGCDICKPVVASILASTGSEHILEGEQASLQDSNDHFLANIQKNGSYSVVPRVPGGDIKPEHLILIGQIAQDFGLYTKITGGQRIDMFGARVDQLPAIWKRLVDGGMESGHAYGKALRTVKSCVGTDWCRYGQQDSVQLAIDLELRYRGLRAPHKIKMGVSGCARECAEARSKDVGVIATEKGWNLYVGGNGGMTPKHAQLLASDLDTETLVRYIDRFVMYYIRTADRLQRTAPWVESLDGGLDHVREVVCEDSLGLAEEFEAAMERHVRNYKCEWKGVLDDPDKLSRFVSFVNAPDAVDSTVAFTEHAGRKIPVSIGMPKIRQG

SEQ ID NO: 47069 - protein, 212 aa, Triticum aestivum
  misc_feature (25)..(25): Xaa can be any naturally occurring amino acid
VHHRLMLMPETLYLTVYIIDQYLSXENVLRKELQLVGVSAMLISCKYEEIWAPLVKELLVLSDNAFSREQVLSTEKSILNKLQWNLTVPTVYVFLLRYAKAAMGDKELENMAFFYAELALVDYSMLVYSPSVTAAAAVYTARCTLNMSPGWSDILEHHTGLGESQLMQCARRLASLHSTAAGSSKQKVVYNKYANPKLGAVSLYSPAKRLAI

SEQ ID NO: 47070 - protein, 987 aa, Geobacillus kaustophilus HTA426
MEAQMVTVTINGRAYRAKPGMTILEVVNEHGLPHPQVCYTPELGAIQTCDTCIAEVNGTLLRACATPVEDGMVVELGSPRAKAAQKEAMDRLLENHLLYCTVCDNNNGNCKLHNTAEMMQIEHQTYPYRPKVDPSEVDMSHPFYRYDPNQCIACGQCVEACQNLQVNETLSIDWEAERPRVVWDGGVPINESSCVSCGQCVTVCPCNALMEKSMLGEAGFLTGLDKDVLNPMIDFVKEVEPNYTSIFAISEIEAAMREQRIKKTKTVCTFCGVGCSFEVWTKGRKILKIQPVSEAPVNAISTCVKGKFGWDFVNSEERLTKPLIRKGDVFVESTWDEALDLVAEKLGAIKRQYGGNAIGFISSSKISNEENYLMQKLARQVFETNNVDNCSRYCQSPATDGLFRTVGMGGDSGTIHDIATAGLVIIIGANPAEGHPVLATRVKRAHKLFGQKLIVADLRRNEMAERADLFIRPKQGTDQVWLMAVTKYIIDQGWHDEAFIRERVHFFEEFKQLLEKYTLDYAEQVTGIAKADLIRIAEMIHEADGTCVLWGMGVTQNTGGSDTSAAISNLLLATGNYGRPGAGAFPLRGHNNVQGACDMGSLPAWLPGYQHVTDDEARAKFEQAYGVRIDAKPGLDNIQMLEAAERGELKAMYIVGEDMALVDCNANHVQETLAKLDFVVVQDIFLSKTAQFADVILPAAPSLEKEGTFTNTERRIQRFYQALEPLGDSKPDWWIIQEIAKRLGADWNYAGPKEIMDEIASLAPLYSQAHYDRLEGWNSLCWGSHDGADTPLLYKERFNFPDGKARFALADWVEPVQYPEEYDLLVNNGRLLEHFHEGNLTYKSKGIEHKFPEVFVEVSPELAKERGIEDGALVRLISPYGRVKVRVLVTDRVRGNELFLPMHSTANESAINILTGPATDRRTNTPAYKQARVRMEVIERSGKTPLPRTNPRFKKRHPQNGVEVERKWRRSDYVPLTEENKGVTIGG

SEQ ID NO: 47071 - protein, 178 aa, Triticum aestivum
CCLPIDGSRASDFGLMKIDDTGRVISFSEKPRGADLKAMQVDTTLLGLLKEEAEKKPYIASMGVYIFKKEILLNLLRWRFPTANDFGSEIIPAAAREINVKAYLFNDYWEDIGTIKSFFEANLALAEQPSKFSFYDASKPMYTSRRNLPPSMISTSKITDSIISHGCFLDKCRVEHSV

SEQ ID NO: 47072 - protein, 389 aa, Arabidopsis thaliana
MVIAAAVIVPLGLLFFISGLAVNLFQAVCYVLIRPLSKNTYRKINRVVAETLWLELVWIVDWWAGVKIQVFADNETFNRMGKEHALVVCNHRSDIDWLVGWILAQRSGCLGSALAVMKKSSKFLPVIGWSMWFSEYLFLERNWAKDESTLKSGLQRLSDFPRPFWLALFVEGTRFTEAKLKAAQEYAASSELPIPRNVLIPRTKGFVSAVSNMRSFVPAIYDMTVTIPKTSPPPTMLRLFKGQPSVVHVHIKCHSMKDLPESDDAIAQWCRDQFVAKDALLDKHIAADTFPGQQEQNIGRPIKSLAVVLSWACVLTLGAIKFLHWAQLFSSWKGITISALGLGIITLCMQILIRSSQSERSTPAKVVPAKPKDNHHPESSSQTETEKEK

SEQ ID NO: 47073 - protein, 303 aa, Pinus taeda
SYCFERVAEFADRPCLIDGATDRTYCFSEVELISRKVAAGLAKLGLQQGQVVMLLLPNCIEFAFVFMGASVRGAIVTTANPFYKPGEIAKQAKAAGARIIVTLAAYVEKLADLQSHDVLVITIDDAPKEGCQHISVLTEADETQCPAVKIHPDDVVALPYSSGTTGLPKGVMLTHKGLVSSVAQQVDGENPNLYFHSDDVILCVLPLFHIYSLNSVLLCALRAGAATLIMQKFNLTTCLELIQKYKVTVAPIVPPIVLDITKSPIVSQYDVSSVRIIMSGAAPLGKELEDALRERFPKAIFGQ

SEQ ID NO: 47074 - protein, 297 aa, Glycine max
  misc_feature (22)..(22): Xaa can be any naturally occurring amino acid
  misc_feature (37)..(37): Xaa can be any naturally occurring amino acid
  misc_feature (40)..(42): Xaa can be any naturally occurring amino acid
  misc_feature (219)..(219): Xaa can be any naturally occurring amino acid
  misc_feature (228)..(228): Xaa can be any naturally occurring amino acid
AHRRNSAFHLSYNMIFNQILCXNGDPENLLHKVLGSXPTXXXIPDLEKQIKSLASAEAWVVIEEESSLKDYFNLLEQHRALNKEIRDIVLSPRHCLPFLQPGRLVSLECTSSDEDLPLIFIEDQLTWGLVINFERVKSVSEDDASIKPEDASYIVDVLTRCVVRKDKIGKKSIKIVPLKEVGEPLVVSVPISQINTISSLRLYIPKDLLPLEARENTLXKVLETLTRXCEKTRPLLDPEEDMKIQSSSYKKASRRIEALESLFEKHEIAKSPLIKQKLKYYLSFCARMQHVIIIYIY

SEQ ID NO: 47075 - protein, 444 aa, Bacteroides thetaiotaomicron VPI-5482
MNAAKVLDDLKRRFPNEPEYHQAVEEVLSTIEEEYNKHPEFDKANLIERLCIPDRVFQFRVTWMDDKGNIQTNMGYRVQHNNAIGPYKGGIRFHASVNLSILKFLAFEQTFKNSLTTLPMGGGKGGSDFSPRGKSNAEVMRFVQAFMLELWRHIGPETDVPAGDIGVGGREVGFMFGMYKKLAHEFTGTFTGKGREFGGSLIRPEATGYGNIYFLMEMLKTKGTDLKGKVCLVSGSGNVAQYTIEKVIELGGKVVTCSDSDGYIYDPDGIDREKLDYIMELKNLYRGRIREYAEKYGCKYVEGAKPWGEKCDIALPSATQNELNGDHARQLVANGCIAVSEGANMPSTPEAVRVFQDAKILYAPGKAANAGGVSVSGLEMTQNSIKLSWSAEEVDEKLKSIMKNIHEACVQYGTEADGYVNYVKGANVAGFMKVAKAMMAQGIV

SEQ ID NO: 47076 - protein, 103 aa, Burkholderia vietnamiensis G4
MDTQQRIKQIVDENQVVLFMKGNAQFPMCGFSGRAVQVLKACGVDQFKTVNVLEDDEIRQGIKEFSNWPTIPQLYVKGEFIGGSDIMMEMYQSGELQQLFAAA

SEQ ID NO: 47077 - protein, 445 aa, Bacteroides thetaiotaomicron VPI-5482
MNIQKIMSSLEAKHPGELEYLQAVKEVLLSIEDIYNQHPEFEKVKIIERLVEPDRIFTFRVTWVDDKGEVQTNLGYRVQFNNAIGPYKGGIRFHASVNLSILKFLGFEQTFKNALTTLPMGGGKGGSDFSPRGKSDAEIMRFCQAFMLELWRHLGPDMDVPAGDIGVGGREVGYMFGMYKKLTREFTGTFTGKGLEFGGSLIRPEATGFGGLYFVYQMLQAKNIDIKGKTVAISGFGNVAWGAATKATELGAKVITISGPDGYIYDPDGISGEKIDYMLELRASGNDIVAPYAEKYPGATFVEGKRPWEVKADIALPCATQNELNGEDAQNLIKNNVLCIGEISNMGCTPEAIDLFIEKKIMYAPGKAVNAGGVATSGLEMSQNAMHLSWSAAEVDEKLHAIMHGIHAQCVKYGTEPDGYINYVKGANIAGFMKVAHAMMGQGVI

SEQ ID NO: 47078 - protein, 347 aa, Pseudomonas fluorescens Pf-5
MPQTLTLNQRVVLVSRPEGAPVPENFRLERVALPELADGQVLLKTLYLSLDPYMRGRMSDAPSYAAPVEIDEVMTGGAVSRVERSLNPKFQEGDLVVGATGWQSHCICDGRNLIPVPSGLPSPSMALGVLGMPGMTAYMGLMDIGQPKAGETLVVGAASGAVGSVVGQVAKLKGLRVVGVAGGADKCRYVVEELGFDACIDHKSPDFADELAQACFKGVDIYFENVGGKVFDGVLPLLNPRARIPLCGLIAQYNAQALPPGPDRLPLLQRTLLTKRVRIQGFIVFDDYGDRHPEFIKAMAPWVREGKVKFKEDVVEGLEQAPEAFIGLLEGRNFGKLVVKVAPDASI

SEQ ID NO: 47079 - protein, 586 aa, Triphysaria versicolor
MCGILAVLGCSDDSQAKRVRVLELSRRLKHRGPDWSGIHHHGDCYLAHQRLAIVDPASGDQPLFNEDKRIAVTVNGEIYNHEELRALLPNHKFRTGSDCDVIAHLYEEYGENFVEMLDGMFSFVLLDSRDNTFIAARDAFGITSLYIGWGLDGSVWISSELKGLHDECENFEVFPPGHVYSSKTEGFRRWYNPPWFSEAIPSTPYDPLVLRGAFEQAVIKRLMTDVPFGVLLSGGLDSSLVAAVTARHLAGTKAAKRWGSQLHSFCVGLEGSPDLKAGKEVADYLGTVHHEFLFTVQDGIDAIEDVIYHIETYDVTTIRASTPMFLMSRKIKSLGVKMVISGEGSDEIFGGYLYFHKAPNKEEFHRETCRKIKALHQYDCLRANKATSAWGLEARVPFLDKEFVNLAMSIDPEAKMIKPDQGRIEKWILRKAFDDEERPYLPKHILYRQKEQFSDGVGYSWIDGLKAHAEQHVTDKMMLNAGHIFPHNTPTTKEGYYYRMIFERFFPQNSAKLTVPGGPSVACSTATAVAWDASWSKNLDPSGRAATGVHDLAYENHVPIGNLKSKKMDSVSLGNAVGPQELTIRS

SEQ ID NO: 47080 - protein, 791 aa, Oryza sativa
  misc_feature (722)..(722): Xaa can be any naturally occurring amino acid
  misc_feature (774)..(774): Xaa can be any naturally occurring amino acid
MENGRLYPERPRTFSTVRTKSSLPPIFRVLMRINPRAFIVLLLLVFSGVLYVGASTSPIVLFVFCICTLSLFFSLYLTKWVLAKDEGPPEMSEIYAVFFIGCLLDVQISDAIRDGAEGFFRTQYGTISKMACILALVILGIYLFRSTTPQQEASGVGRTTSAYITVASFLLGALCSGIAGFVGMWVSVRANVRVSSAARRSAREALQIAVRAGGFSAIVVVGMAVFGVAILYATFYVWLEVDSPGSMKVTDLPLLLVGYGFGASFVALFAQLGGGIYTKAADVGADLVGKVEQGIPEDDPRNPAVIADLASLFCLSCNIIDKNAKLSSDNSYPSGFILFPLVVHSFDLVISSVGILSIRGTRDSGLISPIEDPMAIMQKGYSITILLAVVTFGVSTRWLLYTEQAPSAWLNFALCGLVGIITAYAFVWISKYYTDYKHEPVRLLALSSSTGHGTNIIAGVSLGLESTALPVLVISVAIISAFWLGHTSGLVDESGNPTGGLFGTAVATMGMLSTAAYVLTMDMFGPIADNAGGIVEMSQQPESVREITDILDAVGNTTKATTKGFAIGSAALASFLLFSAYMDEVAAFAQLPFKEVDIAIPEVFVGGLLGSMLIFLFSAWACSAVGRTAQEVVNEVRRQFIERPGIMDYNEKPDYGRCVAIVASASLREMIRPGALAIISPMAVGIIFRMLGHATGRPLLGAKVVAAMLMFATVSGILMALXLNTAGGAWDNAKKYIETGALGGKGSESHKAAVTGDTVGDPFKDTAGPSIHVXLIKMLATITLVMAPIFL

SEQ ID NO: 47081 - protein, 223 aa, Geobacter metallireducens GS-15
MLYPVNLIIFDLDGTLIDSLPDLADATNHMLSSLGRPSIGQNAVRRLVGQGARRLVERALAGASEDEINQGLDLFLDYNHRHIADRTVLYLGVPETLDALKGRGMRMAIISNKNVALCREVVSVLGIDRYFDEVLGADSLPFRKPSPEPVLKLLADFGVPPERAALVGDSINDMAAAKGARVSTVGCTWGYGELTELADADYLVESFGELFGIPLFCGGEVSI

SEQ ID NO: 47082 - protein, 429 aa, Saccharophagus degradans 2-40
MSFPLSSSSFSDKKNAFYAQSGGAAAVLNASAAGVVAGVMAHKDKIENLYIGRNGILGALHEDMVVVNTHDDNLIDDLLHAPAGAFGSCRYKLKSIEESEREYARILEVFKAHNIGYFFYNGGGNSQDTSCKLAKYAAKKNYPLQCIGIPKTIDNDLSGTDCSPGYGSVAKYVAVSILEASMDLASMHQTSTKVFVMEVMGRDSGWIAAAAGLAADERNLGPDLIIFPEVPYEEYKFYAELNRIVARKGFCVVVVAEGVRGPDGNHLTSTANKDAFGHTQLGGAASIIAGRIREVTGHKTHFAVCDYLQRAARHIASKTDVDQSFLVGKKAVEFAANGYSNVMMAIVRESEQPYRWSVGTVPLVEAANSRNALPAGFISKCGFHITDACRRYLAPLIAGESYPSYQNGLPAYRVFNSVAVPKKLEEFTL

SEQ ID NO: 47083 - protein, 335 aa, Robiginitalea biformata HTCC2501
MQRKNKTLGEFIIENQQEFQYSTGELSKLINAIRLAAKVVNHEVNKAGLVDILGAAGETNIQGESQQKLDVLANEKFKQTLQNREIVCGIASEEEDDFITINSQDEQHQNKYVVLIDPLDGSSNIDVNVSVGTIFSIYRRVTPIGSPVSLEDFLQPGVNQVAAGYIIYGTSTMLVYTTGHGVNGFTLNPAIGTFYLSHPNMQFPETGRIYSVNEGNYTHFPQGVKDYIKYCQKEEDDRPYTSRYIGSLVSDFHRNMIKGGIYIYPKSSTAFNGKLRLLYECNPMAYLAEQAGGRASDGYRRILEITPTELHQRVPFFCGSRKMVEKAESFMAQYA

SEQ ID NO: 47084 - protein, 520 aa, Geobacter metallireducens GS-15
MSSDIHSEKILILDFGSQYTQLIARRVREAHVYCELHPFDMDLAAIRAFAPRGIILSGGPKSVYEEGAPAVEEALFELGVPVLGICYGMQLMSRHFGGQVVPAGKREFGHADLLAVGTPGPLFDGFFVEGKSPVWMSHGDHVSLVPAGFQVVGETANAPVCAIQDLARNLYGVQFHPEVNHTPRGELLIDTFVRKICGCSGQWTPGHIIDDAVSRIRAQVGNDRVILGLSGGVDSSVAAALIHRAIGDQLTCVFVDNGLLRLSEGDQVMATFAENLGVKVIRVDAEDRFLTALAGESDPEKKRKIIGKLFVDIFEEESNKITDARWLAQGTIYPDVIESAGAKTGKAHNIKSHHNVGGLPDYMKLKLLEPLRELFKDEVRAIGEELGLPHQMVWRHPFPGPGLGVRILGEVKKEYADILRRADAIYIEELYAAGHYDKISQAFAVFLPVKSVGVMGDGRTYEYVVALRAVETKDFMTAGWYPLPYEDMARISSRIINEVKGVNRVVYDISSKPPATIEWE

SEQ ID NO: 47085 - protein, 230 aa, Zea mays
LQFSSEKIKCLLKRLLTSKQPLTDHYFEALVPQDDASLEALVQNLHPKQENEDQEMPGSQKIRVLQTKDNSALLYDEVGVDFVDSLFGLLSIPLGSAIKLYCQCSAKGCLGNAYRSIDGSVKEFVREECQSLLLDPKSLWFSGCNRSHEFAYSLRCNEVFCANKVKSIKLCEANPKRQNGGSGQTNFVVKEIKLKVMELQRAVLVLSRNILSSVLLHPKKTKKLHHYRRM

SEQ ID NO: 47086 - protein, 400 aa, Aspergillus nidulans FGSC A4
MAPRTMKALNYVGPFNVKVQEVEMPCLEHPDDIIVKITSAAICGSDLHMYEGRTAAEAGITFGHENLGIVEELGDGVTLLKKGDRVVMPFNVADGRCRNCEDGKTAFCTGVNPGFAGGAYGYVAMGPYRGGQAQYLRVPYADFNALKLPPGTEHEADFILLADIFPTGWHGIEISGFQPGDSVAVFGAGPVGLMAAYSAQIRGASRVYVVDRVPERLRAAEKIGAVPIDFTAGDAVDQIIAANGGEMVDRSVDAVGYQAVSGTKDNATEVPNIVLENMIRVTRACGGLGIPGLYVPSDPGAGDTATAKGMISLSFGKLFEKGLTLGTGQCNVKAYNRQLRDLIIAGKARPSFVVSHEISLDEAEIAYDKFDKRIEGYTKVIIHPNGGFQDKRPPVVNSPL

SEQ ID NO: 47087 - protein, 336 aa, uncultured archaeon GZfos1D1
  misc_feature (112)..(112): Xaa can be any naturally occurring amino acid
MMKLAINGWGRIGRLVFRAALQDHSALDFVAINSRSAGASWIEHLLTYDSVHGKQEGEIRAEKDTLFVNGKEIKILSESDPENLPWRDLGVDVVVESTGQFRDRKGASKHLXAGCKKVIITAPGKEPDVTLVPGVNDAMYNPATHNIISLASCTTNCLAPVAKVLEDEFGINRGFMTTVHAYTGDQKLLDGRHNDLRRARAAAMSIVPTTTGAAAALGVVLPSLAGKMDGISLRVPTTNVSVVDLVAELGSEVTREAVNSAFEEASKTSLAGILSVSHLPLVSIDYNGSSFSAIVDAEYTNVVGGRLVKVLAWYDNEWGYSCRVVDMIKRLEAEGV

SEQ ID NO: 47088 - protein, 308 aa, Xanthomonas oryzae pv. oryzae KACC10331
MSLDPALRSRIDTLLQSSRVVLFMKGQPGMPQCGFSAKAVGVLDGLGIDYAHVNVLADQEIREGIKVYGDWPTIPQLYVDGELIGGSDIILQMADSGELSSMLGLQAPDRTPPKITITPAAVEMLKGALADAPDASLTLSIDANFQPNFQLAPTNPNAIAAESNGLRVQFDLASARRADGITIDWVDDIRGRGLAIDNPNAPKPVQELSVRDADDRLKAGSLTLVDVRPADERALASVAAPFRTLDAHERAAIEQLPKDTALAFLCHRGGRSLQAAEHFRSLGFTNVYNVTGGIDAWSDDVDNGVAKY

SEQ ID NO: 47089 - protein, 409 aa, Zea mays
MAAALQATPIKTLATSRWRVEGAEARPRPRPIAVSFRCSAAARSYNITLLPGDGIGPEVVAVAKDVLSFAGALEGVELRFQEKLVGGSALDATGVPLPDETLDEAKGSDAVLLGAIGGYKWDTNEKHLKPETGLLQLRAGLGVFANLRPAAVLPQLVDASTLKKEVAEGVDIMVVRELTGGIYFGKPRGFGTNDKGDDIGFNTEVYSASEIDRIARVAFEVARKRRGKLCSVDKANVLEASMLWRKKVTALASEFPDIELSHMYVDNAAMQLVRNPKQFDTIVTNNIFGDILSDEASMITGSIGMLPSASVGESGPGLFEPIHGSAPDIAGQDKANPLATILSAAMLLRYGLGEENAARRIEAAVTETLNHGFRTGDIYSPGTTLVGCKRMGEEVLKTVESLKEVAAVN

SEQ ID NO: 47090 - protein, 215 aa, Streptococcus pyogenes M49 591
  misc_feature (198)..(198): Xaa can be any naturally occurring amino acid
  misc_feature (206)..(206): Xaa can be any naturally occurring amino acid
APDTIDDEALVMLSDILPTSYEIDVLPSHVKPGDNVCIVGAGPVGLAALLTVQFFSPANIIMVDLSQNRLEAAKTFGATHTICSGSSEEVKAIIDDITNGRGVDISMECVGYPATFDICQKIISVGGHIANVGVHGKPVDFNLDELWIKNITLNTGLVNANTTEMLLNVLKTGKIDATRLITHHFKLSEVEKAYETFXHAGANNAXEVIIDNDIS

SEQ ID NO: 47091 - protein, 1755 aa, Candida glabrata
MSNSDYFSHKPADSTGTPGTGTGTGTGTGGGTGTGTGTGSRRLAKEYLPARSRSSSSDARNPYMYHYNPRDAAGAGAVTGSGSGSNVGTPPGFHTTSPQSGYMSSRIGGPESLMQHHTGLTFDSMMQNPVLSMGPLSPGISPLTNLNAFGKNSTGVPKQPSSGNNTISFAPVPSPTSTSARSSRRASVVSNSSQGIHSLPKIATQIHQGQGQQVQQQSPNKKPYKIYNSQDGNPSITNTASKIRTSSIAMDSSTSTITTPTLVISPDMAAGSLPSNLGSTPSESTLKHSSGKHSAMATPGGTASNAVNMGSVGSLQDMATPGASTRSATIQNGSTASLRTFKKQYVLNEQLYLEKMRRNVPDDYYTRGIGPTSVTDEDEEFDIEMDEVFDQSGSNNKLSELDGNVDIQDDVDFGTKFINPDADRNENLVALSSRFLSRKLDWAFPSKKVREDQSSSTPTESRRSPADINDGNNNNINNNINNNTNDNNNTNSNRNNSNNNNNNNNNKDSNGTSDTAITTTSTTNNSADVTPRKSTPNNSVSDTPAPQENLSANEHFISQLLQDPAVVKRFEWQTMLANVLKGDIVKSEKTKIAKEVKGPGFTTQYSDDIWLELKAWMNGRNVDDQKKSLKLLRESADEVFQRVLDFRLPDGLTSDEGEVEIAKLMNKYYRVIKLWSNMKRLYQDKPIAKTEAFRNRIDTLDSWLNFKRNFEEKIHYIRNWVVGTKDPETQVVVDINDDDAIFRHYAHEFADQMIKEKDIEAIFQKRIFFPLAPWILKAKLFFLKNRDTLNELNLMYLNDQLEMLLMFPMRLVKDIIQLRLSYAKKLQKPTMMMIDQMIDDFNSYIRVAVQMKFTVISYCQGWQFTVNIDPQFDDTVVEAIRHLFILLELKLLDGGGKSTNAFKEPDILLKYWDGLKNCGHYIDGAGKVIAIEFTKLTLRLVHRLHSYLLQQQNSPPKLTNEAEAEKWLVQLFETLGSMKRKLNRFTNVLMKAFQNSVTYRIDDHAQLMNGLKDTGHFLVYTGGKLEKQGIYLIASPELLGCPENEILKVLYNSDSGCDLIPKLEIENSLTLYNAVAEKWDLSTSIVQGVGKDGLPRYYLQNGNVDAQFRPPNLNSGKSHVAEMYNDDRDPDADILELEMKLNSLGYILVLCPQEPMLWSGEVFNLSEFTTEEINDLDFKTRPDTIKLMCQSSSYALEYQCDRFLQSASDCVTFLEKRCSFEVVENNLQKLNKAYFRCTYSVLKNYHKIVKTFKKVCPNNDLLNGIFLFARDFGLNFLRINVASNEKKSLIILLLVRLSVGWLQFLSVDCDPTDPRTFRWCVTAMEFAMHMTSGWNILALDENQFSSLKHKISACMSLLISHFDVMGARAVELEKNSQQPRPNINIEDVFDDDSMLQKNSELRMQSIKALEENVTRGTHRIGKVLDDTDKGNKYISSLASSISNVSIRWQKRNFIGGGTFGSVYSAVDLDNGEILAVKEIRIQDSKAMEKVFPSIKEEMNVLEMLNHPNIVQYYGVEVHRDKVNIFMEYCEGGSMASLLEHGRIEDEMVTQVYTLELLEGLAYLHESGIVHRDIKPENILLDFNGIVKYVDFGAARKISKKGTKRTKMPGADNDMKEDKIVPDSTGLNDLIGTPMYMAPESITGSTNKGHLGSDDIWSLGCVVLEMITGRRPWANLDNEWAIMYHVAAGHIPQLPAQDEVSSAGRRFLKRCLVQDPKRRATAVELLMDPWIVEIREQLFSSDDVDTNSVSSSQERK

SEQ ID NO: 47092 - protein, 182 aa, Pseudomonas fluorescens Pf-5
MAFDSFDIKSLIRPVIDFPKPGVIFRDITPLFQSPRALRLVADSFAQRYVEEDFSHIGAMDARGFLIGSIIAYQLNKPLILFRKQGKLPADILAEGYRTEYGEAFIEVHADSLCEGDSVLLIDDLIATGGTLIAAANLVRRMGAKVYEAAAIIDLPELGGSQKLQDMGIPTFCLTQFSLTER

SEQ ID NO: 47093 - protein, 734 aa, Haloarcula marismortui ATCC 43049
MAKDLERDLGLLSVVAISIGAMVGSGIFILPALAVKDAGAGIIAAYLLAGVLVLPAALSKAEMATAMPEAGGTYVYIERSMGPLLGTVSGLGTWFSLSFKGALALVGGVPYLVLLFDLPIRPVAITLAAVLILVNILGAEQTGRLQIGIVAVMLVAIGWFVAGGGPAVNTATYGGMWEYGVEGIFAATGLVFVSFAGVTKIASIAEEVEDPDRVIPLGMLGSLAFTTLLYVLVVAVVVGVIPLDQLAGSTTPIADAAEATLGTAGVAAVVLAAILALVSTANAGILSSSRYPFAMSRDGLAPDLLSTVSDRFGTPVTAITLTGGVMLLLILFVPILEIAKLASAFKILVFALINVALIGFRESDAPDYDPSFEVPLYPWTPIFGTLTGFALLTQMGLIAIVGAVGIVIASVVWYLGYVRPRVTREGAIKESVRRSIGDRALDRTEETLDETAETSVLVALPEGASRQSEATLLEVGAALSPTDSSLSVVQFDEVPDQQPLDYASGVQSPDDLEFECRTDTLAAALDTPVEYGELVSHHPERAVANAVDERGVDVLLVERGASFEDSLLGDSIDRIRKQADCDTIAVDAQPLDALETITLITTRGPYDPLKVRVGNAVATATGTDLQFLYPLDERQSAEERQQLEAYHDDLLDLCDVPTERTFVDRDDLSAAMDAADNDRTLLIHASNGGLSARTSNDNGTTQSAIQDSNHASMEVDTKRHPGGVVGRLLERLAF

SEQ ID NO: 47094 - protein, 194 aa, Arabidopsis thaliana
  misc_feature (172)..(172): Xaa can be any naturally occurring amino acid
MASSMLSSATMVASPAQATMVAPFNGLKSSAAFPATRKANNDITSITSNGGRVNCMQVWPPIGKKKFETLSYLPDLTDSELAKEVDYLIRNKWIPCVEFELEHGFVYREHGNSPGYYDGRNWTMWKLPLFGCTESAQVLKEVEKCQKEYPNAFLKITGFQNTRQVQCIKFIXAYKPPSFTGLIFPLLLGKTQKF

SEQ ID NO: 47095 - protein, 401 aa, Pisum sativum
MATKRSVGTLKEADLKGKRVFVRVDLNVPLDDNLNITDDTRIRAAIPTIKYLTGYGAKVILSSHLGRPKGVTPKYSLKPLVPRLSELLGSEVTIAGDSIGEEVEKLVAQIPEGGVLLLENVRFHKEEEKNDPEFAKKLASLADLYVNDAFGTAHRAHASTEGVAKYLKPSVAGFLMQKELDYLVGAVSNPKKPFAAIVGGSKVSSKIGVIESLLEKVDILLLGGGMVFTFYKAQGYSVGTSLVEEDKLGLATSLIEKAKAKGVSLLLPTDVVIADKFSADANDKIVPASSIPDGWMGLDIGPDSIKTFNEALDKSQTVIWNGPMGVFEFDKFAAGTEAIAKKLAEISGKGVTTIIGGGDSVAAVEKAGLADKMSHISTGGGASLELLEGKPLPGVLALDDA

SEQ ID NO: 47096 - protein, 233 aa, Bacteroides thetaiotaomicron VPI-5482
MNWENHLIKDLQWSNEIINREAKERVAREIAATAKTGDVIGAGSGSTVYLTLFELAKRIHEEHLYLEVIPASQEISMTCIQLGIPQTTLWDKRPDWTFDGADEVDPDRNLIKGRGGAMFKEKLLIRSSGKTFIIVDPSKLVNILGSKFPIPVEVFPHALSYVEKELRRLGASEISLRPAHGKDGPILTENGNFILDTRFHYIDASLEEQLKTITGVIESGLFINYDIEVVVTR

SEQ ID NO: 47097 - protein, 440 aa, Zea mays
  misc_feature (102)..(102): Xaa can be any naturally occurring amino acid
MGASGKWIRTLVGLRPAAERERPGAVAKGRKWSRLWRSSSSQRGSSAPASEAPSEASSTADMLSSSVVAAVVRAQPRDFRVIRQEWAAVRIQSAFRAFLARXRALRALRGIVRLQALVRGRHVRKQLSVTLKCMNVLVRVQERARERRFRISADGRHSQDILDDRSGLADPVKEAEAGWCDSQGTVDDLRSKMHMRHEGAVKRERAIAYALFHQRSSSHSGRPSSPAASLRNHGTGRSNKDWSHLDGSMATKPWESRLMEQTHTEHSNNSRCSESIEEMNAASSKLSDASSVKVRRNNMTTRVAAARPPPSTISASSSDFVCDASCSPSTSSVTPAASGTSFLTSDRRSDYGPNYMNWTKSAKARLNGSGTAHRLPLQRQRSSDLHHRISRIALSSADAQSTAGSEVSVTSKRLNSLTLRGRGARRSLDRKNDDQPVALF

SEQ ID NO: 47098 - protein, 402 aa, Candidatus Kuenenia stuttgartiensis
MESKKNIVVVGAGYGGITSVLRLARLFRKHPEYQIHLIDRNPYHTLKTQLHEAAVRKREVSIPINRIIQGRNIIFHLGEVTRIDAKEHIVYMEGGALPFHYLVIALGSQVNFHNIPGLQENSFSLQTLRDAQQIYAHIDKLCARAASEPNEELRRDMLRFVIGGGGLSGIEFAAELADYTVHCTHNCHVNSNEVEIIIVESGDHIVPRMEASFATRIHKKLLEKGVKIITRTKIISRTSDTTTLSSGEVVKTKTVIWTGGTRIHELIGESGMKIGQSGRIVVDEFLQVEGYPFIYAIGDNALAINPYSKQPVPAAAQFALQQGRLVAYNVYADIFRGMRKPYHPKVLGEVVSLGRHLAVGWFALPLLKKITFVGFLGSLLKTAIQEKHIFLLRKESRNWITY

SEQ ID NO: 47099 - protein, 339 aa, Guillardia theta
MYKIFDTINNLKDNKKGNKKKTYEGKKSLDNSSKNEIQYVECTIDLKYSLELNYKKKSLNDCKINLKGISSLIINSIRRTIMADVKTLSIEKVYIYKNSTVFGDEIISHRLGLVPIFISTELLRIYENRAKNDPNIIINLDINNNIYNKTKISIFSEMLNLMYKSIEFDLYKNQLIFPVYRDILILKINPGQEIHCECHCLINSGLNHAKFSPVGTIFYRMEPYVKILKEIISFDSSSFLKICPTGVFEVEKLGNLSRIYVKNSKFCTFCKECIKMNFKSKCIIKIGRNKIKINLIIESTGVSSPENLFKRAIDLLIGKSELCLENVIKNFKSDVNFKI

SEQ ID NO: 47100 - protein, 1029 aa, Aspergillus nidulans FGSC A4
MTGSECQPRHSASSGTGRDIHTLSWDGDHDPANPFNWSISRKWAVTYLAALISFLTMMNGTIITVAHFEIAELFNIDETAFPHTYWPVTTWAVGGAFSALFLLPLAEDFGTRPVFLVTYFAFVCFLIPQAVAQNFATLVATRFFAGACVAILANTAAGVIGNVWDTEWSRSIPVSLYIFGYMAGSSMGPVIGAAVLQSLSWRWIGYMQLIWFGALFPIYYFFFYESRGDIILAQRDRKMGKNGKDILPGHPAHSKLNLQNLAVSSTRPVILFCTEPVLFVSTLWSAFTVGTIFLFTQSVEQVFIGTYDWTISKTGYVQAAVVIGEGIGFFFSFLSRELYFASASRNTEVPNSLIPEARLYMAVLGGLFGISGGMFTYAWTSYPFIPWIAPAISLAMVGAGSVLVVTGVSDYVVDAYSQYAGSAIGAVATGENIFSAFLPLATMSMYNNLGFQWASTLLAFVSLVLALVPTLMFVWGRELDNYALPTIATYAYSPANHYCTTQQAFQCHCSNFPSLHSCPTTTRHRPTNHLLKMPSLANTLKDPTLFIESSYIDGKWVTSSSSRTFNVYDPATEEFIGTCPESNIDDINSAIRAAATAFPKWRALSGRQRGRILRRWFDLIVENKEDIGKIITAENGKAKGDAEGEALFSAGFFEWFSEEAARIYGDVVPHSNPSSRVQVLKEPVGVCGLITPWNFPMAMGARKVAAALAAGCTVVLKSDGLTPYSSNVLALLAERAGVPGGVFNVVTALENTPALGLALCESDNVKKISFTGSTRVGKLLMKQSSHTLKKLSLELGGNAPFIVFDDADLETAVTSAVACKFKVTGQTCVCANRFYVQEGIYEAFSKRFVEEVKKCQVGHGLDPGVTHGPLTNGIAKTQEHIQDALNKGATVLLGGSRLPSLGKNFHELTILGDVDDSMKVASEETFGPLAALSKFKAEDEVVRRANGVEVGLASYLITSDLGKAHRVSEKLEFGMVAINTGVISDSAAPFGGVKHSGMGREGSKYGIDDYLNIKTIVTGGIHTAYSAHL

SEQ ID NO: 47101 - protein, 202 aa, Salmonella typhimurium
  misc_feature (140)..(140): Xaa can be any naturally occurring amino acid
MKKVVTVCPYCASGCKINLVVDNGKIVRAEAAQGKTNQGTLCLKGYYGWDFINDTQILTPRLKTPMIRRQRGGKLESVSWDEALNYVAERLSAIKAKYGPDAIQTTGSSRGTGNETNYVMQKFARAVIGTNNVDCCARVXHGPSVAGLHQSVGNGAMSNAINEIDNTDLVFVFGYNPADSHPIVANHVINAKRNGAKIIVCD

SEQ ID NO: 47102 - protein, 357 aa, Marinobacter sp. ELB17
MSRAILLLPGDGIGPEIMGEAEKVLRRVNESFKLDLSFQHGLVGGAALDDSDTPLPDETLELATKADAILLGAVGGPKWDGLPMAKRPEKGLLGLRSKLELFANFRPAILYPQLASASSLKPEVVSGLDIMIIRELTGGIYFGQPRGVRQLESGERQGYNTYAYTETEIRRIGRVAFETAQQRGKKLCSVDKANVLEVTVLWREIMNELKLEYPNVELSHMYVDNAAMQLVRAPKQFDVIVTGNMFGDILSDEAAMLTGSIGMLPSASMNSAKQGLYEPCHGSAPDIAGKGIANPLATILSVAMMLRYSLDEGAAAAAIEAAVGKVLDQGLRTADIMSEGCTRVSTREMGEAVLAQL

SEQ ID NO: 47103 - protein, 170 aa, Brassica oleracea var. capitata
DGLDACTIIIWVASALHAAVNFGQYPYAGFLPNRPTVSRRFMPEPGTEEYTELEENEEVAFLKTITPQLQTLLGISIIEILSMHSTDEIYLGQRDSPNWTADEEPLEAFKRFGKSLELIENNIIRRNNDKKFKNRTGPVNIPYTLLYPNTTDYTRESGLTGKGIPNSVSI

SEQ ID NO: 47104 - protein, 373 aa, Oryza sativa (japonica cultivar-group)
MVAGGGNGGAAVLVGITVLLFVVVVVVVVLVRWWSGGEGGAAPSPPALPVLGHLHLLKKPLHRSLAAVAAGETFSVNGKPSVGDFFPALRWVDRLRGKVGSLKKLQARRDAMVTGLIDDHRQWRSGSAGDGDQDKEKKGVIDALLALQETDPDHYTDNVVKGIILSLLFAGTDTSALTIEWAMAQLVTHPETMKKARAEIDANVGTARLVEEADMANLPYIQCVIKETLRLRTAGPVIPAHEAMEDTTVGGFRVARGTKVLVNAWAIHRDGDVWDAPEEFRPERFVDSDAGGAVTAPMMPFGLGRRRCPGEGLAVRVVGVSVAALVQCFDWEVGDDDVVDMTEGGGLTMPMATPLADVCRPREFVKTILSTSM

SEQ ID NO: 47105 - protein, 452 aa, Arabidopsis thaliana
MDLSGSRDVISSLPDDISSHILSFLPTKEAASTSVLSKKWRYLFAFVPNLDLDDSVYLNPENETEISTSFMDFVDRVLALQGNSPLHKFSLKIGDGIDPVRIIPWINNVLERGVSDLDLHLNLESEFLLPSQVYLCKTLVWLKLRFGLYPTIDVEDVHLPKLKTLYIEATHFEEHGVGLTKLLSGCPMLEDLVLDDISWFIWDFASVSVPTLKRLRFSWQERDEFPKSVLLDTPNLVYLKFTDTVAGKYPKVNLDSLVEAHIDLRLLKPLLINYHQGYGENDMVGNATDFIMRICNVKTLYLSANTLQVLTYSCDAIPIFNNLTHLTIESNPRVGWQSVPGLLKNSPNLETLIFQGLIHKATYRCGDILKFGENSDDMEKQREQIKYFLETMPNLEKMILYYNTPSVEDVTEVSSRLQRLVSKVASSTCIVQLISDNLSLSSTVSTNGLLCF

SEQ ID NO: 47106 - protein, 332 aa, Zea mays
  misc_feature (46)..(46): Xaa can be any naturally occurring amino acid
MSGHGDTATSAKMAKLKELLQKSENHICADCGASDPKWASANIGAXNRSANIGVFICVKCSGVHRSLGTHISKVLSVTLDKWSDSEVDSMIEVGGNSQANAIYEAFIPEGYQKPHSDSTQEEREKFIRSKYELQEFLKPSLRIVSHQPSDSGKHAGNASHSDGSKSQVGMIEFIGILNVKVIGGTNLAIRDMSSSDPYVVLTLGQQKAQTSVINGNLNPVWNEELKLSVPQQYGPLKLLQVFDHDMVSKDDLMGEAEIDLQTMINAAAAFGDPELLGDIQIGRWLKSEDNALVRDSAVVVSGGKVKQGMALKLQHTESGELELEMEWMPLNV

SEQ ID NO: 47107 - protein, 334 aa, Arabidopsis thaliana
MSKNNKKKRRWDLKNGGILLEELIASFDGKTNPIRCFSSDQILKATDNFSESRIISSWGYFIWYKGVIEERQVSIKKWSSQNLSSFTEAYRDISVSSQMSGHKNALKLIGCCLEFDLPALVCEYTEHGPLNRDGGLSSGVVLPWKVRLKIAKEIASSVTYLHTAFPETIVHRNINPTNIFIDENWTAKLSDFWFCVAIPEGELYVEDDVKGVIGFVDPDYYWTMKVTEKVDIYSFGVVMLVLLSGRAAVFNGPDEAPMSLNDHVSEVMEKGEFDEIVDKEIWNDLGGDDDLVLRRSQVKAFLRLALRCVRYKKEDPVSGMLEVAKELKLIEKLS

SEQ ID NO: 47108 - protein, 362 aa, Triticum aestivum
MANQDVVLRPDMGGIASAAAMPGSSSRPIFACRGAASTSLRRRSGVDDDYGARSPCATSWVVQAMRASSPARSAAVDEYAAWTRKHPSALASFEQIAASAKGKQVVVFLDYDGTLSPIVADPDTAFITGEMREAVRGVAKHFPAAIVTGRCVEKVCSFVGLSELYYAGSHGMDIKGPGSNAEEVLLQPAREFLPVIAEVYEALVEKTKSTPGARVENKFCLSVHFRCVDEKRWSPLAEQVKEVLRDYPDLRLNEGRKVLEIRPSIMWDKGKAVEFLLQSLGFDGRSDVLPLYLGDDRTDEDAFKMLRKRGHGLGILVSKCPRETDASYSLQDPTEVMEFLHRLVQWKRRRSSSSSSAMRARV

SEQ ID NO: 47109 - protein, 356 aa, Coccidioides immitis RS
MAAKGTMKAVVFKGPYKVELEDRPIPQIQSPKDIIVKVTYTALCGSELHVFRGHQPSGAGFIMGHEYTGIVTEVGSDVKTVKPGDKIVSPFTSSCGECFYCKRGFSSRCEQSQLLGSATLDGGQAEYVRMPNADGTVMKAPEGINDHALVLMADIFPTGYFAASNAFREFTKEQISELTVVLIGCGPVGLCALINAEDYKPKHLLAVDSIPSRLELARSLGAEPWNYQTDREGLDKRVKELTEGRGADVVIEVVGLSPALKMGFELLRPWGTISSVGVHNGEIPWTGNQAYGKNLKVQMGRCPVRSIFPQALDMLKKKQHLLGFMADKIMPLSQAVEGYGIFDKMQVQKVIFDASQ

SEQ ID NO: 47110 - protein, 223 aa, Helianthus tuberosus
NEGVGAFYKGLSAGLLRQATYTTARLGTFRILTNKALEANDGKPLPLYQKALCGLTAGAIGACVGSPADLALIRMQADATLPAAQRRNYTNAFHALYRITADEGVLALWKGAGPTVVRAMALNMGMLASYDQSVEFFKDSLGFGEGATILGASSVSGFFAAACSLPFDYVKTQIQKMQPDAAGKYPYTGSMDCAMKTLKSGGPFKFYTGFPVYCVRIAPHVMM

SEQ ID NO: 47111 - protein, 203 aa, Glycine max
MGMIVEVENENGDLNDAVLVPPPNFSMVEDCIFRSGLPNPSNFPFLQTLNLRSIIYLCPEPYPEENLDFLRSQNIRLFQFGIEGKTDISMPILKDSIMDALEGLIDVRNHPVLIHCKRGKHRTGCLVGCLRKLQNWCLSSVFEEYQRFAGAKSRTMDLAFIEMFDVLSLSQCLYSIIYQYHGSKKRRLLYKDENLQKPRLTSF

SEQ ID NO: 47112 - protein, 358 aa, Arabidopsis thaliana
LLAQGFYFSRVYLSHSAIMESLGKLQLHHQPFHLSFTRTSSSTFPKNLFKSSIQPISSLKSASIKASSSKFQNFITPLPKSTPFRLFKSTCITLTTAAALLLANLHLKSPAIAAPIAPPPSVESKENVTLEEEERALDEHLITHPSDVDALRSLMEVKIKSRKLTEAVEVIDRLIKLEPEEKEWPVLKANIFTYSGDLDLAKTGFEEILAKDPLRVEAYHGLLMAYSDAGLDLKEVESRIEEAMLKCKKENNQNDFRDFKLLVAQIRVIEGKHSEALKLYQELVKEEPRDFRPYLCQGIIYTLLKKKDKAEEQFDNFRKLVPKNHPYREYFMDNMIATKLFSEKAQREMAEEMAGSTS

SEQ ID NO: 47113 - protein, 153 aa, Triticum aestivum
SVTIKHMIEDGCADDGIPLPNVPAKILSMVIEYCNKHAADAAADDTNKHVADPADADEDDDNNNNNASAGEKEDLKSFDASLVAVDQAMLFDIILAANFLSIKGLLDLACQKVADDIKDKSVEEVREIFKIENDFTKEEEEAVRKENAWAFNE

SEQ ID NO: 47114 - protein, 347 aa, Burkholderia mallei ATCC 23344
MTTASKEGPAASPMTMIQALRSAMDVMLERDGNVVVFGQDVGYFGGVFRCTEGLQNKYGKSRVFDAPINEGGIVGAAVGMGAYGLRPVCEIQFADYFYPASDQIVSEAARLRYRSAAEFIAPLTIRMPCGGGIYGGQTHSQSPEAMFTQVCGLRTVMPSNPYDAKGLLISAIENDDPVIFLEPKRLYNGPFDGHHERPVTPWSKHPASLVPDGYYTVPLDSAAIVRAGGDVTVLTYGTTVHVSLAAAEETGIDAEVIDLRSLWPLDLDTIVESVRRTGRCVVVHEATRTCGFGAELIALVQEHCFHWLEAPVERVTGWDTPYPHAQEWAYFPGPNRVGDALRRAMEN

SEQ ID NO: 47115 - protein, 104 aa, Xylella fastidiosa Dixon
MLVMERIQAEIEEHPLVLFMKGTLEFPMCGYSSRATQALLAAGARHLHIVNVLAEAEIRANLPRFSNWPTFPQLFIHGELIGGCEIILELFESGDLKRILSEAD

SEQ ID NO: 47116 - protein, 590 aa, Oryza sativa (japonica cultivar-group)
MVRRLLVILLQALTGLLVILALWIVSHLAGDRPPPGPVVCAANGTSGCTLTNIYGSFSDRAICRAANVTYPRTEEELVAAVAAAVAAGRKVKVATRYSNSFPRLACPGGEDGTVISTRWLDRAVRVDAARRLMTVESGMVMRDLIREAAAAGLALPHSPYWSGLTIGGVLATGAHGSSLWGKGSAVHEYVVGMRIVTPAPASEGFAAVRELAAGDPDLDAAKVSLGVLGAISQVTLELQPLFKRSVAFVTRNDSDVADTVAAWGRLHEFGDVAWLPRRRVAVYREDDRVDVATPGDGRSDYPAFRPTPTLPLVASRLAEEWLEERSGSDAARCAASRVMPATLEHLNYGLTNDGEAFTGTTGTSPPTTASGTALRGHLFYNSGFSIALSRAPAFVADVARIRDLNPAAFCQIDSKMGLLMRYVAASSAYLGKAEDSVDFDVTYYRSYARGAPRAHADVFDEVEQMALRKHGGVPHWGKNRNYAFDGAIARYPNAGKFMRVKDRFDPDGVFSSEWSDQVLGVGGASPVIVGDGCAMEGLCVCSDDSHCAPEKGYFCRPGKVFTAARVCSPSPRGAANGGDDDDEISDVGDE

SEQ ID NO: 47117 - protein, 466 aa, Burkholderia mallei ATCC 23344
MSDTKTTTLLVIGGGPGGYVAAIRAGQLGVRTILVERDRLGGTCLNIGCIPSKALIHAAGEFDKVRGFAGDSPLGIRTQAPAIDIARTVAWKDGIVKKLTGGVGALLKKNGVEVVHGDARVVDGKTVDVDTGGGARVRIQCEHLLLAAGSEPVELPAMPFGGNVISSTGALSPGRLPKRLVVVGAGYIGLELGIAYRKLGVEVSVVEARERILPIYDAELTKPVAASLKRLGVRVLLGHKVLGLNARGDAVCVQDDAHAQTELAADQVLVTVGRRPRTQGWGLETLQLDRAGAALKVDDMCRTSMRNVWAIGDLTGEPMLAHRAMAQGEMVAEIVAGKKRHFMPAAIAAICFTDPEVVSAGLAPDEAERTFGACVSASFPFAANGRALTLESADGFVRVVARRDDHLIVGWQAVGAGVSELAAAFSQSLEMGARLEDVGGTIHAHPTLGEAVMEAALRALGHALHI

SEQ ID NO: 47118 - protein, 382 aa, Guillardia theta
MSKNDFQITRMNDLVCIEFNSNGISRLRKISRKKIITESRTFPKNYFQKLFDLYFEYSYAKEFKKFPINLINEKDKRQIKKFLDDSIQLRDIRQVDPYFESKPTFWIRNNAILLSLEQIRAIVLFNKLFLFDPDNPKVQRAGKIISEKLEKFQEDSVEDRKTPFEFKALEGIFVNICMNLEKDFSYLEPTILENLDDLPTKLTSRMLEELRSFKQRLSQFSIRSQEVQRILQETLENENNLPNHYLSINNNNKKIKLKTTSDYYAIEIISEGFLQVVEHLTHRAELLDNAIDDTEDLVNIRLDTIRNKILFVELSLNIVSLTLSAGGLVAGLMGMNLGIPIFKEENSSTTFFILVSFLIIFSSLTLYLWLLNWCRIKGLYSI

SEQ ID NO: 47119 - protein, 348 aa, Ipomoea alba
ETLAGSGIERIPKEYIRPEEERRSIGDIFEEEKMGGGPQVPTVDLKGINSDDLEVREKCREELRKAAVDWGVMHLVNHGIPEELTGRVKAAGEGFFAQPIEEKEKYANDQAAGNVQGYGSKLANNASGQLEWEDYFFHCIFPQDKTDLSIWPKTPSDYIAATREYAKQLRALATKVLAVLSLGLGLDEGRLEKEVGGMEELLLQMKINYYPKCPQPELALGVEAHTDVSALTFILHNMVPGLQLFYGGKWVTAKCVPNSIIMHVGDTVEILSNGKYKSILHRGVVNKEKVRVSWAVFCEPPKDKILLQPLPETVSEAEPPRFPPRTFAQHIKHKLFRQSDQGADTPKT

SEQ ID NO: 47120 - protein, 528 aa, Thermobifida fusca YX
MSVAGAPESTFDTVLVVDFGAQYAQLIARRVRECHVYSEIVPPTMPVEEMLAKKPKAIILSGGPSSVYADGAPQAPPGLFDTGVPILGICYGFQVMAQTLGGTVERTGRSEYGRTTINVATDSLLFHSLPQQQTVWMSHGDAVSQVPDGFTVTGQTADAPVAAMEHRDRALYGVQFHPEVVHTEHGRAVLQHFLYEAAGCRPTWTMVNIVEDQVARIRAQIGSKRAICGLSGGVDSAVAAALVQRAIGDRLTCVFVDHGLLRQGEAEQVEKDFVAATGASLKVVDAQERFLTALAGVTDPETKRKIIGREFIRVFEQAAREIVAEAGEGDEAVEFLVQGTLYPDVVESGGGNGTANIKSHHNVGGLPDDLQFTLVEPLRELFKDEVRRVGEELGLPAEMVWRHPFPGPGLAIRIVGEVTAERLEILRAADAIVREELTRAGLDRAIWQCPVVLLADVRSVGVQGDGRTYGHPIVLRPVTSEDAMTADWARVPYDVLATISNRITNEVPDINRVTLDITSKPPGTIEWE

SEQ ID NO: 47121 - protein, 168 aa, Triticum aestivum
VREEEALVPHHELPNGTQPMDAAPAELATTVENQPTEDTPISRFTWTIDNLSRVNTKKLYSETFVVGGYKWRVLIFPRGNNVEFLSMYLDVADSAVLPYGWTRYAQFSLSVVNQIHNKFTIRKETQHQFSARESDWGFTSFMPLSELYNPSRGYLVNDTCVIEAEVAV

SEQ ID NO: 47122 - protein, 121 aa, Brassica napus
MMSFFSIISLLLLLFSLSSVVISDGESFQKLPVPENRSGPEAFAFDSTGKGFYTGVSGGKILKYTPETGYVDFAQITESSNSSWCDGVVGTALAGRCGRPAGIAFNEKTGELYVADAPLGI

SEQ ID NO: 47123 - protein, 464 aa, Oryza sativa (japonica cultivar-group)
MAHVMAASELVTATIKRPFQNDDDNSSNGNGNADGKPKARRREADPAAALAAARHEFGEHGGVNMSIEASATFTVMEPDTMRRLFSGELGPERGDLYIYSRHFNPTVLALGRQMAALEGTEAAYCTASGMSAISSVLMQLVGAGGHVVASRCLYGGTHALLSRFLPRASGVRATFVDADDEAAVRAAVRPGETRVVYVETMSNPTLAVADIPMLARVAHDAGAKLVVDNTFTPMVVSPARLGADVVVHSVSKFISGGADIIAGAICGPASLVNAMMDLQEGALMLLGPTMNAKVAFELSERLPHLPLRMQEHSRRAAEYASRMRRLGLRVAYPGLPDHPHHARLLAIANPGYGAGGMLCVDMGTEDRANRLMHHLQNTTRFGLMAVSLGYYETLMSCSGSSTSSEMPPEDRARAGISPGLVRMSVGYNGTLEQRWAQFERALSLMQQQQQQHPDRDAAAKYCKV

SEQ ID NO: 47124 - protein, 433 aa, Bacillus clausii KSM-K16
MKQTNMRLGIKEIPRPGEWLLFSLQHLCAMFGATVLVPFLVGMSPATALFSSGLGTLAFILVTKGQVPAYLGSSFAFIVPLTTSQALGGIEGAMVGSFFAGLVYGIVALFIKFAGTGWITKVLPPIVVGPVIMVIGLSLATTAVGNAMYLPNSEEYSLVHIATAGVTLFVAVVATMYFKGFLNLIPILLGLIAGYLFALWQGLIDLEPIRTASWFSVPELIVPFVTYSPTVNWAIVAIMAPVALVTLAEHTGQLMVLSKVAGKNFLKQPGMHRTVMGDGLATMIAAAVGGPPNTTYGENVGVVAITRVFSVFVVGGAAVLAIAFAFVGKVAALISSIPPAVMGGVSILLFGIIASAGIRMLVDNRVDMGEKRNMVIASIILVIGIGGAAVRFTDSFEIAGMSLATVIGLILHGLLPNRSVSYGQKDMFESDAN

SEQ ID NO: 47125 - protein, 132 aa, Anabaena variabilis ATCC 29413
MAHQVIRTDKAPAPVGPYNQAIAASGKLLFLAGQIALDPNTGTVVGEGDVKQQTEQVFANIQAILQAAGIKFSNVVKTTVFLADMNDFAAVNAVYAKYFEETTAPARACVEVSRLPKDVLVEIECIAVIPER

SEQ ID NO: 47126 - protein, 111 aa, Brassica napus
  misc_feature (45)..(45): Xaa can be any naturally occurring amino acid
MSEVMIHSSSFLLPSIPADEASAYAIVVLNQNLPRFTPLLWEHEXAKLRVCADGGANRIYDELPLFFPREDALLIRNRYKPDVIKGDMDSIRLDVLHFYQSLVSFLLCVFV

SEQ ID NO: 47127 - protein, 212 aa, Medicago truncatula
MEVHSSVVAKRLWNVLRITFFMMRKSLVSKRKMIMDMNLMMKKGKVLRKSLSNLMSSHNRHHHHSSKNGGGFMVHDYEFSCSNSPNPAFFNMSKRKHHFSFPCINAPNVIDEEPLPCQYQLSPIEFDIENVSKDGKAMVPKTPEYAFNFKFDSSEERKSPLLSPFSVRVSNYSALGDNDEIGNCQVDDEAEDFIRRFYEQLRTQGRMQLPGF

SEQ ID NO: 47128 - protein, 258 aa, Guillardia theta
MNSSKSRNKILTKRTKYNLKGGLRVIIEKHKYDGVFIARSKQDALCTKNLIIGSSVYGEKRILINKNNDSVEEYRVWNPFRSKLAAVILGGVDDIFLRRGMSVLYLGAANGTTVSHISDIIGIEGTVYAVEFSHRSGRDLLNLAKKRTNVVPIIEDARYPYKYRMLLGITDLVFSDVAQPDQARILSINSKHFLKTGGYFIIAIKASCIDSIVDPNIVFSKEIQKLIRNNFKPSEQLTLEPYERDHAVVLGRFNTKKN

SEQ ID NO: 47129 - protein, 496 aa, Mycobacterium avium 104
MTDTATETLVQFDLLIGGESSSAASGLTYDSVDPFTGRPWARVPNAAAADVDRAVGAARAALNGPWGALTATARGKLLHRLGEIIAREADQLAELEVRDGGKLVREMVGQMRSLPDYYFYYGGLADKLQGDVIPVDKPNYFVYTRHEPVGVVGAITPWNSPLLLLTWKLAAGLAAGCTFVVKPSDHTPTSTLAFAKLFAEAGFPPGVINVVTGWGPETGAALASHPGVDKVAFTGSTATGIHVGKAAIENMTRFSLELGGKSAQVVFADADLDAAANGVIAGVFAATGQTCLAGSRLLVDRSVADALVEKIVARAATIKLGDPKDPTTEMGPVSNLPQYEKVLSHFASAREQGATVAYGGEPASDLGGFFVKPTVLTGVDPSMRAVAEEIFGPVLAVMTFEDEDEAVAAANGTEFGLAAAVWTKDVHRAHRVAAKLRAGTVWVNAYRVVAPHVPFGGIGYSGIGRENGIDAVKDFTETKAVWVELSGETRDPFTLG

SEQ ID NO: 47130 - protein, 160 aa, Guillardia theta
MYNEPRTFIPNHILVSMGLVSTFMVIICLGYTYKLLQDLSTDTVNPVEVCDKVNQLKVPEYLAHLFLSIAFVIRGWWIVGFLNFPFIFYNFAQWYEGKHQLDSAQIFNVLSRELRVIKAKSAFFIIIVIYTIWEWMIWVPPDYVSAGEGYHVVKQIQVSH

SEQ ID NO: 47131 - protein, 427 aa, Alkalilimnicola ehrlichei MLHE-1
MSFDSLGLSAVLLRAVAEQGYSKPTPVQAQAIPAILQGGDVMAAAQTGTGKTAGFTLPMLERLSQNRPEGGRRRVRALILTPTRELAAQVRDSVKTYGGKLPLKTAVIFGGVGMNPQIQTLRRGVDIVVATPGRLLDHMGQGTVDLSGVEMLVLDEADRMLDMGFIRDIRRVIAAVPKQRQTLMFSATFSKEIRQLAEGMLRNPTQIEVAARNTAAENVNQRVHPVSRGEKRALLSNLIQDGDWRQVLVFTRTKHGADRLARQLDQDGLSSAAIHGNKSQSARTKALAQFKQGRVRVLVATDIAARGLDIDQLPHVVNYELPNVPEDYVHRIGRTGRAGRGGEALSLVCVDEHKLLDGIHKLLKRPIDQHIVPGFEPDPSERPQPLFKKPAGRGAGGGRRPNGAPAGNRPQGGRRRGGRPGQSARQG

SEQ ID NO: 47132 - protein, 513 aa, Triticum aestivum
MGPPQPAKGIISIEACARPIAVDHRISLPYYFRIAGTLLRQAKIYRDEKNILDLYVILLRYTSLLCETIPKHRDYPVFKLREAEFVRNANSSTLIDVVNELESLKPVVKRQLVEHNRRGSPEANGLNGTPAASLRTEKHPRTTYSTQPFVGSLQKFYPDGRHHVASWTSIQIDRQIRKQFVNLPFPKEETLARHSILGPNGLHGQWNGPVAAVKVQYPCNLEFTQSDMTSLVPAMLNQDGLHGPSTTHPDSTTKDNDDMQSVLSLDDGRWSAPAEECTSTPSASLEGELSQLNIRQPSPPPILAEVHPDRAPPISPSRVADPTQGLAISETGRYHNLHVPVKLMECFLRVAEANTKRSLETCGVLAGTLKKRTFHITTLIIPKQKSTSDSCEATNEEELFEVQDKGSLFTLGWIHTHPTQSCFLSSIDLHNHYSYQVMLPEAIAIVMAPTDTRKKHGIFHLTDPGGIGVIHDCPERGFHPHKAPLDGSPIYEHCSHVYMNADTKFDMIDLREQ

SEQ ID NO: 47133 - protein, 189 aa, Haloarcula marismortui ATCC 43049
MTRIDVIDNHGQFTHLEQRALRDMGVDVSLRDNTTPPEEIDADGIVLSGGPDMDDIGNCPEYLDLDVPVLGICLGMQLIADELGGRVGGGEYGGYADVTVDILDDDDPLLGSLYPETRVWASHADEVKEVPPGFERTATSDVCGVEAMSNTDEAIYGVQWHPEVAHTEEGEEVFENFLSVCDQQSVARQ

SEQ ID NO: 47134 - protein, 261 aa, Anabaena variabilis ATCC 29413
MTASNPTILALDFDGVICDGLIEYFEVAWRTYCQLWSPADDIPPDDLALRFYRLRPVIETGWEMPVLIKALVDGNSDDQILQEWTSITPKILLDDKLQAKEIATKLDALRDQWIANDLDGWLSLHRFYQGVIEKLKITVASEVKLYIVTTKEGRFVEQLLHQEGVDLPRDSIFGKEVKRPKYEILRELIQAADHKPVSLWFVEDRIKTLQLVQQQTDLEDVKLFLADWGYNTQSERKAAQNDPRIQLLSLSQFAKDFPGWV

SEQ ID NO: 47135 - protein, 120 aa, Solibacter usitatus Ellin6076
MIERISPPGAPAPRGPYSPAVRAGDFIFVSGQVAPVTGEVSNETRQVLTNIKSLLESCGATMADVVKCGVFLAEAGDFAAMNAVYAEFFGDAKPARATVVTGFAVPGIHVEIEAIAYKPR

SEQ ID NO: 47136 - protein, 300 aa, Wolinella succinogenes DSM 1740
MSVLERIEARVKEWLLEVGSKEALQMSQSLSSGKMLRSKLILAIAGESEESLSLCAAVELIQSASLLHDDVIDDAFTRRGKPSINAAFGNKNAIMLGDIFYSKAFFELTRFSPLIARTVSHAVVRLSLGELADVTLAQTFNLEEHLYMQMIEDKTASLIEAAAQAAALLVSRDSEAFRIYGKNLGLAFQIIDDLLDITQDSTTLGKPALNDFCEGKSTLPYIYLHRALDSADKARLEASFARTLAPEEAAWIKEKMHEHGAIAQSYALARSLGLEAIEQIRSQKCEKLEVIMREMIEREF

SEQ ID NO: 47137 - protein, 323 aa, Arabidopsis thaliana
VFARDDNLSEETKTLISSLPTYQDSHVKLCKYQGCWYYHNTLQAVINYQRNFQPQDTDIILASFPKSGTTWLKALSVAIVERSKQPFDDDPLTHPLLSDNPHGIVPFFEFDMYLKTSTPDLTKFSTSSPRLFSTHMPLHTFKEGLKGSPCKVVYMCRNIKDVLISDWHFRSKYSNNEVSRSTLESMFESFCGGVSFYGPFWDHALSYWRGSLENPKHVLFMRYEEMKTEPCVQVKRLAEFLGFPFTKEEEDSGSISKLLELCSLGNLSGLEVNKTGKTWMNYDYKSYFRKGEVGDWKNHLTPEMENKIDMIIEEKLKGSDLKF

SEQ ID NO: 47138 - protein, 491 aa, Coccidioides immitis RS
MSQMAPSQSLQAALSSVQEAFVKRNPQSNQAHKEACRYFPGGNTRSVLYTTPFPLSFQSGHGSTLTSVDGDTYTDFLGEYSAGIFGHSNPQIAEALAGVLSRGWNFGGVNSHEAILARKVCERFNLEMVRFTNSGTEANMMALAAALAFSARNHPGRPEPKSIVVFSNAYHGSTLSFPNTLVDEIRRGHDVSHLTPNLPHNFLIAPWNNPAETAELLATRPRGSIAAILVEPLQGAGGCRPASAHFLKTLRALADQKSALLIVDEVMTSRLATRGLAQEWALRPDLITLGKWIGGGMSFGAFGGRRDVLQLFDPRTTKVPLGHAGTFNNNVLSMAAGCAGLDVYSGQRVARLNELGSTLKARLHALLADASLCEPPANRTDNDNDDDDDDAQRYPLETDSNSDTNDVPPTPPPGRMYVSGYGSVLSIRFSGPDATTCHQLFFHHMLEEKIYLAARGYMALSLELSRADIEHFIAAVQRFVTKYAALLLKDG

SEQ ID NO: 47139 - protein, 265 aa, Triticum aestivum
  misc_feature (185)..(185): Xaa can be any naturally occurring amino acid
  misc_feature (226)..(226): Xaa can be any naturally occurring amino acid
  misc_feature (242)..(242): Xaa can be any naturally occurring amino acid
LYRTSLYKKAGWYRSGIPGISSTHASDGISKEASTVYRSTLRYEGFSEIMAILAKIGFFDAENHPLLQETNRPTYRIFLNELLNVNNVSTSNTKVNGEETGGHDDELISRLMMLGHCKEKELAVKILKTIKFLGLHEETQIPKDCSSAFSVICQRMEQRMAYGHNEQDMVLLHHEVEVEYPDGRXTEKHQATLLEFGKTENGRSTTAMALTVGVPAAIGSLLLLRXVQRKGVIRPLKPEIYXPALENLESGGASSLIEKRGRLEK

SEQ ID NO: 47140 - protein, 1085 aa, Magnetospirillum magnetotacticum MS-1
MPKRTDIKSILIIGAGPIVIGQACEFDYSGVQACKALKDEGYRVILVNSNPATIMTDPGLADATYIEPITPEIVAKIIEKERPDALLPTMGGQTALNTAMKLADMGILEKFGVEMIAAKRDVIAKAEDRLLFRDAMDKIGLESPKSRMVKTLQEARDALDFVGLPAIIRPSFTLAGTGGGIAYNVAEYEHIVSGGLAASPVHEVLVEESVLGWKEYEMEVVRDKKDNCIIICSIENVDPMGVHTGDSITVAPALTLTDKEYQIMRNASLAVLREIGVDTGGSNVQFAVNPKDGRMTVIEMNPRVSRSSALASKATGFPIAKVAAKLAVGYTLDELTNDITGCTPASFEPTIDYVVTKIPRFTFEKFPGADTNLTTSMKSVGEAMAIGRTFQESLQKGLRSMETGLTGLDEVEIPGAGAGDMKDAVKSALAQPRHDRLLVIAQAFRLGLSIDEVHAACFYDKWFLAQLKGIVDAEAEVKAKGLPIDAPGLLRLKKMGFSDQRLSKLSGKSLVETAFRREVLNVKPVFKRIDTCAAEFPSSTAYMYSCYEGDGVNAAECESDPSDREKVIILGGGPNRIGQGIEFDYCCVHAAYALDEAGKETIMVNCNPETVSTDYDTSDRLYFEPLTAETVIDLVRREQSNGKVLGCIVQFGGQTPLKLAHALENAGIPILGTSPDSIDLAEDRERFQKMLHELGLKQPANGTARSLEEAIKVAEKIGYPVVIRPSFVLGGRAMQIVYDHEALERYMVEAVKVSGDDPVLIDFYLKDAIEVDVDALCDGNQVYVAGIMQHIEEAGIHSGDSACSLPPYSLDKATIAELERQTAAMAKALNVVGLMNCQYAIKDGDIYILEVNPRASRTVPFVAKATGVPIAKIAARVMAGETLASFGLSTRPELKHVAVKEAVFPFARFPGVDILLGPEMKSTGEVMGIDSDFARAFAKSQLGAGTNLPTEGGAFISVRDGDKPAMVEIARRLLEMGFKVMATDGTAFYLKDRGVTGVTIVNKVLEGRPHCVDAMMNGQVQLVVNTTEGSQAVKDSFSIRRTALTNNIPHYTTVAGARAAVEAIEAMRCGTLDVAPLQSYFKGSF

SEQ ID NO: 47141 - protein, 405 aa, Haloarcula marismortui ATCC 43049
MYFIDDSRSFSLETLADEFSKTIREEMDYQREGRMLTEIRENFRDNDRICIPEVKESHSTRRVLTMEYVPGTKINDIDSLDAGGINRTELAETLQRAYLQMIIDDGVFHADPHPGNLAVQDDGTLVFYDFGMSGRVDPFVQDKIIDFYAAVADQDIDAILDALIEMGTLSPEADRQVMGDVMELAIADARGEDIEQYRVQQIIQQVEDTIYEFPLRLPANLALVLRVATVVEGVCVTLDEDFDFIGVATDYLREEGYLAEGVRNFVEDRATEVSDAARSAVRIPPKLESALDRVEREDFRVQADIEDSDGLLATMTKRLILGMLLASTLFSTAFLYTQASLPATGVGIAGTVGLSLALWWSFRSKKAVRAKPQFTRQSMREQDRESPGGLNTSFGEDTDDAYSGD

SEQ ID NO: 47142 - protein, 174 aa, Glycine max
  misc_feature (157)..(157): Xaa can be any naturally occurring amino acid
  misc_feature (164)..(164): Xaa can be any naturally occurring amino acid
MSFYIGREASKLWKRFYAETTTELNLLAENWKYLLAGIAFQYIHGLAARGVHYLHRPGPTLQDLGFILLPELGQEKAYISETLFTFIFLSFVLWTFHPFIFKSKKIYTALIWCRVLAFLVASQALRIVTFYATQLPGPNYHCREGSKLATLPRPDSXFEVLLIXSQDAIYGCRD

SEQ ID NO: 47143 - protein, 351 aa, Zea mays
  misc_feature (287)..(287): Xaa can be any naturally occurring amino acid
ARRKRGEVRSGRPWRRGGRSTGSPASPGGGRALRGSVNLSVPMWEKNFCTDACAIPWAKLCETKRLMSLYKSVVDWDDSAALEAFNDAKARFCAIYHGQHYDISLPDPDMFIDIINPDEYVDLELVADLEKSRRRVPRKDDGVPDVWDSFILSDKPVPVTGWGDTDTSFTHGQQLSVNWDYQLKHSVEANHKHMSANWDYSIKRPAQIVCQQNSGKQQDQTSSQGEQTNSCISHWIMRGGSQDAWKHDSGWGPAAIQTDLWDNRQGSYEVPDSKGMPYGHWTYWRRXNDDSGRRNTRNRGGPISSKPMKSKYQTDEHNVAINGWRNCRVRNDVYYYYPYGQAVPSSHTQCE

SEQ ID NO: 47144 - protein, 273 aa, Anabaena variabilis ATCC 29413
MRYRALIVAFLAVCLGLLTACSDAPASSTRDILTYEQIRGTGLANKCPQLTETSRGSIPLDSSKSYVIKELCLEPTNFFVKEEPANKRQAAEFVAGKLLTRYTSTIDQVSGDLKFNDDSSLTFVEKDGLDFQAITVQLPGGERVPFLFTIKNLVAQTQPGLSSLNTSTDFEGTFKVPSYRGAAFLDPKGRGVVSGYDNAVALPAQADDEDLTRTNVKRAEILNGKISLQIAKVDSSSGEIAGTFESEQPSDTDLGADEPKEVKIRGIFYARVE

SEQ ID NO: 47145 - protein, 303 aa, Guillardia theta
MDNYKRIEILGQGAYGKVYKAQDLRNGNLVALKKALSSSDEEGIPPTTLREISILKSVSECEFIVKLLDVVNTKSKNGKISIYIVFQYLDSDLKSYMISNYGKGRGMDENSAKKFCFQLLIGMYHCHKLGIIHRDLKPQNILIEKGEKLKIADFGLSRNFSIPVGKYTHEVVTLWYRAPEILLGARTYSSPVDIWSIGCIFAEMLTGNPLFCGESEIEQLLSIFKTIGTPTSQTWPEVLNFKDWHEFPIWPQINLKYSFENISEETLEFIQVFLRLNPNKRISILGAITNTYFEHFFKDYNLY

SEQ ID NO: 47146 - protein, 162 aa, Castanea sativa
TKSRFLLAIDTGVLSSDSFPPSKGSFRADYRPILDPVIRFLVNNGSPLLVNLYPYFSYTGNTKDIRLDYALFTAPSPVVNDPPLSYRNLFDAILDTVYSALEKAGGGSLVIVISESGWPSAGGTATTLDNERTYITNLVQHVKGGTPKKPGRPIETYIFALF

SEQ ID NO: 47147 - protein, 159 aa, Castanea sativa
DQIKVSTAVDTNLLDVFDPPSAGAFSDNARPFIEPIISFLVSNGAPLLANIYPYFRVRYNNQPVPYALFTATEVVVHDGQLEYRNLFDALMDALYSALEKRNGGSLKIVVSESGWPSAGGDVETIENAGTYYRNLINHVKGGAPKRPAKAIEAYLFAMF

SEQ ID NO: 47148 - protein, 289 aa, Oryza sativa (japonica cultivar-group)
LVVDLNCCRLDSCRGSKDTKREQECGRPLGLKFNSKTGELYVADAYLGLRVVSPGENVSRPLVPKRTGSPFSFSNGVEIDHETGVIYFTETSTRFQRREFLNIVITGDNTGRLLKYDPKENKVEVLVDGLRFPNGLAMSIDGSYLLLAETTTGKILRYWIKTPKASTIEEVAQLPGFPDNIKMSPRGGFWVGLHAKRGKIAEWSISYPWLRKLIFKLPAQRIQRITSFLTGFGRQVIALRLSEDGKTIEAMSVHGDVRKLFKSISEVEEKDGNLWIGSVLSPFLGLYRI

SEQ ID NO: 47149 - protein, 424 aa, Arabidopsis thaliana
MATPMVEDTSSFEEDQLASMSTEDITRATRLLDNEIRILKEDAQRTNLECDSYKEKIKENQEKIKLNKQLPYLVGNIVEILEMNPEDDAEEDGANIDLDSQRKGKCVVLKTSTRQTIFLPVVGLVDPDSLKPGDLVGVNKDSYLILDTLPSEYDSRVKAMEVDEKPTEDYNDIGGLEKQIQELVEAIVLPMTHKERFEKLGVRPPKGVLLYGPPGTGKTLMARACAAQTNATFLKLAGPQLVQMFIGDGAKLVRDAFQLAKEKAPCIIFIDEIDAIGTKRFDSEVSGDREVQRTMLELLNQLDGFSSDERIKVIAATNRADILDPALMRSGRLDRKIEFPHPTEEARARILQIHSRKMNVHPDVHFEELARSTDDFHGAQLKAVCVEAGMLALRRDATEVNHEDFNEGIIQVQAKKKASLNYYA

SEQ ID NO: 47150 - protein, 452 aa, Zea mays
  misc_feature (141)..(141): Xaa can be any naturally occurring amino acid
  misc_feature (185)..(185): Xaa can be any naturally occurring amino acid
  misc_feature (203)..(203): Xaa can be any naturally occurring amino acid
  misc_feature (231)..(231): Xaa can be any naturally occurring amino acid
  misc_feature (327)..(327): Xaa can be any naturally occurring amino acid
MCGILAVLGCSDWSQAKRARILACSRRLKHRGPDWSGLYQHEGNFLAQQRLAVVSPLSGDQPLFNEDRTVVVVANGEIYNHKNVRKQFTGTHNFSTGSDCEVIIPLYEKYGENFVDMLDGVFAFVLYDTRDRTYVAARDAXIGVNPLYIGWGSDGSVWIASEMKALNEDCVRFEIFPPGHLYSSXAAGFPGGWYTPHWFQEQXPRMPYQPLVLREAFEKAVIKRLMTDVPXFGSSLSGGLDSSLVASVTKRHLVETEAAEKFGTELHSFVVGLEGSPDLKAAREVADYLGTIHHEFHFTVQDGIDAIEEVIYHDETYDVTTIRASTXPMFLMARKIKSLGVKMVLSGEGSDELLGGYLYFHFAPNKEEFHRETCRKVKALHQYDCLRANKATSAWGLEVRVPFLDKEFINVAMGMDPEWKMYDKNLGRIEKWVMRKAFDDDEHPYLPKVKTA

SEQ ID NO: 47151 - protein, 303 aa, Pinus taeda
SYCFERVAEFADRPCLIDGATDRTYCFSEVELISRKVAAGLAKLGLQQGQVVMLLLPNCIEFAFVFMGASVRGAIVTTANPFYKPGEIAKQAKAAGARIIVTLAAYVEKLADLQSHDVLVITIDDAPKEGCQHISVLTEADETECPAVKIHPDDVVALPYSSGTTGLPKGVMLTHKGLVSSVAQQVDGENPNLYFHSDDVILCVLPLFHIYSLNSVLLCALRAGAATLIMQKFNLTTCLELIQKYKVTVAPIVPPIVLDITKSPIVSQYDVSSVRIIMSGAAPLGKELEDALRERFPKAIFGQ

SEQ ID NO: 47152 - protein, 170 aa, Lactococcus lactis subsp. lactis
MELKDYIATIENYPKEGVVFRDISPLMADGNAYNYAATEIVQYARDKEIDMVVGPEARGFIIGCPVAFALGVGFAPVRKPGKLPREVIEATYEKEYGTDTLTMHSDSIKPGQRVLIVDDLLATGGTIAATIELVEKMGGIVVGCAFLIELDELKGREKIGDYDYKVLMHY

SEQ ID NO: 47153 - protein, 130 aa, Glycine max
MVRVSVLNDALESMYNAEKRGKRQVMIRPSSKVIIKFLLVMQKHGYIGEFEFVDDHRSGKIVVELNGRLNKCGVISPRFDVGVKEIEGWTARLLPSTQFGFIVLTTSAGIMDHEEARRKNVGGKVLGFFY

SEQ ID NO: 47154 - protein, 399 aa, Arabidopsis thaliana
MSSTSRSSAANNRKDPPRKKNKQTPSPVTREPTSIDSLPNDLLLNCFARVSRMYYPALSRVSKRFRSIVTSPEIYNTRSLLNRTEKCLYLCLRFPFDNNTHWFTLYQNPNQTVSDKVFLQIPSPQHPLTLSSNLVAVGSNIYRIGGTVGDDSCPLGFDREPSSKVSILDCRSHTWRDGPRMRLNRRSSTTSVVDGKIYVTGGTEDTDNPSHWIEVFDPKIQSWGTVTNPHIVKVWEEVCYRRAVKSIGHDGKLYLSGDKYVVYDPDEGKWNSVEEHWLIGYAIGSSNCVVDNILFYWDQGVFKWYDSKVSSWKQLKGLEGLPDDFSQREYCKLVDLGGKMAVLWDKWEYSGVCMIFCAEISLEKRDGDEIWGKVEWFDTVLEVGASCSLKSADALSASV

SEQ ID NO: 47155 - protein, 122 aa, Triticum aestivum
  misc_feature (31)..(31): Xaa can be any naturally occurring amino acid
  misc_feature (95)..(95): Xaa can be any naturally occurring amino acid
PKLKGPHNRRVRCTGQVPEVFKDTFWPLSRXAGEKPFVLGMYTQWCGPCKVMALKFQEMFEKGHDVVFLKLDCNQDNSPLAKELGIRVVPTFKIXKDGKVAKEVTGAKIDELARAIEEVKSS

SEQ ID NO: 47156 - protein, 310 aa, Escherichia coli B
MAGVNAAILEQLNSDVQLINQLGYYIVSGGGKRIRPMIAVLAARAVGYEGNAHVTIAALIEFIHTATLLHDDVVDESDMRRGKATANAAFGNAASVLVGDFIYTRAFQMMTSLGSLKVLEVMSEAVNVIAEGEVLQLMNVNDPDITEENYMRVIYSKTARLFEAAAQCSGILAGCTPEEEKGLQDYGRYLGTAFQLIDDLLDYNADGEQLGKNVGDDLNEGKPTLPLLHAMHHGTPEQAQMIRTAIEQGNGRHLLEPVLEAMNACGSLEWTRQRAEEEADKAIAALQVLPDTPWREALIGLAHIAVQRDR

SEQ ID NO: 47157 - protein, 652 aa, Mycobacterium tuberculosis
MVESGTGIPLPASCWSRTRSRRCMPKDSSPHWIWHSSAARAALYVRGKRRPDGQGRRSCALRNRGRTPATGPGPGQSPSPVGARQPALPSRRPLNPARSRTEVVMSDARVPRIPAALSAPSLNRGVGFTHAQRRRLGLTGRLPSAVLTLDQQAERVWHQLQSLATELGRNLLLEQLHYRHEVLYFKVLADHLPELMPVVYTPTVGEAIQRFSDEYRGQRGLFLSIDEPDEIEEAFNTLGLGPEDVDLIVCTDAEAILGIGDWGVGGIQIAVGKLALYTAGGGVDPRRCLAVSLDVGTDNEQLLADPFYLGNRHARRRGREYDEFVSRYIETAQRLFPRAILHFEDFGPANARKILDTYGTDYCVFNDDMQGTGAVVLAAVYSGLKVTGIPLRDQTIVVFGAGTAGMGIADQIRDAMVADGATLEQAVSQIWPIDRPGLLFDDMDDLRDFQVPYAKNRHQLGVAVGDRVGLSDAIKIASPTILLGCSTVYGAFTKEVVEAMTASCKHPMIFPLSNPTSRMEAIPADVLAWSNGRALLATGSPVAPVEFDETTYVIGQANNVLAFPGIGLGVIVAGARLITRRMLHAAAKAIAHQANPTNPGDSLLPDVQNLRAISTTVAEAVYRAAVQDGVASRTHDDVRQAIVDTMWLPAYD

SEQ ID NO: 47158 - protein, 506 aa, Oceanobacter sp. RED65
MPNTQGISLYSAPQVADMDRHAQHQGIDGFELMQQAGEAAFVALLNQWSSVSKLVIYAGAGNNGGDGYVIAKLAKDHEIDAEVIALKAPSELQGSAYKAAQLAKSAGVMISMYSRQCVQFQAGCIIVDALLGTGLERDVEGAYRDAIDDINNSGIPVLSVDVPSGINGSTGAIMGTAVKAELTVTMIAYKRGLFTAKGAIYSGQVRLAPLSVPKNLGPHVAQQDYRVSLSSWRACASLKWFEKRELDSHKGDFGHVLVVGGDIGFAGAAILAAGSALRSGAGLVSVATRREHVNAVLSHYPEAMVLGVDSGQELGMLLSQADSVVVGPGLGQSAWGQSLLQACFATRQPIVLDADALNLIAQGFIQHNLNQRTSVMTPHPGEAARLLGCTVKDVQADRFKAAHELSIRYHSTTVLKGNGSLVCEGEQISVCADGNPGMASGGMGDVLSGISGSFLAQASHDLPEASQQLMTSAVCLHSAAADEAAKTGENALLASDLIKQLGNLLP

SEQ ID NO: 47159 - protein, 152 aa, Debaryomyces hansenii CBS767
MSNNERTFIAIKPDGVQRGLINSILGRFENRGYKLVGIKLVQPTESLLREHYDDLQSKPFFPSLLSYMLSGPVLATVWEGKDVVKQGRAILGATNPLQSAPGTIRGDFAVDMGRNVCHGSDSVESAEKEIGLWFKKEELVDYKPALFGWIYE

SEQ ID NO: 47160 - protein, 623 aa, Oryza sativa
MATPSRTSWADVADADPAPAPAPAANGPARPDRSSYVPPHLRNRGASSGGGAAAPPPSSSSSSAPPPRAAPGLLAPRPAAAGMGRMGGGGGGGGFGGPRRWDREPNPFGNDGDAAAGAGDEPEVFDAHQNTGINFDAYEDIPVETSGREVPPPVGTFAEIDLGQALNDNIRRCKYVRPTPVQRYAIPISLAGRDLMACAQTGSGKTAAFCFPIISGIMRGPPAQRPQRGGMRTACPLALILSPTRELSMQIHEEARKFSYQTGVRVVVAYGGAPINQQLRDLERGVDILVATPGRLVDLLERARVSLQSIRYLALDEADRMLDMGFEPQVRRIVEQMDMPPPGARQTMLFSATFPKEIQRMASDFLENYIFLAVGRVGSSTDLIVQRVEFVQEADKRSHLMDLLHAQRDSATPGKPTLTLVFVETKRGADSLEHWLCMNGFPATSIHGDRNQQEREYALRSFKSGHTPILVATDVAARGLDIPHVAHVVNFDLPNDIDDYVHRIGRTGRAGKSGLATAFFHENNSSMARSLAERMQDSNQEVPAWLSRYAARPSYGGGGGRNRRSGGGSRFGGRDFRRDSSSGRGGGDYYGGGSSGGAGGYGGSSAYGGGGYGGGAGAPSAWD

SEQ ID NO: 47161 - protein, 63 aa, Pleurochrysis carterae
MRGILVDWLVEVHLKFKLMIETLYLTVNLIDRYLEKEKITRNKLQLVGVTAMFLASKYEEIYP

SEQ ID NO: 47162 - protein, 331 aa, Wolinella succinogenes DSM 1740
MILSIESSCDDSSIAITRLEDRAILFHKKISQDSAHSPHGGVVPELASRLHAVALPKILEECAPFFPRLKAIAVTNEPGLSVTLLEGVMMAKALALALHLPLIAVNHLKGHLYSLFLEQESRFPLDVLLVSGGHTMVLHARSFGEIEIIGQSMDDSFGESFDKVAKMLSLGYPGGPIVESYAKEGDASRFPLPLPLAGKKEVAFSFSGLKNAVRLVIQSLQNPPNEQEKRDICASFQATAIAHLIQKCRLYLATSNAPYLAIVGGASANLALREEMERLGEHFGKKLLLAPLAYCSDNAAMIGRAALESYALGAFTSPLELTVRPRTPSLC

SEQ ID NO: 47163 - protein, 500 aa, Guillardia theta
MRQKFSLSDDVMKIVQSLSTTLGPNGKDKILIDNEGHINTTNDGATILKNIKSNTIASLILKDVCSVQDLELGDGTTTICCLIGEMLREAENLMNQNIHPHSIIEGYRISAKIVIDILRKSSFDNSFNYDIFLADLLDIAKTTLMSKFISNYCETFSRISLSVILKLKGNLNRGRINILKILGGSLKDSYLDNGILIEKSFGIGQPKKLLNARIMILNCSLDSDKIKIYGAKVKVKKLSQMAQIELSENKRLLDKCKKILNHGINVVVNRQLIYDKQERFFTDHGIISIENADFEGIEKLSLAVNSEIASSFDDIKKIKIGKADLVEEISIGSKNFVRFSGFENNGIGTIVIRGSTDEILDEAERALNDTLCVLINSLKNSRFVWGAGCCELKASRILQDISKNFDFEYSKCLNSFARALMSIPTIIAYNSDIDIKNLVKNIPLECYDLSSDSCLDLKNSKLGNARNLGIIEPLKLKIFTILSATEAVEIFIRINKIFLN

SEQ ID NO: 47164 - protein, 521 aa, Wolinella succinogenes DSM 1740
MSIQLHDKVSLLILDFGSQYTQLIARRLREYGIYCEIVPYHEKLEAIKAREPKGIILSGGPASVYEEDAFLIDKAVFELGIPVLGICYGMQLMTHYFGGVVAKAEHHEYGKAEVIFDALEGSESKLFEGCHSGKVVWMSHGDKVEKLPEGFTRIAHSTNSPFAAIAHQEKPFYAVQFHPEVVHSEEGALYLKNFALGICGCENDWNMHNFAEEQIKKIQERVKSGKVLCAVSGGVDSSVVAALLYRAIGEKLIPVFVDHGLLRAGEREAVEKMFKENLHVPLITVDASEIFLGKLKGVSDPETKRKIIGETFIEVFDVEAKKHDGIQYLAQGTLYPDVIESVSVKGPSKTIKSHHNVGGLPDWMTFELIEPLRELFKDEVRALGAELGMPREMLMRHPFPGPGLAIRIMGEVNFEDLELLRKADVIMLDELKKSGFYDKTWQAFTVLLNVRSVGVMGDNRTYDNTVCVRVVEAIDGMTATFAHLPHELLERMSTRIINEVDGINRVVYDISSKPPATIEWE

SEQ ID NO: 47165 - protein, 295 aa, Arabidopsis thaliana
MSDALNMTLDEIVKKSKSERSAAARSGGKGVSRKSGRGRGGPNGVVGGGRGGGPVRRGPLAVNTRPSSSFSINKLARRKRSLPWQNQNDLYEETLRAVGVSGVEVGTTVYITNLDQGVTNEDIRELYAEIGELKRYAIHYDKNGRPSGSAEVVYMRRSDAIQAMRKYNNVLLDGRPMKLEILGGNTESAPVAARVNVTGLNGRMKRSVFIGQGVRGGRVGRGRGSGPSGRRLPLQQNQQGGVTAGRGGFRGRGRGNGGGRGNKSGGRGGKKPVEKSAADLDKDLESYHAEAMNIS

SEQ ID NO: 47166 - protein, 126 aa, Xanthomonas oryzae pv. oryzae KACC10331
MPQIIHTDQAPAAIGPYSQAVRAGNTVYFSGQIPLDPVTGEIVPGDIGAQARRAFDNLKAVAEAAGGSLDKIVRLGLYLTDLGQFAAVNAVMQEYFQAPFPARSTIEVSGLPKGAGFEVDAVMVLE

SEQ ID NO: 47167 - protein, 456 aa, Triticum aestivum
  misc_feature (28)..(28): Xaa can be any naturally occurring amino acid
  misc_feature (149)..(149): Xaa can be any naturally occurring amino acid
PKPAAAARASRSPHHRPPLPLQGPPPSXQAAEECLGVHDIVFANRPQLPTGKILSYDWSTMGTASYGDYWRHIRRIGVTELLSVHRVQQYADVHTRMARSMARRLYRSAAGGRARVELKSRLFEMLMNVMTSMICARTYYGTYRWRGDXEVTDEVQWFRTMVEETMTLIGASTVWDYIPTLVRWLDIGGFGRRLWRLRESRTKFVQGLIEDERKKMEDGTTTGRTMIAALLSLQHKDPEDCPDQLIRACTSSALEAGSSTSADTVEWAMSLMLNNPKVMVKVRDEIDSYIGKPIRLIEASDLLKLQYFRCIIMETLRLHPPTPLLVPHESSIDCTVSGFYIPKGTMLLVNTSAIHRDPKIWDKPTNFIPERFEGEKCEGNMAMPFGMGRRRCPAENLGMQMVGLALGTMIQCFEWERVGEELVDMTDGFGLTAPRAVPLEAFYKPRQSMVTLLSEI

SEQ ID NO: 47168 - protein, 442 aa, Xanthomonas oryzae pv. oryzae KACC10331
MWDQAPSTEGAYTVSDLDQVTLNAGDTSVVLPVLKPTLGNDCVDISKLTKETGLFTYDSGFTATASCKSAITYIDGDNGVLLYRGYPIEQLAEKSTFLEVSYLLMNGELPTADEFKKFDHEVTHHTMMHESLKNFLGGFRHDAHPMAMLAGSVASLSAFYHDTLDLNDPEQRRQAAIRLIAKVPTLAAAAYRYSIGWPIRYPRNNLNYVDRFLHMMFEVPSEPLATNPVVAKALDLLFILHADHEQNASTSTVRLVGSTGVNPYASVAAGITALWGPAHGGANEAVLKMLEEIGTADNVESAVAKAKDKNSSFRLMGFGHRVYKNFDPRAKIIREMTHKVLGELGVNDPLLEVALKLEEAALKDDYFVQRKLYPNVDFYSGIIYKALNIPVEMFTVMFAIARTAGWVSHWLEQQVDPEMKIGRPRQIYTGYDKRNYKDAEQR

SEQ ID NO: 47169 - protein, 572 aa, Oryza sativa (japonica cultivar-group)
MASLLLPPQFLCSLPCSTNSIRSHLHYKPHFLGNIMTKPKAKMRLLNRNVSSMAKKSSQDVAEGSSDDESDGETSKTKKRAPRRGRKKATIQASEGETQEGQVSTEEDESPEGTKKIKRRGRKKAATTASSSEEKDKAKEPKKRGRRKVKTVEELSDNEGEDLGEDLVPSNDRQEKISANDLESKIAALLLEDTDDNDINNLIPLVCCFGPAKYSFIPSGRPANRLIDHEIHEGMKDMFWSPDQFVRAPGGSSSNVALALAASGGRVEFMGKLGDDDYGQSTLYHLNVNGVQTRAIKMDPSAFTAMSLMKVTEDCFVQTDINPAVLKEAKMFYYNSSALLEPTTRSSLSKAIEVSKKFGGVTFFDLNLPLPLWSSSKETKSLVKEAWEAADIIEITKQELEFLCGIKPSEKFGTKDNDKSKFTHYSPEVVTKLWHENLKVLFVTNGTSKIHYYTKEHDGWVRGTEDAPITPFTGDMSQSGDAIVAALMKMLAINPHLVTDKDYLHTAMKHAITCGVIDQWLLARERGFLPRERADPTSEQFGVRFVTEKEYRTLPDSIHTEDSSESELLYVE

SEQ ID NO: 47170 - protein, 1079 aa, Neisseria gonorrhoeae
MPKRTDLKSILIIGAGPIVIGQACEFDYSGAQACKALREEGYKVILVNSNPATIMTDPEMADVTYIEPIMWQTVEKIIAKERPDAILPTMGGTDRLNCALDLAGNGVLAKYDVELIGATEDAIDKAEDPGRFKEAMEKIGLSCPKSLFCHTMNEALAAQEQVGFPTLIRPSFTMGGSGGGIAYNKDEFLAICERGFDASPTHELLIEQSVLGWKEYEMEVVRDKADNCIIICSIENFDPMGVHTGDSITVAPAETLTDKEYQIMRNASLAVLREIGVDTGGSNVQFAVNPEKRRDDCDRDEPAAVSRSSALASKATGFPIAKVAANWAVGFTLDELRNDITGRRTPASFEPSIDYVVTKMARFAFEKFPAADDRLTTQMKSVGEVMAMGRTIQESFQKALRGLETGFVLVSMPARRRQTEIRRELANPGPERMLFVGKAFRAAFTPEEIHEISAIDPWFLAQIEDLMKEEKSVSDGQLQDLDYAALHRLKRKGFSDKRLAQLLNVSEKEVRETRTPVKLDPVYKPVDTSAAEFATETAYLYSTYEEECRIPSLPDRKKVMILGAGPNPIGQGIEFDYCSVHAALPLRESGFETIMVNCNPETVSTDFDTSDRLYFEPLTLEDVLEIVRTENPWGVIVHYGGQTPLKLANALVENGVNIIGTSADSIDAAEDRERFQKVLNDLGLRQPPNRIAHNEEEALVKAEEIGYPLVVRPSYVLGGPAMQIVHSAEALQKYMREPVQVSEDSPVLLDFFLNNAIEVDVDCVSDGKDVVIGGIMQHVEQAGIHSGDSGCSLPPYSLSEEIQDEIRRQTKAMAYALGLVGLMNVQFAVQDAVVFVLEVNPRATRTVPFVSKATGQRLAKVGARCMAGISLKEQGVEKEVVPDFYAVKEAVFPFIKFPGVDTILNPEMRSTGEVMGVGRSFGEAYYKAQLGAGERLNPTGKIFLSVREEDKERVIKTAKNFQALGYGHLPTRHGAIPDRTRADCAGHQQSPRRPPAHRRRAEKRRNRTGRKYRFQRSAIRVRQPHHPPKRIAATRAAIHHHRRRRSDERRREKPGLSGCVQRSRAARSFEKPQLMPESG

SEQ ID NO: 47171 - protein, 369 aa, Oryza sativa (japonica cultivar-group)
MDRSGHRSMGSSSGSDRLRDLQAFDDTKAGVKGLVDAGVTTIPAIFHHHPLLLDDAEEDADVIPVIDLQADVDRGHLVGQVRAAAQCVGFFQVVNHGIPGELLEEMLAAVRRFNEQPAEGKKAWYSRDSGRRVKFNSNFDLFQSPAANWRDTLLLELTPRPGPAAEEIPPACRGVVGEYVEAVQRLGGALLELLSEALGLPPEYLGGLGGGLATMAAHYYPPCPEPHLTLGTTRHSDPSFLTVLLQESKGLQVLMRQRQRWVDVPPVAGALVVNIGDLLQLVSNDLFRSVEHRVLATTAAAEPRLSVACFFRPDYACTRVYAPVTTTPPPPLYRSTTMPEFLSHYRAKGLDGRSALHHFRIPPPSSPPH

SEQ ID NO: 47172 - protein, 328 aa, Arabidopsis thaliana
MSSPERKRKKRSLEPSPESTPNPSLPDDLIVSILARVSRLYYPILSLVSKSSRTLVTSPELYKTRSFFNRTESCLYVCLDFPPDPNPRWFTLYRKPNQNITEKTKNSSGSHTWHEAPSMRMKRNYPAANVVDGKIYVAGGLEEFDSSKWMEVFDIKTQTWEFVLSPLAERFIYRSLVIEGEIYIFGDKVVTYKPKEDRWGGVGEHQSMDLGLFFHSYCVIDNVLYCYRPGGIKWYESEKRSWRKLRGLKGLSKLASSCVKLADYGGKMALLWDKYIPCSGNKSHSISCAVVSLERCKNQGIRGKVEWFDDMLTVPSSYNFVGALAATL

SEQ ID NO: 47173 - protein, 272 aa, Zea mays
  misc_feature (216)..(216): Xaa can be any naturally occurring amino acid
SESESEAASRRQGEMGKGAQGSDAAAAGGEVEENMAAWLVAKNTLKIMPFKLPPVGPYDVRVRMKAVGICGSDVHYLREMRIAHFVVKEPMVIGHECAGVVEEVGAGVTHLSVGDRVALEPGVSCWRCRHCKGGRYNLCEDMKFFATPPVHGSLANQVVHPADLCFKLPDGVSLGEGALCDPLNVGVHPCRRAGVGPKKGVLVVGAGPLRLLFLLXAARAFGAPPVVSLLWTTPFCLGPFFGPVPALSVSPPPVDLSSSGLLPLAWARSLLI

SEQ ID NO: 47174 - protein, 374 aa, Zea mays
MLGAARRQLGSGPMLGQVLRRLRPAAAAEVARGYSAAAKEMTVRDALNSALDEEMSADPSVFLMGEEVGEYQGAYKISKGLLDKYGPDRVLDTPITEAGFTGIGVGAAYQGLRPVIEFMTFNFSMQAIDHIINSAAKSNYMSAGQISVPIVFRGPNGAAAGVGAQHSQCYAAWFAHVPGLKVLTPYSSEDARGLLKAAIRDPDPVIFLENELLYGESFPVSAEVLDSSFCLPIGKAKIERGGKDVTITAFSKMVGYALQAAEILSKEGISAEVINLRSIRPLDRAAINASVRKTNRLVTVEEGFPQHGIGAEICMSVVEESFEYLDAPVERIAGADVPMPYAANLERMAVPQVDDIVRAAKRACYRAVPMAAAA

SEQ ID NO: 47175 - protein, 223 aa, Lolium perenne
MCQIKKEMSGESGSPCNGEYCSPSTSSEQKQQTVWTKRPAGRTKFRETRHPVYRGVRRRGNAGRWVCEVRVPGRRGSRLWVGTFDTAEIAARAHDAAMLALAAGDVCLNFADSAELLDMPASSYRSLDEVRHAVTEAVEEFERRQALGEEDALSGTESSTLTDDEESSTPFELDVLSDMGWDLYYASLAQGMLMSSPFLAASAALGDYGEANLADVPLWSYLS

SEQ ID NO: 47176 - protein, 771 aa, Hordeum vulgare subsp. vulgare
MVAAAILPELATQLVVPVAAAVGIAFAVLQWVLVSKVKVAPEPRAEGGSASAVGAKDGATEYLIEEEEGLNDHNVVLKCAEIQTAISEGQTSFLFTEYKYAGGFMTIFAVLIFVFLGSIEGFSTKSQPCHYSVGKTCKPALANAAFSTIAFVLGAVTSLVSGFLGMKIATYANARTTLEARKGVGKAFITAFRSGAVMGFLLAASGLFVLYVAINLFGLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTPMMYPLLISSVGIIACLITTLFATDFFEVKEVDQIEPALKRQLIISTAVMTIGIALVSWLGLPYTFTIFNFGAQKTVHSWQLFLCVAVGLWAGLVIGFITEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAGITTVDVLTPNVFIGLLVGAMLPYWFSAMTMKSVGSAALKMVEEVRRQFNTIPGLMEGTAKPDYATCVKISTDASIKEMIPPGALVMLTPLIVGTLFGVETLSGVLAGALVSGVQIAISASNTGGAWDNAKKYIEAGASEHAKSLGPKGSDCHKAAVIGDTIGDPLKDTSGPSLNILIKLMAVESLVFAPFFATYGGILFKIL

SEQ ID NO: 47177 - protein, 308 aa, Arabidopsis thaliana
MAEENLELSLLCTESNVDDEGMIVDETPIEISIPQMGFSQSESEEIIMEMVEKEKQHLPSDDYIKRLRSGDLDLNVGRRDALNWIWKACEVHQFGPLCFCLAMNYLDRFLSVHDLPSGKGWILQLLAVACLSLAAKIEETEVPMLIDLQVGDPQFVFEAKSVQRMELLVLNRLKWRLRAITPCSYIRYFLRKMSKCDQEPSNTLISRSLQVIASTTKGIDFLEFRPSEVAAAVALSVSGELQRVHFDNSSFSPLFSLLQKERVKKIGEMIESDGSDLFSQTPNGVLEVSACCFSFKTHDSSSSYTHLS

SEQ ID NO: 47178 - protein, 620 aa, Propionibacterium acnes KPA171202
MPVRKDLRNIAIVAHVDHGKTTLVDAMLWQSGAFREGAEVEKRVMDSMDLEREKGITILAKNTAVKHVMSDGEEITLNIIDTPGHADFGGEVERGLEMVDGVILLVDASEGPLPQTRFVLRKALAKKLPLILVLNKVDRSDARIDEVVEETYDLFMDLSDDDDASLLDVPVVYASAKAGRASLNKPGDGELPDSPDLQPLFDCILENIPAPTYDEGGVLQAHVTNLDASPYLGRLALCRVVSGELTKGQTVAWCKRDGSVQNVKLSELLMTEALERVPAEKAGPGDIVAIAGIPEITIGETLSDPENPVPLPLIHVDEPSMSMTIGINTSPLSGRSGDKLTARLLKARLDQELIGNVSIKVADTDRPDMWEVQGRGELQLAVLVEQMRREGFELTVGKPQVVTKTIDGKLHEPFERVTIDAPEEFMGPVTQMMGLRKGQMMHMVNHGSGWVRMEFVVPARGLIGFRTEFLTQTRGQGIMNQIFENFQPWVGELRTRQSGSMVADRQGVVTSYALFNLQERGTMFVSPGEDTYEGMVVGENSRPDDMDVNPTKEKHLTNVRSSTGDELERLIPATKLSMEQQLEFCREDECLEVTPDVVRIRKTELNAHERAKARTRAKHS

SEQ ID NO: 47179 - protein, 352 aa, Desulfitobacterium hafniense Y51
MPKIAVLPGDGIGQEIIPQAVRVLKAVLAETDAEFEFQDYPIGGAAIELVGKALPDETLQGCREADAVLLGAVGGHQWDHLPASERPETAALLGLRKGLNFYANIRPVRMIPSLLATSTLKENVLDGVDMVVIRELTGGVYFGEKGRSDNPRSAYDKMTYSEEEIRRILIQGFETAMLRSKKLCSVDKANVLETSRLWREIANELAKEYPEVELTHMYVDNAAMQLVRNPKQFDVIVTENMFGDILTDLASMLGGSIGMLSSASLSGTQGMYEPAHGSAPDIAGKNLANPLATILSAALMLRYSFGMEAEALRIESAVEKVLEQGYRTGDLAQAGDKVVGTIEMGDAVLAAL

SEQ ID NO: 47180 - protein, 865 aa, uncultured bacterium
MAGLVAPLAAPCGRWPGPATALRPGHRRALQVDVGRSGHQRRGRPVGRLRRPEMRCAGAARQALRPAGQRDRAKHGSARPQGTPGRVRRRGPRAHPGRPGPDRRDQGLPVGMKTGLLEPQHAAIVDLVDLDLPAADGGSAAHALARARVFAEPLLAGQLFDTGENALAHADGVSQILLGIGAPPSLRAAAYLVYASEYLTTPDDVIGRAFGADAAALVAHTRKLVQIQRNARDALGDEAYGPLRADQVERIRKMLLAFSRDLRVVLMRLASRLQTLRHYAETKLPCPKALARESMQVFAPLASRLGIGQIKWEMEDLSFRFLMPEAYHSIARALDEKRLERERSVEQVRQALATALTQAGLNAQVQGRPKHLYSIWKKMQGKNLSIDRVFDVRALRVIVDDIPSCYAALSRAHELWRPMPDEFSDYIARPKPNGYQSLHTVVLGDDDKPIEIQIRSQAMHEHADSGVAAHWAYKEAGAKGYAGVQTVGESEARAAAARKTVLRQLLAWERDLAAADETEGGGPTGHGYFDDRIYVFTPDGKIIDLVHGATPVDFAYSLHTDLGHRCRGAKVDGVMVPLNTALHSGQTIEIVSAREGGPSLDWLNQDLGYVRSPRARAKVRAWFNALAQQATIAKGRDLVEKLLQREGKTAVKLEELASNLGFRSADALFDVVGKDEFSLRNIEHLLRPAVPEQDPDQVVAQRIARSEAELDRSGHGQGGVLVVGMDSLLTQLARCCKPAPPDAIGGYVTRGKGVAVHRSDCSNFRQMVGKHGERVIPVAWGRDAGHQSAHYAVDVLVEAHDRPGLLRDVCDALAQGKTHVVAMNSQTQRDHTTITLTVQTSDTAKLGPVLGRVAQVNGVLRARRK

SEQ ID NO: 47181 - protein, 424 aa, Zea mays
GHRIAVSSAVRLVFMAASGAAHDAAAAEGLRLRYDVIVVGAGIMGSCAAHAAASRGAHTLLLERFDLLHQLGSSHGDSRIIRDAYVKAQYPPMVRLARRLWAEAEAESGYRVLTPAPHLSMGPRGNAALLAAVKSAGAEEVDLSQMWGGAFQAPEGWLTAVSEHGGGVLNATKSVAMFQALAVKMGAVVRDNAEVVDIRKEPEGGVVVKTSSGEEFRGAKCVVTVGAWTSKLLRSVAGVEIPIQPLHTLTLYWRIKPGRERGLMAKAGFPTFSSYGDTPVYGTPSLELPGLIKISCDGGPPCDPDNRDWASGDREITERVARWIQEFMPGHVDSAGAPVVRQSCICSMTPDKDFVIDWLGGEFGEDMVVGAGFSGHGFKMGPAVGRLLAEMAIDGEARTAVEAGVELGHFKINRFNVQDQQVQG

SEQ ID NO: 47182 - protein, 302 aa, Haloarcula marismortui ATCC 43049
MTEETDLEDLRRGTDLVKRGFAKMQKGGVIMDVVNREQARIAEDAGAVAVMHLESVPADIRKRGGVARMADPSKLEEIIEEVSIPVMGKARIGHTAEAQILEAAGADMVDESEVLTQADDRYHIDKREFTAPFVCGARNLAEALRRIDEGAAMIRTKGEAGTGDVNQAVTHQRNIQRSIGKLEGMAYEERDEWAREHGAPRRLVHETADRGRLPVVNFAAGGIATPADAALMMQHGCDGIFVGSGIFGAENPQAMGESVVAAVNNYDDPEQLKEIAKNPGKGMKGQANADLDEEEQLQGRGV

SEQ ID NO: 47183 - protein, 553 aa, Debaryomyces hansenii CBS767
MSQPEFKLSTELPAWKKLEATFKSKGEKFQVKEAFDKDPKRFEKLSKTFQNFDNSKILFDFSKNLIDDEILEQLVQLAKEAKVEELRDAMFNGDKINTTEDRAVYHVALRNRSKREMKVDNVDTFPEVDEVLQHMKEFSNQIRSGEWTGYTNKAITDVVNIGIGGSDLGPVMVTEALKAYGKPGLNVHFVSNIDGTHIAETVKKCDPETTLFLIASKTFTTAETCTNANSAKKWFLAKALDTKHIAKHFAALSTNAEEVSKFGIDTKNMFGFESWVGGRYSVWSAIGLSVAIYIGFDNFESFLKGAEAVDKHFVETPLEENIPVLGGLLSVWYNNFFGAQTHLVAPFDQYLHRFPAYLQQLSMESNGKSVTRANAFTNYETGTILFGEPATNAQHSFFQLVHQGTKLIPSDFILAAQSHNPIENNLHQKMLASNFFAQAEALMVGKNEDEVKKEGATGGLVPHKVFSGNRPTTSILAQKITPAALGSLIAYYEHLTFVEGAIWNINSFDQWGVELGKVLAKVIGKELENNNEKVDTHDPSTKGLINQFKDWAE

SEQ ID NO: 47184 - protein, 204 aa, Triticum aestivum
  misc_feature (8)..(8): Xaa can be any naturally occurring amino acid
  misc_feature (143)..(143): Xaa can be any naturally occurring amino acid
WDPRIRGXFMYNSGFSVALSKAPAFIADMLNLRDLNPDAFCGALDGRVGLVLRYVKASSAYLGKHEDSIDVDILFYRSRTDGMPHAHADVVDEIEQMALGKYGGLPHWGKNRNFAFDGAIARYPKADKFLKVKSRYDPDGLFXSEWTDQVLGINGTPNIIENRCAIEGLCICSDDSHCAPEQGYFCRLGKVYKKARVCSSEEDY

SEQ ID NO: 47185 - protein, 469 aa, Allium cepa
MAFDKKQLHILFFPLMSPGHFIPMIDMACIFASHNVRSTVVATPSDASKIPLSKSKYISVVTIPFPSPSLTNLPPDHENLATIRSSMFDLFVSALSLFQPPLQNLIHDLKPDCLISDSLFPWTADLALQFKIPRIIFHGAGVFPMYVSANIFSHFPLDESKEEFFMDGLAEKIKLYRKGLPDMFSNIPFLITMGEAEAKSYGVVVNTFREMEPTYVDFYKGTKKAWCIGPLSLANKLDEEKTAGWIAEKEEVKEKIVKWLDGKEEGSVLYVCFGSLCHFSGGQLRELALGLEKCNKNFLWVVRKEAEGDDVSEKEWMPENYKERVGERGLVVKGWVPQTTVLDHKSVGWFVTHCGWNSLQESTCAGVPMITWPLFHEQFINAEFLVETMGIGERMWEGFRKSEYRKFDDVIVTADEIAGVVGRVMGGGEKYEEMKRKAKDYGEKAKKAVDEGGSSYNDVVALIEELKTL

SEQ ID NO: 47186 - protein, 585 aa, Oryza sativa (indica cultivar-group)
MAAPPLPFVLAAAAIASLVILVLVVFACRRWRRAVVAAAPQPPPRAAADVVAASPVRSQNEDLNKPLLEILDDHSSQSNTFPGNVVGESSKVHTSRSDTSPRSHGISDSGRTYPADSCTPQGETHVIDVTDDTSEEFHLGSTLKCTKQTSWSRPDKKHKRWGSGEDNKNGSISLKDNTYRSNLDVEVIAGPSHGISCSRQSTSPTIPITLGRVPPSDLVLKDSEVSGKHARINWNAKTLKWEIVDMGSLNGTFVNSRAVHHPNVGSRHWGEPAELADGDIITLGTSSKLSVQISLQNQRVPAGIGMASDPMVGRRSGKKLAMEDISFCQCPLQGVEQFGLFGIFDGHGGDGAARAVSKIFPENVATLLSHHETKEKVLSYSDASDVLRYAFTMTEAAIDHEYEGCTATVLLIWFDQKKDCFAQCANLGDSACVMSVNGKMIEMTEDHRVASVTERARIARAGQALKAGEVRINGLNLARMFGDKFLKEQDSRFSSEPYVSQAVHITKACTAFAVIASDGLWDVISTKRAVQLVVEGRERNSGDSASADKVANRILSEARNLRTKDNTSVIFVDFDILRTDHCIAK

SEQ ID NO: 47187 - protein, 304 aa, Oryza sativa (indica cultivar-group)
MRAAAGQIDPSPGAPAKSRLKRLFERQLLRVSPAERLPSVAGVGEKDESSEPSSVCLDGMVRSFLEDGVGVERPAGAARCCNCFHGGEASDDDDDGPAAAEAAATSDAAETIKGLVHCASLRERNLLADVSTLVERHRAAGARKRDLLRLLADSLRAAGHDAAVCISRWDKSSSHPKGEHAYLDVLLPPASDRAERERILVDVDFRSEFEVARPTKAYRAVLQRLPSVFVGKEDRLRLLVAAAADAARASLKKRGLHLPPWRKPEYMRAKWLSPYERDVPSPQQPDASAGELAVDGEGGGAWTQ

SEQ ID NO: 47188 - protein, 505 aa, Medicago truncatula
MGLTEPKVVTGPAGYVLEDVPHLSDYIPDLPTYPNPLQDNPAYSVVKQYFVHVDDTVPQKVVVHKDSPRGVHFRRAGPRQKVYFESDEIQAAIVTCGGLCPGLNTVIRELVCSLHHMYGVTRVLGIEGGYRGFYARNTITLTPSSVNNIHKRGGTILGTSRGGHDTNKIVDSIQDRGINQVYIIGGDGTQRGASVIFEEVRRRGLKCAVVGIPKTIDNDIPIIDKSFGFDTAVEEAQRAINAAHVEAESFENGIGVVKLMGRYSGFIAMYATLASRDVDCCLIPESPFYLEGPGGLYEYIDRRLKENGHMVIVIAEGAGQELLTESLQSGKKQDASGNKLLQDVGLWISQSIKDHFAREKTLPITLKYIDPTYMIRAVPSNASDNVYCTLLAQSAVHGAMAGYTGYTSGLVNGRQTYIPFYRITERQNNVVITDRMWARLLSSTNQPSFMEVKVSDEDTKGENSLDELPDGHCSEDTSVDEITHNLGCLAPLAVPVLRTGGISGV

SEQ ID NO: 47189 - protein, 599 aa, Glycine max
MEEKHAAAIESAHAESNGVSHGADHGWQKVTYAKKQKKKTVNAANGGPDSRANSSKLVPNGTLSGNDGVFRSLELQSEDRRRKIVEAKKLADAAYDDEDAPLRSKQRHRDDDDEYDYDDENVDRSAENGKAEEAKKVKQKKPKKPKVTVAEAAAKIDAADLGAFLVEISGSFEKQQDILMMRFTDYFGRAFSAVTASQFPWVKLFRESTVAKITDTPLSHISDAVYKTSMDWINQRSPEALSTFLIWSLDSILADLGSQQNVAKGSKKAVQQVSSKSQVAMFVVLAMVLRRKPDALISVLPTLRESTKYQGLDKLPVIVWMIAQAAVGDLSVGLYAWARNLLPIVIGKSGNPQSRDLVLQLVEKILSTPKARPVLVNSAVRKGERLIPSSAFEILVRVTFPPSSTRVKATERFEAIYPTLKEVALGGSAGSKAMKQVALQIFSFAIKAAGENNPELSKEAAGIFIWCLSQNTECYKQWEKVYQDNIEASVSVLEKLSDDWKELSTKLSPHDPLRDTIKNLKQKNEKVLDSETDAARHAHFKDADKYCKIILGRVSRSHGCMTCLTFTVLALAVGAAVSLSPNLESLDFKKLSELFNVQH

SEQ ID NO: 47190 - protein, 280 aa, Thermoanaerobacter tengcongensis MB4
MKIDSTTKVFGLIGHPVKHSLSPLIHNSSFEKLNFNGVYVVFDVAPELLENAVKGLKALGIKGFNVTVPHKESVMNYLDFVTEEAEKIGAVNTVVNENGILKGYNTDVQGFIDSLKELKEDVRGRKAFVLGAGGASKAICFALAREGVESIVIANRTLNKAKALAEYIREEFKMKCDYCSIEEVEKFNEIDILINTTSVGMHPEVGNSPVSEEVVAKANFVYDLIYNPSETLFLKYARKNGVKSANGLSMLVNQASYAFYLWTGEFFDKDFVYEKIRGEM

SEQ ID NO: 47191 - protein, 666 aa, Xanthomonas oryzae pv. oryzae KACC10331
MTQPTRRQLANAIRFLAADAVEAAKSGHPGMPMGMADIAEVLWNDFFRHNPNNPQWFNRDRFVLSNGHGSMLQYALLHLSGYDLPIEQLKQFRQLHSKTPGHPERSETPGVETTTGPLGQGFANAVGFALAEKLLAQRYNRPELEIVDHRTWVFMGDGCLMEGISHEAASLAGTWGLGKLVAFWDNNQISIDGNTAGWFSDDTPARFQAYGWHVIRDVDGHDADKIKAAIETALENTDKPTLICCRTKIGFGAPTKAGKESSHGAPLGKDELEGARKALEWPYGPFEIPEEIYAGWRAGGTGTLRQAEWEQLFDKYSKQYASEADELTRRSHGELPADFIAKADAYIAKAQEEGQTIASRKASQLAIEAFAPLLPELIGGSADLAHSNLTLWKASKSVATDDPDANYVYYGVREFGMTAIANGLALHGGFIPFDATFLVFSDYARNGVRMSALNPSHAIHVYTHDSIGLGEDGPTHQPVEHLASLRYIPNNDVWRPGDAVESAVSWKAAITRKGGPTCLIFSRQNLQHQPRSAEQIKLIERGGYVLADAEGGTPDVILIATGSEVGLAVEAKKTLDTAGLKTRVVSMPSTDVFDRQDAAYRESVLPNAVRKRVAVEAGVTGFWRKYVGLDGDVVGIDTFGASAPADQLYAYFKITAEHVVAAAKAL

SEQ ID NO: 47192 - protein, 223 aa, uncultured bacterium
MTQDEMKTLVGLAALDHVQAGSIVGVGTGSTVDKFIDALGAALKTDPQRVVGAVSSSVRSTERLQSLGVKVLPAESVSRLAVYIDGADEINHQGDMIKGGGAALTREKIVADLAERFVCIADETKLVQTLGKFPLPVEVIPMAAAQVIRAFAAQGGQARVREGVVTDNGNLIVDVTGLSITDPARLESDVNQWPGVVTVGIFARNRASVCLLGTPNGVKTLNF

SEQ ID NO: 47193 - protein, 280 aa, Yarrowia lipolytica CLIB122
MSANYWTSSQRLHWLLTKETLAERRKGLEDIFDPGKLQTIKALNPWHVRVYLHTLIHLLGQNLSIRQRILATAEVYLTRFHTKVPFGEINPYLVVATAVYVACKVEEHPQHIRTITSEARSLWPDYISHDPTKIAECEFYLIEELGTYLVIFHPYKSLMQISDAMARSNAQITMAPEEIQVTWSMINDSYITDLHLLNPPHIVAMACIYMTVVLRSHIMRMTMPSEAVKSRIEAFMTFFGESNVDLEQTIDCVQEMISLYVNWDTYSEKQCRVEIAKVIT

SEQ ID NO: 47194 - protein, 405 aa, Triticum aestivum
MANTSNKRMRPTGFSDITSDRISSLPDEILHHILSLMTAREAVQTCVLSTRWRDVWMSLRCIEVEAQEFTNKEGFVMFMDNLLLRRGLVPLDSFSLMGWSDDFSLNHPRANLWVCHALRSNVRVLQIFSRKLFNLEYSPFISSHLKILNLRDVSIAALFIEKLFSGCPQLEELSLVDCRVPATKFSSRTLKKLTFIAHTPYGADDVHTDFEDLVIDTPSLVSLHLEDIPLLTPCLVNVSSVVKASFRLDEECFSSPYVSCNIISALSNVTKLKLFFGLDNETASKVLRRDLWRCQAFNNLKTLSVSGWCIDVDLRALVYFLRRSPALEKLTLCLSQARASDRLRRRDNTESEETSTSFNCKHLKKVKIRCPQGDKRVGNILNVILASASLPEIVINPYERWDPLE

SEQ ID NO: 47195 - protein, 873 aa, Lactobacillus sakei subsp. sakei 23K
MNYIYAFAEDQTLTNQELGGKGANLAEMTRLGLPVPAGFTITTAACRQYLASAKQETGFLEDELMKAVHILEEKTQRQLGNAEQPLLVSVRSGAPISMPGMMDTILNLGLNDQTVIGLAEMTNDPWFAYDCYRRLIQMFGDVVYGIDKPIFEAALTALKNKRQVQKDTDLTLVDLKQLIETYKGLYVAAGQYQFPQSVDQQLRLAIEAVFKSWQNPRAQTYRRLNQIDGAMGTAVNVQQMVFGNYQGQSGTGVAFTRNPATGEPGLFGEYLLNAQGEDVVAGIRTPEPIATLKAQLPVIYEQFKTIANQLEAHYRDMQDMEFTIEAGQLYVLQTRVGKRTAPAAFRIAVDLVDEGVIDRPTAISRLKPTMIDGLLHPLFETSAVQQATQLLTGLPASPGAATGAIYFDAQKAQQAHEAGEKVVLVRQETSPEDIDGMVISEAIVTSRGGMTSHAAVVARGMGCCCVVGCQQLQVDYEQREAHFAGRVLKEGAIISVDGHTGRLYLGALPQQTGVHETTLGTVLSWCDEIAPFAVWANAETPQEVATAFEFGAQGLGLVRTEHMFFGPERIFKMRQMILATELADRQVALAALKKLQITDFKQIFSLAEERPCTIRLLDPPLHEFLPQNEVEQAELATALGISLAEIKRRIADKAEVNPMLGHRGSRLAVTYPEIYQMQVLAIVESALAVQTTYHHAVTPKIMLPLIGTATEMAYLKQLLQQTINDYLVENQQQLTYQIGTMIEIPRACLVADQIAATADFFSFGTNDLTQMTYGFSRDDIGHFMPDYQQQGLMPAEPFQTLDQDGVGALMQLAVQKGRQTKPDLSIGVCGEVGGDPTAMPFYRDLGIDYVSCSPYRVPSARLAAAQSQLTLAD

SEQ ID NO: 47196 - protein, 423 aa, Blastopirellula marina DSM 3645
MPTVPQFKTFRTEIAGVPVLDLAAKYGTPTFVYDAAKIVERIEDLRAFDVIRYAQKACSNLAILDLMRKNGVMVDAVSAWEIRRALAAGYGAKGEPAPLVYTADIFDHEALALCVEHGLHVNCGSPDMIAQLGEAAPGSEITLRINPGFGHGHSQKTNTGGQQSKHGIWHEQLHECLLIADQHGVRVTGLHMHIGSGTDLEHLAQVCGSMEKAALEVGRTITTISAGGGLPIPYNASQTYVDLDQYFELWNGVRKRLQDSFGHTVSLEIEPGRYLSAESGFLLAEIRAIKTMGENKFYVVDAGFNNLARPILYGSYHPMSIALASGETDERPHLDVVVGGPLCESGDIFTQEEGGFVGTRSLPAASIGDFLVIECAGAYGFVMGSNYNSKPLAAEVLIRDGQTHLIRERQTFENLIAGEHIPG

SEQ ID NO: 47197 - protein, 175 aa, Guillardia theta
MKRLEFTLKTYPLSFIGKSFLENGDKIVLPQSILNYLNQNDDLNPIIFEILNLDNNKKCHCGVYEFTSDDGCAYIPYWMFKNLEINEGSPLCFIQKCLEKGYFLKIQPQQKEFFQISNPKAILELNLRKYTSLTKKNTISIEYNNNIYWLNIVEVKPGNAINIIDTDLNLEICDI

SEQ ID NO: 47198 - protein, 567 aa, Oryza sativa
  misc_feature (75)..(75): Xaa can be any naturally occurring amino acid
  misc_feature (111)..(111): Xaa can be any naturally occurring amino acid
MATRGKKLGGVAGGGGAAVRVVGVVCVMAVPLFALLVLGGWASASTVWQSAERLTAVTAGFTNASKPSATGDAAXTGADELFGGLLADGGCFDRGACLSRHESPRYYKSSXPFSPSPYLLQKLRDYEARHRRCGPGTPGYAKSDEQLRSGHSSEVMECNYLVGLPYNGLGNRMLSLVASFLYALLTDRVFLVHFPDDFADHFCEPFPGGEGETATTWVLPPDFPVADLWRLGVHSNQSYGNLLAAKKITGDPARETPVSVPPYVYLHLAHDLRGDDERFYCNDDQLVLAKVNWLLLQSDLYFVPSLYAIPEFQDELRWMFPEKESVTHLLARYLLHPSNSVWGMVMRYHHAYLAPAAEMIGVQIRMFSWASIPVDDMYKQVMACSSQERILPDTDGGDAPAPARTNTSGGGATTAILVASLQVEYYERLKGKYYEHAATASGGGRRWVGVFQPSHEEKQEMGKRAHNQKALAEIYLLSFADVLLTSGMSTFGYMSSALAGLRPAMLLTAFNHKVPRTPCVRAVSMEPCFHKPPPAAATCQGKLAVSENVTRHIKRCEDLAGGIKLFD

SEQ ID NO: 47199 - protein, 411 aa, Oryza sativa (japonica cultivar-group)
MNALAATSRNFRQAARLLGLDSKLQKSLLIPLREIKVECTIPKDDGTLATFVGFRVQHDNSRGPMKGGIRYHPEVDPDEVNALAQLMTWKTAVAAVPYGGAKGGIGCTPGELSRSELERLTRVFTQKIHDLIGINTDVPAPDMGTNAQTMAWILDEYSKFHGHSPAVVTGKPIDLGGSLGRDAATGRGVMYATEALLTEYSESISGSTFVIQGLGNVGSWAAKLIHQKGGKIVAVGDVTGAIRNKSGIDIPALLKHRSEGGSLEDFYGAEVMDAAELLVHECDVLVPCALGGVLNRENAAEVKARFIIEGANHPTDTEADEILAKKGVIVLPDIYANSGGVVVSYFEWVQNIQGFMWDEEKVNRELQKYMKNAFQNIKDMCKSQNCNLRMGAFTLGVNRVAKATLLRGWEA

SEQ ID NO: 47200 - protein, 476 aa, uncultured bacterium
MEDGRMTPEQVLEFAKENNVEFVDVRFLDFPGLWQHLTVPVTELTLQSFTQGFGFDGSSIRGWQAINESDMLIIPVPDTAIIDPFCQHPTLSMICDIQDPLTRQRYSRDPRSIARKASDHMCSTGIADTAYFGPELEFFIFDQVCYDQGMNYAHYRVDSREGTWRRGQDEPDNLGNQLRPKEGYFPVPPADTMHNLRSEMVAVLQQCGIEVETHHHEVATGGQAEIDMRFDKLVRMGDKMMLYKYILKNVAARHGKVVTFMPKPLHGDNGSGMHTHFSLFKGDQPLFFDKDKYAEFSDLGRWSIGGLIKHAGAVVAFTNPTTNSFKRLVPGFEAPVNLFWSMRNRSAFVRIPVYQHNPNTKRIEFRCPDSSCNPYLAFSAILMAALDGIENRLDPGPAVDENLYEMSPERVAEIGQTPTSLEGALDALGRDHQFLLKGGVFTEDVIHYWIQYKMDNEVNQLRSRPHPYEFCLYFDI

SEQ ID NO: 47201 - protein, 485 aa, Xylella fastidiosa Ann-1
MHHNVHQSEILADPCDLQRAERWRQRDLRVLWHPCTQMREHPDTLPLVPIVRGEGVWLVGHDGRRYLDAVSSWWTNLFGHADPRISAAIAAQARTLEHVMLAGFSHEPAVRLAEALLRLAPRQDGREPLSKVFYADNGSAGVEVALKMAFHYFRNRGEEQRTRFIALHNGYHGETIGALAVGDIPLYRRVYAPLLTEVLFAPSPDAYLAEPGQSAAEYALQAAEALEALFKRYSGQICALILEPLLQCAGGMRMHHPVYLHRVRELCDAHGALLICDEIATGFGRTGTLFACEQACSAISTDTDDKQLGIMPDLLCLSKGLTGGVLPLAAVLTTQQLYEEFLDDSRERAFLHSHSYTGNPLACIAALTTLDIFENDCIIERNQVTAARMTQLAASLSGHPHVADVRQTGMVVAFELTRDGNKRTPFPPQARLGLHVYRAALARGVILRPLGDVVYWMPPYCVDEEQLHLLAETTRVAIDEAIACV

SEQ ID NO: 47202 - protein, 300 aa, Yarrowia lipolytica CLIB122
MRQPFSYRPQFQLGLLMGDPFALSTISLGIIGWIIALGGSIGASDQFKNFGWWGLAFEFFVILCVFLVVATDSVEPYRQMLLAFLALATMYVTNSTNNVVYNGTSASSASGAGHILLSIINFLWMIYFGTTHEAGIHAWVDSFAADKGHSYNNDQFAMRRSNPFSLHDQQRQSLGVPGRPVSAYSAGMGGVANYNGLQLGGFENSSNAEPHQASPAFSQQQQQQTATPQQATDSLFVATEYPYRARAVYAYQANPEDANEISFDKGEILDVSDISGRWWQARRDNGEIGICPSNYVELLA

SEQ ID NO: 47203 - protein, 832 aa, uncultured bacterium
MSAADALPSASMDLDPEETREWLDALSGVIETEGRGRAHDLLEQLLDHARQAGIDLPFSANTAYVNTIGVQDEAQFPGNLEIEERLRAFMRWNALAMVVRANRHEPPDGGDLGGHISSFASLATMLGCGFNHFWHGDHEGHGGDLLYIQGHSAPGIYARAFLEGRITEEQLLNFRQEVGGKGLSSYPHPKLMPEFWQFPTVSMGLGPIMAIYQARFLKYLHARGIADTSKRKVWVFCGDGEMDEPESLGAIGLASREKLDNLIFVVNCNLQRLDGPVRGNGKIVQELEGEFRGAGWNVIKLLWGAYWDPLLARDKEGLLRKVMMDMVDGDYQACKANDGAFVRQHFFGRNPKVAEMVAKMSDDDIWRLNRGGHDPQKVYAAYHAAANHTGQPTVLLIKTVKGFGMGKSGEGKNTAHQTKKLTEEDIKTFRDRFNIPITDEDLPKIPFYKPAEHTPEMEYLHARRKALGGYLPQRRVKADEQLTVPELAAFKAVLDPTAEGREISTTQAFVRCLTPLLRDAQLGPRVVPILVDEARTFGMEGLFRQIGIYAPEGQKYTPVDRDQVSYYREDKAGQILQEGINEAGGMSSWIAAATSYSTNNRVMIPFYVYYSMFGLQRVGDLAWAAGDMQARGFLLGGTSGRTTLNGEGLQHEDGHSQLVASTIPNCLSYDPTFAHEVAVIIQDGLKRMVEQQQNVFYYLTLLNENYAQPGLRQGTEAEIIKGMYLLQEGAKKTPRVNLLGSGSILRESVAARELLEADWGVAANVWSCPSFNELARDGQDTERWNLLHPTEAPRVSFVAQQLGPHNGPVIASTDYVKAFAEQIPLVRVNCGR

SEQ ID NO: 47204 - protein, 395 aa, Arabidopsis thaliana
MTTMGDLPGDLVEEILSRVPLTSLRAIRSTCQKWNSLSKSQICGRKATAAENKFLGFMMKDSRVCSMKFDLQGIRNDDGELVEPSIKQVSKLDQIEVSQVFHCDGLVLCIIKDNTGLLVWNPYLGQTRWIHPRNNYQIEDRYALGYDNNRNHKILRIFDLYPSSNRVFGYEVYDFSSNSWKVLDVIPEWDIQSHFRGASLKGNAYFPAQKKETVGGIKTINIEDVLLCFDFTRERFGPPLPLPFHSYNADFFVSLACVREEQLAVLYQRWGAFETIEICVTNKIDPNTVSWSKFLITSTGFPVDTFSGSFFIDEEKKVAVVFDLDRYKPTETCRYQIVYIIGQDEYFKSVNMGVAPNIAKNSYQAYCVPLVCSSSYVPSLVQLQINKPGKRKESN

SEQ ID NO: 47205 - protein, 112 aa, Pseudomonas syringae pv. syringae B728a
MDTLFTKIINREIPAKIIYEDDQVLAFHDIAPQAPVHFLVIPKKPIRTLNDLTEEDKGLAGHILFTAQRLALELGCEEGFRVVMNCNELGGQTVYHIHMHVLGQRQMTWPPG

SEQ ID NO: 47206 - protein, 463 aa, Synechococcus elongatus PCC 6301
MPDSVVLPATLQTALQTAEQLLWDRALVRYHDQWAGAIAALPEDQELAAANYREIFIRDNVPVMLYLLLQGKTDVVRDFLQLSLSLQSQALQTYGILPTSFVCEETHCVADYGQRAIGRVVSADPSLWWPVLLQAYRRASHDDAFVHSPTVQQGLQRLLAFLLRPVFNQNPLLEVPDGAFMVGRPLDVAGAPLEIQVLLYGALRACGQLLQYTEAANAAHVQARRLRQYLCWHYWVTPDRLRRWQQWPTEEFGDRSHNPYNIQPIAIPDWVEPWLGESGGYFLGNIRAGRPDFRFFSLGNLLAIVFDVLPLNQQGAILRLILQNEAQILGQVPLRLCYPALTGSAWKILTGCDPKNQPWSYHNGGSWPSLLWYLSAAVLHYQQRGGDRNLCQVWLNKLQHYHTQQCEQLPGDEWPEYYEGQDSVQIATRACRYQTWTFTGLLLNHALLSQPQGIQLLSLRGLP

SEQ ID NO: 47207 - protein, 226 aa, uncultured bacterium
MAGVQLGAGCWICEYLSPWDVYAHGVAKTLVHRKTKFQEMHIIETGTFGKALILDGFWQSCTGDEFLYHEPLVHPAMLLHGRPRRVLVLGGAEGAAVREVLRWKSVEQVVMVDIDGEVVEACRQHLPEMHQGACDDPRVEVRIQDALVYLDETRSTFDVIISDLSDPIEDGPSFKLFTRETFERARGSWRRRGCSSCKPAASRRPSCTCTPAWSARSDGCSPTPPH

SEQ ID NO: 47208 - protein, 373 aa, Oryza sativa (japonica cultivar-group)
MAGKENAAAAQPRLTRAAAKRAAAVTAVAVAAKRKRVALSELPTLSNNNAVVLKPQPAPRGGKRAASHAAEPKKPAPPPAPAVVVVVDDDEEGEGDPQLCAPYASDINSYLRSMEVQAKRRPAADYIETVQVDVTANMRGILVDWLVEVAEEYKLVSDTLYLTVSYIDRFLSAKSINRQKLQLLGVSAMLIASKYEEISPPNVEDFCYITDNTYMKQEVVKMERDILNVLKFEMGNPTTKTFLRMFIRSSQEDDKYPSLPLEFMCSYLAELSLLEYGCVRLLPSVVAASVVFVARLTLDSDTNPWSKKLQEVTGYRASELKDCITCIHDLQLNRKGSSLMAIRDKYKQHRFKGVSTLLPPVEIPASYFEDLNE

SEQ ID NO: 47209 - protein, 502 aa, Delphinium grandiflorum
MSISLFLAGAAILFFVTHLLLSPTRTRKLPPGPKGWPVVGALPMLGNMPHVALANLSRRYGPIVYLKLGSRGMVVASTPDSARAFLKTQDLNFSNRPTDAGATHIAYNSQDMVFADYGPRWKLLRKLSSLHMLGGKAIEDWAVVRRDEVGYMVKAIYESSCAGEAVHVPDMLVFAMANMLGQVILSRRVFVTKGVESNEFKEMVIELMTSAGLFNVGDFIPSIAWMDLQGIVRGMKRLHNKFDALLDKILREHTATRSERKGKPDLVDVLMDNRDNKSEQERLTDTNIKALLLNLFSAGTDTSSSTIEWALTEMIKNPSIFRRAHAEMDQVIGRNRRLEESDIPKLPYLQAVCKETFRKHPSTPLNLPRVAIEPCEVEGYHIPKGTRLSVNIWAIGRDPNVWENPLEFNPDRFLTGKMAKIDPRGNNSELIPFGAGRRICAGTRMGIVLVEYILGTLVHAFEWKLRDGEMLNMEETFGIALQKAVPLAAVVTPRLPPSAYVV

SEQ ID NO: 47210 - protein, 665 aa, Chlamydophila pneumoniae CWL029
MINKELDIGILGKIAGAIKQISIESIQKASSGHPGLPLGCAELAAYLYGYVLRQNPRDPHWINRDRFVLSAGHGSALLYSCLHLAGFDVSLEDLQEFRQLHSRTPGHPEYGETVGVEATTGPLGQGLGNAVGMALSMKMLESRFNRPGHEIFNGKIYCLAGDGCFMEGVSHEVCSFAGSLNLNNLVVIYDYNNVVLDGYLNEISVEDTKKRFEAYGWDVYEIDGYDFTHIHETFSSIKRGQERPVLVIAHTIIGHGSPKEGTNKAHGSPLGVEGTHETKQFWHLPEEKFFVPPAVKNFFAHKIQEDRKAQEQWLDEVRVWSKQFPELHEEFVALTSHKLPKNLESLVQSVEMPDSIAGRAASNKLIQVLVQHIPYLIGGSADLSSSDGTWIANEKVIHTYDFSGRNIKYGVREFGMATIMNGLAYSQVFRPFGGTFLVFSDYMRNAIRLAALSKLPVIYQFTHDSIFVGEDGPTHQPVEQLMSLRAIPGLYVIRPADANEVRGAWIAGLKHTGPTVIVLSRQALPTLPAAHRPFKDGIGRGAYIVLKESGEKPDYTLFATGSEVSLALSVAKELEHLDKQVRVVSFPCWELFEAQDVDYKQSIVGGDLGIRVSIEAGSALGWYKYIGSEGLAIAMDRFGYSGASDDVSEECGFTTEQILQRILSQ

SEQ ID NO: 47211 - protein, 199 aa, Blastopirellula marina DSM 3645
MLRLAMFVAISVISASSLLAAPASQGKVTDKVFLEVDVNGKPAGRIVIGLFGDTTPKTAANFRALCTGEKGKGRSGKMLTYKGSSFHRIIPQFMLQGGDFTNGNGTGGESIYGAKFADENFDLTHDGPGVLSMANSGPGTNGSQFFITTVKTSWLDGKHVVFGRVVEGMEVVKRLESLGSQSGKPRATVTIANCGVWDK

SEQ ID NO: 47212 - protein, 574 aa, Zea mays
MMLGMLSRTRLAGAALRVALTALLPLVLPAYYVYKLTTYLLGAVFPEDVAGKVVLITGASSGIGEHLAYEYAKRGAYLALVARREASLREVGDVALGLGSPGVLVLPADVSKPRDCEGFIDDTISYFGRLDHLVNNASIWQVCKFEEIQDVRHLRALMDINFWGHVYPTRLAIPHLRRSRGRIVGVTSNSSYIFIGRNTFYNASKAAALSFYDTLRMELIAHTLMLGMSRTGLAGAALRVALTALLPLVLPAYYVYKLTTYLLGAVFPEDVAGKVVLITGASSGIGEHLAYEYAKRGAYLALVARREASLREVGDVALGLGSPGVLVLPADVSKPRDCEGFIDDTISYFGRLDHLVNNASIWQVCKFEEIQDVRHLRALMDINFWGHVYPTRLAIPHLRRSRGRIVGVTSNSSYIFIGRNTFYNASKAAALSFYDTLRMELGSDIRITEVVPGVVESEITKGKMLTKGGEMKVDQDERDAILGPTPAEPVGDFARTVVRDVCRGARYVFEPRWYMGVYLLRACLPEVLAWNSRLLTVDTVGASTTDTLGKWLVELPGVRRVVQPPSLRSPEIKD

SEQ ID NO: 47213 - protein, 369 aa, Acinetobacter baumannii
MKSRAAVAFAPGKPLEIVEIDVAPPKAGEVLIKITHTGVCHTDAFTLSGDDPEGVFPAILGHEGAGVVIEVGEGVTSVQPGDHVIPLYTAECKECLFCKSGKTNLCVAVRATQGKGVMPDGTTRFSYKGEPIYHYMGCSTFSEYTVVAEVSLAKINPEANHEQVCLLGCGVTTGIGAVHNTAKVQEGDSVAVFGLGGIGLAVVQGARQAKAGRIIVVDTNPDKFELAKQFGATDFLNPKDYDQPIQQVIVEMTGWGVDHSFECIGNVNVMRSALECAHRGWGQSVIIGVAGAGQEISTRPFQLVTGRKWLGTAFGGVKGRSQLPKMVEDAMKGDIQLEPFVTHTMPLQDINTAFDLMHEGKSIRTVIHF

SEQ ID NO: 47214 - protein, 1122 aa, Medicago truncatula
MSFGSKEKLKGVSLSSSAESKMNTNKETEKTLAQYGVDAELLAEFEQSRVYGKSFEYSKTILDPPRLVSEEKMITYLSRIQRGGFIQPFGCLVVIEESTFRIIGYSENCFQLLGDIGSEHFMGLIGVDATTLFTPPSGSSLVKAVASREISRLNPIWVRARTTEKPFYAILHRIDVGVLIDLEPARSSGPALSLSGSFQSQKMAVSAISRLQSCRREDISLLCDTVVEEVQKLTGYERVMIYKFHEDDHGEVVSETRRSDLESYLGLHYPSIDIPQAARFLFKQNRVRLIYDCHAKPVKVIQSRELKKPLCLVNSTLRSPHDCHKQYMANMGSIASLVMAVVINEKDTTRLWGLLVCHHTSPHHVSFPVRHACEFVMHTFGMQLYMEIQLASQMEEKRILKTQTMLCDMLLRDAPFGIVTQSPSIMDLVKCDGAALYYDENCWLLGITPTKLQVKDIAEWLLSNYSDSTGLTTESLVDAGYPGATLLGDAVCGMASARINQRHILFWFRSHTAKEIQWGGAKHHPTDKDDGGKMNPRTSFKAFLEVLKSKSLPWEISEINAIHSLQLIMQDLFQDTDNTCPKTLKDFEKSDALIGGSHEISSIALEMVRLIETAAVPIFGVDSDGLINGWNVKIAELTGLPTSEAMGKSLENEVVHVDSRETLTNILRRALQGQDNKNVELKINRFVLHQEKEVVYLMISSCISRDYTNAIVGVGFVGQDITFEKVIVKKFIKLEGDYKAIMHSLNPLIPPIFASDENACCSEWNVAMERVTGWKKDEVIGKMLLGEIFGSFCRLKGQDALTDFMILLYHGISGQDSEKSPFGFYDRNGKFIETYITTNKRTDASEDIIGCFCFLHVVTEDLNQPFQGHRSKCRQRISKSKELAYILQEMKNPLNGIRFTHKLLENTGISENQKQLLDTSEACERQIMAIIEDIDLGSINEGTWKLNMKEFLLGNILDAVVSQVMMLIKGKDLQMFHEISDKIQTLSLYGDQIRLQMVLSDILHNIVSHTPSPNGWIEMKITPGLKIIQDGNEFIHLKFRMTHSGQGLPSSILHDMFYGENQWTTQEGLGLFMSRKILSRMNGDVHYVREQNKCYFLIDLELRTRKERQRNLKTETSMIRSL

SEQ ID NO: 47215 - protein, 446 aa, Xylella fastidiosa Ann-1
MNFETLGLLPSLLRALSEQGYEIPTPIQQQAIPLALAGHDLLAAAQTGTGKTAAFGLPVLQRLMAASSNVGAGKPRALVLTPTRELATQVHDSLRGYAKYQRVSSAVIYGGVGMGNQLDVLRRGVDLLIACPGRLIDHIERRSVDLSGVGILVLDEADRMLDMGFLPSIKRILGKLPRQNRQTLLFSATFAEPIKQLALEFMCRPREVMVASHNTVAETITHRVHPVDVSRKRELLLYLLAQDSREQTLVFVRTKHGSDKLATFLEKYGIKTAAIHGNKTQGQRLRALNSFKAGRVTVLVATDIAARGIDIDQLPKVINYDLPMVAEDYVHRIGRTGRNGVQGEAISLVTQEDAKLLRQIVRLLDRDMDIRDVPDFEPQVPIRWGNSAPGKSKQPAGQHPPRKSQHRRAFGKASVHTTPALKKQSGVQHSNGSRNRDGMFPVHQRG

SEQ ID NO: 47216 - protein, 403 aa, Propionibacterium acnes KPA171202
MSNRVIRLMGPAFVAAVAYVDPGNVAANLAAGAGYGYLLVWVLVVANVVAMLVQYLSAKLGLVTGHSLPELVGGALPRRGSRLAYWFQAELVAAATDLAEVIGGAVALQLLFGLPLIVGGLMTGALSLAILAIPSRHGQRTFEIVIIGMLVVIAIGFTAGLAFSPLSWGGVASGLVPRFEGTETVMLATSMLGATVMPHAVYMHSSLVRDRHGTDDRPKRITTLLRATRWDVAVSLVLAGSVNIAMLLLAAASLQGVKGIDGIAEAHAAMSNSMGPVVGLIFAVGLFASGLASTSVGAYAGAEIMAGLLHMRVPMLVRRLVTIIPALIILASGANPTQALVWSQVLLSMGLPLVLVPLARFTGDRRLMGQWTNGRVMAAIAWIVVAAVSALNVVLVVETVMGA

SEQ ID NO: 47217 - protein, 452 aa, Propionibacterium acnes KPA171202
MTEPDQQLHRSLRNRHIQLIALGGAIGTGLFYGAADSIAAAGPAVIVSYLIGGVVIYLIMRALGEMSVHNPTSGAFSEYAHQWWGDLPGFISGWNYWFNYIFVSMAELSVVGIYINYWFPVVPRWVSAAVLLAIVTTVNLLHVRAYGEVEFWFAIIKVVAIIAMIVLGLWIIFFGTGSTPATGIGNLWRNGGFLPHGVTGMLAGIIVVMFSFGGTELIGITAGEAEDPQRSIPRAINRVVGRILLFYVGALIVMVAIVPWTKIDGNASPFVQIFDLVGIPGAAAILNLVVLTAAISAYNSGLYANGRMLHALAHQGDAPAFLGKVNKAGSPWAGVLLSSAVTAIAVVVVGLLPEQAFVYIMSIAMIAAIINWATIIITQMLFRRRLDPESRSELRFTMPGAPVTNWIVLAFLVLMVVVMTTMPPYRIAVAIGPIWLAVLGLGWRVSRRRQTL

SEQ ID NO: 47218 - protein, 330 aa, Thermoanaerobacter tengcongensis MB4
MNGRKGIEGMLYAFPPSVRKILSSLSQDVLQKIEEVRLRANRPLAVYLEGSEKFVSTSGELSNSSSSSYIVTVDDCEKAFQLVSQSSLYAFEDEIKSGYITLKGGYRVGLAGECVLENGSIKIIKNVSGYNYRISKEVLGAADEIMEYLIDRQGSVYNLLIISPPQCGKTTLLRDIARALSDGFMGFGGKKVCIIDERSEIAGCYNGVPQLNVGIRTDVLDRCPKAEGMIMAIRSMSPQVVVTDEIGKKEDIEALRHVLNAGVKIITTVHAKDIEDLKKRPLLKDLVEGKYFERYIILSNRFGAGTLEEILDENLKMVFKGPYKKGLKKS

SEQ ID NO: 47219 - protein, 347 aa, Propionibacterium acnes KPA171202
MTETMLAERFHAADRSITLEDIPIPHPGPGEVLVKVAYCGICHSDLSLISGAFPAALPVVTQGHEASGTIVELGAGVIGWKEGDRVIPSAGRPCLKCRKCRRGAFTDCLDLNLMAFAYDGAWAEYHIAQASGMTKIPDNVPLDQAALLADAVSTPYAAVVRTGKVHMGNAVAVWGVGGVGTHLVQLAKLAGGVPVIAIDLNDAVLERAKRVGADHTLRSDDPELMQKIEDITHGRMIDVAFDAVGIKPTLRACVDSLDVDGKAVSVGLSAQDIDAGPFLNFNLQRKQVLGHLGYKSQDIALLAEMLSYHRLDLTESISKVIPLKDVESGIAELESHQGNPIRILVKP

SEQ ID NO: 47220 - protein, 486 aa, Pseudomonas putida
MKEFLNFINGEYVRNASGKTFQDINPVNGQVIGNIYEAGQVEVDAAVAAARAALKGDWGRLSVAERCKLLDAVAGEINRRFDDFLQAEIADTGKPHHLASHVDIPRGAANFQIFIDTIKSTATESFNMRTPDGKTALSYGVRVPRGVIAVVCPWNLPLLLMTWKVGPALACGNTVVVKPSEETPATATLLGEVMNAVGMPKGVYNVVHGFGPASAGEFLTKHPGVNGITFTGETRTGTAIMKAAADGVRPVSLEMGGKNAAVVFADCDFQVTIDTLTRSCFENAGQVCLGTERVYVERPIFDKVVAALKERAEAMKPGLPFDHDTRIGPLISKKHQAKVLGLYKTAKDEGATIVTGGGIPDMPEELKNGSWVQPTIWTGLPETATVVTEEIFGPCCHISPFDSEEEVLGKVNANRYGLATAIFTQDIARANRLAHQIEVGLCWINAWFLRDLRTPFGGSKQSGIGREGGVHSLEFYTELRNVMVKF

SEQ ID NO: 47221 - protein, 435 aa, Desulfitobacterium hafniense Y51
MVSLTQLQEARKGIITPEMVQAAELEGITGEELRQKIAIGEAVLPCNINHQGLRPMAVGKGLSTKVNANIGTSDAYPELAPELSKLEIAVAAGVHSIMDLSTGGDIDEIRRRIIQDSPVMVGTVPLYQVMVDTHKAGRGLVEMTDDEIFAGIEKHCRDGADFITVHCGVTLEVIQELREQGRVMDIVSRGGSFITAWMLHHQRQNPLFEQYDRLLNIALHYDVTLSLGDGLRPGCLADATDGPQIKELITLGSLVKRAQEAGVQVMVEGPGHVPLHQIETNMQLAKTLCHNAPFYVLGPLVTDVAPGYDHITSAIGGAIAASSGADFLCYVTPAEHLGLPTEEDVKEGVIAARIAAHAADLVKGIKGAWEWDLEMAKARKALDWPKQIELSIDPEKAGRMRKAKNEDSQERCTMCGKFCAYQLISDYMGTPFKGC

SEQ ID NO: 47222 - protein, 374 aa, Arabidopsis thaliana
MTITAFLARRLIGNGSSQILGTSSSSSGPFISVSRAFFSSSTPIKATLFPGDGIGPEIAESVKQVFTAADVVIDWDEQFVGTEVDPRTNSFLTWDNLQSVLKNKVGLKGPMATPIGKGHRSLNLTLRKELNLYANVRPCYSLPGYKTRYDDVDLITIRENTEGEYSGLEHQVVKGVVESLKIITRKASMRVAEYAFLYAKTHGRKKVSAIHKANIMQKTDGLFLQCCDEVAAKYPEIYYEKVVIDNCCMMLVKNPALFDVLVMPNLYGDIISDLCAGLVGGLGLTPSMNIGEDGIALAEAVHGSAPDIAGMNLANPTALLLSGVMMLRHLKLNKQAEQIHSAIINTIAEGKYRTADLGGSSTTTDFTKAICDHL

SEQ ID NO: 47223 - protein, 605 aa, Brassica rapa subsp. pekinensis
MALTLTVLILACLLSLVSPDAQGDALFALRMSLRALPNQLSDWNQNQVNPCTWSQVICDDKNFVTSLTLSDMNFSGTLSSRIGILGTLKTLTLKGNGIAGGIPEEFGNLTSLTSLDLEDNELSGFIPSTLGNLKKLQFLTLSRNNLNGTIPVSLTGLPNLINLLLDSNRLSGQIPQTLFEIPKYNFTGNNLNCGVGQPHPCVSEVARSGDSSKPKTGIIAGVVAGVTVILFGILVFLFCRDRHKGYKRDVFVDVAGEVDRRIAFGQLKRFAWRELQLATDNFSEKNVLGQGGFGKVYKGVLPDNTKVAVKRLTDFESPGGDAAFQREVEMISVAVHKNLLRLIGFCTTQTERLLVYPFMQNLSLAHRLREIKAGDPVLDWETRKRIALGAARGFEYLHEHCNPKIIHRDVKAANVLLDEDFEAVVGDFGLAKLVDVRRTNVTTQVRGTMGHIAPEYLSTGKSSERTDVFGYGIMLLELVTGQRAIDFSRLEEEDDVLLLDHVKKLEREKRLGAIVDKNLDGDYVKEEVEMMIQVALLCTQGSPEDRPVMSEVVRMLEGEGLAERWEEWQNVEVTRRHEFERMQRRFDWGEDSMNNQDAIELSGGR

SEQ ID NO: 47224 - protein, 368 aa, Brassica rapa subsp. pekinensis
MARTKQTARKSTGGKAPRKQLATKAARKSAPATGGVKKPHRFRPGTVALREIRKYQKSTELLIRKLPFQRLVREIAQDFKTDLRFQSSAVAALQEAAEAYLVGLFEDTNLCAIHAKRVTIMPKDIQLARRIREGKFNVANPTTGCQKKLEIDDDQKLRAFYDKRLSQEVSGDALGEEFKGYVFKIMGGCDKQGFPMKQGVLTPGRVRLLLHRGTPCFRGHGRRTGERRRKSVRGCIVSQDLSVLNLPRMRGPKRASKIRKLFNLGKDDDVRKYVRKYVNTYRRKFTNKKGKEVSKAPKIQRLVTPLTLQRKRARIADKKKRIAKANADAAEYQKLLASRLKEQRDRRSESLAKKRSRLSSAAAKPVAA

SEQ ID NO: 47225 - protein, 141 aa, Glycine max
  misc_feature (29)..(29): Xaa can be any naturally occurring amino acid
PLSRPNQTPHRTRTRTAHRRPRRRREKKXEMEAAAAAAGVQLGTSKPQIATQAEMAEARLPIPYRDQCAHLLIPLNKCRVAEFYLPWKCEPERHSYEKCQYELVMERMLQMQKIREAQAGAKVKGSVTIGVPLAPSTAKLA

SEQ ID NO: 47226 - protein, 181 aa, Zea mays
  misc_feature (62)..(62): Xaa can be any naturally occurring amino acid
MMLANKLGGLLKNATSSNMSVYQAIRCMSSSKLFVGGLSYGTDDHSLRDEFAKYGQVIEAKXILDRESGKSRSFGFITYTSSEEASAAITAMDGKTLDGRNIRVNHANERTGGFRSSGGYGGGSYGGGGYGGGSGGYGGGGSGDYGGGSGGYGGNYGNRAGGGYGGGGDYGVAGGAESSFA

SEQ ID NO: 47227 - protein, 110 aa, Triticum aestivum
MGVLGDRSGWCFCSGGGAKLERIKSTLLATNGPALAAVSFPRGGEGAGGGGSGGGGGGGKRGGGFLIHRALLLTTHGTVPSAAVAGAAEVQLSHGRLLARLVPQRFFITS

SEQ ID NO: 47228 - protein, 420 aa, Aspergillus oryzae
MAESITTLKQQLIDEFIQANPKSKAAFDRARNALPAGNTRSVLWSEPFPLTLQSGNGAHVTSVDGQEYLDFVSDFTAGLYGHSHPVIKQAVKDALATGFSLGGVVEKEAQLGEILQTRFKSIERVRFCNSGTEANTFALATAKAFTGRNKILVFDSGYHGGTISFHGTTPNPMNLPHEFVVGAFNDIERTQSLVDNSLAAILIEPMQMAGGVRPASIEFLRFLRESATKVGAVLIFDEVVTSRLHYHGLQGAREVYPDMTTLGKYLGGGFPFGAFGGRADIMEQFNPIAHGRSVLHHSGTFNNNIFTMTAAVAAAELVTKQSLAELNKLGDDLRATGNSIVQQAGLKDIVFVGYGSTVGMGFLGDRGQVLREVFYFTLVKQGILMGRRGFLCLNLAHTKEHIDRFLDVVKVFAEQHRADV

SEQ ID NO: 47229 - protein, 794 aa, Oryza sativa
MDVKRARSPRAPGVDADDDKKRAAEWRGAVRPHMVLVGFLITLPVLVFVFGGRWGSFQTTSAPNVGGRHVVPGGVTTTQNKLKHLGRPHALVKVGGPRWIISAVHVASNNAENEAPKNVSVPATATKSLPQPQDKLLGGLLSAAFEESSCQSRYKSSLYRKKSPFPLSPYLVQKLRKYEAYHKKCGPGTKRYRKAIEQLKAGRNADNAECKYVVWFPCNGLGNRMLTIASTFLYALISNRVLLMHVAAEQEGLFCEPFPGSSWVLPGDFPHNNPQGLHIGAPESYVNMLKNNVVRNDDPGSVSASSLPPYVYLHVEQFRLKLSDNIFCDEDQLILNKFNWMILKSDSYFAPALFMTPMYEKELEKMFPQKESVFHHLGRYLFHPTNKVWGIVSRYYEAYLARVDEKIGFQIRIFPEKPIKFENMYDQLTRCIREQRLLPELGTAEPANTTAEAGKVKAVLIASLYSGYYEKIRGMYYENPTKTGEIVAVYQPSHEEQQQYTSNEHNQKALAEIYLLSYCDKIAMSAWSTFGYVAYSFAGVKPWILLRPDWDKERSEVACVRSTSVEPCLHSPPILSCRAKKEVDAATVKPYVRHCEDKVERRGEGCKPRRKNCPVSQLETVCPKLGVVDATAEKTVDGWCKVSRPVDGVNLTQGEGVHFIHTTLLTRITQPVGISHVGRPPSFHDKAFPKPTQAELAPTWRLRGCHAGQREREFDGGESRRRQPAGSEEGNADEVTRDRFPAVRAFTRPRESDASVGLDGATPSEAGDVRVLWSSSGDGGEHAASDGNGRGGAG

SEQ ID NO: 47230 - protein, 468 aa, Bacillus clausii KSM-K16
MVVGDFAQEVDTLVVGSGPGGYVAAIRAAQLGQKVTIVEKGSLGGVCLNVGCIPSKALIQAGHRAHLAKSSEDIGIRAENVAIDFEKVQEWKGSVVKKLTGGVEGLLKGNKVEIIRGEAYFSGEDTVKIMDEKSSSTYKFKHCIIATGSSPIEIPNFKYTDRVINSTGALALKEVPKKLVVIGGGYIGIELTGAYSNLGSEVVVLEGTKQILPGFEKQMAKLVERKLKKNGVTFHTEAMAKGVEETDNGVKVTAEIKGEEKVIEADYVLVTVGRKPNTEEIGLEGIGVEMDDRGYIKVDKQGRTSVKNIFAIGDIVPGPALAHKASYEAKVAAEAISGEPSEVDYLAIPAVCFSEPELATVGYNEAQAKEAGYDVKVAKFPFAANGRALSLNDADGFMKLVTRKEDGLVIGGQIAGPNASDMIAEIGLAIEAGMTAEDIALTIHAHPTLGEITMEAAEVALGTPIHTL

SEQ ID NO: 47231 - protein, 425 aa, Bacillus clausii KSM-K16
MAYKYKLPEVGEGIHEGEIVKWFVKEGDEVKEDDILLEVQNDKSVVELPSPVDGKVLEVKVEEGTTSYVGDVILVIDDGSGDDDAEEESKEEAPKEEKQAASEPEKGQSSSEESDEEEGSRVIAMPSVRKYAREKGIAISKVKGSGKNGRVLKEDVDAFASGGQTEEAAAPKEEEKTASSKPAATAQAGGNEQLEERVPLKGIRKAIAKAMVNSKHTAPHVTHLDEVDVSALVAHRKQYKQIAADQGTKLTYLPYVVKALTSALRKYPALNASIDDEAGEIVYKKYFNVGIAADTEQGLVVPVVKDADRKSIFALADEINELAGKAREGKLSSAEMSGGSATISNLGSARGQWFTPIINHPEVMILGIGRIEEKPVVKDGEIVVGTMLALSISYDHRLIDGVTAQSALNQIKRLLNDPQLLLMEG

SEQ ID NO: 47232 - protein, 556 aa, Phytophthora infestans
MINDTPAWKALAEHAAEIKSTHLRELLNDDARNAAMRTEQQGIYLDFSRQNATSKTLDLLFELAETAELKKKLQAIASGEHVNAAEDRAVMHMALRAPKTEKIVVDGHDVVPDVHEVLDAIRALTSNVRDGKLVGATGKQLKNVISIGIGGSYLGPEFVFESLRYEPVAKAAAEGRNLRFLANVDPVDVARATSGLNPEETLVVVVSKTFTTAETMLNARTLRKWLVDDLTKKGSSEADAVAKHMVAASSAVPLVQQFGIDRANIFGFWDWVGGRYSVTSAVGILPLALQYGFDITEKFLAGAHAMDKHLLETPLRNNLPVIMGLRGVWNSSFLGHSSRALLPYSQALLRFAAHIQQVDMESNGKRVTVEGVDLPFQAGEVNFGEPGTNGQHSFYQLIHQGRVVPCDFLGFCESQNPVQLAGEPVSNHDELMSNFFAQPDALARGKSIEDLKAEGVPEKLQNHKLFPGNRPSISLLFKKLDAFSTGQLLALYEHRTVVQGAIWGINSFDQWGVELGKVLAKQARAQLSASRTENAPVKGFNSATTSMLEAYLAHKA

SEQ ID NO: 47233 - protein, 325 aa, Bacillus clausii KSM-K16
MGNWTMAQAITNALANELKTNEDVLIFGEDVGQNGGVFRVTEGLQKEFGEDRVFDTPLAESGIGGLAIGLALTDHRPVMEIQFFGFVFEVFDSIAGQMSRWRYRTGGKQTMPITVRSPFGGGVKTPEMHSDSLEGLMAQTPGVKVVIPSNPYDAKGLLISAIRDNDPVVFLEHMKLYRSFRQEVPEEEYTIELGKADIKREGKDITIVAYGAMVQASLKAAEELAQEGIEAEVIDLMTISPFDVETVVASVEKTNRAIVVQEAQKQAGVASHIVAEITERAILSLEAPVLRVTAPDTVYPFAAAEDAWLPNHQTIVEKVKEVINF

SEQ ID NO: 47234 - protein, 197 aa, Bacillus cereus G9241
MKVLQEKILNEGKVLSGDVLKVDAFLNHQIDPVLMQEIGKEFAKRFKEENITKIVTIESSGIAPAVMAALELGVKVIFARKRKSLTLQDNMYVASVYSFTKQETNEISLSRNHIDESDRVLIIDDFLANGQAALGLMSLVEQAGASIAGLGIVIEKAFQDGGKKLREQGVRVESLAEIASLDNGTVTFVQQETAEVK

SEQ ID NO: 47235 - protein, 440 aa, Bacillus cereus G9241
MKQHPIKIASLGMQHMLAMYAGAIIVPLIVGGGLGLNQKELTYLVSIDLLMCGVATILQALSNRFFGIGLPVVLGCTFTAVGPMIAIGKQYGVSSIYGAIIAAGLFVVIFAKLFGKLVKLFPPVVTGSVVTVIGVTLVPAAINDMAGGVGSKDFGSLENLALAFGVLLFIIIMYRFFDGFIRSISILLGLLFGTIVAAFMGKVSLQAVGEADWFHGIQPFYFGTPTFELTPIITMILVACVGIVEATGVYFALSDICNKKIGEKELTKGYRAEGLAMVLGGIFNAFPYTTYSQNVGLVQLTGVRNRVIIYTCGGMLIVLGFIPKIAAITTIIPKSVLGGAMLAMFGMVMAYGIKMLSSVDFGRQENLLIVACSVGIGLGVTVVPTLFSQLPESIRILTDNGIVLGSASAVLLNIVFNMVPQRKVKVKDEPVPIQSAVREA

SEQ ID NO: 47236 - protein, 556 aa, Phytophthora infestans
MINDTPAWKALAEHAAEIKSTHLRELLNDDARNAAMRTEQQGIYLDFSRQNATSKTLDLLFELAETAELKKKLQAIASGEHVNATEDRAVMHMALRAPKTEKIVVDGHDVVPDVHEVLDAIRAFTSNVRDGKLVGATGKQLKNVISIGIGGSYLGPEFVFESLRYEPVAKAAAEGRNLRFLANVDPVDVARATSGLNPEETLVVVVSKTFTTAETMLNARTLRKWLVDDLTKKGSSEADAVAKHMVAASSAVPLVQQFGIDRANIFGFWDWVGGRYSVTSAVGILPLALQYGFDITEKFLAGAHAMDKHLLETPLRNNLPVIMGLLGVWNSSFLGHSSRALLPYSQALLRFAAHIQQVDMESNGKRVTVEGVDLPFQAGEVNFGEPGTNGQHSFYQLIHQGRVVPCDFLGFCESQNPVQLAGEPVSNHDELMSNFFAQPDALARGKSIEDLKAEGVPEKLQNHKLFPGNRPSISLLFKKLDAFSTGQLLALYEHRTVVQGAIWGINSFDQWGVELGKVLAKQVRAQLSAPRTENAPVEGFNSATTSMLEAYLAHKA

SEQ ID NO: 47237 - protein, 556 aa, Phytophthora infestans
MINDTPAWKALAEHAAEIKFTHLRELLNDDARNAAMRTEQQGIYLDFSRQNATSKTLDLLFELAETAELKKKLQAIASGEHVNATEDRAVMHMALRAPKTEKIVVDGHDVVPDVREVLDAIRAFTSNVRDGKLVGATGKQLKNVISIGIGGSYLGPEFVFESLRYEPVAEAAAEGRNLRFLANVDPVDVARATSGLNPEETLVVVVSKTFTTAETMLNARTLREWLVDDLTKKGSSEADAVAKHMVAASSAVPLVQQFGIDRANIFGFWDWVGGRYSVTSAVGILPLALRYGFDITEKFLAGAHAMDKHLLETPLRNNLPVIMGLLGVSNSSFLGHSSRALLPYSQALLRFAAHIQQVDMESNGKRVTVEGVDLPFQPGEVNFGEPGTNGQHSFYQLIHQGRVVPCDFLGFCESQNPVQLAGEPVSNHDELMSNFFAQPDALARGKSIEDLKAEGVPEKLQNHKLFPGNRPSISLLFKKLDAFSTGQLLALYEHRTVVQGAIWGINSFDQWGVELGKVLAKQVRAQLSASRTENAPVKGFNSTTTSMLEAYLAHKA

SEQ ID NO: 47238 - protein, 556 aa, Phytophthora mirabilis
MINDTPAWKALAEHAAEIKSTHLRELLNDDARNAAMRTEQQGIYLDFSRQNATSKTLDLLFELAETAELKKKLQAIASGKHVNATEDRAVMHMALRAPKTEKIVVDGHDVVPDVHEVLDAIRAFTSNVRDGKFVGATGKQLKNVISIGIGGSYLGPEFVFESLRYEPVAKAAAEGRNLRFLANVDPVDVARATNGLNPEETLVVVVSKTFTTAETMLNARTLRKWLVDDLTKKGSSEADAVAKHMVAASSAVPLVQQFGIDRANIFGFWDWVGGRYSVTSAVGILPLALQYGFDITEKFLAGAHAMDKHLLETPLRNNLPVIMGLLGVWNSSFLGHSSRALLPYSQALLRFAAHIQQVDMESNGKRVTVEGVDLPFQAGEVNFGEPGTNGQHSFYQLIHQGRVVPCDFLGFCESQNPVQLAGEPVSNHDELMSNFFAQPDALARGKSIEDLKAEGVPEKLQNHKLFPGNRPSISLLFKKLDAFSTGQLLALYEHRTVVQGAIWGINSFDQWGVELGKVLAKQVRAQLSASRTENAPVKGFNSATTSMLEAYLAHKA

SEQ ID NO: 47239 - protein, 612 aa, Oryza sativa (japonica cultivar-group)
MDAVAFPPPPAPFLDDDLDFGDFAFADPQPAAAAAFDAFGAYDDDWGDFVDSRLGSWEKPRGPLPLSLFGADEDEEEEEGPAELPPTAADQRGASHASSNGSKPADLKDLIAGLYGSHPQPSSTDAAEVGTQEGSAVAAAEEEEEDGDGFEDDGWEFKAAAPSSSSDAVQDGGRQAHGDLTQDVPKSMSSDQEGWSLFTSVSENLNNVQTTDHVGTRESAGQSVKAFSYFPPNNAAILDLYKESEPIDAVHIMQCSSESVQSSSDMFSNTEMNSSFGTDENHSIKSASDRILIDFYHKLREESLTVISQYKKDLKESQKNSMLSDEKNEVMTETEREIQEICKELQDSSLAKGFCKDEHPSKDVCISELLNSAKEDHLKDFDKEYHLTEIIAMALEDMSSAVKLYKHSVSILRTLEIASKEEQCDYVSAWYSMLLSCAQELQHGAMIWQESCHANVGETVISQGAHYFIALGEIYRVAQILHISMLSFKPWVLADPGMLSKMLVCWNSCVNSWTSGLGMALTMVVDSKNLHAPVAKVLLESIININDIEVPNLQSFLPSDKMACKLTLLPTSLVPGMEVIIWDADHYFVKVANLWANQISSDPPQFSVSRVA

SEQ ID NO: 47240 - protein, 380 aa, Propionibacterium acnes KPA171202
MSTKDWAEKDYYKILGVSKDAKPEEIKKAFRKIARDNHPDSHPGDKAAEARFKEASEANDVLSNAKKRKEYDQARSLFGSAGGFRFPRGGAQTSVNVEDFLRTASNGDGFGDLFGNLFGASGGRRTASRSPRRGADVEGETTISFDDAVSGTTVTMDMVSQAPCQACRGTGARAGTVPRVCSTCQGSGMHASSAGGVFEMTEPCPDCHGRGMIVEDPCQVCHGSGRAKSTKSMQTRIPAGVEDGQRIRIKGKGSPGENGGKAGDLYVKVTVRPHEIFGRDGHNLTVTVPVTFPEATLGAEVEVPTLAGTTVRLRIPAGTPNGRTFRVRGRGVPRSDGSRGDLLATVEIAVPESLDDDARHVVERLRDSLPQATPRPWEVK

SEQ ID NO: 47241 - protein, 329 aa, Botryotinia fuckeliana
MDGQKIKRSKNIMAQSTYQSVVLAKRPTGQIVPGETFEKKENPMVTEADLKDDQVLVEVLYLSLDPAMRDRRSYVPPVQIGEVMRGVSIGKVIASKSSKFNVGDYASGITGWKEVAIMASKDLTPIELPPNGKLTDALGVLGMTGLTAYFGILEVGKIKAGDFVVVSGAAGATGSVVCQIAKLKGAKVLGLAGSDDKVQWLKELGCDDALNYKDKEFPSKFKAATPNFIDVFFDNVGGEILELALSRAKPFSTFVMCGAISQYNSDTPVGPKNFSMIIAMRIRLQGFIVFDYASKYAEARKEMSQWLAEGKLQRKETIVKGGLGVAEKA

SEQ ID NO: 47242 - protein, 481 aa, Ralstonia solanacearum GMI1000
MASPVEPDGRRMRAHSAVSFDLIVIGAGSAGLAAARRAAQLGARTLLIDRAEVGGTGVNRGCMPKKLLGYGAAWSQSASRCLHTAAAHGRDAWQDAAARIRTEVGRLHGVYRAHLAEAGVQWLAGSASLRGRGALRLLTDAGKRTMRARQIVLATGARPQPLPVPGAELACTPEDVLTWDALPASLAIVGGGVIAVEMASTLVRFGVRVTLLVRDPRVLPDFDAALSEAAFRALAAHGVDVVPDADVVRVERDAVNGDGVAVYVAGPDGTAARVVRAQRVMAAIGRAPATDGLGLEAAGVTLDARGHIAVDRHFRTRARGVHAIGDVSGSPQLTPVAVAQGRYVAERLFGKGAKLPDMEHVPMAVFCEPAIAAVGLTEAQARERWPDRPERDARPVAERIDVVERRFVSLEQRFAGTGAESLIKLVCNARSGRVLGAHVMDNAAPEIVQALAVAVRMGVRLKHLRSTVGLHPTVAEELLCI

SEQ ID NO: 47243 - protein, 305 aa, Triticum aestivum
  misc_feature (164)..(164): Xaa can be any naturally occurring amino acid
  misc_feature (226)..(226): Xaa can be any naturally occurring amino acid
  misc_feature (230)..(230): Xaa can be any naturally occurring amino acid
  misc_feature (254)..(254): Xaa can be any naturally occurring amino acid
MDHWSESEGKRVHDPIFQPRISQNCRRPVEEFCRERSTDAAVTRSERCTWVPGPIIVGAGPSGLAVAACLKEKGVDSLILERSNCIASLWQLKTYDRLSLHLPRQFCELPLMPFPADYPIYPSKEKFVAYLEKYAAQFGICPKYNHVVVRAEYDEKLLLWRVRXALTGRIEEEVEYISRWLVVATGENAEVVQPEIDGLKEFRGTVVHTSAYKTGCAFAGKRVPVXGCGXSAMEVCLDLCDHNAQPHIVVETLXNILPREMLGSATFGLPMGCLSGSHPSFGPDSMALNRTSLGILPVWLNGHPP

SEQ ID NO: 47244 - protein, 512 aa, Arabidopsis thaliana
MSSSPSLEILVREAEGFTVWNGPPFTNGQPTLKLERVSCSNTKFSVDGSKLMAMKSDGVISIYDATSLTEVRSFTIANVTAAELSPCGTYLQTFQKPTTPQEKNVSIWNTETGDLAHSHYQKSITKASWPSIRFCPDESSACRLATNEVQFFDPKDFSKGITSRIRVPGIAAFELSKTPASHVAVFVPESKGSPGSVQIFGCGEELQSQPSARRSFFRCSSVQFSWNHGSTGLLVVVQSDVDKTNQSYYGETKLHYLTDGTHEGLVPLRKEGPVHDVQWSFSGSEFAVVYGFMPACVTIFDKNCKPLMELGEGPYNTLRWNPKGRVLCVAGFGNLPGDMAFWDVVNKKQLGSNKAEWSVTSEWSPDGRYFLTASTAPRRQIDNGMKIFNYDGKRYYKKMFERLYQAEWKPESPERFGDISELIKSVESLKLGEGKSQGQGSAQKKTIAPNPIAQKPAAYRPPHAKHAAAVQAELPGISTTGEMSKNALKNKKKRENKKAAAAAAAASGSNNA

SEQ ID NO: 47245 - protein, 261 aa, Glycine max
MCTLTTVPVLPSKLNKPSLSPHHNSLFPYCGRRVGKKNKAMVPVARLFGPAIFEASKLKVLFLGVDENKHPGNLPRTYTLTHSDITAKLTLAISQTINNSQLQGWYNRFQRDEVVAQWKKVKGRMSLHVHCHISGGHFLLDILARLRYFIFCKELPVVLKAVVHGDENLFNSYPELQDALVWVYFHSNIPEFNKVECWGPLKEASAPTGGVQEEGLAIPQPCQEECQCCFPPLTLSPIQWSKQVPSRHYEPCDGIGTQQNL

SEQ ID NO: 47246 - protein, 397 aa, Arabidopsis thaliana
  misc_feature (223)..(223): Xaa can be any naturally occurring amino acid
MPATEYQRSFGRSFLNLRRDTAVNSVESTTVTPELTQMEAELVSFQRKVAERFIDLNASSCEDLLSLEWVGKLLDSFLSCQEEFRSIVINHRSMITKPPMDRLVSDYFERSVKALDVCNAIRDGVEQIRQWQKLIEIVICAFNNNAGGSSGKRPLGEGQFRRARKTLIELAIGMLDEKDSSSSSVSSQHRNRSFGRNKEQLHHRTIGHFRSLSWSVSRSWSAXKQLQAIGNNLATPRASDITATNGLIVPVYTMTSVLLFVMWALVAAIPCQDRGLQVHFNVPRNYQWGGSLMSLHDRIIEESKKRERKNTCGLLKEIHQFEKTSRLMNELVDSVQFPLSEEKEMEVRERVEELGKLQEALKNGLDPFERKVREVFHRIVRSRTEGLDTVGKHHGSE

SEQ ID NO: 47247 - protein, 435 aa, Rickettsia conorii str. Malish 7
MTNENNNDSEFAELKIRGKIFKLPILKASIGEDVIDISRVSAEADCFTYDPGFMSTASCQSTITYIDGDKGILRHRGYDIKDLAEKSDFLEVAYLLIYGELPSGEQYNNFTKQVAHHSLVNERLHYLFQTFCSSSHPMAIMLAAVGSLSAFYPDLLNFKEADYELTAIRMIAKIPTIAAMSYKYSIGQPFIYPDNSLDFTENFLHMMFATPCTKYTVNPIIKNALNKIFILHADHEQNASTSTVRIAGSSGANPFACISTGIASLWGPAHGGANEAVINMIKEIGSSEYIPKYIAKAKDKNDPFRLMGFGHRVYKNYDPRAAVLKETCKEVLKELGQLDNNPFLQIAIELEAIALKDEYFIERKLYPNVDFYSGIIYKAMGIPSQMFTVLFAIARTVGWMAQWKEMHEDPEQKISRPRQLYTGYVHREYKGIRER

SEQ ID NO: 47248 - protein, 376 aa, Arabidopsis thaliana
MEMIETEISFSGYLKRYGHLKFIELSDPPLTKRPRYSPSVIPPLPDQNPIFTLKLSPIILKNNKRKRFTPKSSSSRSVEEITKQVFDGVVRKSSSWIKSEFLGRGSYGSVYLATSKKAKTKTTMAIKSAEISRASSLMDEERILTRLSSPFIVRCYGHEIAREETLFGGERTNYNLILEYCSGKSLFDLVNDNLGGLSEKDVKLLARDILYGLDCIHRANIIHCDIKPENIFLTPVENRIRPSGYVAKIGDFGLALEKGSSEYEKASGHRRGTTRYMSPELIRHGIVDYAVDTWAFGCTVLEMLTGQQVWGEHSDLGSVDWDILIGQSCYIPYIPDWLSEEAQHFLSRCLKRDPASRWGIGALLNHPFLQCGSIIV

SEQ ID NO: 47249 - protein, 373 aa, Desulfitobacterium hafniense Y51
MEPIKGEQRDGQSEIRKLAILTGGGDCPGLNAVIRAAVKTACHRGIAVVGIQDGFRGAVEGDFRPLELKDVSGILPRGGTILGTTNRDNPFAYPTQVGEERQVQDRSAEVMDRFKAEGIDALIAIGGDGSLSIAWEFAKQGLKVVGVPKTIDNDLMCTDLTFGFQTAVATAQDALDRLHTTAESHHRIMILEVMGRYAGWIALYAGVAGGADVILIPEIPYQLESIAEAVQRRARLGKHFSIIVVAEGAKPLGGDMVVERTMSGRTDPIKLGGIGAKLAADLEKVTDMETRVTVLGHLQRGGSPIAVDRVLSTRYGVAAVEAALAGDFGMMVALQGQDIVRVPMAEAVHKLKQVEPDDPVLNAARSMGIEFGD

SEQ ID NO: 47250 - protein, 471 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHEATSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPLGGIPSPSTEQSAKKVR

SEQ ID NO: 47251 - protein, 193 aa, Arabidopsis thaliana
MAELSKNLKEGERILEPTRRPDGTLRKPIRIRPGYTPEDEVVKYQSKGSLMKKEMASQGPPGYEPDPAPKPKTKAAKRNERKKEKRLQATAEKANSSEDGSASNGSQSVNVLASEMEALDVSSNNDVCGGAPNPGTTGEDVEKRIRALKKKIRLTEAQQQKTASRDLNPEQLEKFSKLEEWRQELKALEDKAA

SEQ ID NO: 47252 - protein, 560 aa, Arabidopsis thaliana
MASSTALICDTEAWKDLKGHVEDIKKTHLRDLMSDANRCQSMMMEFDGLLLDYSRQRATVETMDKLLNLAKASQLTEKISRMFNGEHINSTENRSVLHVALRAPKDAVIKADGMNVVPEVWNVLDKIKEFSDKIRSGSWVGATGKPLKDVIAIGIGGSFLGPLFVHTALQTDPEALESAKGRQLRFLANIDPVDVARNISGLNPETTLVVVVSKTSTTAETMLNARTLREWITAALGASAVAKHMVAVSTNLALVEKFGIDPNNAFAFWDWVGGRYSVCSAVGVLPLSLQYGFSMVEKFLKGASSIDQHFQSTPFEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYEHRVAVQGFVWGINSFDQWGVELGKVLATQVRKQLHSSRTQGTAPEGFNYSTTTLLKRYLETSSEPQM

SEQ ID NO: 47253 - protein, 330 aa, Kluyveromyces lactis NRRL Y-1140
MWEEFDITKLPYYDPKVDNKVALVTGGNSGIGYYTVLHLYLHGFKVYLGGRNSSRVNHAIKEIKKEAEIRLRKGQDEKPHDGLMIRKTGKLEYLHIDLTDLNSVEKAATKFTVQEDHLDVLINNAGVMAIPYELTKDNFEIQMQTNYVSHFLLTMRLLPLIKARKGRVITVSSLGHNLIFFNCNPGAQFNYWPSMFFMWCRYALAKTASIQFTKMLAIKNPDILCMSLHPGLVMNTNLFSYCTRLPFVGIFFWILFQFVGYFFGVSNEQGAISTLKCALSSDLSAETDNGAYFTTGGYPSKPSRVANSLDNAASTWIWTVHELRDRGHEI

SEQ ID NO: 47254 - protein, 556 aa, Phytophthora infestans
MINDTPAWKALAEHAAEIKSTHLRELLNDDARNAAMRTEQQGIYLDFSRQNATSKTLDLLFELAETAELKKKLQAIASGEHVNATEDRAVMHMALRAPKTEKIVVDGHDVVPDVHEVLDAIRAFTSNVRDGKFVGATGKQLKNVISIGIGGSHLGSEFVFESLRYEPVAKAAAEGRILRLLANVDPVDVARATSGLNPEETLVVVVSKTFTTAETMLNARTLRKWLVDDLTKKGSSEAGAVAKHMVAASSAVPLVQQFGIDRANIFGFWDWVGGRYSVTSAVGILPLALQYGFDITEKFLAGAHAMDKHLLETPLRNNLPVIMGLLGVWNSSFLGHSSRALLPYSQALLRFAAHIQQVDMESNGKRVTVEGVDLPFQAGEVNFGEPGTNGQHSFYQLIHQGRVVPCDFLGFCESQNPVQLAGEPVSNHDELMSNFFAQPDALARGKSIEDLKAEGVPEKLQNHKLFPGNRPSISLLFKKLDAFSTGQLLALYEHRTVVQGAIWGINSFDQWGVELGKVLAKQVRAQLSASRTENAPVKGFNSATTSMLEAYLAHKA

SEQ ID NO: 47255 - protein, 340 aa, uncultured bacterium
MKAVVFHGKDAGLKIEDIPVPQIKGDQILVKVAACGVCHTDLHYIEHGVPTFKKPPIVLGHEASGIVEKAGANVTNVKPGQRVLIPAVLTCGHCPACRQGRENICSNMTMLGNHFDGAYAEYVAVPAKDVLGLPEAIPLQEASIIADAISTPYHAVKNRAQVKPGDTVVVFGCGGVGINAVQMASAAGGYVIAVDINPRKLEWAREFGAAKTVDASKVDRVSKEIKKLTGGGADIAMEVIGNPRTIEQAFECVRVGGRLCVVGYTHEAISIVAGKIMFKELEIVGSLGCRPVDYVPLIRMVEQGKIDLKRQVTHRFGLDELGQAFEVMKEGLSLRSIVIP

SEQ ID NO: 47256 - protein, 435 aa, Ruminococcus albus 8
MKYTEREVLQFVEENDVKFIKLMFCDIFGALKSVSVPASELSGIFAKGLLFDASKLSGFMNFSSTDLILFPDPDTLALLPWRPQQGRVVRFFCTIKYTDGTVFEGDGRTFLRNAVEYARGKGYNFQIGTSCEFYVFEKNDNGHITKIPHDYAGYCDIAPADKGENLRRDICLTLEQMDIYPESSRHESGPGQNEIDFQYSNALNAADNLVTFKNVVKSVADRNGLYATFMPKPLCDRPGSGLHIMLFCMKGTENIFKPRLDELGHEAKSMIAGILERVREITLFLNSTASSYSRLGNSRAPKYITWSHENFAQLIRVPMINTDENAMILRSPDNTCNPYFALGLIIYAALEGALSGAELCSATNLSPDNIAELTERLPATLDEAIEAARSSSFLADRLPENLIEHVLNEKSREAKEYAECEDKEMFETVRYFYTL

SEQ ID NO: 47257 - protein, 556 aa, Phytophthora infestans
MINDTPAWKAQAEHAAEIKSTHLRELLNDDARNAAMRTEQQGIYLDFSRQNATSKTLDLLFELAETAELKKKLQAIASGEHVNATEDRAVMHMALRAPKTEKIVVDGHDVVPDVHEVLDAIRAFTSNVRDGKFVGATGKQLKNVISIGIGGSYLGSEFVFESLRYEPVAKAAAEGRILRLLANVDPVDVARATSGLNPEETLVVVVSKTFTTAETMLNARTLRKWLVDDLTKKGSSEADAVAKHMVAASSAVPLVQQFGIDRANIFGFRDWVGGRYSVTSAVGILPLALQYGFDITEKFLAGAHAMDKHLLETPLRNNLPVIMGLLGVWNSSFLGHSSRALLPYSQALLRFAAHIQQVDMESNGKRVTVEGVDLPFQAGEVNFGEPGTNGQHSFYQLIHQGRVVPCDFLGFCESQNPVQLAGEPVSNHDELMSNFFAQPDALARGKSIEDLKAEGVPEKLQNHKLFPGNRPSISLLFKKLDAFSTGQLLALYEHRTVVQGAIWGINSFDQWGVELGKVLAKQVRAQLSASRTENAPVKGFNSATTSMLEAYLAHKA

SEQ ID NO: 47258 - protein, 556 aa, Phytophthora infestans
MINDTPAWKALAEHAAEIKSTHLRELLNDDARNAAMRTEQQGIYLDFSRQNATSKTLDLLLELAETAELKKKLQAIASGEHVNATEDRAVMHMALRAPKTEKIVVDGHDVVPDVHEVLDAIRAFTSNVRDGKFVGATGKQLKNVISIGIGGSYLGSEFVFESLRYEPVAKAAAEGRILRLLANVDPVDVARATSGLNPEETLVVVVSKTFTTAETMLNARTLRKWLVDDLTKKGSSEADAVAKHVVAASSAVPLVQQFGIDRANIFGFWDWVGGRYSVTSAVGILPLALQYGFDITEKFLAGAHAMDKHLLETPLRNNLPVIMGLLGVWNSSFLGHSSRALLPYSQALLRFAAHIQQVDMESNGKRVTVEGVDLPFQAGEVNFGEPGTNGQHSFYQLVHQGRVVPCDFLGFCESQNPVQLAGEPVSNHDELMSNFFAQPDALARGKSIEDLKAEGVPEKLQNHKLFPGNRPSISLLFKKLDAFSTGQLLALYEHRTVVQGAIWGINSFDQWGVELGKVLAKQVRAQLSASRTENAPVKGFNSATTSMLEAYLAHKA

SEQ ID NO: 47259 - protein, 556 aa, Phytophthora infestans
MINDTPAWKALAEHAAEIKSTHLRELLNDDARNAAMRTEQQGIYLDFSRQNATSKTLDLLFELAETAELKKKLQAIASGEHVNATEDRAVMHMALRAPKTEKIVVDGHDVVPDVHEVLDAIRAFTSNVRDGKLVGATGKQLKNVISIGIGGSYLGPEFVFESLRYEPVAKAAAEGRNLRFLANVDPVDVARATSGLNPEETPVVVVSKTFTTAETMLNARTLRKWLVDGLTKKGSSEADAVAKHMVAASSAVPLVQQFGIDRANIFGFWDWVGGRYSVTSAVGILPLALQYGFDITEKFLAGAHAMDKHLLETPLRNNLPVIMGLLGVWNSSFLGHSSRALLPYSQALLRFAAHIQQVDMESNGKRVTVEGVDLPFQAGEVNFGEPGTNGQHSFYQLIHQGRVVPCDFLGFCESQNPVQLAGEPVSNHDELMSNFFAQPDALARGKSIEDLKAEGVPEKLQNHKLFPGNRPSISLLFKKLDAFSTGQLLALYEHRTVVQGAIWGINSFDQWGVELGKVLAKQVRAQLSASRTENAPVKGFNSATTSMLEAYLAHKA

SEQ ID NO: 47260 - protein, 556 aa, Phytophthora infestans
MINDTPAWKALAEHAAEIKSTHLRELLNDDARNAAMRTEQQGIYLDFSRQNATSKTLDLLFELAETAELKKKLQAIASGEHVNTTEDRAVMHMALRAPKTEKIVVDGHDVVPDVHEVLDAIRAFTSNVRDGKLVGATGKQLKNVISIGIGGSYLGPEFVFESLRYEPVAKAAAEGRNLRFLANVDPVDVARATSGLNPEETLVVVVSKTFTTAETMLNARTLRKWLVDGLTKKGSSEADAVAKHMVAASSAVPLVQQFGIDRANIFGFWDWVGGRYSVTSAVGILPLALQYGFDITEKFLAGAHAMDKHLLETPLRNNLPVIMGLLGVWNSSFLGHSSRALLPYSQALLRFTAHIQQVDMESNGKRVTVEGVDLPFQAGEVNFGEPGTNGQHSFYQLIHQGRVVPCDFLGFCESQNPVQLAGEPVSNHDELMSNFFAQPDALARGKSIEDLKAEGVPEKLQNHKLFPGNRPSISLLFKKLDAFSTGQLLALYEHRTVVQGAIWGINSFDQWGVELGKVLAKQVRAQLSASRTENAPVKGFNSATTSMLEAYLAHKA

SEQ ID NO: 47261 - protein, 883 aa, Propionibacterium acnes KPA171202
MTDRYVYDLSEGSAEMKPLLGGKGAGVAEMKRLGVPVPDGFTVTTEACVDTMTRKGEWPEDLESQVWDGLKRLEERTGRVLGDDKKPLLVSVRSGAVISMPGMMDTILNLGISDDTVEAIAKEAGNERFAWDCYRRFIQMYGEVVEGIDAHIYEDALTALKEKKGVESDTDLSADDLKGLVDTFKKLSNEQLGGNWTTDPREQLMRAVDAVFRSWLNPRAFVYRKANKIPDDLGTAVNVMQMVFGNRGDTSATGVCFTRNPATGEKELYGEFLVNAQGEDVVAGIRTPRSLAEMEEVLPEAYHDLIDTMKKMESHYRDMQDMEFTVENGKLYLLQTRNGKRTAAAALKVARDLVDEGVITKEEALMRIEPAQLDQLLHEAIDPDHSEQPVAEGLPASPGAAVGEAVFDADVAAERGAKGEKVVLIRFETTPDDIHGVIVSQGVLTAHGGMTSHAAVVARGMGKPCVAGARGIKIDAKAATLTIGDTVIHEGDMITLDGSTGEVFASGLKLIPPQINADFQEVLSWADEIRRLGVEANADNATDAAKARELGAEGIGLCRTEHMFFGADRLPAMHEMITADTPEERQAAVDKILPMQQDDFEGIFTAMKGLPVTVRLLDPPLHEFLPNLVEQSLKVQKMENQGADAGELDKERRLLAQVKKLHEQNPMLGTRGCRLGMLYPEIPDMQARAIIRAVLSVLKKEGETVQIHIMIPLVFTPIELETHRRIVQQAIDEEFESAGTKVDVKIGTMIELPRAALVADKIAEVADFFSFGTNDLTQTTLGISRDDAENGFLTEYLRTKVLKDNPFASIDQEGVGQLVAGAVEKGRKTNPELSVGVCGEHGGDPDSIHFFNKTGLDYVSCSPFRVPIARFAAAQAVISQQEK

SEQ ID NO: 47262 - protein, 232 aa, Nostoc punctiforme PCC 73102
MITFSDLTSIPILWLQIAITAIWVLLILVIAWVVNRFADEPEIVRKIVHIGTGNVILLAWWLDIPASVGITASILASAITLLSYRLPILPGINSVGRQSFGTFFYSVSFGILVASFWYLQQPQYAALGILIMTWGDGLAALIGQRFGTHKYKVFGTQKSWEGSLTMMFVSYFISILILVGTQGNSWQTWVISLAVAFIATVLEAFSFLGIDNLTVPLGSAALAFFLSQLVYF

SEQ ID NO: 47263 - protein, 302 aa, Oryza sativa (japonica cultivar-group)
MAVYIAREATKLWRKVCAEIAVELQLLFEKWRLLLAGLVFQYIHGLAARGVHYLHRPGPLLQDLGFMALPELGQDKGYVSESVFTFIFISFLLWSFHPFIYHSKRFYTVLLWRRVLAFLVASQFLRIITFYSTQLPGPNYHCREGSKMATLPPPHNVLEVLLINFPRGVLFGCGDLIFSSHMIFTLVFVRTYHKYGSKRLIKILAWLMAIIQSLLIIASRKHYSVDVVVAWYTVNLVVFFIDNKLPEMPDRTNGSSLLPVTAKDKDGRTKEELHKLEKDCKMKEEFHKLLNGNTVDSTDRVS

SEQ ID NO: 47264 - protein, 497 aa, Ralstonia solanacearum GMI1000
MTRTDLPPAPITLNDPALWRTQAFLAGAWTDADDGSTRDVTDPATGRVIGTVPAMGAAETRRAIEAAQAAQRAWRKVTARERARILRKLADLMLEHQQDLARILTAEQGKPLPEATGEIAYAASFIEWFAEEARRVYGDTIPAPQGDRRIVVNKEPIGVTAAITPWNFPIAMMTRKVGPALAAGCAMVVKPALETPYSALAFAELAARAGVPAGLLSIVTGDAQGIGGELTANPVVRKLSFTGSTAVGRLLMRQCADDVKKLSLELGGNAPFIVFDDADLDAAVEGAMVAKYRNAGQTCVCANRFYVQRGIYDAFAARLSEAVRALRVGNGAEPGVQQGPLIHQRAMDKVRAHVDNAVAQGARVLVGGKPHALSAQGGAFFEPTVIVDARPGMLVAHEETFGPLAALIPFDTEDEAVAAANDTEFGLAAYFYTRDLGRAWRVSEALESGMVGVNTGLISTAEAPFGGVKQSGLGREGSKYGIDEYLEIKYVCMAGLG

SEQ ID NO: 47265 - protein, 175 aa, Triticum aestivum
MAPAVMASSATSVAPFQGLKSTAGLPVSRRSNGASLGSVSNGGRIRRMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 47266 - protein, 393 aa, Arabidopsis thaliana
MPRSMSSDRLVQWDDDSNRPHKKLKHSTTISETSVIEDDADSSTQMGHSIKTIPKSDRWVVTRYLGNSSRSSVYLAESTIEGEEDYLPDEMTIKSIEISQASRLMNEEKFLSRLQNPFVVSFYGHEVTIEKDGKDPLLEKMYYNTLQEYSSGRNLATHIEKNRGKLPEDDVRSLANEILLGLKYIHEEKIIHCDIKPKNIILPFENNLFAQIAGFGKAIKKWSVEYGEGLGHRIGTSRLLPPEVMMDMVLDYGADVWAFGCTVLEMLTGERVWSEFGKLDWEGWKTLIGESGSVPYIPNYLSDKAKDFLAKCLERDPSKRWSVDSLLEHEFLKWIDEDEEEEIYEEEEDDFYDGIEDVDEEYEANLEAEAAVEEEEAIEIDEEYPKEESEDDL

SEQ ID NO: 47267 - protein, 426 aa, Ralstonia solanacearum GMI1000
MNARDPQHNAQWNARRLAATPRGVGVMTDRYAEHAENAQFWDVEGKRYIDFAAGIAVVNTGHRHPRLVQAVREQLERFTHTAFQIVPYASYVELAERLNTLTPGAHAKKTAFFSTGAEAVENAIKIARAHTGRPGVIALTGAFHGRTFMGMSLTGKVVPYKTGFGPFPGSIYHVPAPIALHGVSTQDSLDAIGRLFKADIDPRQVAAIIFEPVQGEGGFYQMPADFVRALRALCDEHGIVMIADEVQTGFARTGKLFAMEHTGVLPDLVTMAKGLAGGLPLSAVTGRAEIMDAPAPGGLGGTYAGNPLAVAAAHAVLDIIDEEKLCERSAALGRRLVDALDAAKAGQPRIAEVRGVGAMVAIEFNTPDGKPDADFTRTVQQRALEAGLLLLSCGVYGNVIRFLFPLTIEDAVFEEGLAILKHALEG

SEQ ID NO: 47268 - protein, 338 aa, Neurospora crassa
MVVKVGINGFGRIGRIVFRNAIEHDDIHIVAVNDPFIEPKYAAYMLRYDTTHGNFKGTIEVDGADLVVNGKKVKFYTDADPAAIPWSETGADYIVESTGVFTTTEKASAHLKGGAKKVIISAPSADAPMYVMGVNNETYDGSADVISNASCTTNCLAPLAKVIHDNFTIVEGLMTTVHSYTATQKTVDGPSAKDWRGGRTAAQNIIPSSTGAAKAVGKVIPDLNGKLTGMAMRVPTANVSVVDLTARIEKGATYDEIKEVIKKASEGPLAGILAYTEDEVVSSDMNGNPASSIFDAKAGISLNKNFVKLVSWYDNEWGYSRRVLDLISYISKVDAKKA

SEQ ID NO: 47269 - protein, 174 aa, Triticum aestivum
MAPAVMASSATTVAPFQGLKSTAGLPVSRRSSGSLGRVSNGGRIRCMQVWPIEGIKKFETLSYLPPLSTEALLKQVDYLIRSKWVPCLEFSKVGFVFREHNSSSGYYDGRYWTMWKLPMFGCTDATQVLNEVEEVKKEYPDAYVRVIGFDNLRQVQCVSFIAFRPPGCEESGKA

SEQ ID NO: 47270 - protein, 792 aa, Aspergillus nidulans FGSC A4
MSTDYEKRLSLDDMALKTGDHIETIGKAAAVDATVAANVDDIPISLYVWMVALSASIAGMLFGYDTGIISAVLVYIKDALGGRYLTSSEKELITSLCSGGAFFGSIFAGNTADRWGRKTALYLGCVLFVVGAVLQAAAYTIAQMAVGRVIVGFGVGSAAMIVPLYVAEIAPSKARGRLVGLNNVSITGGQVIAYAIGAAFASVPHGWRVMVGLGGLPPIVLACLLPFCPESPRHLVYNGRMEEARAVLRKLYRGATDVQIESVLASILAGCEEARAISGNEGGWAKIVRLHTVPSNFRALLCACGLMVLSQISGFNTLMYYSSTIFSLVGFTSPTAVGLVVAGTNLIMTFANMILVDRLGRRRLLLSTVWGMSAGLIAVSVAFSFIHVDVNATEVTPQSVTTPAIVVLIFIIWFVVFYGVSVGNTAWMSADFFPLEVRAMGTMWMTCSSWASNVIVSSTFLSMTNAMTMAGTFGFYAGICGVSYVLIYFFYPEVSGLILEEIKEVFEHGFGVSTYIPTPTMRSRLRVWLQIGRPISGLIDRGVAAFDGGYRKFQPESARCIRAKPSISSKCRPFEVFVYYGYSQLPSVHASQNPDIQNSDVRKIWERRIQLGLLGLQRVTTRIERKDKLMLARLQAVPRLFLEARSKAACPTLGTTSPLTSKAAHVPITRRDYKIILATRQSAEDNGDRHDEKMPWRCERRKRSRFRSVTTRDESNERQITVYFLDYLLYLTTLLQESCWKIVHPAYGLDLKHFDDEAADPRTERHAVFSTGLRVSDDYTTKKWNIGLGSLQ

SEQ ID NO: 47271 - protein, 543 aa, Oceanobacter sp. RED65
MQQLRRLITIAYVFIKYRLDDFVPVHLLPWYLRLAFYLAPWRLNPLPKRMPKEKRLRLALIKLGPIFIKFGQILSTRRDLLSPKLAAELAKLQDKVPPFSSRLAKNIIEQALEDDVSKIFARFDTDPLASASIAQVHAAQLLSGEEVVVKVIRPNIERTIEKDIRLMLVAARLFQRYARDGKRLKPIEVVEDYRHTIFGELDLMSEAANCAQLRRNFQDSPLLYVPDVYWDWCRENVMVQERIYGTPIGDVETLISKGTNMKVLAERGVEIFFRQVFQDSFFHADMHPGNIFVDCQDPESPRYIAIDCGIVGTLSEVDQDYLARNLLAFFNQDYHEVARLHVESGWVGAETRINEFEGAIRSVCEPIFEKPLEEISFGQLLLRLFQVARRYNMEVQPQLVLLQKTLLNIEGLGRQLYPQLDLWSTAKPYLESWMKRRMGPQAIWQEIKRQAPAWIAHGPQMPELIRNSLISFNQYPQHQAQLNKRLENIESSLDGQAKGRKHRAVGTLVAALGLVSLHTPYMWDAQASSSLIALGIAWILLRG

SEQ ID NO: 47272 - protein, 175 aa, Triticum aestivum
MAPAVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 47273 - protein, 536 aa, Aspergillus nidulans FGSC A4
MAIGNIYVIAAIAVIGGGLFGFDISSMSAIINTDAYLCYFQQGPLKTNDKGEQVCSGPTADVQGGITAAMPGGSWLGALVSGFLSDIFGRKTTIQIGSVIWCIGSIIVCAAQNIPMLIVGRIINGFSVGICSAQVPVYISELAPPTKRGRLVGLQQWAITWGIMIMFYISYGTSYIDGTAAFRIPWGLQMIPAVLLFFGMMVLPESPRWLARKDRWEECLAVLTLVHGHGDPNAPFVVREYEEIKAMCEFERNNADVSYLELIKPNMINRTHVGVFTQIWSQLTGMNVMMYYITYVFAMAGLQGNNLLVSSSIQYVINVVMTIPAILWVDRWGRRPTLLLGAAGMLAFLFANGGLMSSYGHPAPPGGLDGIEQQSWIVRGPPSKAVIACTYLFVAVYAISWGPVSWVYPPELFPLRVRGKANALCTSSNWAFNFALAYFVPPAFVNIQWKVYIIFGVFCTAMFLHVFFMFPETAGKTLEDVEGIFTNPAGIKYIGTPAWKTKNERGRAAMLEQTGFDVDEEKRAEAVAVHEESQPK

SEQ ID NO: 47274 - protein, 110 aa, Oceanobacter sp. RED65
MSQCIFCSIIAGDIPANKVYEDDHVLAFHDIAPKAETHILVIPKTHIVNLPDVKEDQWPLVTKVLQSINTIAEQEKLEGFRVITNNGEKGGQEVFHMHWHVLAGKSLPGF

SEQ ID NO: 47275 - protein, 339 aa, Brassica rapa subsp. pekinensis
MDLDDFRSVMDNAGVDVWTFIDTAILVASLDYGQELKRRRDNIVERLYATSMANKCRNCDFGGGGGDVARANGSVHEEEEEEEVREKSVNGEDDDEEDDGYDPFAGLFDDEQKSVLEIKERLEDPDLSEEDLVELLQNLDDMEITFQALQETDIGRHVNKVRKHSSNDVRTLAKKLVKKWKETVDEWVKLNPPGDLEPPSLIADEDSPQQRAIRNGNRQQVPDFGYSPVPQNGYSGSSSKNSYVSEPERKPRPVAPPPRRESPSPAKQPSRPIPREKEHKEIDFDSARKRLQQNYRQAENAKKQRTIQVMDIHEIPKPKKGGFFPRRGGSSQGGGGRHW

SEQ ID NO: 47276 - protein, 1286 aa, Oryza sativa (japonica cultivar-group)
MASAAMLVPLVLVLCTAAASAAVVEHTFKVGGTKITQLCMNSVIYTANQQLPGPTIEVTEGDTLVVHAVNDSPYPLSLHWHGVYQLRSGWNDGANKITQCPIQPSGNFTYRFNITGQEGTLWWHAHSSLLRATIYGALIIKPRNGPSGYPFPEPYEEIPILLGEWWNRNVDDVENDGYLTGLGPQISDALTINGMPGDQNRCKGSAMYEVEVEYGKTCLLRIINAAVNVELFFKVAGHTFTVVAADASYTKPYATDVIVIAPGQTVDALMNTTASPGRYYMAAHVFDSKTVAVPFDQSTATGIVKYKGVPNYAPAAMPSLPPHDDVVTAGRFYWSLTGLARPSDPGVPTTVDHNMVVTFGLDQAPCAPNQTKCSGFALVAAMNRNSFQFPDQKVSLLEALYKGVPGVYSEDFPDFPPPMQGFRKATAVEESESEQYSSTLGTEKPPDPPARVRLLPAGAGARPVQPVDEEQVQPRGPADHGGDAKHEVLHTAPGYEVRKYPPCVVAEVTYEPAEIKSRPNGGFTVLGNYIGALGNPQNTKPEKIDMTAPVITSGEPESIAMTAPVITSGEPEPVAMTAPVITAEERSQGKGQMTMQFLLPSKYSKVEEAPRPTDERVVLRQVGDRKYGVVRFSGLTGDKVVKEKAEWLKAALEKDGFTVKGPFVLARYNPPFTLPPLRTNEVMVPLPTEGESRLWPMAASPFLILPSLFPKPTILAARIHPSIFRGRHIRCSPNGAAVPESPEPAPRRGPRKSPSPSPPKAKTTRRRTKKNTQESDSEGEEEPPKRRGRRTRKSKQEAEQEAAEKEDEVRAASPGTEDSKRAVQDEDGEAEATGSDSEDGEDSPYDWPPLVCCFGAPRWEFVPTVRVSDRQMHPDIYSTWLHLQWEPPEFARAPGSAASNVAIALTRLGGRAAVLGKVGDDDFGRELVYRMNCERVQTRAIRFDDGAATATARMKVGFRDREDGSGGTRLVAETVKSAAEDSLSKAEINVDVLKEARVFHFNSEVLLTPSMESTLFRAIELSKKFGSKIFFDLNLPLPLWRSRDETKELINKAWNEADIIEVSRDELEFLLDHEYYQYKRANPPQYYLDGFHLTRNWPQYYHYTPEEIAPIWHDGIKLLLVTYGTLRIHYYTPKFHGCVIGTEDALITPYTTDRTGSGDAVVAAAIRKLTSCPEMYEDQDTLERNLRFAVAAGIISQWTIGAVRGFPTESAAQNLKEQNNAHDIQVYFMSAATEVVKGKVLPKQLTGFSVFSFSWKNVSATWRLPLLYSFEELCLPIDFHGRDASV

SEQ ID NO: 47277 - protein, 173 aa, Triticum aestivum
MAPAVMASSATTVAPFQGLKSTAGLPVSRRSSEPRPRHNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVNGFDNLRQVQCVSFIAFRPPGCEESGKA

SEQ ID NO: 47278 - protein, 126 aa, Triticum aestivum
  misc_feature (11)..(11): Xaa can be any naturally occurring amino acid
  misc_feature (15)..(15): Xaa can be any naturally occurring amino acid
  misc_feature (21)..(22): Xaa can be any naturally occurring amino acid
  misc_feature (54)..(54): Xaa can be any naturally occurring amino acid
MDLMPKESKFXMLPXTAYRVXXPLCAYMGDDDMFSSDLSEDQLKQRLGHMSTTXCLVVFSMADEYVPEYVDKKALVDRLSRALGDSEKVEIKWGNHALSNRVQEAVEVIVDFVKREGPKGWDDPWS

SEQ ID NO: 47279 - protein, 353 aa, Oryza sativa (indica cultivar-group)
MHPRARIHADPAPEFDQFDCLPDPVVLLILNKLEDVRSLGRCAAVSKRFSGLVPLVSDVYVKIDRVVATDGDADDALNLSSAKPKNIFSHFFKLMLFTIVKPFHSMRNLNGTGRPLFPLAQHSPVHVLRNFSDVWNLRVELPSGDVGTEEGVLLKWRAEYGSTLRNCVILGGTLVDRKPIGAEHESSVEDNGSIPESFYTNGGLKLRVVWTISSLIAASTRHYLLRSIIKDHPTLRSLVLADADGQGTLYMGMEQLREFRENKLSASACSNRTQVPACNMKLKYAPYLELPGGMTLQGATLVVIKPSNDGGSGGHSSRKETEAFVSSAFDEPFRFAVKALMKRRTYLLEMNGF

SEQ ID NO: 47280 - protein, 110 aa, Candida glabrata CBS 138
MSEAIISRPKSELSKEELEQLEEFEFKHGPMSLINDAMITRNPVIISLRNNHKLIARVKAFDRHCNLVLENVKELWTEKKNKQTINRERFISKLFLRGDSVIVILKAPLQ

SEQ ID NO: 47281 - protein, 272 aa, Pseudomonas syringae pv. syringae B728a
MSGFEQLFAGKLPKLIMFDLDGTLVDSVPDLAVAVDTMLAELGRPIAGLESVRAWVGNGAPVLVRRALANNLDHSGVDDALAEQGLEIFMRAYAQKHEFTVVYPGVRETLKWLQKMGVEMALITNKPERFVAPLLDEMKLGRFFRWIVGGDTMPQKKPDPAALFFVMKMAGAPASQSLFVGDSRSDVQAAKAAGVACVALSYGYNHGRPIAEENPAMVIDDLRKLIPGCLDMDAEILLPDIKRPSSRESIVVVTRKLWMKVIKALARWRWRA

SEQ ID NO: 47282 - protein, 556 aa, Phytophthora infestans
MINDTPAWKALAEHAAEIKSTHLRELLNDDARNAAMRTEQQGIYLDFSRQNATSKTLDLLFELAETAELKKKLQAIASGEHVNATEDRAVMHMALRAPKTEKIVVDGHDVVPDVHEVLDAIRAFTSNVRDGKLVGATGKQLKNVISIGIGGSYLGPEFVFESLRYEPVAKAAAEGRNLRFLANVDPVDVARATSGLNPEETLVVVVSKTFTTAETMLNARTLRKWLVDDLTKKGSSEADAVAKHMVAASSAVPLVQQFGIDRANIFGFWDWVGGRYSVTSAVGILPLALQYGFDITEKFLAGAHAMDKHLLETPLRNNLPVIMGLLGVWNSSFLGHSSRALLPYSQALLRFAAHIQQVDMESNGKRVTVEGVDLPFQAGEVNFGEPGTNGQHSFYQLIHQGRVVPCDFLGFCESQNPVQLAGEPVSNHDELMSNFFAQPDALARGKSIEDPKAEGVPEKLQNHKLFPGNRPSISLLFKKLDAFSTGQLLALYEHRTVVQGAIWGINSFDQWGVELGKVLAKQVRAQLSASRTENAPVKGFNSATTSMLEAYLAHKA

SEQ ID NO: 47283 - protein, 166 aa, Oryza sativa (indica cultivar-group)
MEAAFCEKFVLTPISLPCSFDKILRKEIPSQVVYEDEKFAFQNRGLKGGAVQTLAFRDISPQAPVHIIIIPKVKDGLSRLSKAEERHVEVMGHLLYAAKTIAKQENLDDGFRIVINDGPNGCEHKLDPIETVSLISPPYSSSRGTSDELASWISCIFPKRCSVMKM

SEQ ID NO: 47284 - protein, 540 aa, Oryza sativa (indica cultivar-group)
MEEAHAMPVTSFFPVAGIHKLIAIFLVVLSWILVHKWSLRNQKGPRSWPIIGATVEQLKNYHRMHDWLVEYLSKDRTVTVDMPFTSYTYIADPVNVEHVLKTNFTNYPKGEVYRSYMDVLLGDGIFNADGEMWRKQRKTASFEFASKNLRDFSTVVFREYSLKLSSILSQACKAGRVVDMQELFMRMTLDSICKVGFGVEIGTLSPDLPENSFAQAFDAANIIVTLRFIDPLWRLKKFLHVGSEALLEQSMKLVDDFTYSVIRRRKAEILQARASGKQEKIKHDILSRFIELGEAGGDEGGGSFGDDKSLRDVVLNFVIAGRDTTATTLSWFTYMAMTHPAVADKLRRELAAFEAERAREEGVALADAAGEASFAARVAQFASLLSYDAVGKLVYLHACVTETLRLYPAVPQDPKGIVEDDVLPDGTKVRAGGMVTYVPYSMGRMEYNWGPDAASFRPERWLSGDGGAFRNASPFKFTAFQAGPRICLGKDSAYLQMKMALAILFRFYTFDLVEDHPVKYRMMTILSMAHGLKVRVSTSV

SEQ ID NO: 47285 - protein, 556 aa, Phytophthora infestans
MINDTPAWKALAEHAAEIKSTHLRELLNDDARNAAMRTEQQGIYLDFSRQNATSKTLDLLFELAETAELKKKLQAIASGEHVNATEDRAVMHMALRAPKTEKIVVDGHDVVPDVHEVLDAIRAFTSNVRDGKLVGATGKQLKNVIPIGIGGSYLGPEFVFESLRYEPVAKAAAEGRNLRFLANVDPVDVARATSGLNPEETLVVVVSKTFTTAETMLNARTLRKWLVDDLTKKGSSEADAVAKHMVAASSAVPLVQQFGIDRANIFGFWDWVGGRYSVTSAVGILPLALQYGFDITEKFLAGAHAMDKHLLETPLRNNLPVIMGLLGVWNSSFLGHSSHALLPYSQALLRFAAHIQQVDMESNGKRVTVEGVDLPFQAGEVNFGEPGTNGQHSFYQLIHQGRVVPCDFLGFCESQNPVQLAGEPVSNHDELMSNFFAQPDALARGKSIEDLKAEGVPEKLQNHKLFPGNRPSISLLFKELDAFSTGQLLALYEHRTVVQGAIWGINSFDQWGVELGKVLAKQVRAQLSASRTENAPVKGFNSATTSMLEAYLAHKA

SEQ ID NO: 47286 - protein, 184 aa, Yarrowia lipolytica CLIB122
MKFFDSRHYFNYSWEQVSIANWKKYPNEVSTHVIAVDVLRREVDPKSGVLRTERLITCKQSIPKWLLALVGGQEVSYVREVSEVDPKARTVVMRSTNMTMNNLLLVFETCTYSPDPENPATKTVFDQEAQITAFASWKRICNKIEDWTVERFGQNAIKGKAGFEGVLQKVANSDVFARESVSLS

SEQ ID NO: 47287 - protein, 556 aa, Phytophthora infestans
MINDTPAWKALAEHAAEIKSTHLRELLNDDARNAAMRTEQQGIYLDFSRQNATSKTLDLLFELAETAELKKKLQAIASGEHVNATEDRAVMHMALRAPKTEKIVVDGHDVVPDVHEVLDAIRAFTSNVRDGKFVGATGKQLKNVISIGIGGSYLGSEFVFESLRYEPVAKAAAEGRILRLLANVDPVDVARATSGLNPEETLVVVVSKTFTTAETMLNARTLRKWLVDDLTKKGSSEADAVAKHMVAASSAVPLVQQFGIDRANIFGFWDWVGGRYSVTSAVGILPLALQYGFDITEKFLAGAHAMDKHLLETPLRNNLPVIMGLLGVWNSSFLGHSSRALLPYSQALLRFAAHIQQVDMESNGERVTVEGVDLPFQAGEVNFGEPGTNGQHSFYQLIHQGRVVPCDFLGFCESQNPVQLAGEPVSNHDELMSNFFAQPDALARGKSIEDLKAEGVPEKLQNHKLFPGNRPSISLLFKKLDAFSTGQLLALYEHRTVVQGAIWGINSFDQWGVELGKVLAKQVRAQLSASRTENAPVKGFNSATTSMLEAYLAHKA

SEQ ID NO: 47288 - protein, 224 aa, Solanum peruvianum
FLMQKELDYLVGAVSNPQKPFAAIVGGSKVSSKIGVIESLLEKVDVLLLGGGMIFTFYKAQGYAVGSSLVEEDKLDLATSLMEKAKTKGVSLLLPTDVVIADKFAADANSKIVPASEIPDGWMGLDIGPDAIKSFGSALDTTKTIIWNGPMGVFEFDKFAAGTEAIAKKLAELSGKGVTTIIGGGDSVAAVEKVGLAEKMSHISTGGGASLELLEGKQLPGVLA

SEQ ID NO: 47289 - protein, 392 aa, Phytophthora infestans
MSLKKIKNFSINFGPQHPAAHGVLRLILELNGEVVQKADSHIGLLHRGTEKLIEYKNYLQALPYFDRLDYVSMMCQEHAYVLAIEKLLNCDIPLRAQYIRVLFSEITRILNHLLAVCCHALDVGAMTPYFWGFEEREKLMEFYERVSGARMHAAYFRPGGVNQDLPKGLLNDIYIFCDQFNTRLDEIEEMLTNNRIWKQRLVDIGIVSAKDALNLGFSGVMLRGSGISWDLRKTQPYEIYDQLDFDIPVGTNGDCYDRYLIRIEEMRQSIRIILQILNKIPNGPIKLDDKKITNPNRIQIKNSMESLIHHFKYYSENISINSGETYTVIEAPKGEYGVYLVSDGTNKPYRCKIKSPGFLHLQALDFLAKNHMIADVVTIIGTLDVVFGEIDR

SEQ ID NO: 47290 - protein, 367 aa, Coccidioides immitis RS
MAFLFSRNKSRQPAEIAKTLKDLLARLWQAPGSPKIEEDLAKHLAQIKLMVQGTQEVDSLPDQVHQLIQAFILDDLLYELARSIQHLPFEARKDTQTIFSHLLRFRPPNITSTDPPVISYIVNKRPEILIQLCHGYENSRSSTPCGTILREALKFEVVTGIVLYDQSKDEEPAIRLNEVQPGTVQTGAGVFWNFFHWINESSFEVSADAFTTFREILTRHKALVAGYLATNFDLFFSTYNNVLVLSDSYVTKRQSIKLLGELLLDRANYGVMTTYVDSGEHLKLCMNLLKDDRKMVQYEGFHIFKVFVANPNKSVAVQRILINNRDRLLKFLPKFLEDRTDDDQFTDEKSFLVRQIEILPPEPVAPR

SEQ ID NO: 47291 - protein, 556 aa, Phytophthora cactorum
MINDTPAWKALAEHAAEIKSTHLRELLNDDARNAAMRTEQQGIYLDFSRQNATSKTLDLLFELAETAELKKKLQAIASGEHVNATEDRAVMHMALRAPKTEKIVVDGHDVVPDVHEVLDAIRAFTSNVRDGKLVGATGKQLKNVISIGIGGSYLGPEFVFESLRYEPVAKAAAEGRNLRFLANVDPVDVARATSGLNPEETLVVVVSKTFTTAETMLNARTLRKWLVDDLTKKGSSEADAVAKHMVAASSAVPLVQQFGIDRANIFGFWDWVGGRYSVTSAVGILPLALQYGLDITEKFLAGAHAMDKHLLETPLRNNLPVIMGLLGVWNSSFLGHSSRALLPYSQALLRFAAHIQQVDMESNGKRVTVEGVDLPFQAGEVNFGEPGTNGQHSFYQLIHQGRVVPCDFLGLCESQNPVQLAGEPVSNHDELMSNFSAQPDALARGKSIEDLKAEGVPEKLQNHKLFPGNRPSISLLFKKLDAFSTGRLLALYEHRTVVQGAIWGINSFDQWGVELGKVLAKQVRAQLSASRTENAPVKGFNSATTSMLEAYLAHKA

SEQ ID NO: 47292 - protein, 231 aa, Oryza sativa (indica cultivar-group)
MAKVVHMAMGNYPPYGHSPPSFQATQRQGNWIQANSPNQVFGAASNRVLFAPHQVTSVEVAANTSSHGSESSIPCPTTTRQQEKQPLNIEELSDSSEEGVRRAPRTNWKEEENLRFVSAWLNNSVDSVDGNDKKSEYYWKDVADEFNSNRPRNAQKRTVKQMKTHWDNVKRDIAKFCGAYAQVRNTCTSEYFEDMIMEKAHTWYKNQSQQKSFTLEYMWREQKNQPKGPPI

SEQ ID NO: 47293 - protein, 556 aa, Phytophthora cactorum
MINDTPAWKALAEHAAEIKSTHLRELLNDDARNAAMRTEQQGIYLDFSRQNATSKTLDLLFELAETAELKKKLQAIASGEHVNATEDRAVMHMALRAPKTEKIVVDGHDVVPDVHEVLDAIRAFTSNVRDGKLVGATGKQLKNVISIGIGGSYLGLEFVFESLRYEPVAKAAAEGRNLRFLANVDPVDVARATSGLNPEETLVVVVSKTFTTAETMLNARTLRKWLVDDLTKKGSSEADAVAKHMVAASSAVPLVQQFGIDRANIFGFWDWVGGRYSVTSAVGILPLALQYGLDITEKFLAGAHAMDKHLLETPLRNNLPVIMGLLGVWNSSFLGHSSRALLPYSQALLRFAAHIQQVDMESNGKRVTVEGVDLPFQAGEVNFGEPGTNGQHSFYQLIHQGRVVPCDFLGLCESQNPVQLAGEPVSNHDELMSNFFAQPDALARGKSIEDLKAEGVPEKLQNHKLFPGNRPSISLLFKKLDAFSTGQLLALYEHRTVVQGAIWGINSFDQWGVELGKVLAKQVRAQLSASRTENAPVKGFNSATTSMLEAYLAHKA

SEQ ID NO: 47294 - protein, 141 aa, Oryza sativa (indica cultivar-group)
MGLLSTAADAAVVLFSLAVAAAAPLIDAQAVLPRRLFPAPHVRLHRWYATEFGDYLAAEPPGFFRGLVWLELVLHWPLSVATLYGVLARRPWAGATALAAGVSVVTAMGNLVMNLDFNRFSLQYSGTGLAPAPSSQKKKRP

SEQ ID NO: 47295 - protein, 161 aa, Lotus japonicus
MFLMVTGFMNYSQQTVRAARYIGQSFMITLSHANRLPVTIQYPYEKLITSERFRGRIHFEFDKCIACEVCVRVCPIDLPVVDWKLETNIRKKRLLNYSIDFGICIFCGNCIEYCPTNCLSMTEEYELSAYDRHELNYNQIALGRLPMSVIDDYTIRTIQIK

SEQ ID NO: 47296 - protein, 201 aa, Synechococcus sp. RS9917
MAGSKLRLGVAGPVGSGKTALVEALCRRLRDRLQLAVVTNDIYTQEDAQFLTRVGALEPERIRGVETGGCPHTAIREDCSINRAAVAELEAAFPDLDLVMVESGGDNLAASFSPELVDFCLYVIDVAAGDKIPRKGGPGITRSDLLVINKIDLAPLVGADLQVMERDTLRMRGERPWCFTNLNSGEGLDQVEAFVWQQLPN

SEQ ID NO: 47297 - protein, 166 aa, Oryza sativa (indica cultivar-group)
MGVVSAAADAAVVLFSLTVAVAAPLIDAQSVLPRHLFPAPLVSLKRWYAREFGDYLVARPPGFLRGLVWLELAFLWPLALATLYGVLARRRWAATTSLIAGVSTLTSMSAILGEIVGSKKATPKLLQMYVPFAVFAVIAILRGLCSSAPRGTAGSSLGPSARKKRA

SEQ ID NO: 47298 - protein, 393 aa, Lotus japonicus
MNVPATRKDLMIVNMGPHHPSMHGVLRLIVTLDGEDVIDCEPILGYLHRGMEKIAENRTIIQYLPYVTRWDYLATMFTEAITVNGPEQLGNIQVPKRASYIRVIMLELSRIASHLLWLGPFMADIGAQTPFFYIFREREFIYDLFEAATGMRMMHNFFRIGGVAADLPHGWIDKCFDFCNYFFTRVVEYQKLITRNPIFLERVEGVGVVGGEEVINWGLSGPMLRASGIQWDLRQVDNYECYEEFDWEVQWQKEGDSLARYLVRIGEMMESIKIIQQALEGIPGGPYENLEIRCFGREKEPEWNDFEYRFIGKKPSPTFELPKQELYVRVEAPKGELGIFLIGDQNGFPWRWKIRPPGFINLQILPQLVKRMKLADIMTILGSIDIIMGEVDR

SEQ ID NO: 47299 - protein, 461 aa, Aspergillus nidulans FGSC A4
MAATQAANLVEKAVGHSGTATVTTDISNYNNEHGVETGEKIRATVWQGKNSVGIVEMPKPRVVDAGDVIVRVTGSTVCGSDLHLYHDYLSDRAHAGVIPQLQKGDVLGHECCGVIESVGPESTKYKPGQRVVVSFPIACGTCKRCKAQLYSQCENTNENTITNAMYGKRTAGIFGYSHFTGGFAGGQAEYLRVPYGDVNLLPIPDDVPDEKALFLSDVISTSWHCVVDTGVNKGDIVAVWGAGPIGQMAVDFAFYHGAERVILIDGGDGAWRLEYVKSKLPKVEVIDFTNLPKGESVSSHLRKITDHNLDVCLECVGGEYAKGWIHFFEQMVGAETDTSEIVNEMITAVRPFGRVGLTGVYAGYTNHFNIGSLMQTGVRLIGNGQAPVQKYWGDLMNLIQKGDIDPLRMVSHRFRLEDIDKVYSLFNERNGGVQKVYLETRHSAPAAKEGPQLTNWHMIFI

SEQ ID NO: 47300 - protein, 563 aa, Oryza sativa (japonica cultivar-group)
MTTLQLDPPVVPARRSAATSCDLHPDETFTGFCTACLRERLAGLEASAAAASAPGRKSTSAIRSLFARPFGGGPGGSSVAGAGASLPDLRRCKSFSADEPQRRSCDVRGHSTLWSLFHQDDRGRVPSSSSAADIAPPHQQPPPPPPRPFIPDDFLDEDIPVVMEHDEIMPVVEPVIVVDTSGEIETEPNVVAREGKAMKDHMDFESSQPKKPPTKDLKESFWVAASVFSKKWQKWRRKQKLKKEAAVSKAAAAAMPPPEKPSKPSFLRRRRLRGEAGSELAGGRRSCDTDPRFSLDAGRMSVDDAGFSWDEPRASWDGYLFGAGAGIGLGRAPPPLSRLPPMMSVLEDTPATIVERSDGQIPVEDDADIDPPGGSLQTRDYYLDSSTRRRRSLERSSSVRRPSFEVTEPKPAPTTIANGKESPLGGSEFYHFHHAEDLLDRGFSSNSLIEDISASLEAALSGPGSAKKPRRWRKAWSLWGFIHRRASGPPERRPVRHRRPLVLGGVAGPARPWVQPQDAAVQQQLERAQLVQQQQRRAWQLEAQPRGRQREQREASGGARAGA

SEQ ID NO: 47301 - protein, 353 aa, Brassica rapa subsp. pekinensis
MEKPNRMSESQNVVVSEAARSIIPNNSSAPPGFISISKKKLLKNLEIINDGERINAWVDSMRASSPTHPKSLPSSISSEQQLSSWIMQHPSALEMFEKITEASGGKQIVIFLDYDGTLSPIVDDPDRAFMSSKMRRTVKKLAKCFPTAIVTGRCLDKVYSFVKLAELYYAGSHGMDIKGPAKGFSRHKRVKQSLLYQPASDYLPMIDEVYRQLLEKTKSTPGVIVENNKFCASVHFRCVDEKKWSELVLQVRSVLKEYPRLKLNQGRKGLETLTTFSQFTSVMTGPTKMHLSCYETEVKAVAFLSPNSPKIRMLHIICKIRPRQVHTHISDEFLATIGGVETNAAKSVKRMNV

SEQ ID NO: 47302 - protein, 395 aa, Burkholderia xenovorans LB400
MSETTQTAGTPGGNEPKSGFKPKKSVALSGVTAGNTALCTVGKTGNDLHYRGYDILDIASACEFEEIAYLLVHEKLPTQAELTAYKTKLKALRGLPANVKAALEWIPAAAHPMDVMRTGVSVLGTVLPEKDDHNLPGARDIADRLMASLGSMLLYWYHYSHNGKRIEVETDDDSIGGHFLHLLHGVEPSNAWVDAMHVSLNLYAEHEFNASTFTGRVIAGTGSDIYSALTGAIGALRGPKHGGANEVAFEIQSRYQTPDEAEADIRRRVENKEVVIGFGHPVYTISDPRNKVIKEVAKKLSKEAGNTRLFSIAERLESVMWDAKKMFPNLDWFSAVSYHMMGVPTAMFTPLFVIARTAGWSAHIIEQRIDNKIIRPSANYTGPENLKYLPLNRRK

SEQ ID NO: 47303 - protein, 535 aa, Aspergillus oryzae
MATAVSQGAAGNNAFKDKEKPMAVRTSNILAARAVADAIRTSLGPRGMDKMIQTPKGNTIITNDGNTMLKDMSVMHPAARMLVDLSAAQDVEAGDGTTSVVVIAGSLLGAAERLLSKGIHPTVISESFQRAAAAAVEILHNMSRPISLVDRSTLLQAASTSLSSKIVSQHSGLLGPMAVDSVLKVVDPKTAENVDLRNIRIVKKVGGTIEDSEMIDGLVLNQSVIKSSGGPTRIEKARIGLIQFQLSPPKPDMENQIVVNDYRQMDKILKEERQYLLNMVKKIQKTKCNVLLIQKSILRDAVNDLSLHFLSRLKILAIKDIERDEVEFLCKSLGCKPVANVDSFTEDKLGTADLVEEVQSSGARYVKITGIKSAPTTNQTVSIVARGANNLILDEAERSLHDALCVIRCLVKKRALIAGGGAPEIEVAQTLAKRARELTGTEAICWKAFADAMEIIPTTLAENAGLNSIKVVTDLRHRHAQGQHNAGVSIRSGGVKDDITEENILQPLLVSTSAIELAAETVKMIMRIDDIALSR

SEQ ID NO: 47304 - protein, 580 aa, Brassica rapa subsp. pekinensis
MCGILAVLGCVDNSQATRSRIIKLSRRLRHRGPDWSGLHCYEDCYLAHERLAIIDPISGDQPLYSEDKTVVVTVNGEIYNHKALRESESLKSHKYHTGSDCEVLAHLYEEHGEEFINMLDGMFAFVLLDTKDKSYIAVRDAIGVIPLYIGWGLDGSVWFASEMKALSDDCEQFMAFPPGHIYSSKQGGLRRWYNPPWFSELVPSTPYDPLVLRDTFEKAVIKRLMTDVPFGVLLSGGLDSSLVASVAIRHLEKSDARQWGSKLHTFCIGLKGSPDLKAGKEVADYLGTRHHELHFTVQEGIDAIEEVIYHVETYDVTTIRASTPMFLMSRKIKSLGVKMVLSGEGSDEIFGGYLYFHKAPNKKELHEETCRKIKALYQYDCLRANKSTSAWGVEARVPFLDKAFLDVAMGIDPEWKMIRPDLGRIEKWVLRNAFDDEKNPYLPKHILYRQKEQFSDGVGYSWIDGLKDHANKHVSDAMLTNANFVFPENTPLTKEAYYYRAIFEKFFPKSAARATVPGGPSVACSTAKAVEWDAAWKGNLDPSGRAALGVHVAAYEGDKAEAPRPEKVQKLAEKTAEAIV

SEQ ID NO: 47305 - protein, 177 aa, Oryza sativa
  misc_feature (87)..(87): Xaa can be any naturally occurring amino acid
MILEQFDESAAEKADAAMVVAPPSNFGMVDTGVYRSGFPDPASFGFLRGLGLRSVVYLCPEPYMETNAEFLKAEGIRLFQFGIEGNXDVRNHPVLIHCKRGKHRTGCLVGCFRKLQNWCLSSVFEEYHRYAAGKSRLSDLKFIESFDVNCMTDCLLRLIYHYHGCLQKSKRLAYSER

SEQ ID NO: 47306 - protein, 700 aa, Oryza sativa (japonica cultivar-group)
MQATSRHTLYRAHSLAWFRWWPIVYNVIQKASVPGPLPDPAHTGPINGATVIERARGVTCPVASRAKSDISVANAEESAPATGAAPTPVANHQNSRPTRSAYVPPHLRGQAPTTTAAPAPAPGPAAVQPSASVQPSGYAAIVGGSRWAGPASGDGTGAVGGPRQSVGGRGGGGGGGGGWNSRPGWDRRDREPNPFANSEAEEATEVDFDTANTGINFDAYEDIPVETSGHDVPPPVNTFAEIDLGDALNENIRRCKYVKPTPVQRYAIPISIAGRDLMACAQTGSGKTAAFCFPIISGIMSSRPPQRPRGSRTAYPLALILSPTRELSVQIHEEARKFAYQTGVRVVVAYGGAPIHQQLRELERGVEILVATPGRLMDLLERARVSLQMVKYLALDEADRMLDMGFEPQIRKIVEQMDMPPRGVRQTMLFSATFPKEIQRMASDFLADYIFLAVGRVGSSTDLIAQRVEFVLEADKRSYLMDLLHAQKANGTHGKQALTLVFVETKRGADALENWLYTNGFPATSIHGDRTQQEREYALRSFKSGATPILVATDVAARGLDIPHVAHVINFDLPNDIDDYVHRIGRTGRAGKSGLATAFFNEGNLSLARPLCELMQEANQEVPQWLERYSARSSFGGGGGRNRRSGGARFGGRDFRRDNRGGGGGGYGGGGGGYGGGGYGGGGGYGGGYGGGQGSTSSWD

SEQ ID NO: 47307 - protein, 418 aa, Blastopirellula marina DSM 3645
MTVSFKHPCWHQRNEAVMEMAPTSGIVEIDVRTDEMLVNMGPQHPSTHGVLRLVLRTDGEVVSEATPHIGYLHRCAEKIGENLTPRQWIPYTDRMDYLAGMNMNLGWALAVEKLIDYDLPEKARHLRVIIAELNRIASHLVGMGTYGLDLGSFSPFLYAFRERERILDLLEDACGARLTYSYLTPGGATADLPPGWLQKLTGFLDQFEPVILDYHALLTNNAIFIKRTANIGVMSAEMAIDYGCSGPVLRGSGVDYDLRRDGEERYTSLYAGYAFEVIVEKNGSYPRDHEYPPVPSDAVLGDCWHRFYVRMLEVIQAIDLLRQGIEKYSQATGDWGTPIKLATKLPKGEAYLETECPRGQMGFYIVSDGSGSIPLRARARSSCFCNLSVAPELCRDCLIADVPAIIGSLDIVMGEIDR

SEQ ID NO: 47308 - protein, 415 aa, Tradescantia virginiana
TTPISIEDVRREVKILKALSGHKHLVKFYDACEESLNVYLIMELCEGGELLDRILSRGGKYTEEDAKAIVMQILNVVAYCHLQGVVHRDLKPENFLFINRDENAPMKLIDFGLSDFTRPDERLNDIVGSAYYVAPEVLHRSYSMEADIWSIGVITYILLCGSRPFWARTESGIFRSVLRADPNFDDSPWPTASPEAKDFVKRLLNKDYRKRMTAAQALSHPWLRDKEPQIPLDILIYKQTKLYLRATPLKRAALKALSKALTEDELVYLRLQFKLLEPNNDGRVSLENFHTALAQNATEAMKESRVLDILNSLESLAYRRMDFEEFCAAAISCYQLEALEHWEQIASTAFEYFEQDGNRVVSVEELAQDLNLPQNAYAILKDWIRQSDKKLSFLGYTRYTRYLHGVTPRPNTRQH

SEQ ID NO: 47309 - protein, 175 aa, Blastopirellula marina DSM 3645
MLTWIRNVYSAVVTVAEGLSITIRYWFSTYDKDRKAFAEHYEYPELPVQVSPRYRGFHRYDLTTCIACDQCAKACPVDCIYIGKERVEGAKGFAVTGFTIDYTKCMFCALCVEPCPVDCIFMGGTLDLSSYSRDGAIVDFSRLPVDIAWGRSSLNPTAVAESKVIAEPVHGGPNQ

SEQ ID NO: 47310 - protein, 453 aa, Glycine max
  misc_feature (142)..(142): Xaa can be any naturally occurring amino acid
MATHAALASTRIPTNTKFPSKASHSFPTQCASKRLEVTEFSGLRSTSCVTYANDARESSFFDLVASQLTPKQTNGSSTPVRGETVAKLKVAINGFGRIGRNFLRCWHGRKDSPLEVVVVNDSGGVKNASHLLKYDSMLGTFXADVKILDNETITVDGKRIIVVSSRDPHKLPWAELGIDIVIEGTGVFVDGPGAGKHIQAGAKKVIITAPAKGADIPTYVVGVNEGDYTHQISNIISNASCTTNCLAPFVKILDEEFGIVKGTMTTTHSYTGDQRLLDASHRDLRRARAAALNIVPTSTGAAKAVSLVLPQLKGKLNGIALRVPTPNVSVVDLVVNVEKKGLTAEDVNAAFRKAAEGPLKGVLDVCDVPLVSIDFRCSDVSSTIDSSLTMVMGDDMVKVVAWYDNEWGYSQRVVDLAHLVASKWPGAAKAGSGDPLEEFCETNPADEECKVYE

SEQ ID NO: 47311 - protein, 136 aa, Zea mays
MVRTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRGERA

SEQ ID NO: 47312 - protein, 247 aa, Synechococcus sp. RS9917
MIRRRNGLRLDRRTFLLGAGLSGIGLLGPGRPASAQAAAPASPRSCRPADPLQALRDGNARFAAAWQQADQARSADARAQRMAALWSGHCFVPASVLTQGQAPWATVLTCADSRVAPEWIFDAAPADLFVIRSAGNTAFAAAIASVEFSVLELATPLVMVMGHSGCGAVTAARSGDAATPLLKELLTPIGAAIRPDQDLEAAIQANAREAAKQLTARSTVIEAAVNNGNLRIVVGYFDIGSGTVTLV

SEQ ID NO: 47313 - protein, 347 aa, Staphylococcus epidermidis RP62A
MSYKIVALPGDGIGPEILSGTLELLKLISEKYHFEYHLESHHFGGVSIDYYGTPLTNETLQSCKNADAILLGAIGGPKWTDPNNRPEHGLLKLRKSLNLFANIRPTFVTKGASHLSPLKQDIVEGTDLVIVRELTSGIYFGEPSYVKKTEALDSLKYSSQEIERIVRIAFNLANRRRKKLTSVDKENVLSSSKLWRQIVNDVKKDYPEVEVNHMLVDACSMHLITQPTQFDVIVTENLFGDILSDEASVIPGSLGLSPSASFGQTGTRLYEPIHGSAPDIANEDKANPFGMVLSLALCLRESLNQNDAANELESIVYSFIQSNKTTADLGGQYRTSEIFKLLKEKYL

SEQ ID NO: 47314 - protein, 264 aa, Oryza sativa (japonica cultivar-group)
MGNATAAAAVACSSQSCMTRSSPYRCALLKRKRSCIRACSSEDDGSDASSSLGGDKRQQEVLAKIAMLQAQKVRITSFLDERSAYLTKFAKDADTEFDLIGQNAMKELDEVGDQIMERLDSKMQAFEETAEVQRQEIEMNERVLEDFEDWIEKEKNEGMFFKSLGKVKPRNKKKLTVKPIPKLEAQKVKDIAKESAGSKTRMNIYLGLMAILGLTIANAVFATPEVEWRKVAALGLIFIGLVAQVIYEQDISSPEAEKKGGKEE

SEQ ID NO: 47315 - protein, 355 aa, Coprinopsis cinerea okayama7#130
MSASKISQLPIINIAPFLNDNPNDEPQRLAASQALHRACVEFGFFYLNLEAFIDPKEPEELTRLGREFFGLPQEEKDKLALRNQDYARGYQRLKENVTNGKADNHEGLDFYKPVANPDKAKPLWGENQWPTNEMVVGFREKYEIWVNKMKKLGTIVMRAMAVGLGMDEDEQEDLLKKVDDSFWVMRVIGYPPLPNDHDGFSCGAHKDYGCLTFLHADPTPSALQVFLRRPGAKETDEQGLPREQGEEEGVWINADPIPGCVVCNIGEMWETWTDGLYKSTLHRVVHRGSNYRIPFFFEPNFDALVEPLPAALRAKAKETGVKLEDIRPEKEPIVYGEFLMKKVGNNFAVEGRDRY

SEQ ID NO: 47316 - protein, 494 aa, Bacillus cereus ATCC 10987
MLTKNIELKPKVKAFLNEEIKMFINGEFVPSISGKTFETYNPATEDVLAVVCEAQEEDINVAVKAARSAFESGPWAEMTTAERAHLIYKLADLIEEHGEELAQLEALDNGKPYQVALDDDIAATVENYRYYAGWATKIIGQTIPISKDYLNYTRHEPVGVVGQIIPWNFPLVMSSWKMGAALATGCTIVLKPAEQTPLSLLYTAKLFKEAGFPKGVVNFVPGFGPEAGAAIVNHHDIDKVAFTGSTVTGKYIMRQSAETIKHVTLELGGKSPNIILEDADLEEAINGAFQGIMYNHGQNCSAGSRVFVHRKHYETVVNELVKMANNVKLGAGMEKETEMGPLVSKKQQERVLHYIEQGKAEGATVAAGGERAFEKGYFVQPTVFTNVTDDMTIVKEEIFGPVVVVLPFDSTEEVIERANRSSYGLAAGVWTQNIKTGHQVANKLKAGTVWINDYNLENAAAPFGGFKQSGIGRELGSYALDNYTEVKSVWVNIK

SEQ ID NO: 47317 - protein, 457 aa, Rhizobium leguminosarum bv. viciae 3841
MIDPKKLAERFPGDFTFGVATAAFQIEGASKADGRKPSIWDAFCNMPGRVHNRDNGDIACDHYNRLEQDLDLIKEMGVEAYRFSIAWPRIIPDGTGPVNEAGLDFYDRLVDGCKARGIKTFATLYHWDLPLLLAGEGGWTARSTAYAFQRYAKTVMNRLGDRLDRVATFNEPWCIVWLSHLYGIHAPGERNMQAALHAMHYMNLAHGLGVEAIRSEAPNVPVGLVLNAASIIPGSNSPADLAAGERAHQFHNGAFFDPVFKGEYPKEFIEALGNRMPVIEDGDLKLISQKLDWWGLNYYKPERVTDDAERKGDFPWTVEAPPASDVKTDIGWEIYAPGLKLSVEDLYRRYELPECYITENGACDNTDVVDGEVDDTMRLDYVGDHLEIVAGLIKDGYPLRGYFAWSLMDNFEWAEGYRMRFGLVHVDYETQVRTVKKSGKWYHELAAQFPKGNHKPG

SEQ ID NO: 47318 - protein, 298 aa, Bacillus cereus ATCC 10987
MKNIKGAFPVLITPMDEFQEINWNGVKQNVNYFIEQKVAGIIINGSTGEFVSLSKEERFKMVETVLKEVDGRIPVIVGTAAETTKETIEYTKHAEAYGADCALIINSYYCKPKEEEIYFHFKEISNAVNIPIMLYNNPFTSGVDMSTELMLRIGKECENVTHIKESSGDIRKARDLVRQGEGAFQVFCGSEDLVMESYLVGATGWVSVAGNIVPGLVTKMYEHFQNGELEKAWEINDAILPLCEFLERSGKYVQIVKRSMELHGQAGGPSRYPRLGLTEEENQKLQMIISKIAAHAAV

SEQ ID NO: 47319 - protein, 144 aa, Triticum aestivum
  misc_feature (72)..(72): Xaa can be any naturally occurring amino acid
MALAEGNNGAVVFSEEQEALVLKSWAVMKKDSANLGLRFFLKVFEIAPSAKQMFSFLRDSDVPLEKNPKLKXHAMSVFVMTCEAAAQLRKAGKVTVRETTLKRLGATHLKYGVADGHFEVTGFALLETIKEALPADMWSLEMKK

SEQ ID NO: 47320 - protein, 395 aa, Oryza sativa (japonica cultivar-group)
MEAVAVAGGGAGLTRWQAAALSAVAGWVWAASSFDLTRRSRALVQPWVTRRVLAETPSIVRFQKVHHKLLDSFFSVLSCVVSVPFYTGFLPLLFWSGHSKLARQMTLLMAFCDYLGNSVKLLTLWKSVDTGRGVSPSAKLSSGRIYLGMHSLIDVIAGICFGVVILAFWLAVHNHVDAFVVSGQNVTTFWASLSLLLCFAYPKPEFPTPSFEYHTAFNGVAFGIVYGIQQTYFHFHNPDVPLIFSPQLPLIVFVGRVLVGIPTILVVKFCSKALSKWLLPVMCNTLGIPIVSTCYVPALKASEKCKVKSDAKQGGYLQKVFSLFPQKAYDVDTGIRIDKASCWAAGEARTTCTLRLRFSRTRISRGAGVGERTNRADGDERNNLPQESKAQRLFF

SEQ ID NO: 47321 - protein, 433 aa, Burkholderia xenovorans LB400
MTPSDVKATLSFSDNSPSVEMPIYKGTLGPDVIDIRKLYGQTGKFTYDPGFMSTAACNSAITYIDGDKGELLYRGYPIDNLAENADFLETCYLLLKGELPNAQQNAEFVKTVTNHTMVHEQMHFFFRGFRRDAHPMAILVAAVGALSAFYHDSLDINNPRHREVSAIRMIAKLPTLVAMAYKYSIGQPFAYPKNDLSYSANFMHMMFSNPCEEYKVNDVLVRALDRILILHADHEQNASTSTVRLAGSSGANPFACIAAGIACLWGPAHGGANEAALNMLEEIGSVDNIPEFIKQVKDKNSGVKLMGFGHRVYKNYDPRAKLMRETCHEVLEELGLHDDPLFKLAMALEKIALEDEYFVSRKLYPNVDFYSGIVQRALGIPTSMFTCIFAMARTVGWIAQWNEMIADPEQKIGRPRQLFIGDTQREAKPIAQR

SEQ ID NO: 47322 - protein, 329 aa, Arabidopsis thaliana
MITTLLRRSLLDASKQATSINGILFHQLAPAKYFRVPAVGGLRDFSKMTFEKKKTSEEEEGSGDGVKVNDQGNKGEQLIVSYWGVKPMKITKEDGTEWKWSCFRPWETYKADLTIDLKKHHVPSTLPDKIAYWMVKSLRWPTDLFFQRRYGCRAIMLETVAAVPGMVGGMLMHFKSLRRFEQSGGWIKALLEEAENERMHLMTFMEVAKPKWYERALVISVQGVFFNAYLIGYIISPKFAHRMVGYLEEEAIHSYTEFLKELDNGNIENVPAPAIAVDYWRLEADATLRDVVMVVRADEAHHRDVNHYASDIHYQGHELKEAPAPIGYH

SEQ ID NO: 47323 - protein, 517 aa, uncultured bacterium
MKSRETVAILDFGSQYSQLIARRVRENHVYSELLSPQASPARLREMGVRGIILSGGPASVYAADAPTCDPGIFELGIPVLGICYGMHVACRLLGGDVGAGQSREYGRVRLQIDRPEGVLAHLPGEISVWMSHGDVVTRVADCFESLAHTEGCPTAAVRHKTRAVFGVQFHPEVTHTPQGAQMIRNFLYDVCRCTGDWKVDSVIEDSVETTRQRVGPDERVICGLSGGVDSSVVAALLHRAIGDRLVCIFVDNGLLRRREAELVEATFHGHFGMQLRAVDARQRFLTRLAGVVDPQEKRRIIGHEFIEVFKDEATRIEGARFLAQGTIYPDVIESGHGPTGHAAVIKSHHNVGALPKELGFELIEPLRLLFKDEVRQVGLALGLPEDLVWRHPFPGPGLAVRIAGDITPERLELLRSADEILLEEITVAGWYQKIAQAFAVLVPVPSVGVMGDGRSYEGQHLIVLRLVESSDFMTADWVHVDYDVLARISNRIINEVPGVNRVTYDVSSKPPSTIEWQ

SEQ ID NO: 47324 - protein, 360 aa, Pseudomonas putida KT2440
MAAEGELLDVIVIGGGQSALTVAYFLKRAKLSFLLLDAEEAAGGAWRHGWDSLTLFSPSAWSTIAGWPMPPFTEGNPDGDHVVSYLEQYEARYGFSIVRPVSVTSVERTGRGLRVRSKDRDWEARVVISATGTWSNPYVPAYSGIELFQGQQIHSAHYQSPEAFQGKRVLVVGGGNSGAQIYAELSEVADATWVTTEEPAFLPDDVDGRVLFERATERLKAQQEGRVIDAPVGGLGDIVMVPSVVRARERGALRAVRPFTSFTPDGVAWLNGEKTQVDAVVWCTGFLPALDHLKTLDVLDDNGRVEVDGGHSIREPRLWLVGYGDWTGLASATLIGVTRTARSTVNEVVEHLNSLEQPDA

SEQ ID NO: 47325 - protein, 494 aa, Bacillus anthracis str. A2012
  misc_feature (307)..(307): Xaa can be any naturally occurring amino acid
MLTTNIELKPKVKAFLDEEIKMFINGEFVPSISGKTFETYNPATEDVLAVVYEAQEEDIDVAVKAARSAFESGPWVEMTTAERAHLIYKLADLIEEHGEELAQLEALDNGKPYQVALDDDIAATVENYRYYAGWATKIIGQTIPISKDYLNYTRHEPVGVVGQIIPWNFPLVMSSWKMGAALATGCTIVLKPAEQTPLSLLYTAKLFKEAGFPNGVVNFVPGFGPEAGAAIVNHHDIDKVAFTGSTVTGKYIMRQSAETIKHVTLELGGKSPNIILEDADLEEAINGAFQGIMYNHGQNCSAGSRVXVHRKHYETVVNELVKMANNVKLGAGMEKDTEMGPLVSKKQQERVLHYIEQGKAEGATVAAGGERAFEKGYFVQPTVFTDVTDDMTIVKEEIFGPVVVVLPFDSTEEVIERANRSSYGLAAGVWTQNIKTGHQVANKLKAGTVWINDYNLENAAAPFGGFKQSGIGRELGSYALDNYTEVKSVWVNIK

SEQ ID NO: 47326 - protein, 357 aa, Glycine max
MEEINKNPSGTSLLVPSVLELAKENLTTVPQRYIQPQHQDMVLISEEDHSTLEIPVIDMHRLLSVESGSSELDKLHLACKEWGFFQLVNHGVNSSLVEKVRLETQDFFNLPMSEKKKFWQTPQHMEGFGQAFVVSEDQKLDWADLYYMTTLPKHSRMPHLFPQLPLPFRDTLEAYSQEIKDLAIVIIGLMGKALKIQEREIRELFEDGIQLMRMNYYPPCPEPEKVIGLTPHSDGIGLAILLQLNEVEGLQIRKDGLWVPVKPLINAFIVNVGDILEIITNGIYRSIEHRATVNGEKERLSFATFYSPSSDGVVGPAPSLITEQTPPRFKSIGVKDYFKGLFSRKLDGKAYIEVMRI

SEQ ID NO: 47327 - protein, 318 aa, Triticum aestivum
  misc_feature (236)..(236): Xaa can be any naturally occurring amino acid
  misc_feature (248)..(248): Xaa can be any naturally occurring amino acid
  misc_feature (263)..(263): Xaa can be any naturally occurring amino acid
  misc_feature (292)..(292): Xaa can be any naturally occurring amino acid
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTSAEREIVRDIKEKLAYVALDYEQELETAKNSXSVEKSYELPDGXVITIGRREVRCPEAXLPASMIGWILPGIPMRQLQLHHECDVDIXKDCMEHCPWWTTFQVYVDKNTCSTHK

SEQ ID NO: 47328 - protein, 163 aa, Arabidopsis thaliana
MAHFMKLLVTIALTTVVTIAIVTTKTTTKTATFALEDPFKDLTPPGTIKIRPSRFLAEKVDKGKEPKARNPNAADHCNKDNEICSSSDYSTGANATMACCNNKCMDLSTDDKNCGLCKNKCKFGQTCCRGQCVYVAYDKRHCGECNHRCDLGEFCVYGLCNYA

SEQ ID NO: 47329 - protein, 158 aa, Aegilops tauschii
EGEAFINEVATIGLIHHANIVQLLGFCSEGMRRALIYEFMPNESLEKYIFSGDSNIFQNLLVPEKLLDIALGIARGMEYLHQGCNQRILHFDIKPHNILLDYNFNPKISDFGLAKLCAGDQSIVTLTAARGTMGYIAPELYSRNFGGISYKSDVYSFG

SEQ ID NO: 47330 - protein, 277 aa, Thermoanaerobacter tengcongensis MB4
MELWFTEHQDENLRFSIKVKETLVVEKTPYQHLAILDSYQFGRVLVLDGILQTTEKDEFVYHEMIVHVPLFTHKNPKDVLIIGGGDGGSVREVLKHSSVERVVLAEIDEAVIRNSKKYLPTISSALDDPRVEIMIGDGIKYVNEHKNEFDVVIVDSTDPIGPAVGLFTSDFYRAVYECLREDGIIVAQTESPFIYGKLINKISKMFKEIYPITKAYIATVPTYPGSLWTFTMGSKKYDPEEVDINSIPRIQTKYYTPEIHKAAFVLPKFVKDIFDEV

SEQ ID NO: 47331 - protein, 298 aa, Nostoc punctiforme PCC 73102
MGFIISLLTSLIGILVYLNTGRISGEKSRLAIRTITILISSIAILNSISRLLVIVPPGNIGVVNLFGEVSESTLNPGVHLLSPFNKVLNFSTRIKDVKENIDVTTQEGLSLNLDVSLQYKLDPQKAATVYKTIGTDETQLVISRFRSTVRAITANYPASAIYSTKRQEIAQKIDQQLTEEIPALGFIVEEALLRNVKMPDILQVAIQNKLKTEQENQQMKFVLEKERQEAERKRIEAQGIADSQKIISGGLSNQVLQLRAIEATEKLAQSNNSKIVIIGSEKGGAPILIQPEAGTSRP

SEQ ID NO: 47332 - protein, 287 aa, Synechococcus sp. RS9917
MTHNAAPTPGWVDEHHLGVRYGLEGRVLVEEQSPFQRITVIDSLRYGKGLLLDGCWMTAERQERHYHESLVHPALCSAAQIERVLVIGGGDGGTARECLRHPGVQHLDMVEIDGRVVKLSQQHLPSIGGGCWQDRRFHLTVGDGIAWAANAPTASYDVVLVDGSDPAGPAEGLFNRAFFEQCRRILKPGGVFATQSESPEAFRQVHIDTVTVIREVFGHADPMYGWVPMYPSGWWSWTFAATDSRRYLNPDPCRAAAVAEGCEIWSPRWQRGAFDAIPAAIERALNA

SEQ ID NO: 47333 - protein, 355 aa, Burkholderia xenovorans LB400
MKIAVLPGDGIGPEIVKEAVKVLNVLGEKFELEEAPVGGAGYEAKGHPLPDSTLALAKEADAILFGAVGDWKYDSLERALRPEQAILGLRKHLQLFANFRPAICYPQLTGASSLKEEIVSGLDILIVRELNGDIYFGSPRGVREAPDGLFAGSKEGFDTMRYSEPEVRRIAHVAFQAAQKRGKKLTSVDKANVLETSQFWKDVMIDVSKEYADVELSHMYVDNAAMQLVKAPKSFDVIVTGNMFGDILSDEAAMLTGSIGMLPSASLDKNNKGLYEPSHGSAPDIAGKGVANPLATILSAAMMLRYSLNKAEQADRIENAVKKVLEQGYRTGDIVTPGCKQVGTVAMGDAVVAAL

SEQ ID NO: 47334 - protein, 289 aa, Desulfitobacterium hafniense Y51
MSETKIPQPAFPAQHQDKQPGLETLMNPSPIFEDLNYRPSGKLQGKVALISGGDSGIGKAVAILYAKEGADIAIVYLDEQVDAQATKERIEQLGRRCLLIPGDIGEENFSNQTVQKTLDTLGRLDILVNNAAEQHPQNSLLDITAQQIEQTFRTNIFGMLYLTKAALPHLRYGSVIINTASITAYKGDAKLIDYSASKGAVVAFTRSLSESLLKQGIRVNGVAPGPIWTPLIPASFDANEVSTFGSTTPMQRAGQPVELAPAYLYLACEGSAYMSGQMLHVNGGTIVNG

SEQ ID NO: 47335 - protein, 252 aa, Aspergillus oryzae
MARNSEKAQSMLFRFRAQQAADLGIIDMGRTRRPKAITSVDSIPMCEKWRGQVLKEISRKVSRIQEPSLSDYQIRDLNDEINKLMREKWIWEMQIRNLGGPNYMRGSGRVYDDEGREIPGGGKGYRYFGRARELPGVKEMFEAAARRGRKPAEEEGEESRGRGGDIATRKVDANYFGYGLDEEDGTLLAYEKQKEKEAVERLREKKEDDVEDGWEPLPGDAGDGVEWRLPTLEEVQEELVDRRRRRLLEKIT

SEQ ID NO: 47336 - protein, 146 aa, Triticum aestivum
MPRGGFSGSLRSPKIDVVIDMGNPFLNRTVDGFLKIGAVGACKVAAEETFDCLHRGDVSKHKVKHALKKMCQEGAYWGTVAGVYVGMVYGVERVRGRNDWKNAMIGGALSGALISGASNNHRDKIIKDAITAGAVATAVEFINCLT

SEQ ID NO: 47337 - protein, 283 aa, Azoarcus sp. BH72
MASASIDTLDFRGQPAISLATASGARAVVGLFGGQVLSWKPAGGEERLYLSDSAVFDGATAIRGGVPVCFPQFATEGALPRHGFARNRAWAVRTRRTGDDFAMLALGLDADDATRALWPHDFDLELTVLIEDSRLELELEVTNTGTDDFAFTAALHTYLRVREVEESRLEGLYGSEYRDSADGGKLKRDSGDALLIEDETDRIYHAVQRPLLLREYDRSLGINAEGFPDVVVWNPWETRCAALPDMAALDFRRMLCVEAAVVQNPVRLAPQAQWWGRQTLVAL

SEQ ID NO: 47338 - protein, 303 aa, Streptococcus agalactiae 2603V/R
MSNIVIIGSISMDLVMETNRIAKEGETVFGQRFSMVPGGKGANQAVAIGRLSQERDNITILGAIGEDSFGPILLDNLNKNHVTTDFVGTIPSSSGVAQITLYNNDNRIIYCPGANGKVDTKKWSQEWSIIKEADLVVLQNEIPHQANMKIANFCKEHSIKLLYNPAPSRETDIEMLDKVDYFTPNEHECQELFPNQKLEDILATYPEKLIVTLGTKGAIYSDGKESHLIPALETKAVDTTGAGDTFNGAFGYAISKKFKIAKALRFATLAAHLSVQKFGAQGGMPTIKEMEDNQHYEKDWYIK

SEQ ID NO: 47339 - protein, 365 aa, Brassica rapa subsp. pekinensis
MVSFVVEKPQRMSNGVVSETTRLSIIPNNSSSAQKTLLKNLEIINGGQRVNAWVDSMRASSPTHLKSLPSSVSSEKHLSSWIMQHPSALEMFEKITQASGGKQIVMFLDYDGTLSPIVDDPDKAFMSSKMRRTVKKLAKCFPTAIVTGRCIDKVYNFVKLAELYYAGSHGMDIKGPAKGFSRHKRVKQSLLYQPASDYLPMIDEVYKQLLEKTKSTPGVIVENHKFTASVHFRCVEEKKWSELVLQVRSVLEKYPTLKLSQGRKVFEIRPMIDWDKGKALEFLLESLGFGNSNNVFPVYIGDDRTDEDAFKMLRVRGEGFGILVSKFPKDTDASYSLQDPSEASPHTRILYLSVPKYKMFSRADL

SEQ ID NO: 47340 - protein, 513 aa, Zea mays
  misc_feature (41)..(41): Xaa can be any naturally occurring amino acid
  misc_feature (67)..(67): Xaa can be any naturally occurring amino acid
  misc_feature (80)..(80): Xaa can be any naturally occurring amino acid
  misc_feature (96)..(96): Xaa can be any naturally occurring amino acid
  misc_feature (168)..(168): Xaa can be any naturally occurring amino acid
  misc_feature (186)..(186): Xaa can be any naturally occurring amino acid
  misc_feature (202)..(202): Xaa can be any naturally occurring amino acid
  misc_feature (215)..(215): Xaa can be any naturally occurring amino acid
  misc_feature (236)..(236): Xaa can be any naturally occurring amino acid
MERVLKDDAVEEKGERARMASFVGAMAISDLVKTTLGPKGXMDKILQSTGRGRNVTVTNDGATILKXPLHIDNPAAKVLXVDISKVQDDEVGDGTXLSVVVLAGELLKEAEKLINMKIHPMTIIAGYRMALECARDSLLKKTMDNKENTDKFRSDLMNIAMTTLRFQXLIAERPGDLSLILNGCCXFKGFRLAPTGKSFQIXLKKSGGPREFILXIKLGFIGSIRKLVLGRSMQNXVRVKLMFSIPGAEAAEKQKMREKVQKIIAHGINCFVNRQLIYNFPEELFADAGILAIEHADFEGIERLALVTGGEIASTFDNPESVKLGQCKVIEEIMIGEDRLIHFSGVAMGQACTIVLRGASEHVLDEAERSLHDALCVLSQTVNDTRVLFGGGWPEMVMAKEVDELARKTPGKKSHAIDAFSHALQAIPTIIADNAGLDSADLISQLRAEHHKENSTAGIDVITGTVGDMQKLGIQESFKVKQAILLSATEAAEMILRVDEIITCAPRRREDRM

SEQ ID NO: 47341 - protein, 191 aa, Candida glabrata CBS 138
MQTLKCVVVGDGAVGKTCLLISYTTNQFPADYVPTVFDNYAVTVMIGDEPYTLGLFDTAGQEDYDRLRPLSYPSTDVFLVCFSVISPPSFENVKEKWFPEVHHHCPGVPCLVVGTQVDLRDDKVIIEKLRRQRLRPITAEQGERLARELRAVKYVECSALTQRGLKNVFDEAIVAALEPPVIKKSKKCTIL

SEQ ID NO: 47342 - protein, 315 aa, Salmonella typhimurium LT2
MNITIATLGELLVEFLAKKENQGFSSPGEFWGPYPSGAPAIFADQVAKLGFRSLLFSCVGNDAFGVMNITRLSRDGVNVQGISVLPNATTGSAFVSYRSQAQRDFIFNMPDSACGLLSADHLDETLLRQYRHFHIMGSSLFSFRLIDAVRKAISIVKENGGTISFDPNIRKEMLKIREMSQAFEYILDYTDFFLPSDGELDYFGLSKSRDEEKIVARLHKRGIAHVIIKRGARGASYYSKDEQHHVAGYPVKVVDPTGAGDCFGATFVSLFLAGYSVPDALAHANAAGSLAISARGPMEGTSTLAQIKELMRQQN

SEQ ID NO: 47343 - protein, 1014 aa, Zea mays
  misc_feature (975)..(975): Xaa can be any naturally occurring amino acid
MSSRGLVRLPVSCSAAVDGVNGCLTYSTCRSRNYYYQYSHTTNLQISPVDQMPLPRKLKKSIQRNAYFLTQKRKLVPHCSSDLSTSCRGVPNYLSINVLQDQSNTKQGAIRKALVILNPNSGFRSSRDVFYQKVQSTLKLSGFKMEVIETAYAGHAKVLSSTVDLKKFPDGIICVGGDGIVNEVLNGLLSRDDFDVAIRFPIGIIPAGSDNSLVWTVLGIRDPVSAAIALAKGDFTPIDVFAVKWIQAGVTHFGLTASYYGFVADVLQLSEKFRVQLGPFRYVVAGLLKFLSLPQYRFEVDYLPSSLQGRSSESRPLAEKRHEQLSDDGKVRRGTQTNGRIKDDWVTRNGEFLGIFVCNHFCKPAQGLLSPVIAPKARHDDGSLDLILVHGSGRLRLFCFFVAYQLCWHLLLPYVEYVKIKEVKVRPVGSTHSGCGVDGLMDATTVDSKWISPATEDGSMDRRGNPAVKTTTGRWRSAILLLANYGLATCAFFGVGVNLVVFLRRVLHQGNAEAANSISKWTGTVYIFSLIGAFLSDSYWGRYVTCAVFQIIYVMGLVVLSLASWLLLVKPSGCGGVKAHCDGPSAPGVALFYLSTYMIAFGNGGYQPSIATFGSDQFDETDPEEARSKVAFFSYFYLALNVGSLLSNTVLVYYEDSGRWVMGFWVSAAAAALALVLFLLGTPGYRHFKPSGNPLTRVAQVFVAALRKWRAEVPRGELLHEVVEAGEDPKVSGIRKILHSDGLRFLDKAATITEEEEEEGPWRLCTVTQVEEVKCILRMLPIWLCTIVYSVVFTQMASLFVEQGATMDTNIGSFHFPAASMSLFDVLSVLAFIAIYRRVLVPVMARLSGNPQGLTELQRMGVGLVIGMAAMVVAGVVEVERLKRVAAPDQPSSLSVLWQVPQYALIGASEVFMYVGQLEFFNGQAPDGVKSFGSALCMASISLGNYVSIMLVSVVTSLTAGEKRPGWIPVDLNSXPHLDRFYFLLAALSLVDLAVYIACNMWDDDNRRKVSSHI

SEQ ID NO: 47344 - protein, 518 aa, Ustilago maydis 521
MNAALSSVRSRAFEAISQLSAGSRSSLPTSSSRSNDKPRRSLDRPRLFKRHGSNVDHIHTQLFDKAVAPPSRSTVLFVLGCLAWYISSSLSSNTSKALLSKGRNHVDSGLPQVRPPAFPYPVTLTLIHFGFVNVCCAICASRRMLGHRALTRLVPPSLSRVAEVGQLAFFNVVGQALSSLAIARVPVSTVHTIKALSPLFTVLSYTYLFNVSYSSKTYMSLFPLTAGVMMACTGFAFNADDMVGFAAALASTLVFVAQNIYSKKLLRKGERSEGEKMDKINILFYSSGCSIVLMIPMALYYDGSSLLFRPSWNASEAYPYDRRTFVLSWLLCNGLVHFAQNILAFNVLSMVSPVTYSIASLLKRVFVIVLAILWFRQSVTRLQWFGIGLTFYGLWMYNDSKTKDDVDKGDKKVERQQGVGNHAILPLTSASTASTASGASGWTDALHNRPHPFAPSTSAYAFAAQQPSAHAAPARLHQPVYPPAPTKGWNDIPDSTLTSYINDPTKSLPSPPDSDKEV

SEQ ID NO: 47345 - protein, 335 aa, Glycine max
QLRRPPPIALIVLFFYTRKWKPRSRVVGSIRKEVTVFTDIGVPLTFETVVQATGNFNAGNCIGNGGFGATYKAEISPGILVAVKRLAVGRFQGVQQFHAEIKTLGRLHHPNLVTLIGYHACETEMFLIYNYLSGGNLEKFIQERSTRAVDWKILYKIALDIARALAYLHDTCVPRVLHRDVKPSNILLDDDFNAYLSDFGLARLLGTSETHATTGVAGTFGYVAPEYAMTCRVSDKADVYSYGVVLLELLSDKKALDPSFSSYGNGFNIVAWACMLLKQGRAKEFFTAGLWEAGPGDDLVEVLHLAVVCTVDSLSTRPTMKQVVRRLKQLQPPSC

SEQ ID NO: 47346 - protein, 358 aa, Oryza sativa (indica cultivar-group)
MAGCLWPCVTGGGAAADGAGSLFRSKARGPVEVVRHARELLAFLAENHDACGDKRDVKREHKMADLAKSIGEMKSILYGNGEADPVDEACSQLTKEFFKENTNSLHLLVVCLPYMDLETQKDVTQVTANLLRQKVDYRMVASDYLEENQDLLDVLMSGYGNMDIAIHYSAILRDCIRHQVAARYVLESQHMKKFFDYIQYPDFNIASDAFKTFKELLTRHRSSAAEFFSNNYDWFFPEFNSKLLSSSNYIIRRQATQLLGDILLDKSNTTAMVRYVSSKDNLIILMNLLREQSRAIQVEAFRVFKLFTCNPKKPPEIVGILVTNKSKILRFLADFTIEKEDLQFEADKAQVVTEISAM

SEQ ID NO: 47347 - protein, 483 aa, Lactobacillus plantarum WCFS1
MAEKQHQEVHRSLQTRHLSMIALGGSIGTGLFVASGSAISTAGPGGALLAYVGIGVMVYFLMTSLGEMATYLPVSGSFSTYATKFVDPALGFAMGWNYWFNWAITLAVDISTAAIVMQFWLPSVPGWVFSLIALVLIFTINALSVRSFGETEYWLSLIKVVTVLVFLVIGVLTIVGIMGGHATGLSNFTYKKAPFVGGIPTILSVFVVAGFSFQGTELIGITAGESATPEKSIPAAIKQVFWRILLFYILAIFVIAAIIPYTSKDLLGSSASDIAISPFTLVFKRAGLAAAASVMNAVILTSVLSAANSGMYASTRMLYSLSLQGYAPKTFGRVNRRGIPIMALLGTTVIGLLTFLSSLFGERIYIFLVSASGLTGFIAWLGIAISHLRFRRAFVKQGHQLSELRYHAKWFPFGPWFAFILCVVVIIGQDLHSFATLDWQAIGVTYMSIPLFIILYVYYKIRYHTKMIPLDKVDLTRKRHHQD

SEQ ID NO: 47348 - protein, 449 aa, Bacillus cereus G9241
MKTKQTDELLAKDEQYVWHGMRPFSPNSTMVGAKAEGCWVEDIQGKRYLDGMSGLWCVNSGYGRKELAEAAYKQLQTLSYFPMSQSHEPAIKLAEKLNEWLGGEYVIFFSNSGSEANETAFKIARQYYAQKGEPHRYKFMSRYRGYHGNTMATMAATGQAQRRYQYEPFASGFLHVTPPDCYRMPEIERENIYDVECVKEVDRVMTWELSETIAAFIMEPIITGGGILMPPQDYMKAVHETCQKHGALLISDEVICGFGRTGKAFGFMNYDVKPDIITMAKGITSAYLPLSATAVKKEIYEEFKGKGEYEFFRHINTFGGNPAACALALKNLEIMENENLIERSAQMGSLLLEQLKEEIGEHPLVGNIRGKGLLVGIELVNDKETKEPIDNDKIASVLNACKEKGLIIGRNGMTTAGYNNVLTLAPPLIISSEEIAFVVGTLKTAMERI

SEQ ID NO: 47349 - protein, 417 aa, Oryza sativa
  misc_feature (97)..(97): Xaa can be any naturally occurring amino acid
  misc_feature (104)..(104): Xaa can be any naturally occurring amino acid
MEGGGAKDGSAAAAQTRGSGDDGSHKPLPPCCLKAKAAAAESEAKCHATVVSGWFTEPRSHSGKTSKVQYFNNPMWPGEAHSLKVENILYQGKSPYXEILVFEXSTYGNVLVLDGIVQLTEKDECAYQEMVTHLPLCSIPSPKSVLVVGGGDGGVLREIARHASVENIDICEIDQLVIDVCKDFFPQLSVGFKDPRVQLHVGDAVDFLRNAPEGKYDAIIVDSSDPIGEILLLLNHHMFQFCAPFVFVPHEDPSHIIGPAQELVEKPFFQTIARALKPGGVLCNQAESMWLHTHLIQDMLSICRETFKGAVHYAWTSVPTYPSGVIGFLLCAKEGPAVNFLSPVNPIEKLEGAMEAGREIRFYNSEVHRAAFVLPTFVRRELESHNTCAEKDKSETKPVAKPKKMKIMPNSAIPTAS

SEQ ID NO: 47350 - protein, 1102 aa, Prochlorococcus marinus str. MIT 9303
MPRRSDLRRILLLGSGPIVIGQACEFDYSGTQACKALRDEGFEVVLVNSNPASIMTDPEMADRTYIEPLTPEVVARVIELERPDALLPTMGGQTALNLAVALAENHTLERFGVELIGADLAAIRKAEDRQLFKQAMERIGVDVCPSGIASSLKEAEEVGEVINSFPRIIRPAFTLGGSGGGIAYNPEEFAAICKSGLDASPVSQILIEKSLLGWKEFELEVMRDLADNVVIVCSIENLDAMGVHTGDSITVAPAQTLTDREYQRLRDQSIAIIREIGVATGGSNIQFAINPDDGEVVVIEMNPRVSRSSALASKATGFPIAKIAARLAVGYTLDEIINDITGKTPACFEPTIDYVVTKIPRFAFEKFKGSPAVLSTAMKSVGEAMAIGRCFEESFQKAMRSLEIGRAGWGCDRQEPELTPTEIERLLRTPSPERIMAVRTAMLAGRSDQDIYALSKIDIWFLAKLRHLINIETTHMHGRKLDELDQECLLSLKQLGYSDRQIAWATGSEELAVRARRELLNIKPVFKTVDTCAAEFSSTTPYHYSTYERPLYRLDSDDQLYKLEPESEVVADERSKVMILGGGPNRIGQGIEFDYCCCHASFAAQDKGFVTVMVNSNPETVSTDYDTSDRLYFEPLTLEDVLNVIEAERPNGVIVQFGGQTPLKLAIPLLRWLESSIGKSTGTRIWGTSPESIDQAEDREQFEAILRQLQIRQPRNGLARSEEDARAVALRIGYPVVVRPSYVLGGRAMEVVFDEQELNRYMAEAVQVEPDHPVLIDQYLENAVEVDVDALCDSDGVVVIGGLMEHIEPAGIHSGDSACCLPSISLGEQALRTIRLWSEALALALKVQGLINLQFAVQRDEAGDEQVFIIEANPRASRTVPFVAKATGVPLARIATRIMAGETLAAVGLTHEPQPPLQSVKEAVLPFRRFPGADSVLGPEMRSTGEVMGSASSFGMAFAKSEIAAGDPLPIRGTVFLSTHDRDKPALLLVAERLIELGFDLTATSGTAQALNQAGLNVQPVLKVHEGRPNIEDLIRSGQIQLVINTPIGRQAAHDDKYLRRAALDYSVPTLTTIAGARAAVEGITALQQQSLSVAALQDIHV

SEQ ID NO: 47351 - protein, 338 aa, Zea mays
  misc_feature (274)..(274): Xaa can be any naturally occurring amino acid
MAEMRPIYREPGKPRRPPRSHGSGSFSVPLWEKKFCTDACAIPWAKLCETKRLMSLYKSVVDWDDSAALEAFNDAKARFCAIYHGQYYDISLPDPDMFIDIINPDEYVDLELVADLEKSRRRVPRKDDGVPDVWDSFILSDKPVPVTGWGDTDTSFTHGQQLSVNWDYQLKHSVEANHKHMSANWDYSIKRPAQIVCQQNSGKQQDQTSSQGEQTNSCISHWIMRGGSQDAWKHDSGWGPAAIQTDLWDNRQGSYEVPDSKGMPYGHWTYWRRXNDDSGRRNTRNRGGPISSKPMKSKYQTDEHNVAINGWRNCRVRNDVYYYYPYGQAVPSSHTQCE

SEQ ID NO: 47352 - protein, 133 aa, Magnetospirillum magnetotacticum MS-1
MTTEVLRNMLYAGSRTLDGLAYVVMDEVHYLADRFRGPVWEEVIIHLPDDVQLVSLSATVSNAEEFGDWLEMVRGDTTVVVSERRPVPLWQHVLVASANPAAGVAHVGAGRAPGAGDPLEGSEPPKQRGQGAQ

SEQ ID NO: 47353 - protein, 309 aa, Synechococcus sp. RS9917
MGWSAADIPDQRGRLALVTGANSGLGLETTRALLAHGATVLMACRNRERGETARRSLSDQSASKGGSIELLDLDLADLESVDRCAQTVRQRFGRLDLLINNAGVMAPPRQCSRQGYELQFATNHLSHMALTRALLPLMEGQPDARVVTVTSGAQYFGRIAWEDPNGEQRYDRWQAYGQSKLANVMFALELDRKLRDRGSSIRSLAAHPGLARTNLQPASVSANGSRLEALAYRLMDPLFQSAAMGALPQLHAATAASAQSGEHYGPNRLGGLRGYPKRQRVAPAAEDPQQRERLWDLSLKLIEAGPALR

SEQ ID NO: 47354 - protein, 416 aa, Thermoanaerobacter tengcongensis MB4
MSTESLNPLVIAQKQIKKACDILGVEESVYELLKEPMRVLEVSIPVQMDDGSIKVFKGYRSQHNDALGPTKGGIRFHPDVTLDEVKALSMWMTFKCGVVGLPYGGAKGGVVVNPKELSNDELQRLSRGYIRAIASIIGPEKDIPAPDVGTNAQIMAWMVDEYNKIVGYNSPAVITGKPLIYGGSKGRVAATGYGVALMAREAVKRLNMDFKDCTVAIQGFGNVGSHAGLSLQRLGAKIIAVSDVYGGIYNEKGIDAEKLVEHVNKTGTVCNFEGTTPITNEELLTMKVDILVLAALENQITSANANEVKAKIICEGANGPTTPEADKILSEKGVFVVPDILANSGGVIVSYFEWVQNLMNYYWTEKEVEERQEIMMVNAFNSIYDLAQQYKVDMRTAAYMISIKRVYEAMKVRGWL

SEQ ID NO: 47355 - protein, 144 aa, Glycine max
MVAFTEKQDALVSSSFEAFKANIPQYSVVFYTSILEKAPAAKDLFSFLANGVDPTNPKLTGHAEKLFALVRDSAGQLKASGTVVADAALGSVHAQKAVTDPQFVVVKEALLKTIKAAVGDKWSDELSRAWEVAYDELAAAIKKA

SEQ ID NO: 47356 - protein, 499 aa, Escherichia coli
MTEPHVAVLSQVQQFLDRQHGLYIDGRPGPAQSEKRLAIFDPATGQEIASTADANEADVDNAVMSAWRAFVSRRWAGRLPAERERILLRFADLVEQHSEELAQLETLEQGKSIAISRAFEVGCTLNWMRYTAGLTTKIAGKTLDLSIPLPQGARYQAWTRKEPVGVVAGIVPWNFPLMIGMWKVMPALAAGCSIVIKPSETTPLTMLRVAELASEAGIPDGVFNVVTGSGAVCGAALTSHPHVAKISFTGSTATGKGIARTAADRLTRVTLELGGKNPAIVLKDADPQWVIEGLMTGSFLNQGQVCAASSRIYIEAPLFDTLVSGFEQAVKSLQVGPGMSPVAQINPLVSRAHCDKVCSFLDDAQAQQAELIRGSNGPAGEGYYVAPTLVVNPDAKLRLTREEVFGPVVNLVRVADGEEALQLANDTEYGLTASVWTQNLSQALEYSDRLQAGTVWVNSHTLIDANLPFGGMKQSGTGRDFGPDWLDGWCETKSVCVRY

SEQ ID NO: 47357 - protein, 360 aa, Pseudomonas syringae pv. phaseolicola 1448A
MSKQILILPGDGIGPEIMTEAVKVLELANEKYQLGFELTHDVIGGAAIDKHGVPLADETLDRARAADAVLLGAVGGPKWDTIERDIRPERGLLKIRSQLGLFGNLRPAILYPQLADASSLKPEIVAGLDILIVRELTGGIYFGAPRGTRVLDNGERQAYDTLPYSESEIRRIAKVGFDMAMVRGKKLCSVDKANVLASSQLWREIVEQVAKDYPEVELSHMYVDNAAMQLVRAPKQFDVIVTDNLFGDILSDQASMLTGSIGMLPSASLDTANKGMYEPCHGSAPDIAGKGIANPLATILSVSMMLRYSFNLTDAADAIEKAVSVVLDQGIRTGDIWSEGKVKVGTQEMGDAVVAALRNL

SEQ ID NO: 47358 - protein, 639 aa, Myxococcus xanthus DK 1622
MARDVSFFDQLGSLLAQEREAEKARLAALAQSLTLNEREEHGLSVLDLESIEEEVGLGGRFLVTLGRADRRPLPTRLHNGDLVAVLPRRAEVKEPARALISRATATRIQLAFDRSPPPYVHEGLLRLDVVPNDVTYDRLRAGLQRIKALDKGAERHKREVVLGNEPPRFDKPREFEPTRPLNPEQQDATARALAAEDFFLVHGPPGTGKSTVLAEVAAQAVADGKRLLCTAASNAAVDHLLDLCLDKGLRAIRVGHPARVAARLQEHTLDIVVESHPDRAVSRDLFDEAFSLLGYARRQRNQGRSRERFANARASTTEAKGMLDEARALERKAVKSVLANADVICVTLSSLDSGVLSGQQFDLALLDEATQATEPLALLGFLRAPRVILAGDPQQLPPTVLSQEAAKAGLGVSLFERLLKDHGEGVKRMLREQYRMNARIMDFPSREMYGGELRAHPSIADRTLDAVLTPGADVDAPPVLYLDTAGKGFDEEVEPTTRSLFNPGEAGLVEARVRALLAAGLAPRELAVITPYSAQAHQLRERIEALSPEVEVDTVDAFQGREKDAIIVSLTRSNSEGQLGFLTDLRRMNVALTRARRHLFVVGDSATLSGHPFYARFVEGTQTHGGYRSAWEWPDAQDT

SEQ ID NO: 47359 - protein, 515 aa, Oryza sativa (indica cultivar-group)
MASSGFSWTLPDHPKLPKGKTVALVVLDGWGEANADKYNCIHVAQTPVMDSLKNGAPERWRLVKAHGTAVGLPSEDDMGNSEVGHNALGAGRIFAQGAKLVDLALASGKIYDGEGFNYIKECFDKGTLHLIGLLSDGGVHSRLDQVQLLLKGASERGAKRIRVHILTDGRDVLDGSSVGFVETLESDLSQLRDKGIDAQIASGGGRILSLKNAQNDWDVVKRGWDAQVLGEAPYKFQNAVEAVKTLRAETKASDQYLPPFVIVDESGKSVGPVVDGDAVVTFNFRADRMVMLAKALEYADFDKFDRVRVPKIRETVKFGHVTFFWNGNRSGYFDETKEEYVEIPSDIGITFNVKPNMKALEIAEKARDAILSGKFDQVRVNLPNGDMVGHTGDIEATVVACKAADEAVKIILDAIEQVGGIYLVTADHGNAEDMVKRNKSGQPLLDKNGGIQILTSHTLQPVPVAIGGPGLHPGVKFRSDIQTPGLANVAATVMNFHGFEAPADYEPTLIEVVDN

SEQ ID NO: 47360 - protein, 326 aa, Pseudomonas aeruginosa PAO1
MNMSQNLDFIHSAQRTIGLERDAVDSLLARIGDDFVKACELLLAGKGRVVVVGMGKSGHVGKKIAATLASTGTPSFFVHPAEASHGDMGMITKDDVVLALSNSGSTAEIVTLLPLIKRLGITLISMTGNPESPLAKAAEVNLDASVGQEACPLNLAPTSSTTVTLVLGDALAIALLEARGFTAEDFAFSHPGGALGRRLLLKVEDVMHVGEGLPQVLLGTSLTGALMEMTRKGLGMTVVLDEHGKLAGIFTDGDLRRALDRGIDVRQVTIDQVMTVHGKTVRAEILAAEALKIMEDNKIGALVVVDADDRPVGALNMHDLLRAGVM

SEQ ID NO: 47361 - protein, 509 aa, Oryza sativa (indica cultivar-group)
  misc_feature (361)..(361): Xaa can be any naturally occurring amino acid
MTKISVEFCIISARGLGRRSTLLNPQWFSVAWIDPNSKYCTKIDASGNSDVNWGTKFSLSVDEHDMSMQQMELTVEVYRREPVFLREHLQGTAVIQMKEYFDKFSQGKDPSGVTEETSSFQLRRKKSDKPHGFVDISIRICKEENNRATFSGSQEGLKYPDQVGITLAIEDGPVYNYPPMPSSHFKGYTQDVDHYSNSMPVTAATRPGQSPPGSNYSYQPTMVPPILPHPTSNPSFFTPQYPTRGPVPQTYINVPPRMGGQNSTPNFGMGLGAGALAAGTMIFGENLLSGKYLASHSLSSDTKNIDCETVKFGHVTFFWNGNRSGYFDETKEEYVEIPSDIGITFNVKPNMKALEIAEKAXDAILSGKFDQVRVNLPNGDMVGHTGDIEATVVACKAADEAVKIILDAIEQVGGIYLVTADHGNAEDMVKRNQSGQPLLDKNGGIQILTSHTLQPVPVAIGGPGLHPGVKFRSDIQTPGLANVAATVMNFHGFEAPADYEPTLIEVVDN

SEQ ID NO: 47362 - protein, 269 aa, Archaeoglobus fulgidus DSM 4304
MLYLGVIGYPIKHSVSPAMHNAALQHEGIEGIYLAFEVKPDRLRDAVFGAKALGFRGLNVTIPFKESVVEFVELEGEAAKIKTVNTIDLVEMVGYNTDVYGVKAALSGTELGGKTALVVGAGGAGKAAALALLDMGSTVIVANRTEEKGREAVEMLRRYGECIFWPLSRVEELKGKVDVVVNATPLGMRGFKAEIPVPPSMLDGVELVFDTVYNPMETPLIREAKKRGCKVVYGIEMLVHQGAKAFEIWTGIEPDVGVMREAALRALRF

SEQ ID NO: 47363 - protein, 611 aa, Arabidopsis thaliana
MIERQSVNRRNKDMVKIHTPVVRKVSPPYKVSHFSVALSNKCSKYLFTENLFSHVMDYLSSMGSQTARFCHNYTVLYIDNNNNSVTLGLSRQDFSGPFCSASFSSTLLSSGLFQNLPSYKSLTVFYACDPRRHFLGNFTCPVKGLGSIIQNSTYGILCDGSFSVPVPTSFVSEEEVLDLTHLESVLRKGFEVKLNIDEIPCPLECFSSRANCLFLAGSCCKYHDRTTTCGGDTGDLLREIIPNTRSILITIGQVVGFHVFIIVVMIIAFLFWRRKKVNDLRKQNLEALVTSRRYSYRQIKKITKSFTEVVGRGGFGTVYKGNLRDGRKVAVKILKDSNGNCEDFINEVASISQTSHVNIVSLLGFCFEKSKRAIVYEFLENGSLDQSSNLDVSTLYGIALGVARGIEYLHFGCKKRIVHFDIKPQNVLLDENLKPKVADFGLAKLCEKQESILSLLDTRGTIGYIAPELFSRVYGNVSHKSDVYSYGMLVLEMTGARNKERVQNADSNNSSAYFPDWIFKDLENGDYVKLLADGLTREEEDIAKKMILVGLWCIQFRPSDRPSMNKVVGMMEGNLDSLDPPPKPLLHMPMQNNNAESSQPSEEDSSIYSEV

SEQ ID NO: 47364 - protein, 243 aa, Prochlorococcus marinus str. MIT 9303
MRKPVIAGNWKMHMTCAQAREYTAMFLPLIEATPNDRHVVIAPPFTAISSMAEAVGGTRLELSSQNVHWEDDGAYTAEVSPTMLLEHQVRYAIVGHSEPRKYFSESDEQINRRARSAQAHGLIPIVCVGESDEQRERGEAERVIRRQVEQGLEDTDPDKLVVAYEPIWAIGTGKTCEASEANRICGLIRGWVGASELIIQYGGSVKPGNIDELMAMSDIDGVLVGGASLDPESFARIANYQTS

SEQ ID NO: 47365 - protein, 378 aa, Wolbachia endosymbiont of Tunga penetrans
MSDLAKRMSLIKPSPTIAVTDKANRLKSEGKKICVLAAGEPDFDTPGHVKKAAIQAINEGKTKYTAVDGTLELKEAIINKLKKDNSLKYTPSQICVGAGAKQVLFNLFMATVNPGDEAIIPAPYWVSYVDMVSLFGGLPVVVECKQSFKLTPELLKSKITKKTKWLILNSPNNPAGVIYTYDELKGIAQILLEYPHVNVVTDDIYEHIIYDEKFFTIAQVEPKLYDRIFVVNGVSKAYAMTGWRIGYIAGRSDVIKAISTLQSQSTSNPNSIAQAAAVEALNGDHDFLKERTKIFKSRRDFVVEKLNSVPGLSASTPQGAFYLFVSCEGLLGKSTRSGKVINNDLDFAEYLLEDHLVAVVPGIAFGLKNFVRISYATS

SEQ ID NO: 47366 - protein, 275 aa, Pseudomonas putida KT2440
MKLDTVFSVEGARVIVTGAASGLGLAFTEAMAESGAQVAMLDLNREALDAQFRRLRSLGYSVRSHVLDVTDRDAVDDTFNAVAAGFGGLDIVFANAGIDPGPGFAALNAAGEREPANMLEEYSDHRWRKVISVSLDAVFYSIRAAARHMRANRSGSIIVTTSVSALRPAVTLGAAYAAAKAGAAQLVRATALELASDGVRVNAIAPGPFETDIGGGFMHNSEVRAKMAAGVPMGRIAEVEEIKPLALYLASKASSFVTGQQFVIDGGLSLSAARA

SEQ ID NO: 47367 - protein, 469 aa, Corynebacterium efficiens
MTEHYDVVVLGAGPGGYVSAIRAAQLGKKVAVIEKQYWGGVCLNVGCIPSKALIKNAEIAHIFNHEKKTFGINGEVTFNYEDAHKRSRGVSDKIVGGVHYLMKKNKITEIDGFGTFKDAKTIEVTDGKDAGKTVTFDDCIIATGSVVNSLRGVEFSENVVSYEEQILNPVAPKKMVIVGGGAIGMEFAYVLGNYGVDVTLIEFMDRVLPNEDPEVSKVIAKAYKKMGIKLLPGHATTAVRDNGDSVEVDYQKKGSDKTETITVDRVLISVGFRPRVEGFGLENTGVKLTERGAIDIDEHMRTNVDGIYAIGDVTAKLQLAHVAEAQGIVAAETLAGAETQTLGDYMMMPRATFCNPQVASFGYTEEQAKEKWPDREIKVSSFPFSANGKAVGLAETDGFAKIVADAEFGELLGGHIVGANASELLNELVLAQNWDLTTEEISRSVHIHPTLSEAVKEAAHGVNGHMINF

SEQ ID NO: 47368 - protein, 319 aa, Bacillus sphaericus
MKKIAVLTSGGDVPGMNAAIRAVVRKAAFHGINVVGIKHGYEGLVKGYLEELDLGSVGGIIQRGGTHLNSARCPEFKEDAVQQQGIENLRAAGIEGLVVIGGDGSYRGAMDLVKKGFPAVGVPGTIDNDVPGTEYTIGFDTALNTVVESIDKIRDTATSHENSFIVEVMGRDAGDIALWAGLAAGAETVLIPEEDYDLDDIVARLDRGAARGKKHSIIIVAEGVMSGNELAKLIKEKTGKETRVSVLGHIQRGGSPTARDRVLASQFGAHAVELLMEGKYGRAVGIRNHQVIDYDMPEAFEKNHEADVSLYTLMKELSI

SEQ ID NO: 47369 - protein, 163 aa, Magnetospirillum magnetotacticum MS-1
MIGWFGCAMLCYVTPKEHLGLPNRDDVKTGVITYKIAAHAADLAKGHPAAQLRDDALSRARFDFRWEDQFNLSLDPDTARSFHDETLPKDAHKVAHFCSMCGPKFCSMKITQDLRADVLAMEEAGVVLGEAKPLSEEERRAGMAAKSQEFLEEGGKLYVDAAE

SEQ ID NO: 47370 - protein, 395 aa, Aspergillus nidulans FGSC A4
MLGRNFPYFNSVGGFYSRENSRRQPGTGYTSKVRVRDKYHIVGFISSGTYGRVYKAVGRNGQGGEFAIKKSESRFKPDKEGDIIQYTGLSQSAIREMALCSELDHANVVQLAEIILEDKCIFMLLNGLLYLHTNWVLHRDLKPANILVTSSGAIRIGDLGLARLFYKPLNSLFSGDKVVVTIWYRAPELLMGSRHYTPAVDLWAVGCIFAELLSLRPIFKGEEAKMDSKKTVPFQRNQMMKIIDIMGLPHRDNWPGIVHMPEYSQLQSLAMSRAPNHISRTSNLGSWYQNCLKNGGYSVNSSVGTPGDDGFDLLSRLLDYDPTSRITAKEALEHPYFKNGGPISANCFEGFEGKYPHRRITHDDNDIRSGSLPGTKRSGLPDDSLMSRAAKRMKE

SEQ ID NO: 47371 - protein, 375 aa, Glycine max
MGKKQSFRSKAAYFVSDLTTGLLNPISDNNNNNNKPPSLPPSGEEEKEDVGESKGGSDDVIIDGPDTSSFTAFLYSLLSTSDSGDKVGEADKKNDDEVAGDDSLLSDSATKESFVVKKSLFSRSKHSLGRAIHQMGGFSNRDSNYTDEGGVEMKRIVKEPLAVAVSGVGDHLPQISEPSMLVSEGVRNAVYASLPALIRGRKWFMLYSTWKHGISLSTLYRRSMLCPGMSLLVVGDRKGAVFGGLVEAPLRPSNKRKYQLCGINRHIAGVNRYFTLCTTDFLAIGGGSHFALYLEGDLLNGSSSVSETYGNPCLAHSQEFEVKEVELWGFVFPSKYEEIVELSRTEAPGICRWKTKDNPIAQALLKLAVLQTKML

SEQ ID NO: 47372 - protein, 525 aa, Aspergillus nidulans FGSC A4
MSNEETVASPPVAPTSDGQHTVSRRQSCSSENSQTAKEFIESQMRLEADAREVLPYSFDSCTQHLGPLRQTLYACLTCNPPPPTPDSPYTAAGVCYSCSISCHGEHTLVELFNKRNFVCDCGTTRITSSTPCTLRSDPNTGTKGVRSEKPHPGNRYNRNFQNKFCGCGEDYNAHEEKGTMFQCLGLGTTETGGCGEDWWHPECLIGLPRDWYKNSIRKEKLDNDDSNEQAEDEDEPPLPPQFPAEDDFETFICYKCVEANPWLKQYAGTPGFLPPVFKEGGLQKTVKKEDSPAPKSLHIQSDDQPSDNPNKRKAEDDAEDGDGSGPSSKRPREENQSQTTAPTSETKSEQEQQEQSQKPKHAFLPQTTPTATFSLFLKEDFRGHFCRCPTCYPNLAPHPQLREEEETYEPPLSEDGDGDRSTGTGSLLDRGEAALSNIDRVRAIEGAMVYNHLREKVKEFLKPFAESGTAVGADDIKAYFEKLRGDEQQIKDAAAAGKASADGGGNEDDKDESGDGVGRREQSGV

SEQ ID NO: 47373 - protein, 250 aa, Fusobacterium nucleatum subsp. vincentii ATCC 49256
MLHNTFFEDLGLKDEYKLYEVDETEINNFKNYMLENTIEGVNITIPYKKIFLDKLDYISGEAKEIGAINLLYIKDNKFYGDNTDYYGFKYTLTKNEIDVKNKKIAIVGKGGASASVYKVLKDMGADDINFYFRKDKLSQIEFPENIGGDVIINTTPVGMYPNVEDNLVSKEILKKFKIAIDLIYNPLETKFLKEAKECGLKTINGLDMLIEQALKTDEILYGILLSTQLRKKIRKKIKKRVEKFYENNGN

SEQ ID NO: 47374 - protein, 475 aa, Rhizobium leguminosarum bv. viciae 3841
MDIQMLIGSRFEKGTETEEHVLNPKTGETVLDLAEASLSQVDAAVDAAEKAFKTWSQTTPGERSGYLLKIADAIEKDAAGFAALEALNCGKPINAVLNDEIPAIVDCYRFFAGAVRNLHAPAAGEYLPGHTSMIRRDPIGIVGSIAPWNYPLLMMAWKLAPAIAGGNTVVFKPSEQTPLTALKMAKLLSEILPEGVVNVILGRGESVGNALINHAKIGMVSITGDVATGKKVLQAAAKTVKRTHLELGGKAPVIIFDDADIDAVVAGIRTFGYYNAGQDCTAACRIYADAKVYDNFVADLSSAVSSIRFNQADDTENEIGPLISKRQRDRVESFVARASEHKHMEITAGGKVSGDKGFFFTPTVIAGALQDDEIVRREVFGPVVSVTRFSDADDAVAWANDSDYGLASSVWTKDIGRGMKTAARLQYGCTWINTHFMLTNEMPHGGLKQSGYGKDMSVYALEDYTAVRHVMINHG

SEQ ID NO: 47375 - protein, 630 aa, Brassica rapa subsp. pekinensis
MDSASASQLKSSDDDETVADKVCNKSIVVPHRVVALANSFEKKDRSWYVKSQIPNDLSIQVNDITFQAHKFPLISKCGYLSNIELQPSTSGNGYHLKLENFPGGAETFETILKFCYGLQLDLNPLNVAPLRCASEYLYMTEEFQDGNLISKTDGFITFVVLVSWRDTLTVLRSCTSLSPWAENLQIVRRCCDLLAWKACNDSHDIPEDVENNERSLYSGIANLQLDHFMRVVTTVNARRGKPETIGRLIMKYAENWLPLIDEDIEGIRGYGSGNNELQFSVEGERTEESSLGCQEQKRIIESLVSVLPQQPEAVSCQFLLRLLKTAIVYSASPALVSDLEKRVGMALEDANVCDLLIPNFKNEDQQKGASSPEDYTIYNVDVVHRILEYYVMHEQQQQEQQIQGKPSITKLLDNYLAEIAKDPCLSITKFQVLAEMLPENAWKCHDGLYRAIDMFLKTHPSLSEHDRRRLCKTMNCEKLSLDACLHAAQNDRLPLRTIVQINTQVLFSEQVKMRMMMQEKQAGNNEENPEGCDDKRTSRDSEVRKLKGELENVRSKMAELQDDYNELQQEYEKLNSSKHKSTQYWGSRWQKVKRSFQMKREDDETRDTPRRRRSSTGPRTSLTRRRMSMS

SEQ ID NO: 47376 - protein, 124 aa, Brassica napus
FASIFILASRLNLIGERKTITMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 47377 - protein, 225 aa, Coprinopsis cinerea okayama7#130
MNVQFINKGASQGDSSPQTHSHDGGATSHSHGHGLNEHGHTHEHLEHPGTESMPSETFQITRPVTLKNADSRLELEATVTNDIFTKEDQEFLIKNKALPPSRILAIETGGCPHAAIREDISANMGALETLQAKFNCQILFVESGGDNLAANYSRELADYIIYIDLAPYVGASLEVMERDSKLMRGEGPTVFTSMKEDKGIDDVVSLILAAWKSAGSPGKPGPVGN

SEQ ID NO: 47378 - protein, 206 aa, Brassica rapa subsp. pekinensis
MAAVTPLAKYKLVFLGDQSVGKTSIITRFMYDKFDTTYQATIGIDFLSKTMYMEDRTLRLQLWDTAGQERFRSLIPSYIRDSSVAVIVYDVANRQSFLNTSKWIEDVRTERGSDVIIVLVGNKTDLVDKRQVSIEEGDNKARDFGVIFIETSAKAGFNIKPLFRKISAALPGMDTLSTRQGDMVDVNLRSSTNASQGEQQGGGCSC

SEQ ID NO: 47379 - protein, 739 aa, Burkholderia xenovorans LB400
MSHAMPDRLLPGSPYPLGASWDGLGVNFAVFSANAQKIELCLFDPTGRKELRRFTLPECTDEVWHGYLPNAHPGTAYGFRAHGPYQPQHGHRFNPHKLLLDPYARKLVGQFRWSDALFGYRVHSNRADLSIDRRDSAPAMPKCVVIDEAFDWSHDKRPNVPWGETIVYETHVRGASMLRADLRQHERGTFAALASPEFIDHLLKLGVTAVELLPVHAFLNDRFLVERGLRNYWGYNSAAFFAPEPSYLSTHRLDEMRIAVRQLHAAGIEVILDVVYNHTCEGNEMGPTVSWRGLDNASYYRLIPGDERHHINDTGCGNTVNLPHPRVLQMVMDSLRYWSTAFNMDGFRFDLGVTLGREQHGFDPGSGFFDALRQDPILSQRKLISEPWDIGPGGYQLGNHPPGFGEWNDRFRDTVRRFWRGDAGLRPDLAARLTGSADLFNRRFRKPWASVNFVTSHDGFTLADVTAYEQKHNEANREDNNDGHNENCSRNWGVEGESDDPAILATRKRVARSLIATLLMALGTPMVLAGDESLRTQHGNNNAYCQDNELSWLDWARAESPDGRQMTAFVARVIALRKQHPLLRETRFLFGDREVLPGLFDVGWFDERGDPLTIEAWQDPEGRAFTLRRAGPGLNGETEVLLMMLNANEKTLRFTPPAPHLEWHVLLDTAEPENAPHRLAVPEIEVAAHGLVMLAAQPVGEADWQAGWKPGPQHGPRLLTALPPDPGAHAPTNDASPTT

SEQ ID NO: 47380 - protein, 400 aa, Triticum aestivum
  misc_feature (223)..(223): Xaa can be any naturally occurring amino acid
  misc_feature (279)..(279): Xaa can be any naturally occurring amino acid
  misc_feature (304)..(305): Xaa can be any naturally occurring amino acid
MAHVLAAAEPLTLLKRPPPQNDGFGDDNGSTEEKGAQRRAAGSPTPRRHWPRPGHEFGEHGGVNMSIGLGHVHRDWSRTPCAGSSRGSWARSAGDLYIYSRHFNPTVLALGRQMAALEGTEAALLHGVRHVGHSPGRLMQLVGAGGHVVASRCLYGGTHALLSRFLPRTSGVQAKFVEANDEAAVRAAIKAGGDAAGCTWETMSNPTPGPSPTSPMLGAEVAXHEAGAKLVVDNTFTPVVVSPARLGADVVVHSVSKFISGGADIIAGAICGPASLVNXMMDLQDGALMLLGPTMNARVASELXXRLPHHARLRAMGNPGYGAGGMLCLDMGTEERANRLMYHLQNTTQFGLMAVSLGYYDTLMSCSGNSTSSEMDPEDRARAGISPGLIRMSVGYNGTL

SEQ ID NO: 47381 - protein, 1290 aa, Oryza sativa (japonica cultivar-group)
METEPFDEAELLALPASPVASPPRRLKRLKKSSQIATAAHPVVGSPPPPSPPPPPPLDEETLAQFPSPPTNPSPPPPPPLDADAAAEAAPSPALTSPPPNPSSSPLPPTDTTEEEEEEEEDDGLDPLFSETFGAAGWDPLGMPRMEGEGDEEEMLGGGLIEELRREKSAKKRLDMDEGEEGGGEIAMDAEVKGKRSKRRKKDEAPKDSARGKKRSEKERRVQLDSIHAESQRLLRETRSVSFKPSAQPVYKPISSVLEKIRLRKLEILKKSVSLLFLSATPNDDDDEEEDDVSSDPVSGTAGDLGAPQVKEVDAEGKDPKIDDIENEGGMNSGDVNQCDSVPENKDALNCDKDLDNCGSKDLDKELLENSQDNLEDKAQSSDNPNNAADEIQSPPSSSPTESTDDISSEDEEYNDKENIAPSTPKDDVNVHEPLQRALAGDSCPDDAILKDFLDVEAEEEDDSDDDMMRFKDNEEDDGSDENEVFNDLIEAGYEEGEIDHEKRNALHQKWLQQQDAAETNKFMQKLKFGHQEQKKVMDQDEDDAEDCEDESENEMSYDLTPTNVVRQNSEKAKQMIARMFTDDNDTYEHSDDEEIEEHLARQRISKREVHNSSFISPLENDSSREVFSLIKKLNIAPQPKRRGKQVTSNHELLTVGRDNSASSKSSFLGRTASGSLASSHRSAYRTYVFGRDDSNSSNKSCLSTSESNADTYQTNSSQPKKAKFSSSQSKQAATKTNSKGDNSSGVSLIEVLRRSSSTSDKQEYTRQESCAVITESQAAHQFSAFKLSRRFSRRRGGGDEIFGSASRPVLRCLPAEEAELAAAAAASTSPPTSTRTPSLGRGGRSFLFGNTWFLLSTYPARLLHTADRRAPAAFFAAINRTPCVRTHCTGQSLLQRGIVMAACGYAFRRAELGAAKRQPEKDSSVGTRISCVVAMGSAGSTPRPEVSFRHRGVEYCKKVGVSLKCREPWGPSRAFWTNAIGPSYKLSFSVEPWLRDFSTSCVAPYSAGATEHQLSLDEAVQDKQMDNSTVGPDGKPRAPGPLKLVSGSCYLPHPAKEATGGEDGHFICVDEQAIGVADGVGGWADHGVDAGLYAKELMSNSMSAIKDEPQGTIDPSRVLEKAYTCTKARGSSTACIVALKEQGIHAVNLGDSGFIIVRDGRTVLRSPVQQHDFNFTYQLESGGGSDLPSSAQTFHFPVAPGDVIIAGTDGLFDNLYSNEISAIVVEALRTGLEPEATAKKIAALAQQKAMDRNRQSPFAAAAQEAGYRYFGGKLDDITVIVSYVTSASAT

SEQ ID NO: 47382 - protein, 481 aa, Citrullus lanatus
MKVTMTSGGMPSIPSSISPPPVTLPLRNIPGSYGLPLFGSIGDRLDYFWFQGPEKFFRSRMEKNQSTVFRTNVPPSFPFFFTDPRVIAVLDCKSFAHLFDMEIVEKKNVLVGDFMPSTSFTGNMRVCAYLDTSESQHSKIKNFVMDVLRRSSRIWIQELESNLSTMWDSIESEIAKDTKSSFRNHLQPTLFNFFSKTLAGADTAKSPEVAKSGYIDVIIWLGLQLVPTIHIGILQPLEEIFLHSFRLPFFPIASRYQRLYDFIQKEGEEVVERGVSEFGLTKDEAIHNLIFTMGFNAYGGFSLFFPVLLDRILNDKTGLQQRILEEVKAKTGSGLTFESVKEMDLIYSVVYETLRLDPPVPTQYARARKDFKLSSYDSAYSIKKGELLCGYQPLVMRDPKVFNKPKTFNPGRFRGEKGAALLDYLFWSNGPQTGLPSEHNKQCAGKDLVVLTAVVFVAYIFRRYDWIAGEGGSITAFQRTN

SEQ ID NO: 47383 - protein, 269 aa, Archaeoglobus fulgidus DSM 4304
MVWFFEYYDGCGLAIKVKKKLYEAEGVQKVEIYETESMGKMLVIDGKIQLTELDEPFYHEMLVHVPMLSHENPRKVAVIGGGDGGALREVLKHNVERAVLVDIDRNVIDLSRKFLKIDHGAFEDERVEIAIMDGKEFLRDCEIFDVIIVDSTDPVGVSDTLFDREFFELARQKCDVISLQSQSPLIQKEYFRTLLVNSAPFERRDVYLSCVPTYPLALWSFIIGGEYDFSNLEERFERIKGKTVHYNPDVHRAAFALPEWLKKEVEACI

SEQ ID NO: 47384 - protein, 354 aa, Desulfitobacterium hafniense DCB-2
MKRMDCRDLNQSELTQHCAELGLPKFRGRQVFQWVQQKAVQNWEELRNIGAGDRQKLQEGLFLQPLRKVREQIAQDGTRKFLFRCADGETLECVLMDYDRRKNRDRHTVCVSTQIGCAVGCAFCATGLGGWRRNLSPGEILGQVLDITYLMRQEDPDFQVTNIVFMGMGEPLLNYEAVLKAIELLNDPEGQGIGMRRMTISTSGVAPKIRQLAKDNPQVGLAVSLHSAHNTTRDQLIPMNRKYPLEELMEACGDYTTLTNRRITFEIALISGQATLEAAQAVGHLLKGQLAHVNLIPVNPVAGTGMARPTAKEVQQFAQSLESMGIPVSVREEKGTDIDAACGQLRRQLECEQK

SEQ ID NO: 47385 - protein, 626 aa, Zea mays
MAAASRPRYPAAAHLAGAGLLAPSSDNGEAKGGGGRTPGGGAARAPRAAYGNDAGEELTQCAPMSFSFRLVRKPMDTFPQPAAARGRRALVDVGNLMNGRPSLVNHQKQAVAAAATSHKPLNVGNKKPLVPQAAARGMRPLADVTNLMINDRAAPANRQKPLDAVFNRNGKAVKLKECKVKPEVIVTIPDSEKEKKGKLPGGQRVCRRVPTLFDNLTKCSRYEHKQNSKASDGITTPKKKDPYDIDAPDSCNELAVVEYVEDIYRFYKSTEGTCRPLSSYMSSQAEISERMRAILIDWIIEVQYRLTLMPETLYLTVYIIDQYLSMESVPRKELQLVGISAMLIASKYEEIWAPLSILRLAFTTSSDILQVKDLMCLCDNAFTRDQVLTKEKAILDRLHWNLTVPTMYMFIVRYLKAAMCDTELENMAFFYSELALVHYAMLVYPPSVTAAAAVYAARSTLGMNPPWTDILEHHTGLAEPQLLSNLLVAEDDAFNRNHRECARRLISFHTLAPESKQKAVYRKYSKPKLGSVALQSPVKKLLSGGLFHGVRSLTFGVDLMKIQLMGILETDLEEEKARELSKLQSSLEELQAKLDETSKMLAKEREAANTIEEACARETQSYRPKH

SEQ ID NO: 47386 - protein, 504 aa, Arabidopsis thaliana
MAGGALTDEGGLKRAHLYEHRITSYFIFACIVGSMGGSLFGYDLGVSGGVTSMDDFLKEFFPGIYKRKQMHLNETDYCKYDNQILTLFTSSLYFAGLISTFGASYVTRIYGRRGSILVGSVSFFLGGVINAAAKNILMLILGRIFLGIGIGFGNQAVPLYLSEMAPAKIRGTVNQLFQLTTCIGILVANLINYKTEQIHPWGWRLSLGLATVPAILMFLGGLVLPETPNSLVEQGKLEKAKAVLIKVRGTNNIEAEFQDLVEASDAARAVKNPFRNLLARRNRPQLVIGAIGLPAFQQLTGMNSILFYAPVMFQSLGFGGSASLISSTITNAALVVAAIMSMYSADKFGRRFLLLEASVEMFCYMVVVGVTLALKFGEGKELPKSLGLILVVLICLFVLAYGRSWGPMGWLVPSELFPLETRSAGQSVVVCVNLFFTALIAQCFLVSLCHLKYGMFLLFAGLILGMGSFVYFLLPETKQVPIEEVYLLWRQHWLWKKYVEDVDE

SEQ ID NO: 47387 - protein, 426 aa, Moorella thermoacetica ATCC 39073
MSQVLDARAGKITPEMEKVAADEKVDVEFVRAGVAEGTIVIPRNTNRKVLKPCGIGRGLRIKVNALIGTSSDRDDRQMEMRKIAAAEAAGCDSFMDLSTGGDIDEMRRLTLAHARVPVGSVPIYQAAIEAIEKRGSIVAMTPDDMFAAVEKQARDGIDFMAIHSALNFEILERLQASGRVTDIVSRGGAFLTGWMLHNQKENPLYEQFDRLLEILLKYDVTLSLGDAIRPGSTADSLDGAQLQGMIVAGELVRRAREAGVQVMVEGPGHVPLNHVETTMKLQKSLCGGAPYFILGTLATDVAPGYDHITAAIGGALAGTVGADFICYVTPAEHLGLPTEQDVKEGVIAARIAAHAADLARGNRQAWERDLQMARARVALDVEKQISLAIDQEKARSLLDGTGEDGVCAACGTNCAALVAARYFGMN

SEQ ID NO: 47388 - protein, 470 aa, Triticum aestivum
  misc_feature (263)..(263): Xaa can be any naturally occurring amino acid
MDPTVPNSGDHAASTPTNTTVTLPPLTLRDAPRLPALPSGATTIPNPISSHPYFHPPPTFYISPGDVSLRHAFFDLSSGSPNPLVAYRRAGPRESLAVDPARARAALVTCGGLCPGLNTVLRELVVGLHELYGVLDVFGVAAGYRGFYGADDDHVRLDPASVDDWHKKGGTALKTTRGGFDLNKIVDGIVARGYTQVYAIGGDGTMRGAVAIFEEFKRRGLRISITGIPKTVDNDIGIIDRSFGFQTAVEIAQQAIDAAHVEXAVSAVNGIGLVKLMGRSTGHIALHATLSSRDVDCCLIPEIDFHVEGKGGLFEFLYERIKKKGHAVVVVAEGAGQEVIPRTDDQKREQDESGNMLFLDVGPWLKSELGRWWKREHPTELFTVKYIDPTYMIRAVPANATDNLYCTLLAHSAIHGIMAGFTGFVPGPINGNYSYIPLEDIAVAKNPVDVNDHKWAWVRSVTDQPDFLKP

SEQ ID NO: 47389 - protein, 432 aa, Moorella thermoacetica ATCC 39073
MNLIESARAGLITPEMEQVAVQEGVTPEFVRQGVADGTIVILRNARRQNVTPVGVGKGLRTKVSASVGLYGETGGIDVEVAKIKAAVEAGTDAIMDLSVSGDIEAMLAETLAVSPKPVGTLPLYQAMAEAGRKYGSSVNMRDEDLFDVIERHAAAGVDFLALHCGTTMNIVERARNEGRIDPLVSYGGSHLIGWMLANRRENPLYEHFDRVLAIARKYDVTISFADGMRPGCLADSLDGPQVEELVVLGELVRRAREAGVQVMVKGPGHVPLQQLKATVVLEKSLCHGAPYFVFGPLVTDIAIGYDHINAAIGGALSAWAGAEFLCYVTAAEHVGIPDIDQVREGVIAARIAAHAADLANGLTCAREWDRELSRARKELDWKRQIALAIDPERAGRLREERSDAAAAGCAMCGKYCAMEIVSRYLGTARHTC

SEQ ID NO: 47390 - protein, 110 aa, Musa acuminata
GVELLQTTLLKLSDMLQVSYKGKPVGVVVLNNESSPESGMLLDVTSTARFSRLLEEESSSTTESEVLLVRRSLAWITGVTLLLSTLIGVYLLLNMPLTRDTLLYSNVKLD

SEQ ID NO: 47391 - protein, 256 aa, Zea mays
MSREENVYMAKLAEQAERYEEMVEYMEKVAKTVDVEELTVEERNLLSVAYKNVIGARRASWRIVSSIEQKEESRKNEEHVNLIKEYRGKIEAELSNICDGILKLLDSHLVPSSTAAESKVFYLKMKGDYHRYLAEFKTGAERKESAESTMVAYKAAQDIALAELAPTHPIRLGLALNFSVFYYEILNSPDKACNLAKQAFDEAISQLDTLGEESYKDSTLIMQLLRDNLTLWTSDLTEDGADEGKEAPKGEAGDGQ

SEQ ID NO: 47392 - protein, 323 aa, Rhizobium leguminosarum bv. viciae 3841
MTMTSKLDQLREITTVVADTGDIEAVARLKPVDCTTNPSIVLKALGTPMFADAIKEAVAWGKKQGGNPEAVSSAVADRLAISVGAALVKLVPGRVSTEVDADLSFDTEASLAKARAIIAAYKDRGIGQDRILIKLASTWEGIRAAEVLQKEGIDCNLTLLFSKAQAIACADAKVFLISPFVGRILDWYKKSTGKDYTAEEDPGVVSVREIYNYYKANDIKTIVMGASFRSAGEIEALAGCDRLTISPNLLDELAKDEGKLERKLSPESRKPDPKVSVDEKTFRWMMNEDAMATEKLAEGIRAFAKDLGTLRTMVQKELQLAAA

SEQ ID NO: 47393 - protein, 467 aa, Oryza sativa
KTHLSNLNRPCFHRGSSEPFPGAREANREFDISSSHALHLFDETPARAVSSFYARDLFDETPLRACSAAMEGSPSKRRGVTAPAHTDDGDWFSDVPDDVILNIMSFLTTRQAVQTCVLSRRWLNLWRSVPCINADVGEFQRSDTEWEEYDQERESAFKMFMDRVLELRNPAAPIRTFRFRCCRLDGFEGTSDEADMNRWITHAMQKQPWVLDILVLYDALKLDHSAFTCRYLTRIKFINVLMMPGFFQQLEMGCPVLENLFLDESIVADVEISSRTLKVLTIKSTQFSYKFRTTISTPSVTYLKLWRPVNGIYVFNDMPLLVTSILVLYDVQDSSDFCQNLRSLSAAKRLEFDYFGRKLTMENNLQLYPKFNNLVSLTLGQWCLDANFYGLVVFLQNAPKLEKLTLELEKNTPERIIGKLEDRSFTCEHLTRVEVVCSEGDPLVKDVVNFFVNSGLTSAQVQIIRWC

SEQ ID NO: 47394 - protein, 550 aa, Azoarcus sp. BH72
MTERKQTPYDVGLEKNAANYVPLTPLTFIERSAYIYPDRVAVIHGKRRYTWLESYTRSRRLASALKQLGVGKNDTVAVILNNTPEMFECHFGVPACGAVLNTVNTRLDAEGVAFILNHGEAKVLITDREYSRMVGKAIELANRPDMIVIDVDDPEYTGPGERVGKLDYEALLETGNPEFEYEQPGDEWDAISLNYTSGTTGNPKGVVYHHRGAYLNAMSNIVSWGMPPHSVYLWTLPMFHCNGWCFAWTMAANAGVNVCLRRVDPRLIFDAMREHGVTHYCGAPIVHSMLANAPEEWRKGINHKVSGLVAAAPPPAAVIEGMAKIGIDITHVYGLTETYGPASVCAKHDEWRDLPLAEQVAKNGRQGVRYHAQEGITVLDPTTMEPVPWDNETMGEIMFRGNLVMKGYLKNEKATEESFRGGWYHTGDLAVMQPDGYVKIKDRSKDVIISGGENISSIEVEDALYKHPAVMAAAVVAAPDEKWGEVPCAFVELKDGATVTAEEIIAHCREHLAGFKTPKKVIFGALPKTSTGKIQKFVLREQAKSSSAIE

SEQ ID NO: 47395 - protein, 336 aa, Pseudomonas syringae pv. phaseolicola 1448A
MSRVTLSRYLIEQTRSNNTPADLRFLIEVVARACKEISHAVSKGALGGVLGSMGTENVQGEVQKKLDVISNEILLEANEWGGHLAGMASEEMDNAYQIPGKYPKGAYLLVFDPLDGSSNIDINAPVGTIFSVLRCPNEYLSQNEALNEKAFLQPGTEQVAAGYAIYGPQTMLVLTLGDGVKGFTLDREMGSFVLTHEDIKIPESTQEFAINMSNQRHWEAPVQRYVNELLAGEEGPLKKNYNMRWVAAMVADVHRILTRGGLFMYPRDSREPSKPGKLRLMYEANPMSFLVEQAGGASTDGHQRILDIQPEGLHQRVAVYLGSKEEVERATAYHKE

SEQ ID NO: 47396 - protein, 797 aa, Ustilago maydis 521
MSTAAPSPSDVRAEPRASIDELTQLPILDEIDAKTDALRSEKASSSPSLDDSEKVEISNSKYVNQESAEEHVRSQKDSEPVIRNGRDVSDVLISDRDDGDACFTFRSITLGLVGAAFQSVLTQIYRFKPTEVSINGTFLAIIIYILGTAWARFLPTRKLLVTKLGEDRLPAWLLTTVHFINPGSFGLKEHAIASITASSASNGAHSSDVFGTQKLFYPDIPVTTTTAVLSVLSIGLFGYGLAGIFRPIIVYPAEMVYWGTLPLVDLFQAFHWDKSFSTKRVKMFWYSFAGMGLYEILPAYIFPTLNSFSIPCLASRHATGSLAQTLTNVFGGAQSNEGMGLLSLSLDWQYITSSQLSLPLIQQANSWIGYAICYIAMAAIYYGNVWSAKSFPFMSTSIFADNGKRYNQSAVFVGGILDKSKLEEVGYPNVTGTYAWGMLMRNAAIGALVTHVVLFWGKDVIKSLGQARDKTQPDRHYQAMRKYKEAPHWWYLLLLAISFVFGLVVVLTQQTTLTWYSYVVSLALGTIVAPFSGVLYALLGNGISTNNLTKMIGGVVSPGRPLANLYFYAWSHSTIAQVINLSNDLKMGQYLKIPPRAMFVTQVIGTVFGAFLNYAIASTIISSKFELLHTNTGSYVWSGAYYQSLNISAVTWSMAKFMYGPGTPYFIIPMAVLIGIGAVVVHWVFTRFVPRIGQVKTSSLVLPTVFLYSAWMTSGQNCVILSTILVGLISQAWIRTRYPRWFKEYNYIVGAGWDGGSLLVIFVLSFAVFGAAGKERPFPTWAGNPDGFPDYCPNPSS

SEQ ID NO: 47397 - protein, 414 aa, Desulfitobacterium hafniense DCB-2
MIREVQIHERLSLAQTIPLGLQHVFAMFGATVLVPFLTGLSPAVALLSSGIGTIVFLLLTKSQIPAYLGSSFAYIASLTYFVKDQNNLAAAMGGALVIGIIYVLLFALMSYFGSSWIHKIVPPVVAGPVVAIIGLSLTPTAAGMASEQWYIAIFTLAVTAFLSIYAKGFLKIIPILAGIVIGYIVAAFAGLVDFTAVTASVSVDSWDKIIVSPINADTWQAPVFNKAAILMFAPLAFVTIIEDLGHMIVLGNITHSDPIEKPGFNRVLLGNGLATGIASFLGGPPVTTYGENIGVLAVTRVYSTFNIWVAAFIAIILSFVNPLQALIMSIPTAVMGGVSLYLFGMIGVTGLRTLIEARVDFSKNKNLIIASVIFAVGIGVQSHGVAYATLAGIILNLVLREEKDEVAGSGKEVS

SEQ ID NO: 47398 - protein, 367 aa, Desulfovibrio desulfuricans G20
MRCLGIESSCDETALAIVDDGRLVDAVMSTQAELHALFGGVVPELASREHYRLIGRMFDSLMLRCGLGVQDIDVISVARGPGLLGSLLVGVGFAKGLALAGGQRLVGVNHLHAHLLAAGLEHRLVFPALGVLVSGGHTHLYRIDSPRNFTLVGRTLDDAAGEAFDKVAKMLNLPYPGGRFIDVLGHMADPDDSMFPRPYTDNDNLDFSFSGLKTAVSTWLKAHGGTALAAPPAESELQAMLQNNVLPSGMPADMPLVCASFNAAVADTLYIKARRALQRLGGRGQIRSVVVAGGVAANSRVRTSMQRLAAEEGLHLHLPSPALCTDNGAMIAYTGWLLASEGLHHSLELETMPRGRVIPDDYIYDAH

SEQ ID NO: 47399 - protein, 338 aa, Desulfovibrio desulfuricans G20
MRQVTVTEHLLLHQTKSPAATGQFTALLYDLILAAKIISKSVNKAGLLDVLGGTGQVNVQGEHVQKLDEYANRVLIHRMERTGVLCAMASEENADLIRVPERFEAGDYILIFDPLDGSSNIDVNINVGTIFSILKRKPGASGSKDVTLGDVLQSGVEQVAAGYFLYGPSTMLVYSSGQGVHGFTLDPSVGEFLLSHPDIRYPEQGRIYSVNESYWHYWDEPTREVVSYFKGPDNPLGKPYSLRYVGSLVADFHRNLFYGGIFMYPMDYRLPEKPQGKLRLMCEASPLAFLAEQAGGRATDGTKRILDIVPGELHQRVPLFIGSAGDVDAVEAIYRRHS

SEQ ID NO: 47400 - protein, 417 aa, Coccidioides immitis RS
MIAEQEKSRVSGEDKPASSSSSSSSPSSTPTSADAPVLPTVNPAATKTEPPKPTLHPAFYVISWIFFSSSVILFNKELLDKDRDRFPFPIILTTWHLAFAAFMTQVLARTTTLLDGRKKVKMTGRVYLRAIVPIGFFFSLSLIGGNKAYLYLSVAFIQMLKATTPVAVLLCTWFLGMAPPNMRVLFNVSFIVIGVIIASFGEIHFVLVGFLFQIGGIVFEATRLVMVQRLLSSAEYKMDPLVSLYYFAPVCALMNFVVALAFEAPYVTMEHFQRTGLFTLLANAMVAFLLNVAVVFLIGKTSSLVLTLCGVLKDILLVAISAVWHKTPVTALQLFGYAIAIGGLLHYKLGTEKIKEYAGQANRSWAEYGATNPIRRRVIIFGVSAFLIICVLVQLGGPYDPNSLKGMIPGSTVANHA

SEQ ID NO: 47401 - protein, 310 aa, Synechococcus sp. RS9917
MASSVITAPSPPSRPAAPDVALKKAAALHQPRKGEAPVSVDQGKRWGTIGFMIGIHVLAIVALLPGFWSWQAVTTLLVLYWVTACLGVTIGYHRLLSHRSFRVPHWLERFFATCGALSCQHGPIDWVGLHRHHHKFSDTDADHHNSHRGFWWSHMGWMFEPIPAMQAVPRMSGDLVSDPYYRWLNNNFLLLQLPLAGLLFWIGTVTGAGGWALVLWGIPLRLVLVYHITWLVNSATHCWGEVVYESGDASRNNKWVAALTFGEGWHNNHHAFPHSARHGLQPGQIDLTWQHIRLMRAIGLASKIRLPVAS

SEQ ID NO: 47402 - protein, 1283 aa, Cryptococcus neoformans var. neoformans B-3501A
MLRQTLVSLSSLAASAPIEVITTTFIFATLAYFQLLHAIKGSEFFNVPSVSPPSRPAHFVRLAHQPSSEDASYILPSSHGVAGSSWVGDVESKREWTPISPSDFRKILEQNALGGYTFPIEAGGNTSGEKASVAIVKQLVVTRDGAQEPIDEFEQWLLNELSVEVDGEKYTYRDLCFNTSDHPSFVPHPLYPSQSTLTMFLQPPSPSDPTLTYLNRLNRLPAFTLSDSTTAFQLLPPSGANWGFLPSIDGVGLFSKLGEGMISGQGESYPMQNVRWFAYAARALVGRFWTLAKNADSADIFVVLLGYIVMHGVFVNLFIGMRKLGSSFWIPVATLCSSTFAFLIALLSAYLLDLPVDPICLSEAIPFLVITVGFDKPYHLAKAVLQNPDIDPVPSSPEPSIAGYSGELAKDPKSGSSLGLDLGTLHKELAPLERLQRLAEGQVKWVAPVAAKKIVVDAVKTSGVRIVRDYVLEIIALCVGAASGIGGLREFCYLAALIMAVDCVFLFTFYVAILSVMVEVHRIKLIRGNRRVKSVKRVSSSASLNGHGNGNGGTTNTSSSTSSPSTKRSFWSRSPSSEREDQPQNPVVRLKLLLIISFLTLHVLNLCTTLTEQTALKRHSTHSGAEITSRAMLNPRGISLSPVLQALYESQPPETDLAVQIMPPTQILMTSETLIPSRLSSFDHFMSEWTLLVGDPVLSKWIVVFLAISVLLNGYLLKGIALNSMGGKGPVAAAAQALAGIFDAERGQRALRETTPRGRKMELSAHMVGTNASTSTRDGDSTPRVEEVGKVAASHTVNVPIIKEPRIPSPSFPSASDDSALTFGRRSFEECVEIYAGGVGANNLSDEEIILLVQKGKIAPYGLEKALKNLERAVRIRRAVISRSSLTKSLETSLLPMADYDYKQVIGACCENVIGYLPLPVGIAGPLNIDGQLLHIPMATTEGTLVASTSRGCKALNAGGGVTTVLTHDAMTRGPAIDFPNIVQAAQARLWIDSPDGYATLKTAFESTSRFAKLQTLECALAGRTLYVRFATQTGDAMGMNMISKGVEKALEVLRGHFPDMHVLALSGNYCTDKKPAAINWIEGRGKSVVAEAVVPGHVVKTVLKTTVKDLCNLNIKKNLIGSAMAGSIGGFNAHAANILTAMYLACGQDPAQNVESSNCMTLMEPINDGEDLLISCSMPSVEVGTVGGGTILSPQRAMLDMLGVAGAHATSPGANAQRLARIIVAAVMAGELSLMSALAAGHLIQAHMKHNRSTPATPGAVTPFGGITPLRESVLINGPGAK

SEQ ID NO: 47403 - protein, 775 aa, Aspergillus oryzae
MTNTILDTYSSRRKPRRIGILTSGGDAPGMNGAIRAVVRTAIQNGCEAWAIHEGYEGLIQGGAMMHPLYWEDVRGFLSRGGTLIGSVRCDRFREREGRLQAARNMVLFGIDALVVCGGDGSLTGADLFRSEWPELLNELVSTGVLTVAQVAPHQNLNIVGLLGSIDNDFSGTDATIGCYSALTRICEAVDAVFDTASSHRRGFVVEVMGRHCGWLALMAAIATGADWLFIPERPPRDGWEDDMCSIITKNRNRGKRRTIVILAEGAQDSNLDRISSSAVKDVLSKRLGLDTRVTVLGHIQRGGSPCAYDRWLSTLQGIHAVKAVLSMTPESPSPVVIIQENRIRTSSLAETVALTKEANASMHAKEFEKAATLRDPEFMEYHSAYRHLNTSDHPKMVLPEDKRMRVAIIHVGAPAAGMNPATRAVVAYCLTRGHTPIAIHNGFPGLCRHHDDTPGSVREMHWLESGDWINDGGSDIGTNAGLPLDDIETTAQCFERYKFDALFVIGGFEAFTAVSQLRKARKQYLAFRIPLVLLPASMSNNVPGTEYSLGSDTSLNTLVYFCDVVRQSASSSGHSVFVVEAQGAEYQATAAALAAGAMTVYTPERGITLQSLSNDIEYLRQQFSKDHGANRSGKLIIRNDQTSTIYSTTEIANIIKHEAKNRFDAQGVVPGHFQQGGKVSPIDRIRAFRLAVKCMEHLETFAGQSPEEIMNDENSATVISIKQSRILLLPMGGPTGVEATDTDWKRQRPKTQNWLEIQEAVDSLSGRSSLYAIPN

SEQ ID NO: 47404 - protein, 307 aa, Synechococcus sp. RS9917
MVTTPLASAATDRELRMRAAVMAPRGPLPRRQRRIKWGTTSFMLILHVLATVALLPRFWSWQGVVALAVLYWMTVLGVTLGLHRLVAHRSLSVPRWLERTLVIMGTLACQSGPIEWVGLHRHHHRFSDQANDHHDAARGLWWSHSEWMLHAIPALEHIDRYAGDLQADPFYRWLDRWFLLLQIPLGLALYAYGQMADVHGGGLGLVLWAIPLRLVIVYHVTWLVNSATHACGYRNFDCPDLSRNCWWVALLSFGEGWHNNHHAHPASARHGLRWFELDITWLHIRLLRRLRLAHRIRQARYAPSGLP

SEQ ID NO: 47405 - protein, 785 aa, Aspergillus oryzae
MATTHAPAEPPKRRRIGVLTSGGDAPGMNGAVRAVVRMAIYSGCEAYAVYEGYEGLVHGGDMIRQVHWEDVRGWLSRGGTLIGSARSMAFRERAGRLKAAKNMIVRGIDALVVCGGDGSLTGADLFRSEWPGLLEELVKTGELTEEQIVPYKVLNIVGLVGSIDNDMSGTDATIGCYSSLTRICDAVDDVFDTAYSHQRGFVIEVMGRHCGWLALMSAISTGADWLFIPEMPPREGWEDDMCDIITKNRQERGKRRTIVIVAEGAHDRQLNKITSSKIKDILTNRLDLDTRVTVLGHTQRGGAACAYDRTLSTLQGVEAVRAVLDMTPESPSPVITVRENKLLRTPLMDAVKATKEVADLIHERKFDEAMHLRDSEFKEYHFAYKNTATPDHPKLILPENKRMRIAIIHVGAPAGGMNQATRAAVAYCQTRGHTALAVHNGFPGLCRHHADTPVSSVREVSWEEQDTWVNEGGSDIGTNRSLPSEDFETTAKCFEKFKFDGLFVVGGFEAFTAVSQLRQAREKYPAFKIPMVVLPATISNNVPGTEYSLGSDTCLNTLIDFCDAIRQSASSSRRRVFVVETQGGKSGYVATTAGLAVGASAVYIPEEGIDIKMLARDIDFLRNNFAHDKGANRAGKIILRNETASSTYTTQVIADMIKEEAKGRFESRAAVPGHFQQGGKPSPMDRIRALRMAIRCMQHIETFSGKSADEIAADELSATVIGVKGSQVLFSQMGGPNGLEATETDWARRRPKDEFWLDLQSTVNILSGRASFGEGKTGWSCYENC

SEQ ID NO: 47406 - protein, 427 aa, Oceanospirillum sp. MED92
MSRSEELFQAAQVHIPGGVNSPVRAFKGVGGTPVFFKRGEGAYLFDEDDNKYIDYVGSWGPMILGHCNSAVIDAVRNSLDNGLGFGAPTEIEIEMANKVCEIMPSLDMVRMVSSGTEATMSAIRLARGYTKRDKIVKFEGCYHGHSDSLLVKAGSGMLTLGEPSSPGVPASLAEHTITLTHNDIESVRKAFAEMGDQIACIIVEPVAGNMNCIPPVPGFLEGLREVCDEYGTVLIFDEVMTGFRVALGGAQSVYNVQPDLTTLGKVIGGGLPVGAFGGKKEIMEHIAPLGAVYQAGTLSGNPLAMAAGLAMLNAVSEPGFYEQLGAKVELLTEGLQAVAMANGIPFTTSRVGGMFGLFFTEQEKVTSFAETMKCDADRFSKFFHGMLEQGVYLAPSAFEAGFVSAAHTQDDIEATLAAADQVFASLK

SEQ ID NO: 47407 - protein, 358 aa, Cryptococcus neoformans var. neoformans B-3501A
MAPSSALPATSKKAKKPQPTPKAPLPLPSTFSTAQAEKAVKALLAHHAKVSKQKEEEQLLPREEHVWVVVNTKTGSTRRSLNPVKIQLPHPALPPPPTSSVCLFTKDPQRQYKDLLAQHNIKFISRVVGVEKLKGKFKPYEARRELLRDHDMFLCDERVLGVMPKLLGKMFFEAKKQPIPVNLQRKDLTSTLARAISSTYFHPTTGTSTSTRIATPSHSSTSQTLANLLEAVPQIVAEVDGGWEGVLSVGIKTSGSVMLPVWTGKLGGRFEKAEKPEKSANSGEEMEVEVEEKSETPSAPAPTVEKREKKEKAAAAPVEKPKKKSSTIGSTAGGAAKRAKQVAVGAKKPAVKKSKSKL

SEQ ID NO: 47408 - protein, 467 aa, Aspergillus nidulans FGSC A4
MPLIVLTGYPCSGLSYRAQQLATRLEEIQSQLVANGIIPPSKSKYKIHIVSTHDNVNYPRTVYDTARTEKEARGVAYTKAKRMLGRDSFVILDGMNYIKGYRYQLWCEAKALGTTCCVVCSRFSQFRYEVHVGTPVDQCIAINEARLRKKNASRPDGSAKESRDENPKPATNPSSSPDSTSSTESKDESDPYPPDLLNNLIFRYEEPSMNSRWDKPLFTVPYTDAEPPIAEIWTALTGIPHPETQEKENTISELAASLTSTTISPSSAASTTTTTPGASRGGLSSRPRVAIKPHQATVAPATADSSALYNMEKRTSAIVQAIRSFTLANPSAKAALASSKTQQASALDNEDFTRQEEGICIPVPDSSTPVFVPAHIASGSVTDDLAAAGGILALPRLQRLRRQWISLNRAYIAGPHAAVKGGDNPKVDRAGPSSRAQKAHEVQINCTPTASHKKYQKYFHKNQSKNN

SEQ ID NO: 47409 - protein, 218 aa, Arabidopsis thaliana
MTSSSSSSGSPCGACKFLRRKCAKGCVFAPYFCHEQGASHFAAIHKVFGASNASKLLSHLPISDRCEAAITISYEAQARLQDPIYGCVSHIFALQQQVVNLQAELEILKQQAAQSMIFADSPTSENPNSYYGDTTKAPYHHDHQNIYHHHDQTHLVYQTGSSGTVQHGDATESSYHNETSSGMGEFSIYSDLEQHLNTFNQDHLKELQSANFGYISFS

SEQ ID NO: 47410 - protein, 398 aa, Laminaria digitata
MSLKKKEFNKKLKHFTINFGPQHPAAHGVLRLILELNGEVVQRADPHIGLLHRGTEKLIEAKTYFQALPYFDRLDYVSMMCQEHTYALAVENLLQISVPKRAQYIRILFAEITRILNHLLAVGCHAMDVGAMTPFLWAFEEREKLMEFYERVSGARMHASYFRPGGVSQDISIGLINDIFSFAAQFGQRLDEMEEMLTDNRIWQERLVDIGVVSAQEAIDWGFSGVMLRGTGVRWDLRKNEPYDAYSELSFQGVVGKTGDCYDRYLVRVEEMRQSLSIIYQCLNKMPEGSIKIDDAKISPPSRADVKQSMEALIHHFKLYTEGVTVPLGETYTATEAPKGEFGVYLVSDGSNRPYRCKIKAPGFSHLQALNFMANSHMLADVVTIIGTQDIVFGEVDR

SEQ ID NO: 47411 - protein, 467 aa, Bradyrhizobium sp. HW13
MSIVNIAEVIESQTLNRKVVSLLLLSFLIMLCDGYDLQTISFASPSIVADWGIEKSAFGFVFTAGALGIMVGGFLFGSLADRIGRRPSFIIGTLLFSVMTLSTVLATTVTHLAVFRFIAGLGIGGVTPICFALNVEYVPKRFRATVVAVVMIGYMIGTGIGGILAAWLVPQHGWHVLFYIGGVAPLALMPLLVFALPESIKYLLLSNEHSKSVPLLVNALCPAAGATSDTRFVLDDTEDQAKLGSWKEIILSLFKGRLRRVTPVLWISFIASNMTVFLLAFWIPLITVSTGRSASLAAIGLTLYSLGGAFGGLLASRIVDMRGVAAVALIPLIASAVIIATGALEFSDAGFLTMMGVIGFFVFGGHLALMSVTGMFYPNSNRASGAGWALSVGKLGAIFGPALAGFVIASHPPLIDLFLIAAAPLPIVALGFFMLGRLGGAQAVATRAEDGGQANVEKPVLVHGSAS

SEQ ID NO: 47412 - protein, 301 aa, Bordetella parapertussis 12822
MASSAPAATVQFQGSLVALVTPMQPDGSLDYDAYRSLIDWHVAEGTDGLVVVGTTGESPSVSMEEHAELIRVAVEHAAGRIPVIAGVGANSTDEAIHLARHAKAVGAQAGLSVVPYYNKPNQEGIYRHFRAVAEAVDLPTVLYNVPGRTVADMSNDTVLRLAEVPGIIGIKEATGDIARGALLLREAPAGFQVFSGDDPTAAALILLGARGNISVTANVAPRLMHELCTAARGGDVPRTRELNARLARLNKALFIEANPIPVKWALAQMGHTALGYRLPMVELSEQYHSLVRTALQEVGLL

SEQ ID NO: 47413 - protein, 478 aa, Bacillus anthracis str. A2012
MKIAGRNLNHHGTSAAFVKNKLLWKVEEMMKTKQTDELLAKDEQYVWHGMRPFSPNSTMVGAKAEGCWVEDIQGKRYLDGMSGLWCVNSGYGRKELAEAAYKQLQTLSYFPMSQSHEPAIKLAEKLNEWLGGEYVIFFSNSGSEANETAFKIARQYYAQKGEPHRYKFMSRYRGYHGNTMATMAATGQAQRRYQYEPFASGFLHVTPPDCYRMPGIERENIYDVECVKEVDRVMTWELSETIAAFIMEPIITGGGILMPPQDYMKAVHETCQKHGALLISDEVICGFGRTGKAFGFMNYDVKPDIITMAKGITSAYLPLSATAVKREIYEAFKGKGEYEFFRHINTFGGNPAACALALKNLEIIENENLIERSAQMGSLLLEQLKEEIGEHPLVGDIRGKGLLVGIELVNDKETKEPIDNDKIASVVNACKEKGLIIGRNGMTTAGYNNILTLAPPLVISSEEIAFVIGTLKTAMERI

SEQ ID NO: 47414 - protein, 298 aa, Synechococcus sp. CC9311
MPALPNAGQIVETSLMELCLGGCAANTAYDLAKLGVDVCLGGCIGEDPFGDFLLRTLEEAGVQTTGVSRCSQATTATSAVINVEGGDRRLISVVGANRLFKCSMIPEGLIESAAVIHIGGFLLLDALESVQTQERLQQARANGALVVLDVIEVKDPLAMERVQRVLPFTDVVLPNRDEAALLTGRKNPWDQAQMFGDAGASTVVITDGAQGTYVVTDGLRLRSDAYSTSFLGGTGAGDAFDAGFIAGYLNGEDLKGCVRWGSAMGASCVRSTAATSSVFSKEEALRFMGNHTLHIHEV

SEQ ID NO: 47415 - protein, 144 aa, Brassica napus
  misc_feature (10)..(10): Xaa can be any naturally occurring amino acid
  misc_feature (37)..(37): Xaa can be any naturally occurring amino acid
FTTTHKDRLXDPALLRPGRMDMHIYMGHCTFQGFKTXLASNYLCLNDTTMPHRLYPEIERLMEGDVITPAQVAEELMKSEDADMALEGLVSVLEKMRFKADESSQVIMKKEGRLEMDEMALKRDAEGSPRKNGKRIKKLVLFWT

SEQ ID NO: 47416 - protein, 310 aa, Synechococcus sp. CC9311
MVSSTIRTPSPPSRPAASHLAVAQASLLRRPRKGEPATSPKNHQHSVTIGFMIVIHALAAVALLPGFWSWPAVTSLLVLYWVTACLGVTLGYHRLLTHRSFRLPLWLERFFATCGALSCQHGPIDWVGLHRHHHKFSDTDADHHNSHRGFWWSHMGWMFHPIEAMPAVPRLTGDLLSDPYYRWLNAHFLWLQLPLGLLLFWIGTATGAGGWALVMWGIPLRLVVVYHVTWLVNSATHCWGNVVYDSGDASRNNKWVAALTFGEGWHNNHHAFPHSARHGMQPGQIDLTWEHIRLLRALGLATKVRLPVAS

SEQ ID NO: 47417 - protein, 360 aa, Moorella thermoacetica ATCC 39073
MRKRLGILTGGGDCPGLNAVIRAATKTAMSHGYEMIGFLDGYTGVVEGRYIRLDPAAISGLLHRGGTILGTNNRSNPFYFPIQENGETIYRDMSDLAIERLKEMNIEVLLVVGGDGTLAGARDFKAKGARVIGIPKTIDNDLAATDQTFGFDTAVRTATDALDKLHTTAESHHRVMVLELMGRYAGWIALYSGLAGGADVILIPEIPWNIESVLAKIEARRAEGKPFSIVVVAEGVKSPEGELVVQRRVEGSVERVRLGGIGQLVGKLIEEKSGIETRVTVLGHIQRGGSPSSYDRVLATRFGVAAAELAVRGVHGVMVCLRGSDISHVPLEEAVGKPRTIPRDHQLLAAARAIGISFGE

SEQ ID NO: 47418 - protein, 389 aa, Oceanospirillum sp. MED92
MKMVFRPSQRVAEIESFKVMDLLKRAKQLDAEGFDVIHMEAGEPDFATAAPIAEAAKAAIDKGLTQYTPAAGIPELRTAISQWYKTKYNLEISPERIIVTTGASSALLMVFSLLADAGQSFMMADPGYPCNRQFLQFLDAKSQLVAVNAEQNFQLNAQLIRDNWCPETAGALLASPANPTGAVVHKDELRAISNQIKQLGGHLVVDELYHGLTYGDDAPSVLEVDPDAFVINSFSKYFGMTGWRLGWLVAPEAAAPELEKLAQNLMISPHTVSQYAALAAFKPESLAIFEERKAQFELRRDLLVSGLRELKFDLPISPEGAFYVYAGAQHLTDNTYDYCWSMLEEDHIATTPGLDFGRHRCNEFIRFSYTTGYDRIELMLDRLQKRIHG

SEQ ID NO: 47419 - protein, 419 aa, Oryza sativa (indica cultivar-group)
MARGAAGGEVGRSMPAVHDAHDDSENFLELLNSRTLAPELFAEPPACDYLKKMEYGGGGGGGGGGWPEHQFTAAAALEKHLSSTAAAGYGGALAHHHHAAGAPERLTANLSDLVSNWSIAPPNHGHHVGGAAACDNPAVAAAMAAAHGGGNVKQSGSSFLDSGGGGGGAMLQQESSSSTGTGGGGQDFLRPMGLAAGSSSYSSMLGLSSRMYGGGGTATMDVPWGSSNAGAARSLSDLISFGGGAMDKPPPPPPSSAPARTSSADYKKQQGQQEISSPVKTSSSGGGGKEGKKKRSEEAAGSEGSTKKSKHEATSPTSSLKVPKVKLGDKITALQQIVSPFGKTDTASVLYEAINYIKWLHEQVQLLSDPYMKSSSSKDYNAWGGLDRKEKADAEVDLRSRGLCLVYMVRVISIELLID

SEQ ID NO: 47420 - protein, 125 aa, Ehrlichia chaffeensis str. Arkansas
MSDLLKEFNEQQMKLLSNKEIPKFSSGDTLRVSMKIFDGVSERLQVFEGVCIKRKNNGLHSSFTLRKISYNESIQLQVFLYSPIVESIEVIKFGRVRRAKLYYMLSLFGKSARIKERSDRTKKLS

SEQ ID NO: 47421 - protein, 868 aa, Oryza sativa (indica cultivar-group)
MSQASLSPSSSGDEEEEDEGVEGYRKGGYHAVRPGDQFAAGRYVAQRKLGWGNFSTVWLAFDVHTQMLDKFFWLVMAGSFKCCDKKFVALKIQKSAPEFAQAAFHEIEFLSEITKRDPSNCKCIIQLIDHFKHAGPNGQHICLVFEFLGDSLLKLVQYNRYNGIGFGPVREICRSILIGLDYLHRELGIIHSDLKLENILLISTIDPSKDPIRSGLKPNLERPEGNPNGEVMLNPIEKKLKMRARRVLAKLAEKKKSAAEYARAERSLDGIDMTCKIVDFGNACWADKQFTDFIQTRQYRAPEVILGSGYSFPVDMWSFACIAFELATGEMLFTPKEGQGYSEDECIYATEKRLNEMKLKGGSKGSLGFDDGSPWEDTEKAQIATMGTKSKEYFDRHGDLKRIRRLKFSSIERVLVDKYKISESDAREFAEFLCPLFDFAPEKRPTAAQCLQHKWLQYSDGKNYGTLNISDVKNASVTCSPGTTASSDSKSIDVTRNIGDKPDSYAERADAKCNTSKKSIINSNSENSDVQPNTASVGNRNSKIDDVNSNTGSITNKDSKNTVIKPSIGSFANRNAETVDVKPNIGSITSRGDSSSDTKSNIGSVASKDAKTIDAKPSTSSITSQDSKIGDGRSNIDGIANRDAKTADVKHNIRSVVNTYLRNFDVKHNTGNIVDGGVKHSDLKPGTVSAANVDSKSISAKPSTGSFENSDAKSISAKTSTGSFENSDAKSISAKTSTGSFDNSDARNIMKANTGIVANNDVKDTDVQTNTESVTSGDDLNDIDRKPNIGRVAASIQRLESSIGKVQSGKYRIHMEILLTFKGVLRGIHGSCECRGDSSASCTHVGSVLMAFIPVLRKGYKDPILRPV

SEQ ID NO: 47422 - protein, 429 aa, Escherichia coli
MTTDDLAFDQRHILHPYTSMTSPLPVYPVVSAEGCELILSDGRRLVDGMSSWWAAIHGYNHPQLNAAMKSQIDAMSHVMFGGITHAPAIELCRKLVAMTPQPLECVFLADSGSVAVEVAMKMALQYWQAKGEARQRFLTFRNGYHGDTFGAMSVCDPDNSMHSLWKGYLPENLFAPAPQSRMDGEWDERDMVGFARLMAAHRHEIAAVIIEPIVQGAGGMRMYHPEWLKRIRKICDREGILLIADEIATGFGATGKLFACEHAEIAPDILCLGKALTGGTMTLSATLTTREVAETISNGEAGCFMHGPTFMGNPLACAAANASLAILESGDWQQQVADIEVQLREQLAPARDAEMVADVRVLGAIGVVETTHPVNMAALQKFFVEQGVWIRPFGKLIYLMPPYIILPQQLQRLTAAVNRAVQDETFFCQ

SEQ ID NO: 47423 - protein, 429 aa, Escherichia coli
  misc_feature (274)..(274): Xaa can be any naturally occurring amino acid
MTTDDLAFDQRHILHPYTSMTSPLPVYPVVSAEGCELILSDGRRLVDGMSSWWAAIHGYNHPQLNAAMKSQIDAMSHVMFGGITHAPAIELCRKLVAMTPQPLECVFLADSGSVAVEVAMKMALQYWQAKGEARQRFLTFRNGYHGNTFGAMSVCDPDNSMHSLWKGYLPENLFAPAPQSRMDGEWDERDMVGFARLMAAHRHEIAAVIIEPIVQGAGGMRMYHPEWLKRIRKICDREGILLIADEIATGFGRTGKLFACEHAEIAPDILCLGXALTGGTMTLSATLTTREVAETISNGEAGCFMHGPTFMGNPLACAAANASLAILESGDWQQQVADIEVQLREQLAPARDAEMVADVRVLGAIGVVETTHPVNMAALQKFFVEQGVWIRPFGKLIYLMPPYIILPQQLQRLTAAVNRAVQDETFFCQ

SEQ ID NO: 47424 - protein, 249 aa, Zea mays
MTTAPNIEMIASSLRHCSLTGGAGGRRRGGTRRRGAEGGGDTDGVTVELNSEVALPYHWEQCLDIRTGQVYYINWENGTRTTVDPRTASAFVSSPTPRSSTSRRTRRASTPSSGYTSVSSSVGAADVVTGAWRGVSNDSGYDNDDEQEDGEADDEDEAESSSSTTTSSSSSSSTGSSRGSAVSSTLSSFSPTDESGSGDNGGARLGAGHVLVAAGCRACFMYFMVPKRADVCPKCGSSGLLHLSRNGYA

SEQ ID NO: 47425 - protein, 374 aa, Oryza sativa (japonica cultivar-group)
MAVAVRTAKIFEGKDPAVKLREVLEGHRLPDDPGPPSWMEFIEVPSPPPNLEYGVDLTNYLGALGDEPEQTWWAALAAHRWVFLFGGLAILGLFGYGVYWMIKRRNRRGEAAPPGATGADPPDNPPPATAAASVQGGADSPARGGRGSPPPASEPPGGATSLDEEDVPPQEVYPEGTQFMILLFERPIIYDVRARPNLVESTSGSRDLQMVKIGLRVLTRPLPEKLPTIYRSLGENFNERVLPSIIHETLKAVVAQYNASQLITQREAVSREIRKILTERASNFNIALDDVSITSLSFGKEFTHAIEAKQGEAKSAQLIGEAINNNPAFLALRQIEAAREISHTMARSNNKVYLDSKDLLLGLQQLNVDSKNKK

SEQ ID NO: 47426 - protein, 330 aa, Lactobacillus plantarum WCFS1
MQSATQLHPIWRDYPALQPELQQVMQLMTANINIQDADINDAILEMIHGGGKLLRPAYCLLFSQFTTTDRQRMVALAASLETLHTATLIHDDIVDDAALRRHHVTIQERFGKDTAVYAGDYLFVVVFKILAHYSSSFKSIQMNSENMEKILVGEVQQKDRHYHLDITMAEYLQQIQGKTAELFALSCFLGAYESGQSSHFAQRARKAGLAIGMAFQILDDILDYQEVSQETGKPILEDVAEGVYTSPLIFALQTEAKHDLLPLMRLQGAISDTQRQEVQRLVINAGGVVQAQELATKYTQDALAIMRKLPDQPAKTDLISLTKRLLDRHN

SEQ ID NO: 47427 - protein, 583 aa, Glycine max
MGKSPGKWIKTVLFGKKSSKSNISKGREKFVNKKEAVVSSNELENGLSLDPTPDEIATNEEDHELENEESENILPDNQERDIIGSVDPDAPPDPEKIRLEQAASKAQAAFRGYLARRAFRALKGIIRLQALIRGHLVRKQAVVTLCCMYGIVKLQALVRGGRIRQSNEIHEKCNLFKPLDAKLGEPVGISTKISKLTANTFIHKLLASSITIMALHLQYVNGDPNSVLSWLERWSASYFWKPVPQPKKIRDSKSQRKQGNVSNGEAQITKSKRTTRKLPIANFETALEQTNPEFEKPKRNFRKTPYQVSDPEQENPQSELEKVKRSLRKIHNPVVENAGQPEVESETPKQHLEMTKVIPGHAVLEQATITSDDKTKMEETSTISNVPDVEITPIPSVNKEVSEILNNYQVSVESKPLSETPTKDRNTSHDEVKNKLGNLPETIFKDENSLLTNGDLSHSDLTGNENQKPTRKISNLTKQENGEDGIKNSPKLPSYMAATESAKAKLRAQGSPRFGQDGTEKNNTAGGSGRHSLPSSTNNQISSHSPKPQRSVPAGGKGGNKSDRTVPSSKAGNGKVTQAEWRR

SEQ ID NO: 47428 - protein, 562 aa, Archaeoglobus fulgidus DSM 4304
MSGILGIEGQNIRETDGSGINRIWVKHYDEGVRDRLDYPVMPAYRILEMAAEKYGNKVGTIFFGNQITYRQAKEASDKVAGFLFDIGIEKGDRVIFALPNTPHAAPIMAGILKVGGIIVQCNPLYTQREIKFLAEDSGAKTMFCMDMLYSNVSPLLDDGTLDTVITCSLQDFMVGATMPDPPEKRKGLYSWKNVMEAEKTERRAEINPKEDVAMLQYTGGTTGFPKGVMLTHFNIVANAYQAANWDPKASSADVGIGMLPVFHSYGMTMMNVGILVGATIIPMPDPRNYPMVLQAIQTFKVTTLAAVPTMYIGMLKLLEENGYDLSSLRVCTSGAAPLPIEVKRRWEELTGKRITEGYGLSEASPITHGNPIYGLNKEGSVGLPYPDTIAVVIDDEGNILPPGEVGELVIRGPQVMKGYWNRKEETENTLINGWLLTGDMAKMDEDGFFYIVDRKKDMIIAGGFNIYPREIEEVLYEHPAVAEAAVVGIPDPYRGETVKAFIELKPGWKGKVTEEDIIKFCKERLAPYKVPKLVEFRDELPKSLVGKVLRRVLREEEMRKQG

SEQ ID NO: 47429 - protein, 636 aa, Lactobacillus plantarum WCFS1
MAKKNIVVVGAGFAGVYATKKLSKHFKKNADVEITLIDRHSYFTYMTELHEVATERVEPEHIQYDLQRLFARRKNVRLVTDTVTGIDKKAQTVTTEHGSYQYDQLLISLGGESNDFGTPGVKEHGFELWSFEQAMALRAHLSAIIRRGAAELDPAKRKAMLTFTVCGSGFTGSELIGELIEYRDVLARDNKLDPSEITLQLVEAAPTIINMLNRTQAGKAAKYMEKHGVKIMTNSMITEVCEDHVNLKGKDPIPTYTLIWTAGVRANSIVKKFGIETNPRGGRLMANEFMQAKDCNNIFLAGDSTSYQEPDQPRPVPQIVQGAEETAAKAVEGIIKNVDQTDVTIKPFKGAYQASVDSIGSKYAVAQVLEKWNVSGFIAVLLKHAINWMYYVQIFSGYYLFQYFMHEFFRTRNNRNVFRGWVSRAGNVLWSVPLRFFYGAMWLWDCWTKVQGSESWFTDKLRLPFEWITVAATSGASQATKAAATSGASEAATSTVKAAKGVFSLSYMYGKEPLMVFDKMPHWFESITKVFIPNMQMALFFQKFMTCVEIVIALCIFFGLFTWFANAVTIGLVVVFCLSGMFYWVNIWMIFVALALMNGSGRTFGLDYWVVPWMQKHLGHWWYGNVRSHYDGVKTR

SEQ ID NO: 47430 - protein, 803 aa, Moorella thermoacetica ATCC 39073
MRVPYKWLQQYVDVTLPPAELADKLTMAGLAVEGVEDLTPGFQKVVAGKIKTITPHPDADHLVICNVDAGRELQLVTGAPNVHEGQMVAVALEGARLPGGREIHRATFRGVVSEGMLCSAQELGLDVSLVSPEDREGIITLPPDASPGADAAEVLGLKDVVLVLELTPNRADCLSILGVAREVAAITGAPIHLPATLPGEDGPEITGLATVEITAPDLCARYVARLVQGVRIGPSPAWLQAFLRAAGMRPINNVVDITNFIMLEMGQPLHAFDYDLLEGHRIIVRRAGPGEKITTLDGVERELDPEMLVIADAARPVAVAGVMGGLATEVTPATTNILIESAHFDGASIRRTSRRLGLRSEASTRFERGVNLEGAPAAADRAARLMAELAGGRVAPGRIDCYVKRRQPVTIELRPERVNYLLGTELAPTTMKELLERLHLEVRGEGPFQVTVPAYRGDLTGEIDLVEEIARLYGYNRIPVTLPGNLTAREKQAPAQRWEEAGREAAAAAGLAEVITYSFIGPRALDQLRLPEDHPWRRTVKIQNPLREEQSIMRPSLLPGLLEVAGRNASRRVLPVAIYELGRVFIPAGSRRPGEPLRLAGLVMGTTPRGWNWPAGEMDFYYLKGILESIFSRLRVRDVSWEASNAYPFLHPGRAATIKAGTRVLGYLGELHPDVLAAVELPARACAFELDWEAAGDLALRVPRYEPLPRFPAVERDLAVVVPATTPAAAVAGVIREAGGELLRAIALFDVYEGAPVPEGCKSLAYSLVYQLPDRTLTDAEVNAAQERIQRALEERLGASLRQ

SEQ ID NO: 47431 - protein, 365 aa, Thermoplasma volcanium GSS1
MAKDYYKILGVDRNASEEDIKKAFRELAKKWHPDLHPDNKAEAEEKFKEISEAYEVLSDPEKRRIYDQTGSVDFGGGGSNFNWDNFTHFSDINDIFNEIFGGNFGSDFFSGFGNRQSTRNIDLDMYTNLDISLEEAYYGTEKRIKFRRNAICPDCKGTGAKNGKLITCPTCHGTGQQRVVRGQGFFRMVTVTTCNTCGGKGRIPEEKCPRCNGTGTIVVDEDITVKIPRGATDNLRLRVSGKGQSYDGRTGDLYVILRIKQDKNLQRINDDLLLDQKINFGQAALGADIPIQIFNEKYNLKIPEGTQPGDVIKIKGAGMPHLNGHGSGDLLVRINVEVPKRLTAKQRELIRELFDIKENHKSWFH

SEQ ID NO: 47432 - protein, 118 aa, Brassica napus
PRFLFSIKLSQSEKNMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 47433 - protein, 391 aa, Arabidopsis thaliana
MQFLASLVSNSRKFGRRWDRALSLHHFSSNATPASISNPAFVEFLRDNGFQKPLAIAIAMRYPNLKSLEQPRSVIQMLKSYSFSDTQIQKSIRVHPRMMFYNVEKILEPKLRFFKDIGFTGSGLGKFVSQNSSVVGVSLVKKLIPTVEILKSIVAPKHEDLPVILSRCGWLLLSRDPNLFLLPNISYLETCGIVGSQLASLLRRQPRIFNLSEEKLRGYVSRALDLGFTLNSRMLVHAIISLSSLSEKTFDRKVKLFMANGFSEDEITDIIRRSPGLIRCSEDKLTLGFEFYLKRMGIEREALAKRPCVLSYNLEKRVIPRLKVLQILREKGLLLKEEKKKKNMVGIVEMTEEAFLEKYVVRFGDEIAEELLVAYKCVCLVDETLLDRIKI

SEQ ID NO: 47434 - protein, 417 aa, Cenarchaeum symbiosum
MGGDADVEITMVSEDNFLLFTPMLPQVASGMIETRHIVMPIRTICDRTTFYEGRVKNIDPYGKSVDLWGTREKRGISITYDFLVLALGSQTNFFGLSDVEKNAYTMKTLGDAVVLRNRVVDMLEQAENETDPILRGTLLTFVIVGGGFAGIETAGEILDLLLDARKHYPNIRKDDFSVVVLEALGAILPGFDEKLAKFAHEKLLEKGMDIRLRTAVSGFDGTEVSFKGLDGGGEDAIRTNTLVWTAGVTPVNTIKRSLFKTEKGKIVVDGFLAVPEFPGVFAVGDCALSVDPGSGRPFPPTAQLAEAQGETVAHNLQALIRGGGMKAFTFKQKGQMAVIGKRTGIASFLGANIAGFWAWFLWRNVYLSKIPRMEKRIRVLLDWTIDLFFDRDIARMKLFRKSSAVEQRGLDEVDDVW

SEQ ID NO: 47435 - protein, 341 aa, Amycolatopsis mediterranei
MRVGVLTGGGDCPGLNAVIRAVVRKGIEVHGWDFVGFRNGWNGPLTGDSRPLGLNDVEDILTRGGTILRSSRTNPYKVEGGVDKIKQVLADQGVDALIAIGGEDTLGVAKRLTDDGIGVVGVPKTIDNDLGATDYTFGFDTAVSIATEAIDRLHTTAESHHRALVVEVMGRHAGWIALHSGLAGGASVILVPERHFNVDQVVSWVERRFEKEFAPIIVVAEGALPEGGEEKLLTGEKDAFGHVRLGGIGTWLADEIAHRTGKESRAVVLGHVQRGGTPTAYDRVLATRFGLNAVDAVADGDFGVMVALKGTDIVRVKLSEATAELKTVPVERYQEAEVFFG

SEQ ID NO: 47436 - protein, 510 aa, Oryza sativa (japonica cultivar-group)
MGGFEDDEPPSKRARASSVEPASLLDSFSCLKPAAPLGSTMARPLPSQGKEVMVGSKGVIKRDEFVRIITKALYSLGYEKSGAVLEEESGITLHSPTVNLFRRQVLDGNWDSAVVTLKKVGLLDENIVKSAIFLILEQKFLELLRNDNVMGAIRTLQSEITPLGVNKKRVHELSGCIISSPQHVLLGFSKLGIESSNSRLKLLEELQKVLPPTVMVPERRLENLLEQALTVQREACYFHNSIDGLSLYTDHHCGKDQLPSCTVQVLRAHRDEVWFLQFSNNGKYLASASNDKSAIIWKVDEDGELLLKHTLTGHDKPVMMVAWSPDDCQLLTCGMEEVIRCWDVESGKCLHVYEKSGIGLISCGWFPDGKHILSGLTDHNFCLWDLDGKEVDCWKGQRSSKTSDFAVSNDGKLIISMNRESTIRLFDRETKQERLIEEDNTITSFSLSEDGDFLLVNLISEAIHLWNIRNCPIRVNRYAGHKRSRFVIRSCFGGSEQAFIASGSEDSQVW

SEQ ID NO: 47437 - protein, 432 aa, Alteromonadales bacterium TW-7
MSNIVKVIGREIMDSRGNPTVEADVHLADGSWGRAAAPSGASTGTREALELRDGDKARYLGKGVLNAVGYINKEIADALAGQDALNQSAVDKVMLDLDGTENKEKLGANAILAVSLATAKAAAQSKKVELYEHIADLNGTPGVYSMPLPMMNIINGGEHADNSVDIQEFMIQPVGASNFREGLRMGAEVFHSLAKVLKADGHSTAVGDEGGFAPNLESNEAALAAIKVAVANAGYELGKDITLAMDCAASEFYDKEANIYDLKGEGKKFTSEEFNFFLQELTQQYPIVSIEDGLDESDWDGFAHQTKLMGDKIQLVGDDLFVTNTKILKRGIDNGIANSILIKFNQIGSLTETLAAIKMAKDAGFTVVISHRSGETEDATIADLAVGTAAGQIKTGSLSRSDRVAKYNQLLRIEEQLGAKAPYNGLKEVKGQ

SEQ ID NO: 47438 - protein, 480 aa, Ehrlichia chaffeensis str. Arkansas
MLSTFSNIISLLNILSVLVRYNILPYTYLFAKRSIRKKSRGEKIAMAMQKLGPIFIKFGQSISSRTDIIGEEIASHLLCLCDKLPAFPYVDVVKIVEEDFKCKINEVFCEFEQNPIAAASIAQVHKAKDINGNVRAVKVLRPRIEKIFERDIKLMFWLARVAQNFQSLQRFQLLQLVQTFHEICKMEIDLRFEAANAEELRSNIQSDKGCYVPEVDWTRTTRRVLTLEWIDAVPIYNVYKSENCKALVENLIFCFCNQVYRDRFFHADMHPGNLMVDAKGRVVIIDFGIVGRLDKATCMYVTEILVGFLKRDYQYVADIHYRAGYVDAKYSNFVTACCAIGEPIVGKNTENISISALLTQLFKVTADFNMKLQPQLFLLQKTTVLIEGVCRQLCPEVNMWKIAELWMEKYAIEKNKYIQKLKRSYLCQAIHDVPLFMKKVDKSLDLINNYQELSKAKTSISRDVIWALIVLGLIIKLIIG

SEQ ID NO: 47439 - protein, 346 aa, Dictyoglomus thermophilum
MSKMRIGVLTGGGDCPGLNPAIRGIVMRALDYGDEVIGLKYGWAGLLKADTMPLSLEMVEDILEIGGTILGSSRTNPFKKEEDVQKCVENFKKLNLDALIAIGGEDTLGVASKFSKLGLPMIGVPKTIDKDLEETDYTLGFDTAVEVVVDAIKRLRDTARSHARVIVVEIMGRHAGWLALYGGLAGGADYILIPEVEPNLEDLYNHIRKLYARGRNHAVVAIAEGVQLPGFTYQKGQEGMVDAFGHIRLGGVGNVLAEEIQKNLGIETRAVILSHLQRGGSPSIRDRIMGLLLGKKAVDLVHEGKSGLFVAVKGNELVPVDITLIEGKTKNVDPAFYESVKTFFNK

SEQ ID NO: 47440 - protein, 460 aa, Clostridium perfringens ATCC 13124
MEIFKKQSLKRILSEANENKERTLSALDLTLMSVGSVIGTGVMVLTGIVAAKQSGPATSIAFIGGGIAAAIIVLCYAEFSSSIPSAGGSYSFTYVSLGEIIAYISGLCIVIGYTLSTATVASGWGSYLLSLLDILGIKLPKTFTAIPSEGGIVNLPAMISILFIVFVISLGTKESKKVNDIMVFIKIAVIALFIGVGVFHVNTSNWHPFAPFGVKGIVTGTASLFFAYCGFDATASAAEEVKNPQKSLPLGLISSLVICTIIYIAVSLVLTGVTSYTNLNVGDALSYALKLVGQRGVAFVVSLGTVIGILAVIFAGNFTTSHILLAMSRDGLLPKFFSKVDKKDVPYTALWTVGIIGALLAGFFNLGQLANFANIAFLLTYTLVCISLIAFRKKYPHVKRGFKTPLVPFIPLLGAFSCLFLMSNLSEEIWKIFIVVLVLLIISYLVYGRKHSLINKNNDN

SEQ ID NO: 47441 - protein, 429 aa, Escherichia coli
  misc_feature (274)..(274): Xaa can be any naturally occurring amino acid
MTTDDLAFDQRHILHPFTSMTSPLPVYPVVSAEGCELILSDGRRLVDGMSSWWAAIHGYNHPQLNAAMKSQIDAMSHVMFGGITHAPAIELCRKLVAMTPQPLECVFLADSGSVAVEVAMKMALQYWQAKGEARQRFLTFRNGYHGDTFGAMSVCDPDNSMHSLWKGYLPENLFAPAPQSRMDGEWDERDMVGFARLMAAHRHEIAAVIIEPIVQGAGGMRMYHPEWLKRIRKICDREGILLIADEIATGFGRTGKLFACEHAEIAPDILCLGXALTGGTMTLSATLTTREVAETISNGEAGCFMHGPTFMGNPLACAAANASLAILESGDWQQQVADIEVQLREQLAPARDAEMVADVRVLGAIGVVETTHPVNMAALQKFFVEQGVWIRPFGKLIYLMPPYIILPQQLQRLTAAVNRAVQDETFFCQ

SEQ ID NO: 47442 - protein, 141 aa, Zea mays
MAGLQRSATTFRRSGSSGLVWDERFLTEAEAEADADAEAKAGAAEDAEQPELRHSRSVGMLRRAGGGGDSRSKKGKESRQKQAESARRSNQQVFRTKDVAPDMDPPSPRVSGCAFCAVFRGGSGGTGRRAQARRRSKPRKK

SEQ ID NO: 47443 - protein, 333 aa, Glycine max
ILLATGTSGGALVVRLYFIHGGKRIWLSSFLETAAFPIIILPIIISYIHKRRRHRSSALISIKPPLFLASALIGLLTGLDDYLYACGVARLPVSTFSLIQASHLAFTAVFAFLLVRHRFTPYSVNSVVLLTVAAVVLALRSSGDRPAGESSRQYVIGFVMILAAAALYGFVLPLMELVYKKSRQRITYSLVMEIQLVLCFFATLFCTVGMIINNDFKVIPREARDFKLGETKYYVVLVWSAIMWQFFFLGAIGVIFCASSLLSGIIIAAFLPVTEVLAVIVYKESFHAEKGVALVLSLWGFVSYFYGEIKQDREKNKNRCPETDLPQSLPPNA

SEQ ID NO: 47444 - protein, 562 aa, Bacillus anthracis str. Ames
MTTTTTVKSDIEIAQEANMKKIQEIAADLNILEDELEPYGHYKGKLSLDIFKRLQNEKDGKVVLVTAINPTPAGEGKSTVTVGLGQAFNKIGKKTVIALREPSLGPTMGLKGGAAGGGFSQVVPMEDINLHFTGDIHAITTANNALAAFIDNHIQQGNTLGIDTRKIVWKRCVDLNDRALRNVVIGLGGPVQGVPREDGFDITVASEIMAVFCLATDIQDLKARLSRIVVAYNFANQPVTVKDLGVEGALTLLLKDALKPNLVQTLENTPAIIHGGPFANIAHGCNSVIATTMAAKLGDYVITEAGFGADLGAEKFLDIKARAAGIKPEAVVIVATIRALKMHGGVAKDQLKEENVDALAKGMENLQKHVETIQSFGVPFVIAINKFITDTDAEVAYLQEWCNERGYAVSLTEVWEKGGQGGVDLAEKVLKEIEKGENNYAPLYELELPLEEKIRTIAQKVYGAKDIEFAPKARKQLAQYEGEGWSNLPICMAKTQYSLSDDATKLGRPSDFIVTIRELKPSIGAGFIVALTGTMLTMPGLPKQPAALQMDVNEDGKAVGLF

SEQ ID NO: 47445 - protein, 154 aa, Neurospora crassa
MSNQEQTFIAVKPDGVQRGLVGNIISRFENRGFKLVAMKLTQPGQVHLELEKHYEDLNTKPFFAGLIKYMNSGPICAMVWEGKDAVKTGRTILGATNPLASAPGTIRGDFALDMGRNVCHGSDSVENAKKEIALWFKPEELNQWNHHSAAWIFE

SEQ ID NO: 47446 - protein, 473 aa, Bacillus cereus E33L
MMDQNKGLKRELKSRHIFMIALGGVIGTGLFLGSGYTIHEAGPGGAIVAYLVGGFVMYLTMLCLGELAVAMPDAGSYQTYATKHISPAAGYVVGWMSWLNWSATIGIELIAVSILMKRWFPDVPSWIWCVVFAVLLFAINALSSRSFAEVEFWFASIKVITIIAFIILGGAAMFGFLDMKGNEPAPMFSSFTDYGGLFPNGLSAILITMIAVNFSFQGTELVGIAAGESENPEKTIPKAINNTVWRILVFFVLSIFILAGLFPWQQAGVIESPFVVVFDKIGIPYAADIINFVIITAVLSVANSGLYATSRMLWSMSNQGMISPIFGKLSKNGVPIYALIVSTIVGCLSLLSGIYAEDTVYLWLLSIAGFGAILVWASIALSNLLARRSYIKRGGDVKDLKFKTPLYPFVPLLALVLNVTVIVGMAFIPEQRMALYCGIPFMIVCLLFYRATRNKAHKVEHIEKTDTTEVESL

SEQ ID NO: 47447 - protein, 831 aa, Oryza sativa (japonica cultivar-group)
MSPAAAAAGHDDLGRHLPPFFISTDWYDGGGEMGGRAPRAADDDSLAGDETAAALGVPGDDSHRNGTGAGAEAVEFHRNYFRIMIMILHRVLMAIIYLRLGELEMLRQKFKPLSMALSSCHAKDFYIDCGRNMREHERLERNRLHQEVNQLKAENFLTANQTIFFQGRSFAISKPELQQGQQDYGLLRTDTASRSKPASMIKSSLANHSKKLQFPEKVRPFSNPYTAASAAAGARAPSLPPPRAADSTGRSAVPDRWDWEMPLHVRIREKTSIASLLSSRRNWSGGGVDGGKKSGKREGAKTKGTRTTGRNKSEKREEHKEARGNAGQRRRWSDTNGQSDAKKNASQAVRRKRKGDHDSWNGDHSDTPYSKSKLTRNGPSTMTRGKASARKGDRFRSETLDEDDLHSRKRGNSMVSSVSRGGRSNSMVSGITREGKSQSVFSRNAEASSKGKKFDTPTRVSRQKEAATDANLDDHGAESKKSDDSGQIADEKPRPRRTRVLDKTGKKIRVANKDPVSDIEETLPPKKRKRMKLDPYDTSNKRLEDSTAKQDVCSPEKIPEKSPPEETETSINAKFRAIQPSSSIISYVEDNLLGRRRLNEIKNAGYNVKLSAPLDNVPFSTSPERERIEENVFRNKLEFFAAAKISSSFPPPTLPEIAFAGVSNVGKSSLLNALTRQWGVVRTSDKPGLTQTINFFRLASKLCLVDLPGYGFAYAKDEVKDSWQELVKEYVSTRVGLERVCLLVHTKRGMKPLDYELVDLMERSKTPYQIVLTKTDLVFPIDVARRAVEIQESLKKNKSVVRPVLGRDWALSPVDPEEIESRLAGEAQSGC

SEQ ID NO: 47448 - protein, 132 aa, Zea mays
MARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIR

SEQ ID NO: 47449 - protein, 198 aa, Triticum aestivum
MGWGEVKRVTKETNVHVKINLDGTGVANSSTGIPFLDHMLDQLASHGLFDVYVKATGDTHIDDHHSNEDIALAIGTALLQALGDRKGINRFGHFTAPLDEAAVEVILDLSGRPHLSCGLSIPTERVGTYDTQLVEHFFQSLVNTSGMTLHIRQLAGNNSHHIIEATFKAFARALRQATEYDLRRQGTIPSSKGVLSRS

SEQ ID NO: 47450 - protein, 263 aa, Triticum aestivum
  misc_feature (255)..(255): Xaa can be any naturally occurring amino acid
HSRTSLYKKAGWYRSGIPGISSTHASAHASAGDWLQGPYVYYLYSQYGFDKGDIGRLFIAGFGSSMLFGTIVGSLADRQGRKRACITYCITYILSCITKHSPQYRVLLLGRILGGIATSLLFSAFESWLVAEHNKRGYDPQWLSITFSKAIFLGNGLIAIIAGLFANLLADNLGFGPVAPFDAAACFLAIGMAIIMSSWTENYGDQSEGKDLMSQFKGAAKAIASDEKIALLGAIQSLFEGSMYTFVFLWTPALXPNDEDIPP

SEQ ID NO: 47451 - protein, 484 aa, Staphylococcus aureus subsp. aureus MRSA252
MEDNKMNRSLNSRHISMIAIGGAIGTGLFVATGNIISQAGPGGAILAYLVIGVMLYFLMASIGELATFYPVSGSFSSYSTRFIDSSLGFTMGWLYWALWSLVTSVDVIVASNVLYFWDTFKFFHPITWSLIFITILLLLNIFSVKSFGETEFWLSLIKVLTIIVFVIFGFLMIFGILGGHAYGFENYTKGQAPFVGGISGFLGVLLVAGFSVGGTEVVAVTAGESDDPKKSMPKAIKQVFWRILLFYVLSIAVIGAIIPYTDPSLLRASSSISQSPFTIVFDRVGIAFAASVINAVILTSLLSAANSGVYTTGRMLYSLSSDKKAPKFLSKLNKTTKLPLRALLTTYAVVVIVIIYANFNSNAVFNLLEIIGSMIIVVWGSSIWSQIRLRQAIKKQGQDPNKVLPYKAPFYPLGPIIVIATLLFLLFGGSVEYILKDQWLNAFKNFLPLIILALIYFIHKIIHKTKFVKLETINLKPHDYDNQK

SEQ ID NO: 47452 - protein, 327 aa, Synechococcus sp. CC9311
MAGTLLFNALREAIDEEMARDPHVCVMGEDVGQYGGSYKVTKDLYEKYGELRVLDTPIAENSFTGMAVGAAMTGLRPIVEGMNMGFLLLAFNQISNNMGMLRYTSGGNFTIPTVVRGPGGVGRQLGAEHSQRLEAYFHAVPGIKIVACSTPTNAKGLMKAAIRDNNPVLFFEHVLLYNLTEELPDGDYTCALDQADLVKEGSDVTILTYSRMRHHCLKAVEQLEADGINAELIDLISLKPFDMETIARSIRKTHRVIVVEECMKTGGIGAELIALITEHCFDDLDARPIRLSSQDIPTPYNGNLENLTIIQPHQIVETAQAIVRKGL

SEQ ID NO: 47453 - protein, 670 aa, Lactobacillus plantarum WCFS1
MQAFDEIDELAVNNLRVLSAEMIERAGSGHPGLPLGAAPMMWALWSRQLRVDPQQSQWANRDRFVLSAGHGSALLYSLLHVSGFNVTMGELQRFRQFGSHTPGHPELGIVDGVEATTGPLGQGLGMAVGMALAERQLAAQFSESPQLVDHYTYALVGDGDLMEGVSHEAASFAGNQQLQKLIVLYDDNAVSLDGPTSRSFRTDVNQRFASYGWDTQTVGDGNDLTAINAAIERAKHSSRPSLIAVKTTIGFGAPQAGTNAVHGNPLGTAGLTSLRQQLGWQAAPFTVMPAVAKRAQQLILQRGQRAHRRWQSQREALPQAVQHRFEQQLSMRLPVDLATSLPIFDEGAQASRITSHTVIQKLAAQLPGLVGGAADLASSNKTTIEQDQLSTPVTPDQRNVAFGVREFGMGTILNGMTLHGGLRVFGGTFLVFSDYTRAAIRLAAMMKLPVTYVFTHDSIAVGEDGPTHQPIEQLMSLRLIPNLTVIRPADPNETVAAWWQAINATDHPTVLVLTRQNLAVLSGSKTKAMTGVARGGYVLSPQRGRQPMGILIASGSEVALALQAQAKLATLGEDVSVVSMPSMENFARQSTNYQAQVLPPQIRRRVAVEMGATSGWERYVGLDGAVLGLDHFGASGAADQVLAANQFTVADLVRTYQQTHVDLGQQLRVI

SEQ ID NO: 47454 - protein, 137 aa, Zea mays
IPTLPSTRPQATPNPRSSTDELAGERATEMEAAAAAAGVELGSSKPQIATQAEMAEARVPLAYRDQCAHLLIPLNKCRVAEFYLPWKCEPERHAYEKCQYELVMERMLQMQKIREAQETKVKGGASIGLIPATAKLA

SEQ ID NO: 47455 - protein, 297 aa, Lactobacillus plantarum WCFS1
MIDGQTALFGFIAHPARHSRSPRMHNLSFDYWGLNARYLAFDVAPDGLAGTLAGIRSMGIAGVNLSMPFKQTVVPLLDGLTVRAQRIQAVNTIKNEAGKLIGDSTDGAGVFQDLLHQGLNLVDKHVMVLGAGGAGKAIIAAALDYGVASVTVFKRNNERYAGVQHWLEQLSTTTSVPLRLCAYEDQVRMQQVARTSNLIINATNIGMTTAGTPLPISIIQQLVPQQTVYDVIYQPLETTFLRLARQQGCATYNGLGMLIWQGALAFEFWTGKQMPVQQVRQDMLASIQATPPITAQA

SEQ ID NO: 47456 - protein, 459 aa, Moorella thermoacetica ATCC 39073
MSYQIAIIGGGPGGYVAAIRAAQLGAKVVVIEQDALGGTCLNRGCIPTKALLAGAAMVRGIKGAAAFGIDVEDYRVDYARLAARKDAVVKQLTGGIAYLFKKNKVDLIKGRGFLKGPGQIEVATADGTIENLQAENIILATGSEPALIKALGYNGRTVVTSTEALAWTEVPAELLIIGGGVIGCEFATLFATLGSKVTIVEMMPAILPMIDSEISRRFSMLLKKTGVEIKTKAQITEVKEAGGRVQATLADGQTINADKVLISIGRQFNTRGLGLEDAGITLGPKGEIVVDEYLRTSVPGIYAIGDVTNKIQLAHVASAQGLAAVTTIMGRPTKVNYDAVPSCIYTLPEIAGVGLTKEAAEGRGMKVRVGKFPFQASGKALCSGETDGMVKIIAEAESDRVVGVFIMGPHATELIAEGALAVNKGITAGELAATIHAHPTLSEAVMEAAEAVHGLSIHS

SEQ ID NO: 47457 - protein, 390 aa, Bacillus sp.
MSTHFDVIVVGAGSMGMAAGYQLAKQGVKTLLVDAFDPPHTNGSHHGDTRIIRHAYGEGREYVPLALRSQELWYELEKETHHKIFTKTGVLVFGPKGESAFVAETMEAAKEHSLTVHLLEGDEINKRWPGITVPENYNAIFEPNSGVLFSENCIRAYRELAEARGAKVLTHTRVEDFDISPDSVKIETANGSYTADKLIVSMGAWNSKLLSKLNLDIPLQPYRQVVGFFESDESKYSNDIDFPGFMVEVPNGIYYGFPSFGGCGLKLGYHTFGQKIDPDTINREFGVYPEDESNLRAFLEEYMPGANGELKRGAVCMYTKTLDEHFIIDLHPEHSNVVIAAGFSGHGFKFSSGVGEVLSQLALTGKTEHDISIFSINRPALKESLQKTTI

SEQ ID NO: 47458 - protein, 442 aa, Moorella thermoacetica ATCC 39073
MVDSREAILQKATDLGVKFIRLQFTDIFGVLKNVAITLDQLPKALNNELMFDGSSIEGFVRIEESDMYLRPDPSTFTIFPWKPNGDAVARLICDVYNADGTPFIGCPRGTLKRVIAEAEALGYTMNVGPEAEFFLFHTDATGRPTLETHDRAGYFDLTPVDLGEDARRDMVLTLQQMGFEIEASHHEVAPGQHEIDFKYADALRTADNIATFKFVVRTIAQRHGLHATFMPKPIYGIAGSGMHCNISLFRAGQNAFYDPDDDLQLSQVAYYFIGGLIAHARGMTAITNPTVNSYKRLVPGYEAPVYIAWSPQNRSPLIRIPAKRGLSTRLEVRHPDPSTNPYLAIAVMLKAGLDGIKNRIQPPAPINANIFDMEATRLRAEGIDLLPGTLDEALDALEKDPVIREALGPHIYQRFMEAKRIECEEYRTRVHQWEIEHYLTKF

SEQ ID NO: 47459 - protein, 482 aa, Cenarchaeum symbiosum
MSHGKALELSYSADEVFSRIQHEGIKFIDLQFTGLTGRFHHTTISANTFTPEQMRDGLPKLDGSSIVGFTSIDDSDLVLKPDPNTFAVIPWYTANKTARLLCDVYWGEDRGRLSRDPRGLAQRAEEYVKSSGFDYSAWGPEVEFFVFDKIHWDVLTPYKGQSYSIESEEAPWSQSGSGYPMGLQEGYYPSTPSDTLTPFRNECVNILSENFGILCDNHHHEVATAGQCEIDIRYDYLTNSADATQSYKFVIRNVAKKYGKVATMMPKPISMDSGSGMHTNVSLWKDKKNIFFDEEAEMELSQVGRYFCGGILEHSRALCAISNPTTNSYHRLVPGYEAPVYIAWSGSNRSAIVRIPRHFKGVGYARLKRLEFRAPDPSSNPYLVFASVLAAGLDGITKKSDPGDQVQEDIFKMTRSERAKRGIGVLPANLGEALDELESDKEFLAPVFPDDVIDRLIELGRRDQREIAIRPHPHEFYLYFDV

SEQ ID NO: 47460 - protein, 151 aa, Synechococcus sp. RS9917
MAERTFIAIKPDGVQRGLVGEILGRFERKGFKLVGLKQLTPSRELAEQHYGVHKERPFFAGLVDFITSGPVVAMVWEGDGVIASARKLIGATKPLEAEPGTIRGDLAINIGRNVIHGSDAPETALFEIGLWFQPSELSDWSPSDQGWRTEG

SEQ ID NO: 47461 - protein, 532 aa, Arabidopsis thaliana
MNCLPDELLVQILSFLPTKEATSTSLLSKRWRTLFTLSPNLDFDNSLLLQSKKRKWNMRNIQKSFVGFVDSTLALQGGKGIKSFSLKFKETLGDVNGEVDVNRWICNALEHGVSELHLRIDYTKRCHLPSEIFTSTKLVKLSLVTQSCFPVVPNCISLPSLKVLFLDSIWFEVPQFLIFLTACPALEDLTIYQKPHSVGMPYHISSKTIKRLSVTYTCGYFVDYGLKLFNTPSVVDLYYSDYVRHKYPHMNLDSLPKATLDIHFLDDNAANVTELLSGIRNVKTLHLTSSTVKVILLCCKGEIPMFENLINLKFSGKTRQWKFLLPLLLEICPNLTTLVLSGLDQNWFVGFRTPPNNQVKMLSIMQYQGSERELKLISYFVLKMECLQVVKVYVSSPMNDLKKMQLTEDLLKLPKASPKLNIQVLVPSDTYLPALKVLFLDSVWFDFHQFANVFFPACPALEDFAIHIKSFRRKARSENELEHISHFSLKMEFLEVLKVYVALTMDDTKKVELTKELLKLPISSSKLIIQVM

SEQ ID NO: 47462 - protein, 344 aa, Nocardia farcinica IFM 10152
MRIGVLTGGGDCPGLNAVIRAVVRTANGRYGDAIVGFQDGWRGLLEDRKINILNDDRTDRLLNKGGTMLGTARTNPDVLRAGLGKIKQTLDDNGIEALIPIGGEGTLTAASWLSDEGVPVVGVPKTIDNDIDCTDVTFGHDTALSIATEAIDRLHTTAESHQRVMLVEVMGRHAGWIAVNSGMAAGAHLTLVPEEPFDVDEVCTMIKRRFQRGDKHFICVVAEGSHPAPDSGFTLREGGVDEFGHERFTGVAQQLGTEIERRIGKEVRTTVLGHVQRGGSPTPYDRVLATRFGLHAAEAVHAGHFGQMVALHGTAIELVPLAEATKQLKRVPTERYREAQAFFG

SEQ ID NO: 47463 - protein, 469 aa, Cryptococcus neoformans var. neoformans JEC21
MAEFHFLNKTQPPQVTKLNLPDNTSCILLKKRNIVVKPRPMPILQPDGVLVKVVATDKLIHCEEYDKTAGKLTCLLILSRICGSDLHNYLAGGVGGRPVTEPIVMGHESSGEVIAVGDLVKTHKVGDRVAIEPGLPCRRCINCKEGKVNICLNMHYCGAPGSVGSLSRYFALPADMAPHIPDHLSWEEAGCIQPLAVGIQVGKRVDLRPHKTVAIFGCGPIGLISAAVAHAYSARKIIAFDNNPQRVEFAKKYISPLTGKPIIDHVFLVKDLPTSSLKGSHANGDHANGNGSMANGDTETLAHALGEDGSGAGMGDGEILDEDHEETIGDKKWEWAKKIVAGFVQEAGLTAEEGVDRVVEATGAEDCMLMGIAIAKQGGNYLAVGLGHIQTNCFPTLAVTNKEINVMGITRYTASCFPSALDLLSRGVVDVKQLITKTFPLTQSTEAFEAVAAGQDMKVVIKNQEGFDN

SEQ ID NO: 47464 - protein, 452 aa, Arabidopsis thaliana
MGKENAVSRPFTRSLASALRASEVTSTTQNQQRVNTKRPALEDTRATGPNKRKKRAVLGEITNVNSNTAILEAKNSKQIKKGRGHGLASTSQLATSVTSEVTDLQSRTDAKVEVASNTAGNLSVSKGTDNTADNCIEIWNSRLPPRPLGRSASTAEKSAVIGSSTVPDIPKFVDIDSDDKDPLLCCLYAPEIHYNLRVSELKRRPLPDFMERIQKDVTQSMRGILVDWLVEVSEEYTLASDTLYLTVYLIDWFLHGNYVQRQQLQLLGITCMLIASKYEEISAPRIEEFCFITDNTYTRDQVLEMENQVLKHFSFQIYTPTPKTFLRRFLRAAQASRLSPSLEVEFLASYLTELTLIDYHFLKFLPSVVAASAVFLAKWTMDQSNHPWNPTLEHYTTYKASDLKASVHALQDLQLNTKGCPLSAIRMKYRQEKTYYGFAVQICGGSHVSKAT

SEQ ID NO: 47465 - protein, 352 aa, Bipolaris oryzae
MPPAGSGSSRKISFNVSEQYDIQDVVGEGAYGVVCSALHKPSGQKVAIKKITPFDHSMFCLRTLREMKLLRYFNHENIISILDIQKPRNYETFTEVYLIQELMETDMHRVIRTQELSDDHCQYFIYQTLRALKAMHSANVLHRDLKPSNLLLNANCDLKVCDFGLARSAASTEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKIPWKAMFPKTNDLALDLLERLLAFNPVKRISVEDALKHPYLEPYHDPDDEPGADPIPEEFFDFDKNKDNLTKEQLKLLIYQEIMR

SEQ ID NO: 47466 - protein, 399 aa, Bacillus cereus ATCC 10987
MTYTLATRMKAFQSSIFSELGAYKKEKIAAGHKMIDLSIGNPDMPPADFVREEMVHTANQKESYGYTLSGIQEFHEAVTEYYNNTHNVILNADKEVLLLMGSQDGLVHLPMVYANPGDIILVPDPGYTAYETGIQMAGATSYYMPLKKNNGFLPNLELIPEEIADKAKMMILNFPGNPVPAMAHADFFKEVIVFAKKHNIIVVHDFAYAEFYFDGNKPISFLSVPGAKEVGVEINSLSKSYSLAGSRIGYMIGNEEIVRALTQFKSNTDYGVFLPIQKAACAALKNGAAFCEKNRGIYQERRDTLIDGFKTFGWNVDKPAGSMFVWAEIPNGWTSIDFAYALMDRANVVVTPGHAFGPHGEGFVRIALVQDKEVLQQVIENIRNSGIFSLEKINELVKN

SEQ ID NO: 47467 - protein, 375 aa, Yarrowia lipolytica
MEDETVALVIDNGSGMCKAGFAGDDAPRAVFPSIVGRPRHQGVMVGMGQKDSYVGDEAQSKRGILTLRYPIEHGIVTNWDDMEKIWHHTFYNELRVAPEEHPVLLTEAPINPKSNREKMTQIFFETFNAPAFYVSIQAVLSLYASGRVTGIVLDSGDGVTHVVPIYSGFSLPHAIMRLDMAGRDLTDYLMKILSERGYSFTNSAEREIVRDIKEKLCYVALDFEQELQTASQSSSLEKSYELPDGRVITIGNERFRAPEALFHPSMLGLEAAGIHETTFNSIMKCDVDVRKDLYGNIVMSGGTTMYPGIAERMHKEISALAPTSIKVKITAPLERKYSVWIGGSILASLGTFQQMWISKQEYDEAGPTIVHRKCY

SEQ ID NO: 47468 - protein, 481 aa, Papaver somniferum
SLVAVVITTFLYLIFRDSSPKGLPPGPKPWPIVGNLLQLGEKPHSQFAQLAETYGDLFSLKLGSETVVVASTPLAASEILKTHDRVLSGRYVFQSFRVKEHVENSIVWSECNETWKKLRKVCRTELFTQKMIESQAEVRESKAMEMVEYLKKNVGNEVKIAEVVFGTLVNIFGNLIFSQNIFKLGDESSGSVEMKEHLWRMLELGNSTNPADYFPFLGKFDLFGQSKDVADCLQGIYSVWGAMLKERKIAKQHNNSKKNDFVEILLDSGLDDQQINALLMEIFGAGTETSASTIEWALSELTKNPQVTANMRLELLSVVGKRPVKESDIPNMPYLQAFVKETLRLHPATPLLLPRRALETCKVLNYTIPKECQIMVNAWGIGRDPKRWTDPLKFSPERFLNSSIDFKGNDFELIPFGAGRRICPGVPLATQFISLIVSSLVQNFDWGFPKGMDPSQLIMEEKFGLTLQKEPPLYIVPKTRD

SEQ ID NO: 47469 - protein, 105 aa, Xanthophyllomyces dendrorhous
PMATTEGCLVASASRGCKAINSGGGAITVLTADGMTRGPCVAFETLECAGAAKLWLDSEAGQDMMKKAFNSTSRFARLQFMKTALAGTNLYIRFKTTTGDAMGMN

SEQ ID NO: 47470 - protein, 680 aa, Magnaporthe grisea 70-15
MPPPRVDDEAPMPPEDNGIDSSGPRRSSSGSTAATYNNAEKSGAISGQGGVVSNQIAGQQKATVGALLKNPLAGMTDAQIIADADRFVEEKGLTEHREAFRKGAMLARVQNNDTAFEQLDIITEQEKETLRKEVKNRWHQPFMLYFLCSLCAGSAIVQGMDQTAVNGAQEFYYETFNITDDLMRGLLNGAPYLCSALIGCWTNPILNKWTGRRGTIFISCFVSTVTGFWMAAADTWYNLLIARFALGFAVGAKSSTTPVYSAECTPKAIRGALTMQWQMWTAFGIMLGFVASVAFANTDFLGENTQWRWMLASTSIPPFLVMIQVYFCPESPRWYMERGEFTKAYSSVRRLRYLECQAARDMYYAFKLLEIEQAQREGRNLLKEFFTVRRNRRAAQSSWFVMFMQQFCGVNVIAYYSTAIFQNAGFSRNAALLTSLGGGAINFLFAIPAIYTIDTFGRRNLLLVTFPLMAIMLFFTGFSFFIPEDNPARLGCIATGIYLFMMVYSPGEGPVPFTYSAEAFPLHIRDIGMSSATAITWGFNFIISFSWPALETAFGPTGAFCWYAAWNIFGWIFAYFLLPETKNLTLEELDMVFGVSNRDHAKYYTDKLPWYLKKHILRKDVDSFPPLYQLAEDEDLADPPIAAKVDDRVDAKQTQPVMSPRLGVEHAEEPSIPGDDKTVR

SEQ ID NO: 47471 - protein, 503 aa, Oryza sativa (japonica cultivar-group)
MALAILARRRAAEALLRRPLGAAGVSALRASYAAVAGEESDVVVVGGGPGGYVAAIKAAQLGLKTTCIEKRGTLGGTCLNVGCIPSKALLHSSHMYHEAKSSFAHHGVKFSNLEVDLPAMMAQKDKAVAGLTKGIEGLFKKNKVTYVKGFGKLASPSEVSVDLSDGGSTVVKGKNIIIATGSDVKSLPGVTIDEKKIVSSTGALCLSEIPKKLVVIGAGYIGLEMGSVWNRLGSEVTVVEFAPDIVPSMDGEVRKQFQRMLEKQKMKFMLKTKVVGVDTSGDGVKLTLEPAAGGEQSVIEADIVLVSAGRVPYTAGIGLESVGVETDKAGRILVDKRFMTNVNGVYAIGDAIPGPMLAHKAEEDGVACVEFIAGKEGHVDYDTVPGVVYTHPEVASVGKTEEQVKALGIPYRVGKFPLLANSRAKAIDDAEGLVKVVAEKETDKILGVHIMAPGAGEIIHEAVLALQYGASSEDIARTCHAHPTVSEALKEACLQTFTKAIHI

SEQ ID NO: 47472 - protein, 548 aa, Synechococcus sp. CC9311
MPTEPTQRQVQLEAPFTDQKPGTSGLRKSSQQFEQPHYLESFIEASFRTLPGMEGGTLVLGGDGRYGNLRAIDVILRMGAAHGLQKVIVTTGGILSTPAASNLIRQRQAIGGIILSASHNPGGPDGDFGVKVNGANGGPTPASFTDAVYSCTKTLTEYSIVEAPAISLQAPGHHLIGEMQVEVIDGVDDFVLLMKQLFDFESISALIRNDFPLAFDAMHAVTGPYAKKLLEEVLGAPAGTVRNGTPLEDFGGGHPDPNLTYAHELAELLMDGGAYQFGAACDGDGDRNMILGNRCFVNPSDSLAVLTANATLAPGYASGLAGVARSMPTSAAVDVVAKDLGINCFETPTGWKFFGNLLDAGDITLCGEESFGTGSNHVREKDGLWAVLFWLQILATRRCSVAEIMTEHWNRYGRHYYSRHDYEAVASEAAHGLYDRLETMLPSLIGQPFAGRSISAADNFSYTDPVDQSVTKGQGLRILLDDGSRVVLRLSGTGTKGATLRVYLESYVPTTGDLAQDPQVALGEMIKAIDQLAEITERTGMDRPTVIT

SEQ ID NO: 47473 - protein, 302 aa, Synechococcus sp. CC9311
MSPAAELSPTPFGRLLTAMVTPFDAEGRVDFALAGRLARHLVEEGSEGLVVCGTTGESPTLSWQEQVKMLEVVRQAVGPGVKVLAGTGSNSTGEAVKATREAAASGADGALVVVPYYNKPPQEGLEAHFRAIANAAPELPLMLYNVPGRTGTSLAPATAAQLMNCANVVSFKAASGSIEEVTELRLACGPRLAVYSGDDGLLLPMLSAGAVGVVSVASHVVGRRLRHMIDAYLSGQNAVALGQHEQLTPLFQALFATSNPIPVKAALELSGWPVGAPRLPLLPLNSAMRDSLADLLTALRQT

SEQ ID NO: 47474 - protein, 416 aa, Magnaporthe grisea 70-15
MPQSIAAYHSSRRRSSAWAAAVSVAGNVVTNAISRATKTDLGIDPLRIVAKEMKFLTGNIRKLLGSGHPSLDRVAKYYTQAEGKHVRPLIVLLMSRATSLCPKAPRQQYIQSAAGIDTSISPIGILGDANPSSSIQALDNQSDLSSHSDPDILPSQRRLAEITELIHTASLLHDDVIDHSESRRGSPSANLEFGNKMAVLGGDFLLGRASVALARLRDAEVTELLATVIANLVEGEFMQLKNTSRDESRPVWSEDALTYYLQKTYLKTASLISKSCRASALLGGADAQTVDAAYAFGKNLGLAFQLVDDMLDYTVSAVDLGKPAGADLELGLATAPLLFAWKNHPELGELVGRKFSKEGDVARAREIVLASDGIEQTRALAQRYAEQAIEAISHFPDSEAKDGLIEMAAKTLKRKK

SEQ ID NO: 47475 - protein, 331 aa, marine gamma proteobacterium HTCC2207
MLSFHKAVESDFSAVNELIIANLQSNVGLVENIGHYIVGSGGKRLRPVVVLLSALASGYQGKQHLTMAAVIEFIHTATLLHDDVVDVSALRRGRETANNQWGNAPSVLVGDFIYSRAFQMLVDVGDMPIMGVIADATNLISEGEVQQMGNAGNSAIDEATYYEVIYRKTAKLFEAAARIGAMLAAEEADLFVGDSAILDARTDAMAAYGKHLGLAFQIADDVMDYQGDSQSIGKNVGDDLAEGKMTLPLIHARDHLDDQKKQLICSAIESKSAEHFEKILAAVRQSSSLEYSVTQAQEQAELAKQSLAQMPESDFKEVLSDLADFAVSRIV

SEQ ID NO: 47476 - protein, 662 aa, Staphylococcus aureus subsp. aureus MRSA252
MFNEKDQLAVDTLRALSIDTIEKANSGHPGLPMGAAPMAYTLWTRHLNFNPQSKDYFNRDRFVLSAGHGSALLYSLLHVSGSLELEELKQFRQWGSKTPGHPEYRHTDGVEVTTGPLGQGFSMSVGLALAEDHLAGKFNKEGYNVVDHYTYVLASDGDLMEGISHEAASFAGHNKLSKLVVLYDSNDISLDGELNKAFSENTKARFEAYGWNYLLVKDGNDLEEIDKAITTAKSQEGPTIIEVKTTIGFGSPNKAGTNGVHGAPLGEDERKLTFENYGLDPEKRFNVSEEVYEIFQNTMLKRANEDESQWNSLLEKYAETYPELAEEFKLAISGKLPKNYKDELPRFEFGHNGASRADSGTVIQAISKTVPSFFGGSADLAGSNKSNVNDATDYSSETPEGKNVWFGVREFAMGAAVNGMAAHGGLHPYGATFFVFSDYLKPALRLSSIMGLNATFIFTHDSIAVGEDGPTHEPIEQLAGLRAIPNMNVIRPADGNETRVAWEVALESESTPTSLVLTRQNLPVLDVPEDVVEEGVRKGAYTVYGSEETPEFLLLASGSEVSLAVEAAKDLEKQGKSVRVVSMPNWNAFEQQSEEYKESVIPSSVTKRVAIEMASPLGWHKYVGTAGKVIAIDGFGASAPGDLVVEKYGFTKENILNQVMSL

SEQ ID NO: 47477 - protein, 485 aa, Oryza sativa (japonica cultivar-group)
MGKKHAAAGSGGGWLAAVRKVFRPSKDAADKKGGGGGDREEEAAAEAAPEVLLLEHFPAGGTSPSAEGTGNDQGGTVVGKGEGEEEDGEDGYGEVERARALAAAAEAAVAAAEAAARVVRMSALRRASREERAAVRIQAFYRGYLARRALRALRGLVRLQALVRGHQVRRQVHLTMRCMQALVRAQARVRARRLITDHIHAGVAPLRLPPLPPATAAATYSSRRREGGYSWHPLRNNSYHAQLGERDESDDDVDGDGGKVGEHARQQQQRQRGNDVRSRSPFRSWDGSSRTPEEDRAEGVRRHDAAARRERARAYAYGYQQRQWQEKAGGFQWLDRWMAAQAQQHAPEPDKSRRRAALTAAADGTTMPERTVEMDTTSYRSPLNSHSAAVQGRPPAVPGYMAATQAARARARTAPPATPAHARSRSGAVLAGDTSSSGQSGSGSGGGGAHVQKPCAVYSPESRGTGDWTPPRLAVSSRATRLVYA

SEQ ID NO: 47478 - protein, 258 aa, Brassica napus
MASSSPSQMVHTSRTISQIGVRSQLVSANRTPQSLSFGARSSLSSRLNYATSFPLKTISGAHKLQRTACVKSVAAEEEEEEEVLAPPQAKVTHKVYFDVEIGGEVAGRIVMGLFGDVVPRTVENFRALCTGEKKYGYKGSSFHRIIKDFMIQGGDFTEGNGTGGISIYGAKFEDENFTLKHTGPGILSMANAGPNTNGSQFFICTIKTSWLDNKHVVFGQVIEGMKLVRKLESQETRAMDVPKKACRIYACGELPVDA

SEQ ID NO: 47479 - protein, 220 aa, Prunus domestica subsp. insititia
GRPAGGREFTSDWHGSEVAVKILMEQDFHAERFKEFLREVTIMKRLRHPNIVLFMGAVTKPPNLSIVTEYLSRGSLYRLLHKPGAMEALDERRRLNMAYDVAKGMNYLHRRNPPIVHRDSKSPNLLVDKKYTVKVCDFGLSRLKANTFLSSKSAAGTPEWMAPEVLRDEPSNEKSDVYSFGVILWELATLQQPWGNLNPAQVVAAVGFKNKRLEIPRDLN

SEQ ID NO: 47480 - protein, 90 aa, Glycine max
MDLDDFRSILDTAGVDVWMFIDAAIAVASSDSAGDLKRRRDGIVERLYAATAAFLLFSRGWGDLGPPPGGVKKKIFFREGGHRLNGHRIK

SEQ ID NO: 47481 - protein, 379 aa, Arabidopsis thaliana
MATQGQVITCKAAVAYEPNKPLVIEDVQVAPPQAGEVRIKILYTALCHTDAYTWSGKDPEGLFPCILGHEAAGIVESVGEGVTEVQAGDHVIPCYQAECRECKFCKSGKTNLCGKVRSATGVGIMMNDRKSRFSVNGKPIYHFMGTSTFSQYTVVHDVSVAKIDPTAPLDKVCLLGCGVPTGLGAVWNTAKVEPGSNVAIFGLGTVGLAVAEGAKTAGASRIIGIDIDSKKYETAKKFGVNEFVNPKDHDKPIQEVIVDLTDGGVDYSFECIGNVSVMRAALECCHKGWGTSVIVGVAASGQEISTRPFQLVTGRVWKGTAFGGFKSRTQVPWLVEKYMNKEIKVDEYITHNLSLGEINKAFDLLHEGTCLRCVLDTSK

SEQ ID NO: 47482 - protein, 741 aa, Prunus domestica subsp. insititia
MEACNCIEPQWPADELLMKYQYISDFFIALAYFSIPLELIYFVKKSAVFPYRWVLVQFGAFIVLCGATHLINLWTFSMHSKTVAIVMTTAKVLTAVVSCATALMLVHIIPDLLSVKTRELFLKNKAAELDREMGLIRTQEETGRHVRMLTHEIRSTLDRHTILKTTLVELGRTLALEECALWMPTRTGLELQLSYTLRQQNPVGYTVPIHLPVINQVFSSNRALKISPNSPVARMRPLAGKHMPGEVVAVRVPLLHLSNFQINDWPELSTKRYALMVLMLPSDSARQWHVHELELVEVVADQVAVALSHAAILEESMRARDLLMEQNIALDLARREAETAIRARNDFLAVMNHEMRTPMHAIIALSSLLQETELTPEQRLMVETILKSSHLLATLINDVLDLSRLEDGSLQLEIATFNLHSVFREVHNLIKPVASVKKLSVSLNLAADLPVQAVGDEKRLMQIVLNVVGNAVKFSKEGSISITAFVAKSESLRDFRSPEFYPVQSDNHFYLRVQVKDSGSGINPQDIPKLFTKFAQTQSLATRNSGGSGLGLAICKRFVNLMEGHIWIESEGPGKGCTAIFIVKLGFAERSNESKLPFVTKVQANHVQTNFPGLKVLVMDDNGVSRSVTKGLLVHLGCDVTTVSSIDEFLHVISQEHEVVFMDVCMPGIDGYELAARIHEKFTKRHERPVLVALTGNIDKMTKENCMRVGMDGVILKPVSVDKMRSVLSELLEHRVLFEAM

SEQ ID NO: 47483 - protein, 109 aa, Oryza sativa
RRERVMRKLFELDLGSRRWGEASSHPDAPMDLNAAFAAGADTVYAVEMFRVFGKVLDFVTACRVSDTDDHRWRRLARNNAAADADAMSSKLKSMAVLHLQLLVRPFHCL

SEQ ID NO: 47484 - protein, 335 aa, Oryza sativa (japonica cultivar-group)
MSTTAKLAGLLRDEQGPVAFNDAVDEDAVPVEPLTEHDDAISAMSAAHCNNMQFRCYRGFWISEMWAPGVVAVHRSFAPRADDVLVASLQKSGTTWLKALTFATMARGAWPPSSHDHPLRRLNPHLCVPSLEVLYTLGRDALLDMLPSPRLLSTHMPLSLLPPSTCKIVYIYRDQKDTAVSLWHFMKRRHPDLTFSEVHEAFCNGICMGGPAWDNILEFWYASNAEPTRVLFLTYEKVLQDPCDAVKKLAQFLGQPFSGAEEEAGVVTEIADLCSIDNLRNQKANKYGSIGGKISHESFFRKGMAGDWTNHMTLEMAERLDSILREKLDGSGLIV

SEQ ID NO: 47485 - protein, 295 aa, Vibrio cholerae
APANRDILLALFHADGSYETHQLEHEYAGVKHTHISGIHAGQKYGYLIQLNDELHYISDPYARALEGPLHYAPPFDSHKSFDLPKCVVTDTHFDWQNVAKPRIARDEMVLFETHVKGLTQLNPDVEKALRGKYLGLVSQPMLDFYRQQNINTLQLLPIAACMHEPHLLESGKVNYWGYNPYVFMAPDPRYASKDAVNELKTTIRELHRNGIQVILDVVYNHTAEGGTNGPVFNLKALDPNYYLHHGDHYANYTGCGNTVDLSNQAALNLVMDTLRCWVTEYQIDGFRFDLAATLG

SEQ ID NO: 47486 - protein, 475 aa, Cenarchaeum symbiosum
MERIRKEEVTFLDFWFVDIFGELRRMGMPSYAVSEENFHDGLEKLDASSIAGFKSVNNSDMILKPDPTTFRILPPEYDNGRRRNARLICDLYEGSTSEGSRYNRDSRGITKKASEKLSAAGLTHTNWGPEIEFFVFDAINVYPSPYAATHSYGGSGYSIESKESPWAKGNISTAIDIKEGYYPSQPKDTLETFRKDICDDLYEYFGIRIEAEHHEVATSGQCEINLAYDEMTAMADNVIAVKNVVKVKAKRRGKVATFMPKPIYGDNASAMHVHQSLWKGDENAMFDSADSVAEMSQIGRYYIGGILDHSQALCAISNPTTNSYKRLVPGFEAPINVCWGMGNRSAAIRVPMYCRNQQRSKRMEYRVPDPTANIYLLEAALLLAGLDGIRKKTDPGSPVVENVYRMTNEKKREYNIGSLPSTLKGALDALASDSGFLEDVFTKDFLDKYSELKRKEYSAFAQTPTAWEVSMYADA

SEQ ID NO: 47487 - protein, 347 aa, Schizosaccharomyces pombe
MDTAIEDRPGQTLTDDHQVKVAIKATGICGSDVHYWKEGGIGDFILKKPMILGHESAGVVVEVGKGVSSLKPGDPVAVEPGCVCRLCDYCRSGRYNLCPHMEFAATPPYDGTLRTYYITTEDFCTKLPKQISVEEGALFEPMSVAVHAMTRGNLKCGSRVLVMGCGTVGLLMMAVAKAYGAIDIVAVDASPSRVEFAQKYVGAKPFTPIAAKENESLPDYAQRYKQAIIEKYGEFDFAVDATGVGICIHTAVLALKRGGTFVQAGNGKPVIDFPINHIINYEINVLGSFRYAHGCYKQSLFLVSNGLVDVKPLITHRFAFKDALKAYETVASGEEGVLKVIIGGPDA

SEQ ID NO: 47488 - protein, 651 aa, Oryza sativa
MAGRSGGGGGGSSGKSGTGRMVSLQEFVSSMAPLIDLEKAAEISAESATSSKTLERRGCVMANLKCTDAQTGLMGKTLLEFQPNKGDVLPPHKFGTHDVVALKPNKADAGSAALGQGVVYRLKDSSITVAFDDIPEDGLNSPLRLEKLANEVTYRRMKDALVQLSKGIQTGPSANLIPVLFGENPPMSSKDVAKFSPFNKNLDESQKDAISKALRSRDVFLLHGPPGTGKTTTIIEIILQEVKRGSKILACAASNIAVDNIVERLSRYRTKLVRLGHPARLLPQVLDSALDAQVLRADNSSLAGDIRKEMKVLNSKLLKAKDKNTKRDIRKELRTLAKEERKRQQLAVADVRKNADVVLSTLTGASSKKLDGITFDLVIIDEAAQALEMACWIALLKGPRCVLAGDHLQLPPTIQSAEAEKKGMGKTLFERLTEAYGDQITSMLTIQYRMHELIMNWSSKELYNNKIKAHSSVADHMLYDIEEVKRSSSTEPTIILIDTTGCDMEEVKDEEESTMNEGEAAVSIAHAKLLVESGVRASDIGIITPYAAQVTCLKMMRNKDTKLKDLEISTVDGFQGREKEAIIISMVRSNSKKEVGFLSDHRRMNVAVTRARRQCCLVCDVETVSNDKFLKRLVEYFEENGEYLSASEYQS

SEQ ID NO: 47489 - protein, 215 aa, Oceanobacillus iheyensis HTE831
MTKSISIEHLQFDEKGLIPAIVQDHQSGQVLTLAYMNSDSITKTIETNETWFYSRKRQELWNKGATSGNKQTVKQISFDCDADAVLVLVDAQGPACHTGEESCFYEDLYKNDVALLQIIPQVSAKIKERHEHPVEGAYTSYLFEKGVDKILKKIGEEATEVVIAAKNEDKQELTSELSDLLYHSLVLMEQQGVTLEDIKKELYKRHVEKEGQQRE

SEQ ID NO: 47490 - protein, 573 aa, Bacillus megaterium
MTKEIQGIAASSGIAIAKAFRLENPELTVEKKSVTEVEAEVARLEAALEKSKSELEIIREHARKELGDDKAEIFEAHLLVLSDPELINPIKDKITNENVNAEHALDEVAAMFINMFESMDNEYMKERAADIRDVTKRVLAHLLGVNVSNPSLISEEVVIIAEDLTPSDTAQLNRKFVKGFTTDIGGRTSHSAIMARSMEIPAVVGTKTVMEDIQNGVLVIVDGLDGEVIVDPSEETVKAYEKKAAEYAEQKAEWAKLVNEKTVSADDHHVELAANIGTPEDVKGVLENGGEGVGLYRTEFLYMGREDLPTEEEQFTSYKTVLERMEGKPVVVRTLDIGGDKELPYLNLPKEMNPFLGFRAIRLCLEMQDMFRTQLRALLRASVYGNLKIMFPMIATVDEFRQAKAILLEEKAKLQQEGVQVSEDIEVGMMVEIPSSAVIADLFAKEVDFFSIGTNDLIQYTLAADRMNERVSYLYQPYNPAILRLVNMVIKAAHKEGKWVGMCGEMAGDEIAIPILLGLGLDEFSMSATSILKARSQIRQLSKADIEPHLDTILSMSSTEEVIEFVKSTFHIG

SEQ ID NO: 47491 - protein, 578 aa, Bacillus sp. S
MGNAIREKTIHGIAASSGIAIAKAYRLETPDLAAEKRAVADVEAEVARFEAAVAKAKEELEAIKQHALEKLGEDKAAIFAAHLLVLDDPELLNPIKEKIQTERVNAEYSLDETASFFISMFEAMDNEYMKERAADIRDVTKRVLAHLLGVTISNPSLISEEVVIIAEDLTPSDTAQLNRQYVKGFATDIGGRTSHSAIMARSLEIPAVVGTKTVTAEVKNGDIVIVDGLDGQVIINPSPELLAQYEQKRARYEAQKAEWAKLVHEATVTADGIHVELAANIGTPDDVKGALANGAEGIGLYRTEFLYMGRSELPTEDEQFVAYKTVLEQMNGKPVVVRTLDIGGDKELPYLQLPKEMNPFLGFRAIRLCLEMQDMFRTQLRALLRASVYGNLKIMFPMIATLDEFRQAKAILLEEKEALLRQGVAVADGIEVGMMVEIPAAAVMADQFAKEVDFFSIGTNDLIQYTMAADRMNERVAYLYQPYNPAILRLISHVIDAAHREGKWVGMCGEMAGDPIAIPILLALGLDEFSMSATSILPARAQLKQLAKEEAARIKETVLSLGTAEEVVSFVKRTFSLA

SEQ ID NO: 47492 - protein, 194 aa, Oceanobacillus iheyensis HTE831
MRKASLSRKTNETSVHLTLELDGEGTSTIETGIGFFDHMLTLLAKHGGINLDLSCDGDLEVDQHHTVEDIGIVLGQTLREALGNKEGITRYANVMSPMDEALSSIAFDISGRSYLVYNVEGLKEKVGTFDTELVQEFFQAFASNAQVTLHINLLYGVNSHHIIESIFKGFGRVIRQGCSIDLNQKGIPSTKGSL

SEQ ID NO: 47493 - protein, 645 aa, Clostridium perfringens ATCC 13124
MCKKPYYITTPIYYPSTNLHIGNTYTTVAADAIARFKRLTGHEVMFLTGTDEHGQKIERIANEKGITPKEHVDEIVAGIKDLWKMMNISYDKFIRTTDDYHVKAVQEIFKKLYDQGDIYKDSYEGLYCTPCESFWTETQLVNGNCPDCGRPVEKAKEEAYFFKMSKYADRLIQYIEEHPDFIQPESRKNEMLNNFLRPGLQDLCVSRTSFTWGIPVSFDEKHVIYVWIDALSNYITALGYGQEDQELYKKFWPADVHLIGKDILRFHTIYWPIMLMALGLELPKQVFGHGWLLVDGGKMSKSKGNVVDPVVLVNMFGADAVRYYLLREIPFGSDGLFNNEIFIKKVNTDLANDLGNLLSRTIAMVYKYFDGVIQAPTCKEAIDDELINLALSTPGKVEASIDALKIPEALESIWTLISRANKYIDETTPWILAKDEEKKERLGTVLYNLLETLRFVSVMISPFLTETSVKIDAQLNTKVTTWESLKEFNGTVAGDKVVKGDVIFPRIDVEEKLAELEALKQAPVKPANEELVKNPIKEEITIDDFDKIDLRVVKVLECEPVKKAKKLLKLKVDLGGEERQVISGIAQYYKPEELVGKYVVLVANLKPVKLRGELSQGMILAAAPSDDSELLLVNPGEMLTGSQVR

SEQ ID NO: 47494 - protein, 715 aa, Rhodococcus sp. RHA1
MSPHIDSHPGKMSSLPPSLRLPGSPFPLGAKVRGTGTQFAVHAPDAELVQVCLISGDGDEMRIDLVQRTYGIWHGIVEGVGAGQRYGYRTHGRWDPARGVRLNPAKLLLDPWATRITGKLGDHDALVSHDGDPFGGPSRVDSLGHTPLSVVTADHARTSGPRIERPWEETVVYELHVGSFTARHPDVPPQYRGTYLGLAEPAVVGHLVRLGVTAVELLPVQAYVSEATVRSRGMRNHWGYSTAAFFAPHPGYAVVPGEEITEFHTMVDALHAAGIEVILDVVYNHTCEQGVDGISLSWRGLDAPGYYLLDSDGRDIDITGCGNTVDAQSPVVVRMIGDSLRYWAHEMGVDGFRFDLASALGRPGGGRFDSRASIFSAITADPVLSRCKLIAEPWDATSDGYRVGHFGVQWSEWNDKYRNTVRRFWNGGTGVRDLASRVAGSEDLFGNRRPWASVNFVTAHDGFTAADLVSYVRKHNEANGEDNRDGADHNDSVDHGVEGPTDDPSIIETRSRHVRALLATLALSTGTPMFTAGDEFGHTLGGNNNAYCVPEDTPREDSWPLDWSTGDTTLTAFVTRALDLRRASPALRQPEFFEGRRTPTGHPDLVWFGADGAEMDDPAWYDDSRRTLQAWIDGSDIRSHTEDGRQLTDDSWLLVFHSGGPAVITLGCPEWFYGTVLAEFDSTSPDGAPAPGGPISGDSTIALSGPTLLVFRAVG

SEQ ID NO: 47495 - protein, 324 aa, Ostreococcus tauri
MFKRARTPEELATKCTDALDKLRRDRANEEQLERVRKYLTEMRTILLSPDVSTQSRALVKAASKVSLATQLVEHLRNLPFETRKDAATVFNCLIRTEVDGQEVVVEELSDSPELLEVIATGYEVTDAALTYGAILRDLCRNQTLVRKILYAESFWKLFEYMQLQTFEIASDAMATFREALTRHKDIAAEFLMANYDRFFKEYTELLEKGNYVTRRQSLKLLGELLLDSANVQVMLKYVAEVENMCFMMNLLRDESKSIQFEAFHIFKVFVANPEKPAMVSTILTKNKAKLITYLQDFQTTREDESFHSERTMLLELLADLPDAE

SEQ ID NO: 47496 - protein, 708 aa, Gibberella zeae PH-1
MASEPENGKGKEPCETTPLMDSHQHSIPLMLPDTRESIPYNDYHTIDWLQDLIKDNQSHDLSTLHTRRGIRHRVSEIWDASQGWVAAFSIGLLTACVAAVVDAWKPWTESYISAYAVYVTMSLAFGIIAGSVTMTTKSKLKSVALEDEQSKRNAKHAPKSGGKTMYMAAGSGIPEIKTVLSGFSIPHLFDLKVLIVKAVGATFAVATGMCLGKEGPFVHISACVGYLVTICFPKYANNQRKLREMLSVACSAGLSVAFGAPIGGVLFSYEEISTHFPRRVLWRSCLCSVVAAAALKELNPTGTGKLVLFETNYGVNYDALHYLVFVVLGICGGVFGGVFCRANFLWAKSFRKISIIKNWPVFELALVALVTAVLQFPNVLIRETGDIVMQRLLVDCNDIEEDWICQQEAKLSGKGTYYAWLISGTFVKLLLTTITFGCKVPSGIIIPAMDAGALFGRTIGQLVPDISPGVFAMVGSAAFLAGVSRMTVSLAVIMFELTGEVNFIPPFMIAILTAKWVADAISADGVYDLAQHLQGHPFLDAEAAIKKVREFRDDNGSATVDVLLPAKDTVDDAIVSVGPNHQVATSVLRNKLSKLQNQGCTDSGLLFVHESGICRGYVSQYKLDNVLQSMEERDGIPEPSEVHVLQGSLAQAIDRSPITISSKAPLEYAVELFGKLGVSYLVVTQEDTATVLGIVSTKHLLAFLDRFR

SEQ ID NO: 47497 - protein, 377 aa, Synechococcus sp. CC9311
MPAGSTAPVGETIGLIVETEAEIADVKAKAPSSAPAAPAAAAPPAAPAPPTPVSAPAAVSAPAPVTAPVAASVSNGRLIVSPRARKLASQMGVDLAGLRGTGPNGRIQAEDVEKAAGRPVTPPRVGEGTSAAAVVGDTVSASPSAPSGNSFGAPGDTVAFNTLQAAVNRNMEASLAVPCFRVGYTITTDKLDAFYKQVKLKGVTMTALLAKAVAVTLARHPQVNAATTASGMSYPAEVNVAVAVAMEDGGLITPVLRNADRTDLYELSRQWGDLVKRSRSKQLQPEEYSTGTFTLSNLGMFGVDRFDAILPPGTGAILAVAASRPTVVAGKDGSIAVKRQMQVNLTADHRVIYGADGAAFLKDLAELIDTRPESLAL

SEQ ID NO: 47498 - protein, 323 aa, Synechococcus sp. CC9311
MATVTELLQPVEADLEILLSDLRSLIGAGHPILQAAAEHLFSAGGKRLRPGIVLLISRALSADGELSSRHRRLAEITEMIHTASLVHDDVVDEASTRRGVETVHSRFNYRVAVLAGDFLFAQASWHLANLDNLDVVKLLSRVIMDLADGEVKQGLFRFDTGQSFETYLEKSYCKTASLIANSAKAAGVLSGLSEPQLESLYHYGRQLGLAFQVVDDILDFTGSDQQLGKPAASDLSSGYLTAPALYALEERPALSGLIEREFSGDGDLETALALVRESEAIPRTRELAKTFAREARESLDWLPESPSRTALLELPDFVLSRLY

SEQ ID NO: 47499 - protein, 194 aa, Oryza sativa (japonica cultivar-group)
ATFLKLAGPQLVQMFIGDGAKLVRDAFQLAKEKAPCIIFIDEIDAIGTKRFDSEVSGDREVQRTMLELLNQLDGFSSDERIKVIAATNRADILDPALMRSGRLDRKIEFPHPSEEARARILQIHSRKMNVNPDVNFEELARSTDDFNGAQLKAVCVEAGMLALRRDATEVTHEDFNEGIIQVQAKKKSSLNYYA

SEQ ID NO: 47500 - protein, 257 aa, Neisseria meningitidis FAM18
MYHQIGMWDQKWVIGNWKMNGRLQNNNSLMHRFRILPTAERVLIGLAAPTVYLLQLHNAMQIVLNNRILTCAQDVSRFPDNGAYTGEVSAEMLADTGTDIVLIGHSERSLYFGEKNEIQRRKMENVLNVGLIPLLCVGESLEEREAGKEHEVIAHQLSILQGLDTKNIAVAYEPVWAIGTGKVATVEQIADMHAFIYKEILSLCGSDVKIRVLYGGSVKADNAADIFAVPYVDGALVGGASLSYDSFTAIISAAQNA

SEQ ID NO: 47501 - protein, 398 aa, Staphylococcus aureus
SFGTPTIVYDELQIREQMRRYHRAFKDSGLKYNISYASKAFTCIQMVKLVAEEDLQLDVVSEGELYTALEAGFEPSRIHFHGNNKTKHEIRYALENNIGYFVIDSLEEIELIDRYANDTVQVVLRVNPGVEAHTHEFIQTGQEDSKFGLSIQYGLAKKAIDKVQQSKHLKLKGVHCHIGSQIEGTEAFIETAKIVLRWLKEQGIQVELLNLGGGFGIKYVEGDESFPIESGIKDITDAIKSEIKVLGIDAPEIGIEPGRSIVGEAGVTLYEVGTIKEIPEINKYVSIDGGMSDHIRTALYDAKYQALLVNRNEEADDSVTIAGKLCESGDIIIKDAKLPSSVKRGDYLAILSTGAYHYSMASNYNQMQKPSVFFLKDGKAREVIKRQSLRQLIINDTK

SEQ ID NO: 47502 - protein, 267 aa, Triticum aestivum
  misc_feature (26)..(26): Xaa can be any naturally occurring amino acid
  misc_feature (53)..(53): Xaa can be any naturally occurring amino acid
MAATAACRSMERRWSLAGSTALVTGXAAKGIGHAIVEELAGLGARVHTCSRKXAELDECRRQWEDKNLRVTVSVCDVSVRAEREKLMNTVRQTLGGKLDILVNNAGQSMVKAATECTGEDYALVMATNIESCFHLAQLAHPLLLRSGGGASSIVHVSSIAGFVGFPGLAVYSMTKGAMNQLTRSLAAEWAGDGIRVNCVAPGGINTDIAKDMITRDPEIVKRQATQLPMQRLGETEEVASVVAFLCMPAASYITGQVICVDGGRTIA

SEQ ID NO: 47503 - protein, 340 aa, Bacillus cereus E33L
MTKIFILASTLSLSFFSGLNIGNAATENFSPITNAIVQNNDHFAEGNSKDNNKPPGNGGSQDDSGSGGNGSDGNGSGGSGSGGNGSGDNGSGGNGSGDNGSGGSGSDGNGSGGNGSGGNGSGDNGSGGNGSDGNGSGGNGSGGSGSDGNGSGDNGSGGNGSGGNGSDGSGSGGNGSGGNGSGGNGSGGNGSGGNGSGGNGSDGSGSGGNGSGSSGSGGNGSGGNGSGGNGSGGNGSGGNGSDGSGSGGNGSGSSGSGGNGSGGNGSDGNGSDGNGSGGSVKGDSSSQSENNLQGGNVKDNAKKQGDKLPNTATHYPASILIGLSTFLMGMLLLIRRKNAK

SEQ ID NO: 47504 - protein, 295 aa, Vibrio cholerae
APANRDILLALFHADGSYETHQLEHEYAGVKHTHISGIHAGQKYGYLIQLNDELHYISDPYARALEGPLHYAPPFDSHKSFDLPKCVVADTHFDWQNVAKPRIARDEMVLFETHVKGLTQLNPDVEKALRGKYLGLVSQPMLDFYRQQNINTLQLLPIAACMHEPHLLESGKVNYWGYNPYVFMAPDPRYASKDAVNELKTTIRELHRNGIQVILDVVYNHTAEGGTNGPVFNLKALDPNYYLHHGDHYANYTGCGNTVDLSNQAALNLVMDTLRCWVTEYQIDGFRFDLAATLG

SEQ ID NO: 47505 - protein, 425 aa, Archaeoglobus fulgidus DSM 4304
MTLIEDARKGVVTDFVKKAAEYEGIEAEKLIRLISHGYVVLPKNVRREEVQPRAIGMLTSTKVNANVGTSADYINVEEEVEKAIIAQKAGADAVMDLSSGGDLDAIRKRIMEVVEVPFGTVPIYQAARDCHRVVDMDEDDFFRVVEKHAKDGVDFMTIHAGVNWVSVERLRRSKRLLGVVSRGGAITIGWMLHNEKENPYYKDFDYLLEILKEYDVTISLGDAYRPGCIHDAGDRAKYTEFIMLGELVEKCREKGVQCMVEGPGHVPLDQIETSVRAMKSVTDNAPLYLLGPLVTDIAAGYDHIAAAIGAAIAGMAGADFICYVTPSEHLALPTVEDVREGVIAAKIAAHAIDLIKEGQRERARQRDYEMSLARKNLDWERQFELSIDPEKAREIYSRRKSESEACSMCGDLCAIKLVKEAFERD

SEQ ID NO: 47506 - protein, 295 aa, Vibrio cholerae
APANRDILLALFHADGSYETHQLEHEYAGVKHTHISGIHAGQKYGYLIQLNDELHYISDPYARALEGPLHYTPPFDSHKSFDLPKCVVTDTHFDWQNVAKPRIARDEMVLFETHVKGLTQLNPDVEKALRGKYLGLVSQPMLDFYRQQNINTLQLLPIAACMHEPHLLESGKVNYWGYNPYVFMAPDPRYASKDAVNELKTTIRELHRNGIQVILDVVYNHTAEGGTNGPVFNLKALDPNYYLHHGDHYANYTGCGNTVDLSNQAALNLVMDTLRCWVTEYQIDGFRFDLAATLG

SEQ ID NO: 47507 - protein, 295 aa, Vibrio cholerae
APANRDILLALFHADGSYETHQLEHEYAGVKHTHISGIHAGQKYGYLIQLNDELHYISDPYARALEGPLHYAPPFDSHKSFDLPKCVVTDTHFDWQNVAKPRIARDEMMLFETHVKGLTQLNPDVEKALRGKYLGLVSQPMLDFYRQQNINTLQLLPIAACMHEPHLLESGKVNYWGYNPYVFMAPDPRYASKDAVNELKTTIRELHRNGIQVILDVVYNHTAEGGTNGPLFNLKALDPNYYLHHGDHYANYTGCGNTVDLSNQAALNLVMDTLRCWVEEYQIDGFRFDLAATLG

SEQ ID NO: 47508 - protein, 295 aa, Vibrio cholerae
APANRDILLALFHADGSYETHQLEHEYAGVKHTHISGIHAGQKYGYLIQLNDELHYISDPYARALEGPLHYAPPFDSHKSFDLPKCVVTDTHFDWQNVAKPRIARDEMVLFETHVKGLTQLNPDVEKALRGKYLGLVSQPMLDFYRQQNINTLQLLPIAACMHEPHLLESDKVNYWGYNPYVFMAPDPRYASKDAVNELKTTIRELHRNGIQVILDVVYNHTAEGGTNGPVFNLKALDPNYYLHHGDHYANYTGCGNTVDLSNQAALNLVMDTLRCWVEEYQVDGFRFDLAATLG

SEQ ID NO: 47509 - protein, 557 aa, Alteromonadales bacterium TW-7
MCSIFGVLDIKSDPAQLRTQAIEMSKLLRHRGPDWSGVYASEKAILVHERLAIVGVSSGAQPLYNPEKTHILAVNGEIYNHKELAANLDTDFTFQTQSDCEVILALYKQKGPEFLDDLNGIFAFCLYDEENDAYLIGRDHIGIIPLYTGHDEHGNFYVASELKALSPICKHIEEFPPGHYLYSKDGKLKPYYKRDWQTFDAVEDNSAESSDVKDALEAAVKRQLMCDVPYGVLLSGGLDSSVISAITQRFAAKRIEDNDESDAWWPKLHSFSVGLEGSPDLAAAQKVADMIGTVHHPIIFTIQEGIDALREVIYHIETYDVTTIRASTPMYLMARQIKAMGIKMVLSGEGADELFGGYLYFHKAPNAQEFHEELNRKVSKLHMFDCLRANKSMAAWGVEARVPFLDKEFVDVAMRINPEAKMCKDGKIEKHILREGFGGYLPDEVLWRQKEQFSDGVGYSWIDTLKEYVEEQVSDQDLANAKFKYPINTPDSKEAYYYRAIFESHFPGDASAKCVPHGKSVACSTPEALAWDESFQNNADPSGRSAGVHNDAYTGKK

SEQ ID NO: 47510 - protein, 147 aa, Magnaporthe grisea 70-15
MLGTAMIKTAALLLAASASVFAAPARPVITHLGSQGPILSGGVMTRDLVYTSGTTPSINGTIPEGISAQTANVINNIAAVLKEAGTSWEYALKTTVFLANMDDYAAMNAVYGELLPNPKPARTTIQAGKLPGNFLVEIEAVVARPHC

SEQ ID NO: 47511 - protein, 439 aa, Oryza sativa
PCVCFALAAAAILFDCHRLRPPPPPAQTHRRANRMELHLTSRGALPLSPPLAGQRRPHLSLSTPSLPIKNHTYSVPPPFSKAHCAIGCQASLATNYMETSAVADLDWENLGFGLVQTDFMYIAKCGPDGNFSKGEMVPFGPIELSPSAGVLNYGQGLFEGLKAYRKTDGYILLFRPEENAIRMRNGAERMCMPAPTLEQFVDAVKQTVLANKRWVPPTGKGSLYIRPLLMGSGAVLGLAPAPEYTFMIFVSPVGNYFKEGLAPINLIIEENFHRAAPGGTGGVKTIGNYASVLKAQRIAKQKGYSDVLYLDAVHKKYLEEVSSCNIFIVKGNVISTPAIKGTILPGITRKSILEVAQRKGFMVEERLVSVDELLEADEVFCTGTAVVVSPVGSITYLGQRVEYGNQGVGVVCQQLYTSLTSLQMGHVDDCMGWTVELNQ

SEQ ID NO: 47512 - protein, 434 aa, Nocardia farcinica IFM 10152
MDNVAVVEATGIEYSDVVIVGSGFGGLAAAKQLAKSNVDYVLISSTPEHLFQPLLYQVATGVLAAEEIAPPIAKILRRHDTADVRQGTVVAIEPDTAVLTYRTPGGELRRIRYGSLIAATGASQSYFGRDDFAEKTYSLKTIEDAKLLRAQIERVFTEAATADEATRQRLLSFVVVGAGATGVEVAGQLTELAKRHFHQEVSVTLVEGAGAVLPPFGGGLSEYAKKSLAKGGVEVLLDTFVTDIEPGKVTVKDKAGVERKIAAETVVWSAGVQAGGFAEILAEATGVETDRAGRLLINPDLTVGGYADIYAIGDMTSLNGYPGQSPVAMQEGRHAADIIRRKKQPGTPFVYWDKGSMAVISRFSAVAKLNEHITFRGVIAWFMWLAVHLFYLVGFRNRFAAVASWLVAFIGTGRPGFDEVDRTVEEPGRERVAA

SEQ ID NO: 47513 - protein, 377 aa, Gossypium hirsutum
MADGEAIQPLVCDNGTGMVKAGFAGDDAPRAVFPSIVGRPRHTGVMVGMGQKDAYVGDEAQSKGGILTLKYPIEHGIVSNWDDMEKIWHHTFYNELRVVPEELPVLLTEAPLNPKANREKKTQIMFETFNVPAMYVAIQAVLSLYASGRTTGIVLDSGDGVSHIVPIYEGYALPHAILRLDLAGRDLTDALMKILTERGYMFTTTAEREIVRHMKEKLAYVALDYEQELETAKSSSSVEKNYELPDGQVITIEAERFRCPEVLFQPSFIGMEAAGIHETTYNSIMKCDVDIRKDLYGNIVLSGGSTMFPGIADRMSKEITALAPSSMKIKVVAPPERKYSVWIGGSILASLSTFQQMWISKGEYDESGPSIVHRKCF

SEQ ID NO: 47514 - protein, 53 aa, Leucaena leucocephala
CPFNLAPVTSTAIQMVFGDTVAIALMQARKLSKEDYASNHPAGRIGKHLIFKV

SEQ ID NO: 47515 - protein, 801 aa, Bacillus anthracis str. Ames
MKKRLVMIGNGMAGIRCMEEILKHDCDSYEITIFGDEPHPNYNRIMLSHVLQGKTNIQDIIMNEYSWYEENEITLYTNERVQSIDREEKVIMTEKNRTLTYDKLIIATGSSAFILPVEGSTLPGVTGFRTIEDTQFMMDTAKEKKKAVVIGGGLLGLEAARGLIDLGMDVHVVHLMPSLMEQQLDTKAASLLREDLEAQGMKFLMEKKTVKILGTNHVEGIQFEDGEVVDCDLIVMAVGIRPNTQIARDAGLIVNRGIVVNDYMLTNDESIYAVGECAEHDGIAYGLVAPLYEQGAILAKHISNLQTDGYSGSIVGTQLKVAGCDLFSAGQIYEDDQTKAISIFNECKRSYKKVLIRDNKVVGIVLYGDTADGTRLFSMLKKEEDIQEYTPASILHKAGEESELDVATMSADDTICGCNGVTKGTIVHAILEQELTTFEEVKGCTKAAGSCGKCRPLVEQVLSHTLGDAFDASAQSAGMCGCTPLSRDEVVAAIHEKGLKSPKEVRNVLGFVHEDGCSKCRPALNYYLRMAIPEEYEDDKASRFVNERMNGNIQHDGTFSVIPRMYGGVTTADDLMKIAEVAKKYDVPLVKITGASRIGLYGVKKQDLPNVWADLNMTSGYAYSKSLRNVKSCVGSRFCRFGTKDSLGLGMLLEQSLEMVDTPHKMKMGVTGCPRNCAEVLTKDFGVVCVENGYQLYIGGNGGTEVREADFVMIVPTEDDVLHIATAYMQYYRETGIYGERTAYWTERLDFDHIKEILQDANMVTKLNERFQTARGTYKEAWGQALETKSLKAMYEVETVK

SEQ ID NO: 47516 - protein, 252 aa, Ostreococcus tauri
MSQYEEEQAMEIEALESIFMDDMKRLPENSGDGIAHASSSCYQVEISAYGENDSEPEEGKERDDAVLGLVFAHTERYPDEPPLLKCRSVRGLREGELGEISALVLEQSETSVGQAMIFDLTQTCKDWMRRRAGASDFVDEETEEELRARLEHEAEERLRQMRINGTPVTIENFKSWQLAFIKERGESFNPGRVRDADELTGRQYFESARKSGKDVEADGGDGSEGDFEPDTDSSEDDFADSDSDVSSVDADA

SEQ ID NO: 47517 - protein, 149 aa, Daucus carota
MASYGEGGYGGQKHHGSDEYGNPVRQTDEYGNPVQHTTGGTGMHGTGATTGAHGVGLSTGSDGQPRLNRSGSSSSSSSEDDGMGGRRKKVGMKQKIKGMLPGGHKEDQQTQTTTPVMGGSYGATGTGEQPEEKKGIMDKIKDKLPGGHH

SEQ ID NO: 47518 - protein, 509 aa, Geobacter metallireducens GS-15
MSRTFYVTTPIYYVNDVPHIGHAYTTLAADVLARYKRLKGYDVFFLTGTDEHGQKVEKAANAAGETPLELADRVVKRFQALWEKLDISYNDFIRTTQERHKKGVTHLFREVMAKGDIYLGEYEDWYCTPCETFWTETQLIDGKCPDCNRPVEKLKEESYFFRMSKYQEQLLAHIEANPDFIQPKSRRNEIISFVKEGLRDLSVSRTSFNWGIPVPGNERHVIYVWFDALTNYITALGYPDQAGNYGKFWPVDAHLIGKDILRFHAVYWPTFLMAAGLPVPRKVFAHGWWTVEGQKMSKSLQNVVEPNMLVDKYGIDAVRYFLLREVPFGLDGDFSHAALVHRINSDLANDLGNLLSRSTAMVNKYFGGTLPQPGAMTELDAAFRARTEAMISQLESCMDEMAFSKGLQAIWEVISAGNKYIDESAPWTLAKDPAQKERLGTIMYTLLEAQRIVHTLLSAFMPRTAAKALGYLGCMEALRDEDLAWGKLVPGTQIAKAEALFPRIEDKAE

SEQ ID NO: 47519 - protein, 125 aa, Geobacter metallireducens GS-15
MKEIIATDKAPKAIGPYSQAVKAGGFLFLSGQIPLDPATGEFVPGGIREQTDRVMDNIAAVLAEAGLGFDAVVKTTIFLTDLANFGVVNEVYGSRFSAEPPARSTVEVKGLPRGALVEIEVLALC

SEQ ID NO: 47520 - protein, 291 aa, Daucus carota
MASGGQFPPQKQESQPGKEHLMDPSPQHASPHYKPANKLQGKVALVTGGDSGIGRSVCYHFALEGATVAFTFVKGHEDKDANETLELLRKAKSSDAKDPIAIAADLGFDDNCKKVVDQVVNAFGSIDVLVNNAAEQYKASTVEDIDEERLERVFRTNIFAYFFMARHALKHMREGSTIINTTSINAYKGNAKLLDYTATKGAIVAFTRGLSLQLISKGIRVNGVAPGPVWTPLIPSSFDEEEVKQFGSEVPMKRAGQPYEIATAYVFLASCDSSYYSGQVLHPNGGAIVNG

SEQ ID NO: 47521 - protein, 487 aa, Hordeum vulgare subsp. vulgare
MNQSGMARSDEGSLVPREVPGSYGLPFVSAIRDRLDFYYFQGQDKYFESRVEKYGSTVVRINVPPGPFMARDPRVVAVLDAKSFPVLFDVTKVEKKNLFTGTYMPSTSLTGGFPVCSYLDPSEPTHTKVKQLLFSLLASRKDAFIPAFRSHFSSLLATVESQLLLSGKSNFNTLNDATSFEFIGDGYFGVLPSASDLGTTGPAKAAKWLIFQLHPLVTLGLPMILEEPLLHTVHLPPFLVSGDYKALYKYFFAAATKALDTAEGLGLKRDEACHNLLFATVFNSYGGLKVLLPGILARIADSGEKFHKKLVTEIRAAVAEAGGKVTIEALEKMELTKSAVWEALRLDPAVKFQYGRAKADMNIESHDAVFAVKKGEMLFGYQPCATKDPRVFGPTAREFVGDRFVGKEGSKLLKYVYWSNGRETESPSVHNKQCPGKNLVVLVGRLLVVELFLRYDTFTAKVGLDLLGTKVEFTGVTKATSGVADAV

SEQ ID NO: 47522 - protein, 378 aa, Aspergillus nidulans FGSC A4
METPSNARRSGLAGTARKTLGICLLLVVVILWTASNFLASTLFSDDTYSKPFFVTYLNTSIFILPLFTIVSSRLWSLFRAGKLYQIQSFETLLQRFDSSYSSAESERILSHDHGTGPGADFGHGHGHDGSGAWSASRRGSVGKGHRKEKLGLKETAKLSFHFCLLWFTANYFSMACLQFTTVGSTTILTSTSGVWTLIFGAVLRVEKFTGRKFLGVIASLLGIILISRVDLSATDDPSAGRDGSGSTFPPKSAGEIALGDAMAAFSAVMYGVYTVVLKRQVGDESRVNMQLFFGLVGVFNMFLLWPGFVLLHLTGVEPFALPNTRRVWMIILINALSSLLSDICWAYAMLLTSPLVVTVGLSLTIPLSLIYDEARYRN

SEQ ID NO: 47523 - protein, 374 aa, Zea mays
MLGAARRQLGSGPMLGQVLRRLRPAAAAEVARGYSAAAKEMTVRDALNSALDEEMSADPSVFLMGEEVGEYQGAYKISKGLLDKYGPDRVLDTPITEAGFTGIGVGAAYQGLRPVIEFMTFNFSMQAIDHIINSAAKSNYMSAGQISVPIVFRGPNGAAAGVGAQHSQCYAVWFAHVPGLKVLTPYSSEDARGLLKAAIRDPDPVIFLENELLYGESFPVSAEVLDSSFCLPIGKAKIERGGKDVTITAFSKMVGYALQAAEILSKEGISAEVINLRSIRPLDRAAINASVRKTNRLVTVEEGFPQHGIGAEICMSVVEESFEYLDAPVERIAGADVPMPYAANLERMAVPQVDDIVRAAKRACYRAVPMAAAA

SEQ ID NO: 47524 - protein, 134 aa, Triticum aestivum
  misc_feature (6)..(6): Xaa can be any naturally occurring amino acid
FHLSQXAHPFLLNATIAGGGSIVNISSHAGSLGFPGLALYSMAKGGINQLTRSLATEWAQNKIRVNCVAPSATKTDMLNSLGPEIIENELARTPMRRAGEPAEVATVVSFLCMPAASFVTGQVITVDGGRTISG

SEQ ID NO: 47525 - protein, 145 aa, Saccharomyces cerevisiae
MFLRNSVLRTAPVLRRGITTLTPVSTKLAPPAAASYSQAMKANNFVYVSGQIPYTPDNKPVQGSISEKAEQVFQNVKNILAESNSSLDNIVKVNVFLADMKNFAEFNSVYAKHFHTHKPARSCVGVASLPLNVDLEMEVIAVEKN

SEQ ID NO: 47526 - protein, 285 aa, Saccharomyces cerevisiae
MELSSPSKKTTTSPINIPGGNRDNLIIGPHSHSFKTDPFSSNNSSLLSKISTNPSLESPFSSKSLLDCSPVQAVKKSLESEAKTHSLDEETNEQTDVKILNIADFPTDELILMISALLNRIITANDETTDVSQQVSDETEDELLTPILAFYGKNVPEIAVVQYLERIQKYCPTTNDIFLSLLVYFDRISKNYGHSSERNGCAKQLFVMDSGNIHRLLITGVTICTKFLSDFFYSNSRYAKVGGISLQELNHLELQFLILCDFKLLVSVEEMQKYANLLYKFWNDQ

SEQ ID NO: 47527 - protein, 380 aa, Saccharomyces cerevisiae
MNCIPSPISERKIQINNEDCIGKENAFHTIPRESSINLTPHSTNEKKVLSEVNSNKIDSLQLPRGKLQRDSTHLEKTRKRQLSNDSTDPIEPKTVKKIKCHQWKNLDSIEMDDPFMVAEYTDSIFSHLYEKEIQMLPTHNYLMDTQSPYHLKSSMRALLIDWLVEVHEKFHCLPETLFLAINLLDRFLSQNVVKLNKLQLLCITCLFIACKFEEVKLPKITNLAYVTDGAATVEGIRKAELFVLSSLGYNISLPNPLNFIRRISKADNYCIETRNMAKFIMEYSICCNKFIHLKPSYLAAMSMYIARKIKNENSKWDETFIHYSGGIDIESDPAFKDFISELVEDIAVPDTNLDSLRLKYKKPKHGMVYFKVFDWCKQKR

SEQ ID NO: 47528 - protein, 334 aa, Oceanospirillum sp. MED92
MGVITRWPQDQLCLSYREREEAVAAVEKAFASTLESLKVDIGLVDMFEAIYVPLGAWLACRKRQKDGPLVMGINGAQGAGKSTLFNLIEVILTEGFGLKVVGFSIDDLYKTYDERVELSETIHPLLRTRGVPGTHDVGLGVEILNSLKNSDENTVTKIPVFDKSTDDRCQAAVWQEWVGPADVIVLEGWCVGADPQAPEALVEPINALEKEKDPNGAWRDYVNAQLAGAYSELFSMIEVLVMLKVPSMDAVFEWRSLQEKKLAERVKYIYDTQQPTEHLRIMNEEQIQRFIQHYERLTRHMLEEMPSRADITLHLNDNHKISEITINNPLQSCG

SEQ ID NO: 47529 - protein, 492 aa, Mycobacterium sp. MCS
MAGHGGAPVGGDLPIGDDEFTSGKTAIRIASVAALGGLLFGYDSAVINGAVDSIQEDFGIGNASLGFAVASALLGAAAGAMTAGRIADKIGRIAVMKIAAVLFLISAFGTGFAHEVWAVVLFRIVGGIGVGVASVIAPAYIAETSPPSIRGRLGSLQQLAIVSGIFLSFVVNWLLQWAADGPNKPLWFGVDAWRWMFLAMAVPAVVYGALAFTIPESPRYLVASHKIPEARRVLSTLLGKKNLEITITRIRETLEREDKPSWRDLRKPTGGLFGIVWVGLGLSIFQQFVGINVIFYYSNVLWQAVGFSADESAVYTVITSVINVLTTLIAIALIDKIGRKPLLLIGSSGMAVTLITMAVIFANATLDADGNPSLPGASGVIALIAANLFVVAFGMSWGPVVWVLLGEMFPNRIRAAALGLAAAGQWAANWLITVTFPGLREHLGLAYGFYGMCAILSGLFVWRWVRETKGVSLEDMHGEILKHDLPTGAKEG

SEQ ID NO: 47530 - protein, 377 aa, Gossypium hirsutum
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDALMKILTERGYMFTTTAEREIVRDMKEKLAYVALDYEQELETAKSSSSVEKNYELPDGQVITIGAERFRCPEVLFQPSFIGMEAAGIHETTYNSIMKCDVDIRKDLYGNIVLSGGSTMFPGIADRMSKEITALAPSSMKIKVVAPPERKYSVWIGGSILASLSTFQQMWISKGEYDESGPSIVHRKCF

SEQ ID NO: 47531 - protein, 377 aa, Gossypium hirsutum
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTHIMFETFNVPAMYVAIQAVLSLYASGRTTGIVLDSGDGVSHTVPIYEGYALPHAILRLDLAGRDLTDALMKILTERGYMFTTTAEREIVRDMKEKLAYVALDYEQELETAKSSSSVEKNYELPDGQVITIGAERFRCPEVLFQPSFIGMEAAGIHETTYNSIMKCDVDIRKDLYGNIVLSGGSTMFPGIADRMSKEITALAPSSMKIKVVAPPERKYSVWIGGSILASLSTFQQMWISKGEYDESGPSIVHRKCF

SEQ ID NO: 47532 - protein, 377 aa, Gossypium hirsutum
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRVDLAGRDLTDSLMKILTERGYMFTTTAEREIVRDMKEKLAYVALDYEQELETAKSSSSVEKNYELPDGQVITIGAERFRCPEVLFQPSLIGMEAAGIHETTYNSIMKCDVDIRKDLYGNIVLSGGSTMFPGIADRMSKEITALAPSSMKIKVVAPPERKYSVWIGGSILASLSTFQQMWISKGEYDESGPSIVHRKCF

SEQ ID NO: 47533 - protein, 294 aa, Mycobacterium sp. MCS
MRRMTSVHGKVVLITGGARGVGEELARRLHAKGAKLVLTDLDDGPLSALAADLGAERVLTVVADVCDLETMQSAAEQAVSRFGGIDIVIANAGIASYGSVLVVDPDAFRRVLDVNVVGVFNTVRAALPSVIERKGYILVVSSLAAFAAAPGMAPYDASKAGVEHFANALRLEVAHHGVTVGCAHMSWIDTPLVQDTKADLPSFRTMLDSLPGPLSKTTSVQKCGEVFVKGIERRRERIYCPGWVGLIRWAKPILTTRIGQASVLKTAPKVLPQMDAEVTALKRSLGARTHGLKK

SEQ ID NO: 47534 - protein, 311 aa, Novosphingobium aromaticivorans DSM 12444
MPLETLPVISLAGEPDALSRELGESFRTFGFAMVRDHGIDPDLIARAWDLTAQFFALPEAEKRSYYLDGLAGARGYTPFGTEIAKGARLHDLKEFWHVGRDLPAGHPLSASMPPNVWPARPEGFRQTFETLYGEFDKVGARILSRIAVWLGLDENWFDPAIEDGNSVMRLLHYPPVPDAESGAIRAGAHEDINLITLLLGAEEAGLELLSRQGEWIGVSPPEGALVVNIGDMLQRLTNHVLPSTTHRVRNPEGERARFSRYSMPFFLHLRSDFPFVTLPQCISDENPDRYPVSITADDYLQERLREIGLRK

SEQ ID NO: 47535 - protein, 377 aa, Gossypium hirsutum
MADGEDIQPLVCDNGTGMVKAGFAGDDAPRAVFPSIVGRPRHTGVMVGMGHKDAYVGDEAQSKRGILTLKYPIEHGIVSNWDDMEKIWHHTFYNELRVAPEEHPVLLTEAPLNPKANREKMTHIMFETFNVPAMYVAIQAVLSLYASGRTTGIVLDSGDGVSHTVPIYEGYALPHAILRLDLAGRDLTDALMKILTERGYMFTTTAEREIVRDMKEKLAYVALDYEQELETAKSSSSVEKNYELPDGQVITIGAERFRCPEVLFQPSFIGMEAAGIHETTYNSIMKCDVDIRKDLYGNIVLSGGSTMFPGIADRMSKEITALAPSSMKIKVVAPPERKYSVWIGGSILASLSTFQQMWISKGEYDESGPSIVHRKCF

SEQ ID NO: 47536 - protein, 368 aa, Bdellovibrio bacteriovorus HD100
MTNKRIEWPVALFLVLNPLITLILAPIYFYNFGFQWDILLFALVFAAATNLGITAGYHRLFSHKSYDAHPIVKALFLLIGASAFQGSALKWSSDHRRHHTHIDGEKDPYNINEGFWYAHMGWMFFKDSVDQKIHAPDLEKDWMVKFQNDHYVPIAILTGFIFPMLVGWAMGSWLGGLVIAGGLRIALTQQSTFFINSLCHTLGKQTYSKEISARDSWFVAILTHGEGYHNFHHKFQIDYRNGIKWYHWDPTKWVIRTLSAMGLATKLRQISNVEILKARLQAEAAELTKHGFAEEKLAQMKEKILEAQNRMKKLREDYEQFKVDAVRKREELKEAYDHKLEELRRDMEIARLEFQMGMKQWRVYLRSV

SEQ ID NO: 47537 - protein, 377 aa, Gossypium hirsutum
MADGEDIQPLVCDNGTGMVKAGFAGDDAPRAVFPSIVGRPRHTGVMVGMGHKDAYVGDEAQSKRGILTLKYPIEHGIVSNWDDMEKIWHHTFYNELRVAPEEHPVLLTEAPLNPKANREKITHIMFETFNVPAMYVAIQAVLSLYASGRTTGIVLDSGDGVSHTVPIYEGYALPHAILRLDLARRDLTDALMKILTERGYMFTTTAEREIVRDMKEKLAYVALDYEQELETAKSSSSVEKNYELPDGQVITIGAERFRCPEVLFQPSFIGMEAAGIHETTYNSIMKCDVDITKDLYGNIVLSGGSTMFPGIADRMSKEITALAPTSMKIKVVAPPERKYSVWIGGSILASLTTFQQMWISKGEYDESGPSIVHRKCF

SEQ ID NO: 47538 - protein, 335 aa, Ostreococcus tauri
MKRNKKRRERERASEDADPSTAGLARAAVDVASDSEDEFAASEFSEKRARATVKGSGYVVEGGAGARVEHTGINKSEKTLVLASRGTTSRYRHLMLDLTTLVPNAKRDAKMDTKNERSAVVEAADLRGCTSAMFFECRKRQDCYMWLAKTPSGPSIKFHVENVHTMAELKMTGNHLKFSRPSLHFAPAFDDEPHRRLIKEALIQTFATPYRHFKSKPFYDHQLCFYWEDGRVWFRNYQVVHPAGKEARQTGLTLSETGPRLCLHPIKIFAGAFAGAVLFEDESFVSPNIRRAEEKKKDVERYQKKVQKKQARKAHKSMNALKAGELDDLFREGDD

SEQ ID NO: 47539 - protein, 412 aa, Shewanella oneidensis MR-1
MRRLAIPLQGAQMLFVAFGALVLMPLLTGLDTSVALFTAGIGTLLFQLITKRQVPIFLASSFAFIAPILYGVQTWGIPSTMGGIMAAGVVYVCLGALVKVRGTDFIHKLLPPVVVGPVIIIIGLGLAPVAVNMALGKSGDGSLALVPTNTALIISLVSLCTTIAVAIFAKGLLKVMPILAGIIVGYGLSLAFGIVDFSVVTAANWIAIPKFVAPEFNWHAIAFMIPVAIAPAVEHIGDILAISNVTGKDFMKKPGLHRTLTGDGVATIAAAAFGGPPNTTYSEVTGAVTLTRNFDPRIMTWTAITAITLAFVGKLGALMQTIPVPVMGGIMCLLFGSIAAVGLNTLIRNHVDLSEPRNLSIVGVTLVFGIGGMAFGIGSFSLTGISLCGIVAITMNLLLPASKHHKQDVASH

SEQ ID NO: 47540 - protein, 110 aa, Shewanella oneidensis MR-1
METVEKIKQQIGENPIIVYMKGSPKLPSCGFSCQVAQIMINCGEQFAFVDILQHPDIRAELPKYANWPTFPQLWIEGELIGGCDIVVDMYQKGELQPLIKATAEKYKTAE

SEQ ID NO: 47541 - protein, 205 aa, Triticum aestivum
  misc_feature (172)..(172): Xaa can be any naturally occurring amino acid
MEAERSQLSPIDPRRARFPCCIVWTPIPFITWLMPFIGHIGICREDGVILDFAGPNFVSVDNFAFGAVTRYIQLNGDECYKLLDTGAETTWDGALRKGVQEFQNRNYNLFTCNCHSFVANNLNRLFYAGHDKWNVVSLAAVMFLRGRWVSAGAVVKTLAPFVVVLALGVLLXGGTTFLLGLLAFAAVMAGWFLVGTYCIKGLVEL

SEQ ID NO: 47542 - protein, 480 aa, Hordeum vulgare subsp. vulgare
MNQSAIGSLVPRQAPGSYGLPFVSAIRDRLDFYYFQGEAKYFESRVEKHGSTVLRINVPPGPFMARDPRVVAVLDAKSFPVLFDVDKVEKKNLFTGTYMPSTSLTGGFRVCAYLDPSEPTHTKVKQLLFSLLASRKDAVIPAFRSHFSSLLATVESQLVLSGKSNFNTLNDFTSFEFIADTYFGVLPSASDLGTTGPAKAAKWLIFQLHPLVTFGLPMILEEPLLHTVLLPPIFVSGDYKALYKYFYAAATKALDMAESLGLNRDEACHNLLFATVFNSYGGLKVMLPGFLGRIAEAGEKFHQRLAAEVRTAVADAGGKVTIEALEKMELTKSAVWEALRLEPPVKFQYGRAKVDMNIESHDAVFAVQKGEMLFGYQPCATKDPRVFGSTAREFVGDRFVGEGSKLLQYVYWSNGRETESPSVDNKQCPGKNLVVLVGRLLVVELFLRYDTFTADVGVDLLGPKVEFTGVTKATSGPGAV

SEQ ID NO: 47543 - protein, 427 aa, Neisseria meningitidis FAM18
MNRNEILFDRAKAIIPGGVNSPVRAFGSVGGVPRFIKKAEGAYVWDENGTRYTDYVGSWGPAIVGHAHPEVIEAMREAALGGLSFGAPTEGEIVIAEEIAKIMPSVERLRLVSSGTEATMTAIRLARGFTGRDKIIKFEGCYHGHSDSLLVKAGSGLLTFGNPSSAGVPADFTKHTLVLEYNNIAQLEEAFAQSGNDIACVILEPFVGNMNLVRPSEAFVKALRELTEKHGAVLIYDEVMTGFRVALGGAQSLHGITPDLTTMGKVIGGGMPLAAFGGRKDIMECISPLGGVYQAGTLSGNPIAVAAGLKTLEIIRREGFYENLTARTEQLVQGFRTAADAAGIEFTADSVGGMFGLYFAAHAPRNYADMARSNIDAFKRFFHGMLDRGIAFGPSAYEAGFVSAAHTPELIDETVAVAVEVFKAMAA

SEQ ID NO: 47544 - protein, 559 aa, Marinobacter sp. ELB17
MMNFEQFYQGKYPQGMALDVDLAKYASMVDVFNQAVTKYADRPAVSAVGVTLSYRDLDVHSRNFAAWLQNKTDLKPGDRIAVQMPNVCQYLVVTFGAMRAGLIVVNTNPLYTTREMEHQFNDSGAKALVVLANMAANVEKVLPNTSIEHVIVTEVADMHSTFKRTLMNTVVKHVKKMVPAYNLPQAHKLPAVLAAGAREKFTPVECKKDDIAVLQYTGGTTGVAKGAMLTHGNLVANLLQIRPMLEDNIIEGREVVIAPLPLYHIYSFTLNCGTLLEAGAHNVLIPNPRDIDAFVKELQNHEFTAFLGLNTLFVALCNNEEFCKLDFSHLKLTASGGMALTSKAAKTWKRVTGCEICEGYGMTETSPVVSFNPRSAIQLGTIGLPLPGTLLKTVDDDNNETPFGERGELCVKGPQVMRGYWQRPDDTRKSMTDDGYLRTGDVAVIQEDGYIRIVDRKKDMIIVSGFNVFPNEVEDVISGHPNVLECAAVGIPDEKSGEAVKVYLIASKEGVTAGELKEFCRERLTAYKVPRHFEFRTELPKTNVGKVLRRELRDEASNH

SEQ ID NO: 47545 - protein, 298 aa, Saccharomyces cerevisiae
MSTSVPVKKALSALLRDPGNSHCADCKAQLHPRWASWSLGVFICIKCAGIHRSLGTHISKVKSVDLDTWKEEHLVKLIQFKNNLRANSYYEATLADELKQRKITDTSSLQNFIKNKYEYKKWIGDLSSIEGLNDSTEPVLHKPSANHSLPASNARLDQSSNSLQKTQTQPPSHLLSTSRSNTSLLNLQVSSLSKTTSNTSVTSSATSIGAANTKTGNRVGEFGQRNDLKKSILSLYSKPSAQTQSQNSFFTSTTPQPCNTPSPFVNTGITATNNNSMNSNSSSNISLDDNELFKNVWS

SEQ ID NO: 47546 - protein, 1071 aa, Neisseria meningitidis FAM18
MPKRTDLKSILIIGAGPIVIGQACEFDYSGAQACKALREEGYKVILVNSNPATIMTDPEMADVTYIEPIMWQTVEKIIAKERPDAILPTMGGQTALNCALDLARNGVLAKYNVELIGATEDAIDKAEDRGRFKEAMEKIGLSCPKSFVCHTMNEALAAQEQVGFPTLIRPSFTMGGSGGGIAYNKDEFLAICERGFDASPTHELLIEQSVLGWKEYEMEVVRDKNDNCIIICSIENFDPMGVHTGDSITVAPAQTLTDKEYQIMRNASLAVLREIGVDTGGSNVQFAVNPENGEMIVIEMNPRVSRSSALASKATGFPIAKVAAKLAVGFKLDELRNDITGGKTPASFEPSIDYVVTKIPRFAFEKFPAADDRLTTQMKSVGEVMAMGRTIQESFQKALRGLETGLCGFNPRSSDKAEIRRELANPGPERMLFVADAFRAGFTLEEIHEICAIDPWFLAQIEDLMKEEKAVSDGILSDLDFAALRRLKRKGFSDKRLAQLLNVSEKEVREHRYALKLHPVYKRVDTCAAEFATETAYLYSTYEEECESRPSDRKKVMILGGGPNRIGQGIEFDYCCVHAALALRESGFETIMVNCNPETVSTDFDTSDRLYFEPLTLEDVLEIVRTENPWGVIVHYGGQTPLKLANALVENGVNIIGTSADSIDAAEDRERFQKVLNDLGLRQPPNRIAHNEEEALVKAEEIGYPLVVRPSYVLGGRAMQIVHSAEALQKYMREAVQVSEDSPVLLDFFLNNAIEVDVDCVSDGKDVVIGGIMQHVEQAGIHSGDSGCSLPPYSLSEEIQDEIRRQTKAMAYALGVVGLMNVQFAVQDGVVFVLEVNPRASRTVPFVSKATGVPLAKVGARCMAGISLKEQGVEKEVVPDFYAVKEAVFPFIKFPGVDTILGPEMRSTGEVMGVGASFGEAYYKAQLGAGERLNPTGKIFLSVREEDKERVIKTAKNFQVLGYGICATRGTAQYLTEQGLIVQTINKVPEGRPHIGDALKNGEIALVVNTVSSDPQSVSDSHIIRQSALQQRVPQYTTTAGGEAMSEGAKSRDHLGVYSVQELHGRLKNRN

SEQ ID NO: 47547 - protein, 666 aa, Streptococcus pyogenes M49 591
MMKKPFTITTPIYYPSGKLHIGSAYTTIACDVLARYKRLMGHEVFYLTGLDEHGQKIQTKAKEAGISPQTYVDNMAKDVKALWQLLDISYDTFIRTTDDYHEEVVAAVFEKLLAQDDIYLGEYSGWYSVSDEEFFTESQLKEVFRDEDGQVIGGIAPSGHEVEWVSEESYFLRLSKYADRLVAFFKERSDFIQPDGRMNEMVKNFIEPGLEDLAVSRTTFTWGVPVPSDPKHVVYVWIDALLNYATALGYGQANHANFDKFWNGTVFHMVGKDILRFHSIYWPILLMMLDLPMPDRLIAHGWFVMKDGKMSKSKGNVVYPEMLVERFGLDPLRYYLMRSLPVGSDGTFTPEDYVGRINYELANDLGNLLNRTVAMINKYFDGTVPAYVDNGTAFDADLSQLIDAQLADYHKHMEAVDYPRALEAVWTIIARTNKYIDETAPWVLAKEDGDKAQLASVMAHLAASLRVVAHVIQPFMMETSAAIMAQLGLAPVSDLSTLALADFPANTKVVAKGTPIFPRLDMEAEIDYIKAQMGDSSAISQEKEWVPEEVALKSEKDVITFETFDAVEIRVAEVKEVSKVEGSEKLLRFRVDAGDGQDRQILSGIAKCYPNEQELVGKKLQIVANLKPRKMMKQYISQGMILSAEHGDQLTVLTVDSSVPNGSIIG

SEQ ID NO: 47548 - protein, 631 aa, Magnaporthe grisea 70-15
MSPSEVLQFPADDRIEPGSTDYPAAQFPTIKNTSVDVDAAADDIVGAFNKALDAGDANAVAALFLPDGASHGYWRDHLCLTWVMRTLKGRGQIGSFLASEIPHDGGDVKLPKRIAVDRSSAFRSPTLTAFEASGTHKCIGFHVEVEAQNGKGRGLARLAEGEDGKLYIATLFTTLLEIDGHPEPVRARRAKGVEHKGTHDEPNWRERREAAAGFGEQQPTVLVVGAGQAGLSVAARLQMQGVPTLVIDRNPRVGDSWRNRYHHLVLHDPIWFDHMPYIPFPDHWPVFTPKDKIADFFEAYVSLLELNVWTDTNLADSSWDEEKREWTVKLERAGETRTVRPKHIIQATGHSGKKNFPQIKGMDAFKGTRLCHSSEFPGATPNSAGKRAVVVGSCNSGHDIAQDFYSKGYDVTMVQRSSTCVIGSNAIVNIGLAGLYEEGGPPTEDADVVLYSYPFEQFKAAQRAVTALQNEADREILEALERAGFKVDMGPEACGLFIKYFQRGGGYYMDVGASRLVADGKIKIKQGCEISEVQADGLLFADGQKLEADEIVFATGYLNMRGEARAIFGDALADRVDDVWGFDDKGEHRTIWSRSGHPGFWFMGGNLALCRYFSRLLALQIKAAELGLNKL

SEQ ID NO: 47549 - protein, 351 aa, Ipomoea hederacea
ERLASSGIERIPKEYIRPEEERRSIGDIFEEEKIAGGPQVPTVDLKGINSEDLEVREKCREELRKAAVDWGVMHLVNHGIPEELTGRVKAAGEGFFGQPIEEKEKYANDQAAGNVQGYGSKLANNASGQLEWEDYFFHCIFPEDKTDLSIWPKTPSDYIDATKEYAKQLRALATKVLAVLSLGLGLEEGRLEKEVGGMEELLLQMKINYYPKCPQPELALGVEAHTDVSALTFILHNMVPGLQLFYGGKWVTAKCVPNSIIMHVGDTVEILSNGKYKSILHRGVVNREKVRVSWAVFCEPPKDKILLQPLPETVSEAEPPRFPPRTFAQHIKHKLFRQSDQEAADTPKPDN

SEQ ID NO: 47550 - protein, 256 aa, Zea mays
MSHFGRSGPPDIRDTFSLLVLNISFRTTADDLFPLFERYGKVVDVFIPRDRRTGDSRGFAFVRYKYADEAQKAIDRLDGRDVDGRNIMVQFAKYGPNAEPIRKGRVKEGVEKSQDRSRSRSPRPRHRDRDHRSQSRSRSRERHVRDRDRGYRRRSRSRSRSLSSSPDNRSHHRARDDDKRKSMSKSRSRSRSTSRSRSYYSASPARHSASPRKSPPPQRSPTPAKHANGKVAPLSRCVSPLPKRATSRSPGSDGKE

SEQ ID NO: 47551 - protein, 351 aa, Ipomoea purpurea
ERLAGSGIERIPKEYIRPEEERRSIGDIFEEEKIAGGPQVPTVDLKGINSEDLEVREKCREELRKAAVDWGVMHLVNHGIPEELTGRVKAAGEGFFGQPIEEKEKYANDQAAGNVQGYGSKLANNASGQLEWEDYFFHCIFPEDKTDLSIWPKTPSDYIDATKEYAKQLRALATKVYAVLSLGLGLEEGRLEKEVGGMEELLLQMKINYYPKCPQPELALGVEAHTDVSALTFILHNMVPGLQLFYGGKWVTAKCVPNSIIMHVGDTVEILSNGKYKSILHRGVVNKEKVRVSWAVFCEPPKDKILLQPLPETVSWTEPPRFPPRTFAQHIKHKLFRQSDQEAADTPKPDN

SEQ ID NO: 47552 - protein, 186 aa, Oryza sativa (japonica cultivar-group)
MAAAAAGGGGFEARVARIASTIRVIPDFPKPGIMFQDITTMLLKPDAFRDTIELFVERYKDKGITVIAGVEARGFIFGPPIALALGAKFVPLRKPKKLPGEVISEEYSLEYGTDKIEMHVGAVEPNGRAVVVDDLIATGGTLSAAVKLIERAGAEVVECACVIELPELKGRDKLGNKPVFVLVKAD

SEQ ID NO: 47553 - protein, 343 aa, Rhodococcus sp. RHA1
MRIGMLTGGGDCPGLNAVIRAVVRTAAGRYGSSVVGFRDGWRGLLEDRKVVLSNDDRIDRILTRGGTILGTARVNPDKLKAGLDQIRQTLDDNGIDALIPIGGEGTLTAASWLAESGVPVIGVPKTIDNDIDCTDVTFGFDTALSIATDAIDRLHTTAESHQRVMLVEVMGRHAGWIALHSGLATGAHLTLVPEVPFDVGEVCSLVKKRFQRGDSHFICVVAEGATPTPESMSLREGGIDEFGHKRFTGVAQQLGDEIVRRIGKEVRTTVLGHVQRGGTPTPYDRVLATRFGVHATDAVHRGDFGNMVALHGTSIDLVPLEEATRRLKTVPRERYEEAAAFFG

SEQ ID NO: 47554 - protein, 174 aa, Bdellovibrio bacteriovorus HD100
MSVMQNNSEKSKWFLPGILGGLATTMKHLLKNLFNQKKMMTLNYPEEKYEYSPRFKGNHVLTVKKDGSLRCTACMLCATNCPAECIKITAAEHNDPTVEKFPISYEIDILRCVFCGFCEEACPVDAIRLGPEWQTPGVNGANFIYDINHLAYRPNLKGGILTHVDDEERHKAGI

SEQ ID NO: 47555 - protein, 435 aa, Novosphingobium aromaticivorans DSM 12444
MAQCARDRTMSDPQWYSTGRDHVWLPYTQMKTARPPLPVASAEGVKLRLADGRELVDGISSWWATVHGYRHPHIEEAIRRQLETLPHVMLGGLAHEQAYTLARRLAGMLPGDLDHVFFSDSGSVAVEVAMKMAAQFWLNQGHRRVKFLCFRGGYHGDTFATMSVCDPDEGMHSLFRGALLEQVVVDLPRDAEGEAALGALIEQHRGELAGIVVEPLVQGAGGMVFHDPFTLQALRRLADEHELLLIFDEIFVGLGRLGDAMFACQIAGVQPDIVTLSKALTGGNLPLAATIASGRIYDAFLSDDPMHALMHGPTYMGNALGCAAANASLDLFESEPRLEQAQAIGRGLEQALEVLRGLPGVRDVRVRGAIGVIQLDRTAPADRLSAACIDRGVWLRPFRDILYTTPPLVTGEEDLARITSAMVEAVTEWSRETHV

SEQ ID NO: 47556 - protein, 307 aa, Cryptococcus neoformans var. neoformans JEC21
MTQPQQPLSLLESFLCGGLAGCGAVTITNIPETMKTRLQLQGELQRNDPSAPRVYRNVLDVFRKTWQHEGIRGLQRGLVPAYGYQTLLNGSRLGLYEPCRRLFNRAIGKDPNEGVFITAITAGAVTGCIGASLGSPLFLIKARMQAYSPHIPVGAQHYYKNSYDALRTILKSDGFFGLWRGVSTAILRTAMGSSVQLPSYNLSKYYLVSSAGMASDSFWTFLAASSVSGVCVCIAMQPPDTALTRMYNQNTIKDPITGKVRGALYTNPFDCLWKTFKAEGIAGWYKGTTAHFLRITPHTIFTLVFNE

SEQ ID NO: 47557 - protein, 560 aa, Bdellovibrio bacteriovorus HD100
MNKLENLKQLLAGKFKIENFKFTHAVGDDVIEVPKEDAPALLLFLRESGQFDFLMDVCGADYPSREKRFDVVYNLFNSKDSSRLRVKAQVGEGESIGTAIPAYRGADWFEREAYDMFGIIFEGHPNLRKILTHHQFVGHPLRKDYDANNQQACTNSLPIHFNNEPGSPGDVLNDKYLPLNIGPSHTAMHGTLRVMAEMDGETIVRCNNEIGYLHRCFEKMAETHPYNQVIPYTDRLNYCSAPMNNIGYCKAVERLLGVEIPPKAQAMRVILAELSRIIDHTIAIGTGAMDLGALTSFFYMFGMREKVYGLFEKLCGARLTVSMTRIGGMAQDAPEGWFDEVLALVKEIRKGTDEMANMVIDNKIFIQRTKNVCPVSAADAIQWGYTGPMLRACGVNLDLRKAQPYYGYDALDFDVPVGTNGDIYDRYLVRFEEMRQSVRIIEQVCKNVPGGDYTIRDKGIVLPEKKDVYGNIEGLMNHFMLIIKGLRPPVGEVYDATEAANGELGFYLVSDGSANPYRLKVRPPCFAIYQSFPTVVKGAMLADAIATVASMNLIAGELDR

SEQ ID NO: 47558 - protein, 139 aa, Glycine max
MAVNSYSSSAQISLQKYGSFMEYTNKELMSKRCCVPQKTAPVGPVVLRITSSIKNKIYEDQSQGIICYEDESGEIICEGYDEGPRYHRIPSPTQHPRDVEIMNLQQQQSWLQIVKGEEINHLAKGALHLQEDLNYNKWL

SEQ ID NO: 47559 - protein, 836 aa, Saccharomyces cerevisiae
MAHRKLQQEVDRVFKKINEGLEIFNSYYERHESCTNNPSQKDKLESDLKREVKKLQRLREQIKSWQSSPDIKDKDSLLDYRRSVEIAMEKYKAVEKASKEKAYSNISLKKSETLDPQERERRDISEYLSQMIDELERQYDSLQVEIDKLLLLNKKKKTSSTTNDEKKEQYKRFQARYRWHQQQMELALRLLANEELDPQDVKNVQDDINYFVESNQDPDFVEDETIYDGLNLQSNEAIAHEVAQYFASQNAEDNNTSDANESLQDISKLSKKEQRKLEREAKKAAKLAAKNATGAAIPVAGPSSTPSPVIPVADASKETERSPSSSPIHNATKPEEAVKTSIKSPRSSADNLLPSLQKSPSSATPETPTNVHTHIHQTPNGITGATTLKPATLPAKPAGELKWAVAASQAVEKDRKVTSASSTISNTSTKTPTTAAATTTSSNANSRIGSALNTPKLSTSSLSLQPDNTGASSSAATAAAVLAAGAAAVHQNNQAFYRNMSSSHHPLVSLATNPKSEHEVATTVNQNGPENTTKKVMEQKEEESPEERNKLQVPTFGVFDDDFESDRDSETEPEEEEQPSTPKYLSLEQREAKTNEIKKEFVSDFETLLLPSGVQEFIMSSELYNSQIESKITYKRSRDMCEISRLVEVPQGVNPPSPLDAFRSTQQWDVMRCSLRDIIIGSERLKEDSSSIYAKILENFRTLEMFSLFYNYYFAITPLEREIAYKILNERDWKVSKDGTMWFLRQGEVKFFNEICEVGDYKIFKLDDWTVIDKINFRLDYSFLQPPVDTASEVRDVSVDNNNVNDQSNVTLEQQKQEISHGKQLLKQLKQGKISV

SEQ ID NO: 47560 - protein, 146 aa, Triticum aestivum
MAARPMLVVALLCAAAAAATAQQATNVRATYHYYRPAQNNWDLGAPAVSAYCATWDASKPLSWRSKYGWTAFCGPAGAHGQASCGKCLQVTNPATGAQITARIVDQCANGGLDLDWDTVFTKIDTNGIGYQQGHLNVNYQFVDCRD

SEQ ID NO: 47561 - protein, 174 aa, Synechococcus sp. CC9311
MLSMAISTMSMLSMPAQILDNAVLAWGLAACGLAQFSKLFLELVLNQRWRPAVLFETGGMPSSHSALVTGTAAGVGWQMGFDQPAFALAATVAFVVMYDASGVRRAAGFTAARLNELPDSLWPTPPEKPLKERLGHTRTEVLVGSLLGPLIALPGLFFVGSPLHLAQTFGLFSG

SEQ ID NO: 47562 - protein, 295 aa, Staphylococcus aureus subsp. aureus MRSA252
MTHLFEGVGVALTTPFTNNKVNLEALKAHVNFLLENNAQAIIVNGTTAESPTLTTDEKELILKTVIDLVDKRVPVIAGTGTNDTEKSIQASIQAKALGADAIMLITPYYNKTNQRGLVKHFEAIADAVKLPVVLYNVPSRTNMTIEPETVEILSQHPYIVALKDATNDFEYLEEVKKRIDTNSFALYSGNDDNVVEYYQRGGQGVISVIANVIPKEFQALYDAQQSGLDIQDQFKPIGTLLSALSVDINPIPIKALTSYLGFGNYELRLPLVSLEDTDTKVLREAYDTFKAGENE

SEQ ID NO: 47563 - protein, 716 aa, Saccharophagus degradans 2-40
MSEGYSVSEGRSFPMGATVSAQGTNFAIFSEHAEKVELCLFDEMGQTETARIMLPGNTDHVWHGFVEGVHAGALYGYRVYGPYEPQRGHRFNPNKLLLDPYAKRIDGAFHWSSIMYGYDADNPRQDLVKDKRDNSRDMPKCVVVAPLSLSDKERISEARPQVPWHKTIIYETHVKGFTQLNLAIPSSARGTFAGLAHPENLAYIKELGVTAIELLPVHGFIDESFLTAQGLSNYWGYNSLHFFAPHSGYLNDGDPAEFRHFTQAAHEAGLEVILDVVYNHTSEGNHLGPTLSFRGIDNASYYCLQAQDSRFYVNDTGCGNTLNLKHPRVLQMVMDSLRYWVTEMGVDGFRFDLATVLGRESHGFDPGSGFFDAIKQDPVLASVKMIAEPWDIGPGGYQLGNYPTGWSEWNDRYRDTCRRFWRGDPGMLPEFARRIHGSSDLFEHSGRKPSSSVNFITSHDGFTLADLVSYKNRHNEANNEQNSDGHHSNFSENYGVEGETDDDAILYVRERQKRNFLATLFLSQGTPMLLAGDELSRSQKGNNNAYCQDNEINWLDWQALTKKEIALSKFVSHLIKVRSSSPLLTSQRYIHKPDEPDGKISWCVNWINSYGEPMKDAQWAEQHAHCLGWVLEKIPVAEDSDKKSERLLVLFNSGNDDVLFRLPEDENVIGWKCLVDTRFIDGQGVPSCYEPRGEVPLMHKSLCLLKALFDGQDERD

SEQ ID NO: 47564 - protein, 148 aa, Triticum aestivum
MTMAARLMLVAALLCAAAAAATAQQATNVRATYHYYRPAQNNWDLGAPAVSAYCATWDASKPLSWRSKYGWTAFCGPAGAHGQAACGKCLRVTNPATGAQITARIVDQCANGGLDLDWDTVFTKIDTNGIGYQQGHLNVNYQFVDCRD

SEQ ID NO: 47565 - protein, 425 aa, Saccharophagus degradans 2-40
MLDPNSRYVSRLTRDTVALVLAGGRGSRLHELTDWRAKPALHFGGKFRIIDFPLSNCVNSGIRRIGILTQYKAHSLIRHVIRGWSSFKKEFGEYVEILPASQRYSPNWYQGTADAIYQNLDILQAEAPKYILVLSGDHVYQMDYGAIIAHHVETGADLTVSCIEVPIEEAAGSFGVMTVDDDNRIIRFDEKPQRPTELANKPGYTLASMGNYVFNTEFLFDQLRKDAADPDSEHDFGKNIIPNIIAEKLVSAYRFRDHDTNETAYWRDVGTLDSFWEANMELVSPNPSLNLYNHDWPIWTYQTQLPPAKFVFDDDSRRGYAVDSMVSGGCIVSGGKVKSSLLFSDVHIHSYAEIEESVLLPEVEVHRSAKIKKAIIDSACVIPEGMIIGHDHEHDKARGFRVTKKGVTLVTREMLGQQPAGTSAK

SEQ ID NO: 47566 - protein, 570 aa, Klebsiella pneumoniae
MSEKHPGPLVVEGKLSDAERMKLESNYLRGTIAEDLNDGLTGGFKGDNFLLIRFHGMYQQDDRDIRAERAAQKLEPRHAMLLRCRLPGGVITTTQWKAIDKFAAENTIYGSIRLTNRQTFQFHGILKKNVKPVHQMLHSVGLDALATANDMNRNVLCTSNPYESQLHAEAYEWAKKISEHLLPRTRAYAEIWLDQKKVATTDEEPILGQTYLPRKFKTTVVIPPQNDIDLHANDMNFVAIAENGKLVGFNLLVGGGLSIEHGNKKTYARTASEFGYLPLEHTLAVAEAVVTTQRDWGNRTDRKNAKTKYTLERVGVETFKAEVERRAGIKFEPIRPYEFTGRGDRIGWVKGIDDKWHLTLFIENGRILDYPGRPLKTGLLEIAKVHQGEFRITANQNLIVASVPEDQKARIEKLARDHGLMNAVTPQRENSMACVSFPTCPLAMAEAERFLPSFIDKVEGVMSKHGVSDEHIVTRVTGCPNGCGRAMLAEVGLVGKAPGRYNLHIGGNRNGTRIPRMYRENITESEILDSLDELVGRWAKEREAGEGFGDFTVRAGIIRPVLDPARDFWE

SEQ ID NO: 47567 - protein, 553 aa, Ralstonia eutropha JMP134
MLGLMQDRPLLISSLIEYAAAYHPQQEIISRTVEGGTVRTNYDQVHRRAKRLANALAKLGLSEGDRIGTLAWNTHRHLEMYFGVSGSGAVLHTVNPRLFPEQIEYIINHAEDSVLCFDSCFAPLVAKLAPQLKTVRHYVAMTDPEHMAALASAGIPNLVCYEDLLADSSEDYEWPQFDERTASSLCYTSGTTGNPKGVLYSHRSTVLHSLKASGSDTFGVSPESSILMIVPLFHANAWGLPYACAMNGAKMVLPAQHLDGESVYRLLRDERVNYSTAVPTVWLMLFQYLDAHPEIDPRELSLRIAGVGGSAAPAAMIERFEKQFGATLMQGWGMTETSPIGVINTLLPQHAGLSEAEQLKIKLKQGRALWGVELRIEDDEGRVLPHDGQAFGKLKVRGPWIASSYFKAEHDALDNDGWFDTGDVANIDPEGYVQLVDRAKDVIKSGGEWISSIDLENATMSHPAVAEAAVIGVPHPKWQERPLLIVVKRPDHEVTSAELIAFLAGKVVRWWVPDDVVFVDALPHTATGKLLKVKLRDAYRNYVLPTVRDERIA

SEQ ID NO: 47568 - protein, 350 aa, Ipomoea trifida
ERLAGSGIERIPKRYIRPEKERPSIGDIFAEEKMAGGPQVPTVDLKGINSEDLEVREKCREELRKAAVDWGVMHLVNHGIPEELTARVKAAGEGFFGQPIEEKEKYANDQAAGNVQGYGSKLANNASGQLEWEDYFFHCVFPEDKADLSIWPKTPSDYIAATREYAKQLRALTTTVYAVLSQGLGLEEERLEKKWRDGRASSTNEDNYYPKCPQPELALGVEAHTDVSALTFILHNMVPGLQLFYEGKWVTAKCVPNSIIMHVGDTVEILSNGKYKSILHRGVVNREKVRVSWAVFCEPPKEKIILQPLPETVCRADPPRFPPRTFAQHIKHKLFRLTDQEGADTPKPDE

SEQ ID NO: 47569 - protein, 147 aa, Oryza sativa (indica cultivar-group)
MAKKRTNVIPIIEDARHPARYRMLVGMVDVIFSDVAQPDQARILALNASYFLKNGGHFVISIKIITLIEVEIGEILDVILGIGLKLFEQANCIDSTMPAEAVFASEVEKLKADQFKPSEQVTLEPFERDHACVVGGYRMPKKQKGTS

SEQ ID NO: 47570 - protein, 469 aa, Shewanella sp. MR-4
MSVESVLKQLEELEVKFVDLRFTDTKGKEQHVSIPAHQVDADFFEDGKMFDGSSIAGWKGINESDMVLMPDPTTFVLDPFTEETTALIRCDILEPGTMTGYDRDPRSIAKKAEEYLRSTGIADTVLVGPEPEFFLFDDVRFGTDMSGCFVKIDAKEAAWNSGTSYEGGNTGHRPFVKGGYFPVAPVDSSQDLRSAMCLVLEEMGQVVEAHHHEVATAGQNEIATRFNTLTKKADEIQILKYVVHNMAHAYGKTATFMPKPIVGDNGSGMHVHQSLSKDGVNLFAGDKYAGLSETALYYIGGIIKHARALNAFTNPSTNSYKRLVPHFEAPVMLAYSARNRSASIRIPVVPSPKGRRIETRFPDPHANPYLGFAALLMAGLDGIQNKIHPGEAMDKDLYDLPAEEAAEIPQVATSLENALENLQADHEFLTRGGVFSEDFIQSYIALKSAEAERVSRTTHPLEFEMYYSL

SEQ ID NO: 47571 - protein, 126 aa, Oryza sativa (indica cultivar-group)
MEIGGLQRSSQTFRRSGSSGLVWDGRLMSEDQNQSDQRATGDAEAGSLESKELRHSRSVGSSIKVQRRCSDSVERSRSGNQAFRTRHVPPAMDPPSPKVSRCLFCGIFSKEEPSQPPKPRSLYWQP

SEQ ID NO: 47572 - protein, 116 aa, Oryza sativa (indica cultivar-group)
MATSSASTVSFSARPSAASAVRPCAAAGRARARAAAGESGKWWAPLLGWSGKADYIEAPAPAVVAAAEESEARRRPFVGGLTEEKARELRARMVETESFHDAMYHSAIASRLARSA

SEQ ID NO: 47573 - protein, 302 aa, Brassica napus
EIEMLSQFRQSNLASLIGYCDENNEMILVYEYMENGTVKGHLYGSGLPSLTWKQRLEICIGAARGLHYLHTGDSKPVIHRDVKSANILLDENFMAKVADFGLSKTGPELDQTHVSTAVKGSFGYLDPEYFRRQQLTEKSDVYSFGVVLFEVLCARPVIDPTLPREMVNLAEWAMKWQKKGLLDQIIDQSLRGNIRPDSLRKFAETAEKCLADYGVDRPSMGDVLWNLEYALQLQEAVVDGEPEDNSTNMIGDLPPQINNFSQGDTSVNVPGTAGRFEESSIDDLSGVSMSKVFSQLVKSEGR

SEQ ID NO: 47574 - protein, 370 aa, Pneumocystis carinii
MDSKHSVFNVMGQEFVLQKGYEVIKGLGKGSYGVVCSAKNIEVEDNNKVAIKKITNIFSKKMLAKRALREIMLLQHFRNHKNITTLYDMDIVDPSKFNELYLYEELMQANLNSIIRSDQPLTDAHFQSFIYQILCGLKYIHSANVLHRDLKPSNLLINADCKLKICDFGLSRGISVNQGQGTEYMTEYVTTRWYRAPEVMLSFQSYSKAIDLWSVGCILAELLGRKPFFKGSNYVDQLNQIFCILGTPNENIISKIKSASAQSYIRSLPTLPKMPYSKIFPYANPDALDLLNCLLTFDPYDRISCEEALEHPYLIIWHDPNKEPVCSEQFDFGFEAIDSIEEIRQMIINEVSRFKGLTGNQKLYHSISNT

SEQ ID NO: 47575 - protein, 336 aa, Rhodococcus sp. RHA1
MKLAVIPGDGIGVEVTAEALKVLRKLVPDLQTTEYDLGARRYNATGELLPDADLAAIREHDAILLGAIGDPSVTPGVLERGLLLNMRFALDHHVNLRPSQLYPGSKSPLAAQPDIDFVVVREGTEGPYTGNGGAIRVGTPHEIATEVSINTWFGAERVVRYAFALAQTRRKHVTLIHKTNVLSNAGAIWTRAVETVSAEYPDVETAYCHIDAATIYMVTDPSRFDVIVTDNLFGDIITDLAGAVTGGIGLAASGNIDASGTNPSMFEPVHGSAPDIAGQGIADPTAAILSAALLLRHLGRDGDAARIEAAVEADLASRGDSKVVTSEVGDRIAAAL

SEQ ID NO: 47576 - protein, 437 aa, Pneumocystis carinii
MFMTGQCSKKESKYEPLVMSTRIGRRYNRNKGPDASYKFPMVYPTTRCRLKLLKMERIKDYLLLEQEFVSNQELLKLDSEKRDQKGEEEDDDKLQSLIGSPMGVGTLEEMIDDDHAIVSSATGPEYYVSIMSFVNKDLLEPGCSVLLHHKAVSIVGVLSDDIDPMVSVMKLDKAPTESYADIGGLESQIQEIKETVELPLTHPELYEEIGIRPPKGVILYGEPGTGKTLLAKAVANQTSATFLRIVGSELIQKYLGDGPKFVRELFQTAQDNSPSIVFIDEIDAIGTKRYDSTSSGEREIQRTMLELLNQLDGFDDRGDVKVIMATNRINDLDPALIRPGRMDRKILFETPDQNTKRKIFQIHTSKMNLGDDVLIEEFITAKDEMSGADVKVIAICTEAGLLALRERRMRVVADDFRKAKEHVLKTKQKNIQGELYI

SEQ ID NO: 47577 - protein, 337 aa, Novosphingobium aromaticivorans DSM 12444
MTATIHTLPRKAEPSLAPMMALVAEGMNSVNAVILDRMQSRIPLIPTLAGHLIAGGGKRMRPMLTLASAALLGYGGSRHYKLAAAVEFIHTATLLHDDVVDGSDMRRGKKTANIVYGNPATVLVGDFLFSRSFELMVEDGSLKVLRILSNASAVISEGEVDQLVAQRQIDTTEEMYLDIIAAKTAALFSAACRIAAVVAERPDADELALDAYGRNLGIAFQLADDAIDYDSDAAEMGKDQGDDFREGKMTLPVILAYARGDEEERGFWQQAIAGERSSDADLAHAISLIRRHDAVHATRERARMYAQRAIDAISGFPASAAKAAMTEAAEFAVARRF

SEQ ID NO: 47578 - protein, 405 aa, Vibrio cholerae O1 biovar eltor str. N16961
MAGVLGMILAGGEGSRLKPLTETRTKPAVPFGGSYRLIDFALNNFVNADLMRIYVLTQFKSQSLYIHMKKGWNLSGITDRFIDIIPAQMRDGKRWYEGTADAIYQNLRFVEIVAPDQVCIFGSDHIYKMDIRQMLDFHRRMEAELTVSALRMPISQASQFGVIEVDENGKMVGFEEKPSNPKSIPGEPEWALVSMGNYIFEAETLSKELREDAENNQSSHDFGKDIIPKMFPRGKVYVYDFTTNKIKGEKESTYWRDVGTIESYWSAHMDLLDKDPEFSLYNRSWPLHTYYPPLPPATFVDVKDKKVKITDSLISGGSYIQGSTIYKSVLGFRSNIAAGSFISESVILGDVKIGAGCTIKRAIIDKDVEIAAGTIIGEDLEMDRKRFHVSDEGIVVIAKGSKVGF

SEQ ID NO: 47579 - protein, 365 aa, Cryptococcus neoformans var. neoformans JEC21
MADFVKLSIFGTVFEVTTRYVDLQPVGMGAFGLVCSAKDQLSGTSVAIKKIMKPFSTPVLSKRTYRELKLLKHLRHENIISLSDIFISPLEDIYFVTELLGTDLHRLLTSRPLEKQFIQYFLYQILRGLKYVHSAGVVHRDLKPSNILVNENCDLKICDFGLARIQDPQMTGYVSTRYYRAPEIMLTWQKYDVAVDIWSTGCIFAEMLEGKPLFPGKDHVNQFSIITELLGTPPDDVIQTIASENTLRFVQSLPKREKVPFSTKFPNADPVSLDLLEKMLVFDPRTRISAAEGLAHEYLAPYHDPTDEPVAAEVFDWSFNDADLPVDTWKVMMYSEILDFHNLGDISQNEAEGPVTGEVPAAPAS

SEQ ID NO: 47580 - protein, 481 aa, Geobacillus kaustophilus HTA426
MNLDFLPNDAFIEPSGQNIDEVASLMKKFMDLVIENSASSEQRPPLSQIENYTFDEIPIQGIPTEGILLQLKEILRNSMNPLTPNYIGHMDSIPTLISCLGEFVTTTLNNNMLSLEMSPVFSQMEVQVLRKIARMFGYDEQGGGVMVSGGSLANLQALAVARNHYFSVKEEGLTGLIEQPVILASEASHTSLHKAAMLLGLGTSSVVAVKTNQNSQMDTSDLEKKINKMIEEGKQPFAVVATAGTTVTGNIDPILSIAEITKKYGLWLHVDAAYGGALVFSDKHRERLSGIEKADSITFNPQKWMYVAKTCAMVLFKNRDLLETEFRISAPYMNDTDFTNLGEISVQGTRHADILKLYLSLQHIGLKGYDQLINEGYLRVEEFVKQVKQRPYLELASEPDINICCFRGRPKNLDEKQCDQWNLELQQFLLHKERVFFSLPTYMGKRWLRAVLLNPFTPISTIQKIFKTIDEFYINHHNYKS

SEQ ID NO: 47581 - protein, 393 aa, Mycobacterium avium subsp. paratuberculosis K-10
MTVSRLRPYATTVFAEMSALAARAGAVNLGQGFPDEDGPAEMLKAAQEAIADGVNQYPPGIGIAPLRHAIAAQRHRRYGIEYDPDTEVLVTVGATEAIASAVIGLVEPGSEVLLIEPFYDSYSPVIAMASAQRVAVPLVPHGRGFALDADALRRAVTPRTRALIVNSPHNPTGTVLGATELAAIAEVAVESDLLVITDEVYEHLVFDDHRHLPLAGFDGMAERTITISSAAKMFNCTGWKIGWACGPAHLIAGVRAAKQYLSYVGGAPFQPAVALALETQDAWVADLRDRLRARRDRLAAGLIDIGFEVHDSAGTYFLCADPRPLGYDDSVAFCAALPEKVGVAAIPLSPFCDPAGAHGPADVWNHLVRFTFCKRDDTLDEAIRRLAALRGAG

SEQ ID NO: 47582 - protein, 121 aa, Burkholderia vietnamiensis G4
MSHDPNCLFCKIAAGEIPSTEVHEDDEFVAFRDIRPAADTHVLVIPRRHLPTLSAASEADAPMLGRLMLLVARLADQLGVAYTGGETGFRTVINTGPGGGQEVYHLHAHILAGPRPWQRMG

SEQ ID NO: 47583 - protein, 537 aa, Schizosaccharomyces pombe 972h-
MEAAPSEKVPAKKLSSSENLDIGVSEVVTVDAAENNSNGIKRGLKTRHVSMMALAGIIGPGVFIGMGSALHIGGPVGLIVGFAIVSIVVFGVMLSIGEFNSLFDFNFNTHAARWVDPAFGAAIGWNYVIVWLTNIAAEYTSLTSILQYWGPHVPSYGFFLIFWGFFTCYQMLGVSVFGESEYILAFIKLLFITGFYIFAIIYAAGGIPHHKPPNLFKEMPLAHGFGGIVSAFVYAGVFFSGVESVSMTAAESKNPKKAIPLAVRQTFWRILYVYFGISISYGITVAWNDPNLSSGSKTLKSPMTIAIMNAGWNHAGDFVNAVILITCLSSINSGIYIGSRSLYNLAKDGMAPKIFKRVDKRGVPWVAVHSVHLFGFLSIMNYSTGAVKAYGYIINLAGVSAFIVWTAIIFVHFRFRRGWVKQGYALSDLPFKSPLYPFPQLIGFVIGIILTLVQGWTVFKPFAAGDFVDAYILLPLFFVIWLSYKFIKKTKWVSYEDMDFINGRRVIEPTYSNEQSSDKETEDGKKTSFWNRVWKEV

SEQ ID NO: 47584 - protein, 138 aa, Rickettsia sibirica 246
MNIIDRFEQENISKRTANKKIPDFEAGDTVKVTVKIIDRSIEKDGKEKLTERFQAYEGVVIAKRNRGITSSFLVRKISHGEGVERRFMTYSPIVHSIDVVKYGVVRRAKLYYLRNRSGKSARIKERHIPIANTKAAKA

SEQ ID NO: 47585 - protein, 300 aa, Magnaporthe grisea 70-15
MANVTGVASATDMPIQAVFAEVSQHFQQLTMMERLWATWYTWMQNDVLATGLLTFIIHEVVYFGRSIPWIIMDSMPIFQKYKIQQTKVPTIKEQLHCAGLVLLSHFTVELPEIWVFHPVAIYCGMAFDVPFPPAWKIALHIAVFFVLEDAWHYWTHRLMHYPPLYRSIHKLHHTYTAPFGLTAEYASPIEVLVLGLGTAGTPLLWVYLTGDLHLFTMQAWIVLRLLQAVDAHSGYEFPWSLHHILPFWAGAQHHDIHHEQFVGNYASSFRWWDYFMDTEAGAEANAKRRERKMAALKKTL

SEQ ID NO: 47586 - protein, 121 aa, Burkholderia vietnamiensis G4
MTQSTEDTLLRLAAVIDSRKGGDPEQSYVSRLFHKGDDAVLKKIGEEATEVVLAAKDVRQGGAPTALVGEVADLWFHCLVMLSHFDLSPADVIAELERREGLSGIEEKALRKRREREANGG

SEQ ID NO: 47587 - protein, 460 aa, Zea mays
  misc_feature (432)..(432): Xaa can be any naturally occurring amino acid
MQFALALDTNSGPHQIRSCEGDGIDRLEKLSIGGRKQEKALRNRCFGGRVAATTQCILTSDACPETLVPVGGCYRLIDIPMSNCFNSGINKIFVMSQFNSTSLNRHIHRTYLEGGINFADGSVQVLAATQMPEEPAGWFQGTADSIRKFIWVLEDYYSHKSIDNIVILSGDQLYRMNYMELVQKHVEDDADITISCAPVDESRASKNGLVKIDHTGRVLQFFEKPKGADLNSMRVETNFLSYAIDDAQKYPYLASMGIYVFKKDALLDLLKSKYIQLHDFGSEILPRAVLDHSVQACIFTGYWEDVGTIKSFFDANLALTEQPSKFDFYDPKTPFFTAPRCLPPTQLDKCKMKDAFISDGCLLRECNIEHSVIGVCSRVSSGCELKDSVMMGADTYETEEEASKLLLAGKVPVGIGRNTKIRNCIIDMNARXKGIQEGYYIRSGIVVILKNATINDGSVI

SEQ ID NO: 47588 - protein, 421 aa, Staphylococcus aureus subsp. aureus MRSA252
MTVKYNQNGELTMDGISLKTIAQSFGTPTIVYDELQIREQMRRYHRAFKDSGLKYNISYASKAFTCLQMVKLVAEEDLQLDVVSEGELYTALEAGFEPSRIHFHGNNKTKHEIRYALENNIGYFVIDSLEEIELIDRYANDTVQVVLRVNPGVEAHTHEFIQTGQEDSKFGLSIQYGLAIKAINKVQQSKYLKLKGVHCHIGSQIEGTEAFIETAKIVLRWLKEQDIQVELLNLGGGFGIKYVEGDESFPIESGIKDITDAIKSEIKVLGIDAPEIGIEPGRSIVGEAGVTLYEVGTIKEIPEINKYVSIDGGMSDHIRTALYDAKYQALLVNRNEEADDSVTIAGKLCESGDIIIKDAKLPSSVKRGDYLAILSTGAYHYSMASNYNQMQKPSVFFLKDGKAREVIKRQSLRQLIINDTK

SEQ ID NO: 47589 - protein, 535 aa, Arabidopsis thaliana
MGFALVLIFLFGFYLFLMKSSSIFPQRPFTFLYDLWVLLLVLRFLFSLIQILILCLFNFRFVEMTSNNKKKKTELCDLPKCLAPHILSWLPTKTAVTVSLLFMKGWWRSEMKNLSSLKFSFSDDQEEEHFVRFVDQVLRQRGNRKLDSFSLTLNDEIDGGFVTHLVDYPLDNGVEKLKLSIYDIKGNFQLSSRVFSQATLVTLKLATNRSLIWINGDDVAAAHLPCLKTLWLDDVLVADVKVFVRLLSRCPILEELVMIDMKWHNWEACFVVSASLRRLKIVWTDYVEMDEYDRCPQSVLFDTPNVLYLEYTDHIAGQYPLLKFSSLIEAKIRLEMIDEKEEEDEGQEVIVGDNATAFITGITSVRKLYLYANTIQVLHHYFDPPIPEFVYLTHLTIQSDKELGWDAIPELLSKCPHLETLVLEGLFHLATDVCGDVCPCRRNMEQAISYLVKSPVTHLEIYEGVVGKKRGEVTEDAARFGEQVRWFLMRMLHLQQVKIYGQTEDSVTALYDIATELRRLEGKASPNVQISVLQA

SEQ ID NO: 47590 - protein, 558 aa, Neisseria meningitidis FAM18
MSFKTDAEIAQSSTMRPIGEIAAKLGLNADNIEPYGHYKAKINPAEAFKLPQKQGRLILVTAINPTPAGEGKTTVTIGLADALRHIGKDAVIALREPSLGPVFGVKGGAAGGGYAQVLPMEDINLHFTGDFHAIGAANNLLAAMLDNHIYQGNELDIDPKRVLWRRVVDMNDRQLRNIIDGMGKPVDGVMRPDGFDITVASEVMAVFCLAKDISDLKERLGNILVAYAKDGSPVYAKDLKAHGAMAVLLKDAIKPNLVQTIEGTPAFVHGGPFANIAHGCNSVTATRLAKHLADYAVTEAGFGADLGAEKFCDIKCRLAGLKPDAAVVVATVRALKYNGGVERANLGEENLEALAKGLPNLLKHISNLKNVFGLPVVVALNRFVSDSDAELAMIEKACAEHGVEVSLTEVWGKGGVGGADLARKVVNAIENQPNNFNFSYDVELSIKDKIRAIAQKVYGAEDVDFSAEASAEIASLEKLGLDKMPICMAKTQYSLSDNAKLLGCPEGFRITVRGITVSSGAGFIVALCGNMMKMPGLPKVPAAEKIDVDAEGVIHGLF

SEQ ID NO: 47591 - protein, 301 aa, Corynebacterium efficiens
MSTGLTAKTGVEHFGTVGVAMVTPFTESGDLDVAAGREIAAHLVDNGVDALILAGTTGESPTVTTAEKLTLLKAVREEVGDRAKLIAGAGTNNTRSSVELAEAFAEVGADGLLVVTPYYSKPSQEGLVRHFTEIAQATDLPICLYDIPGRSGIPIESDTIRRLSELPTILAMKDAKGDVVAAAPLIEETGLAWYSGDDPLNLVWLALGGSGFISVIGHAAPNALRELYTSFEEGDLARAREINATLSPLVAAQGRLGGVSMAKAALRLQGINVGDPRLPIVAPNEQELEDLRADMKKAGVL

SEQ ID NO: 47592 - protein, 885 aa, Glycine max
MAPDPNRAGTSASANAAKDDAVAKKKVENEDLSDEDLALKQQLELYVERVQDPDQGLQKVALESMRQEIRTSTSSMTSVPKPLKFLRPHYGTLKTYYETMAESDLKKYLADILSVLALTMSAEGERESLKYRLLGSEGDIGSWGHEYVRNLAGEIAQEYAKRQSEEAPIDDLMELVQQIVAFHMKHNAEPEAVDLLMEVEDLDMLSGHVDKTNFKRTCLYLTSSARYLPGPDDMLVLDIAYSIYKQFEEYPNALQIALFMDNMQHVREVFTSCNDVLRKKQFCYMLARHGITFELDEKMVSDDEDRELLQEIINNSKLSEGYLTLARDIEVMEPKSPEDIYKAHLLDGRASAGASVDSARQNLAATFVNAFVNAGFGQDKLMTVPSDSSSSASSGNWLFKNKEHGKTSAAASLGMILLWDVDSGLAQIDKYFHSNDNHVIAGALLGVGIVNCSIKNDCDPAMALLGDYIDKEDTSTRIGAIMGLGIAYAGSQNEQLREKLTGVLNDSKASLEVLAFAAISLGLIYVGSCNEEIAQAIIYTLMDRSESELGEPLTRLLPLGLGLLYLGKQDSVEATAEVSKTFNEKIRKYCDMTLLSCAYAGTGNVLKVQNLLGHCSQHLDKGETHQGPAVLGIAMVAMAEELGLEMAIRSLEHLLQYGEQNIRRAVPLALGLLCISNPKVNVMDTLSRLSHDTDSEVAMAAVISLGLIGAGTNNARIAGMLRNLSSYYYKDTSLLFCVRIAQGLVHLGKGLLTLNPYHSDRFLLSPTALAGLITMLHACLDMKAIVLGKYHYVLYFLVLAMQPRMLLTVDENLKPLSVPVRVGQAVDVVGQAGRPKTITGFQTHSTPVLLAAGDRAELATEKYIPLSPILEGFVILKENPDYREE

SEQ ID NO: 47593 - protein, 346 aa, Arabidopsis thaliana
MAVTLRLTNSLAFSSHPLTSSVLFRGSKSIGTITKIASTIRTVKMAAFAGSDSETTSSTSRVIDSHLHIWASPQEAETYPYFPGQEPTLTGDVNFLLKNMEEARVDGALIVQPINHKFDHSLVTSVLKRYPSKFVGCCLANPAEDGSGITHLENLVLESNYRAVRFHPYLWPSGQKMTNAVGKALFSKAGELCVPVGFMCMKGLDLHIAEIEELCTEFPKTTVLLDHAGFCKVPESGEAKLAYSQLMKLSRFPQVYVKFSALFRISRTGFPYQDLSPLLSQLVSHFGANRVMWGSDFPFVVLECGYKEAKEAVTIIAKEASLSSSEMDWILGKTLMQLFPGQWVLP

SEQ ID NO: 47594 - protein, 674 aa, Cryptococcus neoformans var. neoformans JEC21
MFRLPSALLSTLLFFSSIFLRSHAFRVPISDTDSLREVCSGMYGGKDAYIEVDFDQTSSGQVALIIYEWNDVQYLGAQTGDETRTYICTTSAVRSGLCSNAQLGSFLTSFPDDVSAESSSIFTTPLKFSNDYTPTPTTDEDDNNTLPTENEDQEETSTEVAEEPVQETDSVDADMDEDEADQEQAEQVEGLAEALGDGWQKRQVGDIVNRIVTGVAISDDESAEDSEDWTETGSSTADSDSTSTAPVSVPVFSAPITYAVPKTGYYCVGIVPVTLVNSRDSVRERQATHAEYSGMVLFRNNFAGELPAVEYPKIHFYFALSIVYFVLGCGWAYLCSKHHRELLPMQYYISGTIVFLIIEMLAQFAYYRYINKHGGGTASLAFLFVIAVLNAARNSLSFFLLLIVCMGLSVVTHSLGSVMNKVRLLTILHFIFGVLYSVGTVEVELDDASLFTVLLLIFPLSITLTAFLMWIIVSLNGTIMHLQARKQRHKLQMFQRLWRILVVSVIAVAAFFVVSSMSLSNRMNEDYTPNSWRYRWILLDGSLATIYLCAFTAIAYLWRPTRDNVRFSMSQELAQDEAEADAEDYEIEALENGHGRGLGGHQQLSQHDDEDYNEDERKGLVRNGVGEENVVFAMGDDSDEEEDHVHGHGRTEYRDSEEVGRSSEAKSKDRGKDD

SEQ ID NO: 47595 - protein, 377 aa, Arabidopsis thaliana
MADGEDIQPLVCDNGTGMVKAGFAGDDAPRAVFPSIVGRPRHTGVMVGMGQKDAYVGDEAQSKRGILTLKYPIEHGIVNNWDDMEKIWHHTFYNELRVAPEEHPILLTEAPLNPKANREKMTQIMFETFNAPAMYVAIQAVLSLYASGRTTGIVLDSGDGVSHTVPIYEGYALPHAILRLDLAGRDLTDALMKILTERGYSFTTTAEREIVRDIKEKLCYIALDYEQELETAKTSSSVEKNYELPDGQVITIGSERFRCPEVLYQPSMIGMENAGIHETTYNSIMKCDVDIRKDLYGNIVLSGGTTMFPGIADRMSKEITALAPSSMKIKVVAPPERKYSVWIGGSILASLSTFQQMWIAKAEYDESGPSIVHRKCF

SEQ ID NO: 47596 - protein, 138 aa, Burkholderia vietnamiensis G4
MTTDTQSLPAWLDKVRWDDNGLVPVIAQEAATNDVLMFAWMNREALAKTIETQRAVYYSRSRKRLWFKGEESGHVQHVHEVRLDCDEDVVLLKVEQVSGIACHTGRHSCFFQKFEGTVENGDWVAVEPVLKDPEHIYK

SEQ ID NO: 47597 - protein, 961 aa, Cryptococcus neoformans var. neoformans JEC21
MPHTTNVSLSPRPTTPSGSLPRTDRSRRPLPPDTAASGINDLPRREFFSEGSDGEDYDDEEDEEEEDDVFAFNRPATAAQPNGASSSGYGTAPTSGRPTTAGISWTQTTAEERGPAHVGTSTGPGTLSYDGPTPLRDQPQSVNSNNKDAVPTPTGVIDVGGHLPDTTYDVNNPPPFSEDGVYSEDGNFGRRRRRSRGSIGMTELTGDMTVPDGMTTWGDGMGGLAKGGSDGEVQSAMDVDFDEEDSPYPEVRASVSNIDDPDMPAMTIRAWVLGIFLTILASGCNTYFHFRTPAPYISPLIVQVVAYPLGKFAAWILPIDTYKLPLWLGGREFSFNPGPFNIKEHTVIVMMANVAIGPAYALYATVSSELYYNHPMGFGFSIMFLFATQMTGFTLAGICRRFVVWPASMIWPGNLVVATNLNTFHAEEDGFTGGMSRFKFLIVCMAGSFAWYFFPGFVFTALSYFSWVCWIAPRNNVVNQLFGVSTGLGMGLLTFDWTQITWIGNPLTTPWWAEVNVGIGFVIFYWILTPILYYTNVWHTAFLPISVIQAADRFGSTYDVFNILTPEITLNKTAYAEYSPIYLSASYCVTYMVAFALSTALLVHTALYHGPRIYRAILNIKTEADDIHYKLMKMYPEVPDWWFLALFAVVFVFAVVSIEVYHTELPVWGYLISVLLPFIYIIPTAFIYAMTSQQITINLLAELIPGYIFQGQPLPGMIFKVFSVQTIVEALSFVQDQKLGHYMKVPPRATFVAQLSATTVACFVQSGTKELLFHVVKDICTATQKSLLICSSTKVFFTSSIIWGLIGPNRLFSKGAFYYPQLFALVFGAVLPIPLWFWVRRNPRSIFRNLNFPVMFNGALSIPPASGVNYASWLSTGFIFQFWLRRKRFAWWSKYNYVLSAALDVGTALSAVALFLFIDLPGASLSWWGNNVYKQTVDWDGVGATYYKPPPEGFGPDTWKV

SEQ ID NO: 47598 - protein, 195 aa, Burkholderia vietnamiensis G4
MRVAEVVRNTSETQIRVKLDLDGTGRQKLATGVPFLDHMLDQIARHGLIDLEVEAHGDTHIDDHHTVEDVGITLGQAVAKAVGDKKGIRRYGHSYVPLDEALSRVVIDFSGRPGLEFHVPFTRARIGTFDVDLSIEFFRGFVNHAGVTLHIDNLRGINAHHQLETVFKAFGRALRAAVELDERAAGQIPSTKGSL

SEQ ID NO: 47599 - protein, 1064 aa, Arabidopsis thaliana
MNSNGHEEEKKLGNGVVGILAETVNKWERRTPLTPSHCARLLHGGKDRTGISRIVVQPSAKRIHHDALYEDVGCEISDDLSDCGLILGIKQPELEMILPERAYAFFSHTHKAQKENMPLLDKILSERVTLCDYELIVGDHGKRLLAFGKYAGRAGLVDFLHGLGQRYLSLGYSTPFLSLGASYMYSSLAAAKAAVISVGEEIASQGLPLGICPLVFVFTGTGNVSLGAQEIFKLLPHTFVEPSKLPELFVKDKGISQNGISTKRVYQVYGCIITSQDMVEHKDPSKSFDKADYYAHPEHYNPVFHEKISPYTSVLVNCMYWEKSFPCLLSTKQLQDLTKKGLPLVGICDITCDIGGSIEFVNRATLIDSPFFRFNPSNNSYYDDMDGDGVLCMAVDILPTEFAKEASQHFGDILSGFVGSLASMTEISDLPAHLKRACISYRGELTSLYEYIPRMRKSNPEEAQDNIIANGVSSQRTFNILVSLSGHLFDKFLINEALDMIEAAGGSFHLAKCELGQSADAESYSELEVGADDKRVLDQIIDSLTRLANPNEDYISPHREANKISLKIGKVQQENEIKEKPEMTKKSGVLILGAGRVCRPAADFLASVRTISSQQWYKTYFGADSEEKTDVHVIVASLYLKDAKETVEGISDVEAVRLDVSDSESLLKYVSQVDVVLSLLPASCHAVVAKTCIELKKHLVTASYVDDETSMLHENAKSAGITILGEMGLDPGIDPMMAKKMINDAPITKGKVKSFTSYCGGLPSRAAANNPLAYKFSWNPAGAIRAGQNPAKYKSNGDIIHVDGKNLYDSAARFRVPNLPAFALECFPNRDSLVYGEHYGIESEATTIFRGTLRYEGFSMIMATLSKLGFFDSEANQVLSTGKRITFGALLSNILNKDADNESEPLAGEEEISKRIIKLGHSKETAAKAAKTIVFLGFNEEREVPSLCKSVFDATCYLMEEKLAYSGNEQDMVLLHHEVEVEFLESKRIEKHTATLLEFGDIKNGQTTTAMAKTVGIPAAIGALLLIEDKIKTRGVLRPLEAEVYLPALDILQAYGIKLMEKAE

SEQ ID NO: 47600 - protein, 50 aa, Brassica napus
PVFRLPYVPLPLAKRVEFVKMVEEIGREHFVGERDVQVLDDDDFILIGRY

SEQ ID NO: 47601 - protein, 308 aa, Pseudomonas fluorescens Pf-5
MTSKLEQLKKITTVVADTGDFDAIARVKPVDATTNPSLLLKAAAIPGYADLLNACVNDCKGDVGLASDRFGVAVGQEILKVIPGRISTEVDARLSFDTEAMLKRAHRLIELYDKAGIGRDRVLIKIASTWEGIRAAEKLEREGIQTNLTLLFSFAQAVACAEAGVFLISPFVGRIYDWYKKATGNDYQGADDPGVQSVTRIYNYYKANDYKTVVMGASFRNLNQIEQLAGCDRLTISPDLIEKLAADTGKLERKLSPGKTGEARQSLNEAQFRWASNEDAMATEKLAEGIRQFARDQEKLEALLAAKL

SEQ ID NO: 47602 - protein, 657 aa, Ostreococcus tauri
MGFSRSARAVKRRRPRALDAPRSRARNPASTVRATHADANEADGEKTRAVEGSRARWDRSRARLTMGWRCANASQRSPVWATVVQELLVQGHFQKYNKKSEYNELASLGFVSVYDQLFEGFPSEEEKGKIFNAFLGALDEDAVRTRADAETLGAFATSANGVEGLKENAIFAKLAAKSAEGTLLYTKYIAIGMFRMLELAKATDPAALEALVTAGGLSMSKVSGDLSMYKGLLSKLAAAKELQEELCETFRSTPRARMSFTEAFKAIPTVRFERSLVVIDLARCPTTSKKLARCSQLVRLFVEEISGLVTKVPYGYRALRTHRKLPRRGERDGRVEHGVAMSRDVRYDDGERCVMDIYVPEGLVEGENAPVALFVHGGVWASGEKWQFSPMATALAREGVVCCVATYSLYPRADAVQMWDEISRAISWTMDNIETYGGDANRVSVVGHSAGAQLCARALLQRGGVKNVKSKTSTREWHRDSRMPRKFIGIAGVYDIGYHYEYEDSRGVAIVSTMARAMNGAENFDMCSPARLMPRRKRDGRSVVPGPDNLTGDVMAKMAGFYRKSEDVAESLEEEVAFPPTVLMAGCADITVPWHESADFYWKLQDAGVPSRMLLYLKEDHVDFVLNWNEKGSGKDTADGNDYLEPYTRDFVRMLKD

SEQ ID NO: 47603 - protein, 488 aa, Vibrio cholerae O1 biovar eltor str. N16961
MRSLAMLPTDFPFFHQSAFINGQWILGEPQARQTVTNPFDGSLIGSVPLLSAAQVQEAIAGAQAAQILWCQQPAENKAKILRRWYELIEQHHESLAKLLTIEQGKPLAEARGEIHYAASFVEWYAEEAKRAYGELIPSHKPDARIMVSRQPVGVVAAITPWNFPAAMITRKCAPAFAAGCAVVLKPAPDTPFTALALADLAQQAGIPDGLLQVVTGDAIEIGRVLTESKTVRKLSFTGSTGVGKLLMAQSANNVKKLSLELGGNAPFIVFEDADINAAIDGVMVAKFRNAGQTCVCANRIYVHDAVYDQFAAKLVDRVSRLNVGYGLDAGVNIGPLINDAAVAKVTSHIVDAQSKGAKVMFGALPEAGSRLFQPHVLTEVTDEMRVADEETFGPLAALFRFSSEQEVIERANATDSGLAAYCYTQSLRRAWHMSEALEAGIVGINEGLISTTLAPFGGIKESGLGREGAKHGLEEYLEVKYTLMGGLA

SEQ ID NO: 47604 - protein, 211 aa, Ostreococcus tauri
MTREFHTKTKHPLSTHTRVIKPEDFTASLPTTSSPPLAAHEAARVVESRPMASKISHIPAVVSSPALVAALLSFSIAQIAKVFTHYHATGKIDYTRVVGSGGMPSSHTALVVGLCTSIGLKEGMSSSIFALCLVFSLVVMYDATGVRLHAGRQAEVLNQLIVELPRDHPLTDSRPLRDTLGHTPIQVVVGAILGMSVAYVHFVFWMATYAL

SEQ ID NO: 47605 - protein, 492 aa, Schizosaccharomyces pombe 972h-
MRAFRLASGVLRNRKVILGIGAGSLITAGNIKIRNDSKFDAFFAKGFPDELQHRSLFSVLRSAFVYEICSRAWLVKLSLGAMSLCDVFHLSFLYNPFCRYTFYKHFCGGETPQAVMATMDTLQAAGITSCLNYSREVDLDGDMDVNKIASQGVVPPQVPVPSEKNQKVLRQIADKAFESNMHIIDMATYKPGTVCAVKLTPFINPLVLQRYNSILNQYPVESACNYLEHLKSPELSTYEVSELKKFWEYADKLCQFAKEKQIPLFIDAEQTYFQDCMHAVTVDLMRKYNKEVAIVHNTYQLYLKKSRKIMDDHIKKCVAEGWLMGAKLVRGAYLNSEPRFLIHDTKAETDKDFDSAVEAIIAAAAKFAPGDPASASDPIASRKGKWGIMVASHNKKTMFESVNLAETKKVDFTKTSFYLAQLLGMADDITYALAYSQRNQQPNFCIVKYVSCGPISEVLPYLVRRARENIDALDRCKEERAYYRQALRRRIF

SEQ ID NO: 47606 - protein, 343 aa, Burkholderia mallei ATCC 23344
MKCTLKPIGEQTIVITGATSGIGLVTARKAAKKGAKLVLVARNDTALEALCEEIRQHVGLAVAVAADVSRYEDVQRAAAKAVETFGGFDTWINNAGVTIFGSALSVPLDDQRRLFDTNYWGVVHGSLVASEHFRRKSDFRGGAIINMGSEASDAPVPLQSAYAASKHAIKGFTDSLRIELEADNVPVSVTLVKPAAVDTMFVMHAKNYMNVEAKLPPPIYDPDIVADAILFAAEHARRTLFVGGAAKLASSGAYHAPRLFDRLATSLFSRGQRTMRPARPRDDNALYEPTRPLHEREGMDGVVLRSCAYNTVMQRPRVAGALALTAAALVVAALARARRDVAS

SEQ ID NO: 47607 - protein, 547 aa, Saccharophagus degradans 2-40
MQAKTLADLYSDWDKVQAHAQAWQKRTLKDAFDADRNRAARYSVGAAGLELDFSKNHIDDETLQLLMGVADQANLKAAIKKLLRGDHVNNTEDRPALHSALRFQGKPQTAEHQEVKATLDKMAKLIKSVHSGEWKGYKGEKITDVVNIGIGGSDLGPRMITKALTPFHTGDVKVHFVANIDGAEIHDLTRGLNPSTTLFLVASKSFSTLETLENSLTARKWMLDNGCAQDQLAKHFVAISSKVEKAVEFGIAAENVYPIWDWVGGRYSLWSAIGMPIAFAIGMDNFNKLRAGAAAMDDHFAEAPLERNIPALMGLLMFWYSSCLGTDTQAILPYAYHLQLLPAYLQQLEMESNGKSVTKSGERVDYQTGSIVWGTEGTNGQHSFHQLLHQGTTMVPIDFIATLQAHHPLDHQHKFLFANCVAQSQALMTGRDQATSEAEMRAQGMSDEQIAELAPHKVHPGNRPSNTILMDKLTPETLGALIAAYEHKVYTLGVLWNINSFDQWGVELGKLLGTHVATAIDTTDIPSDWDSSTQTLVKKFTEANKNL

SEQ ID NO: 47608 - protein, 320 aa, Saccharophagus degradans 2-40
MQSFYKVVQEDFAEVNTLIVNQLHSDVGLVENIGHYIVDAGGKRLRPLLVLLTARALGYNGNQHLSLSAIIEFIHTATLLHDDVVDVSALRRGRPTANANWGNAPSVLVGDFLYSRAFQMMVEIGEMGIMKELANTTNVISEGEVQQLVNARNPEVTEQNYMTVIHKKTAALFEAACETAAILAGADAATCKAVRSYGYHLGVAFQLVDDVLDYQGDAEELGKNVGDDLAEGKPTLPLIYTINNGSAEEAELVKQAIINSSLDKLQQIVDIVQRRGGLEYTQQCAQDHINRAKQAIALLPETEFRSAMEDLADFAIKRNH

SEQ ID NO: 47609 - protein, 157 aa, Geobacter metallireducens GS-15
MRSVEKLLVLFLFVTGVAIAACSDKDAKSLGEAKPAAVSTAPAGAVTTPSGLSYVDLVVGNGPQPTSGKPVKVHYTGWLENGTKFDSSVDRGEPFVFTIGAGEVIPGWDEGVMTMKVGGKRRLIVPAQLGYGAAGAGGVIPPNATLIFEVELLEAAK

SEQ ID NO: 47610 - protein, 264 aa, Oryza sativa (indica cultivar-group)
MDAAAAAGGEMSRQKATASAPPPPELDMVARAVQRLVARNDAVEALSGGGEAAAGLGAGMAAFEAARGAPAPRIGVAQYLERVHRYAGLEPECYVVAYAYVDMAAHRRPAAAVASRNVHRLLLACLLVASKVLDDFHHNNAFFARVGGVSNAEMNRLELELLAVLDFEVMLSHRVYELYHEHLEKEARRDGGGGDMLAGASAAAAAKAGRMAAVSPSKLLERAAVNGAAQHDDWRSLGTAAAAEAANGVRRHRSSSSSRYSFDC

SEQ ID NO: 47611 - protein, 220 aa, Brassica napus
MGSRQGPPKHQNKFAWVPNAGVKINETEVGGRFRPLSEITGVCHRCREQIAWKRKYGKYKKLTEPAKCQKCLKRNVRQAYHKLCTGCAKEQKVCAKCYSSSEQIMGRDIYEVEAEQKLLDETIKNARERDRRTLLRAMNKDSNPKKSDEEATRSDSSKVGDVFPSTSLEEYANKSGRVSGIIGHGHVVDDEDEDEDDVASEPELDEDHSGDDDEHEEVQK

SEQ ID NO: 47612 - protein, 503 aa, Ralstonia eutropha JMP134
MRDRTLVISVLIVASCGLGYELIAGALSSYLLGDSILQFSSIIGCYLFAMGVGSWLSRYVKDEDVLARFIDIEILVGLLGGISAALLFVVFAWLSAPFRTALYALVFLTGVLVGMEIPLVMRILNARRAAFSDLVSRVLTFDYLGALAVSLVFPLVLAPRLGLSRTGFLFGMLNAAVALYTTRLFRDELPQVPLRTMRALVVIALLGAGFAGSDRLTHWAERGLFGDEIIHSESTPYQRLVITRWKDDLRLYINGNLQFSSRDEHRYHEALVHPVMQALPWARRVLVIGGGDGLALREILRHRNIEHVTLVDLDPAMTTLFSQSAPLRALNRDSLRDARVTVFNADAAQWMEQNAEVFDAIIVDLPDPSNFGLGKLYSVPMYRLLSRHLAEKGYAVVQSTSPYYAPRSFWGIDATLHEAGLHTWPYHAYVPSFGEWGFILAGKRSDYTPPTRYDMPMKFLDADSTALMFRFPPDMAPRAGHANRLNEQSLVHDFEQDWGNVIR

SEQ ID NO: 47613 - protein, 543 aa, Mycobacterium sp. MCS
MQSTMQNVPLTVSAIVQHAAAIHGDSEVVTPTGNGYRRTPYRIVLARVARLANALRSLGVTADQRVATFQWSNQEHLEAYCAIPSMGAVLHTLNIRLAPEQLAYIANHASDQIVLVDASVAPLLARALPAMASVHTVIVTGEGDLAPLQGCGKTVLRYEEVLAGQEESFDWPELDELSAAAMCYTSGTTGDPKGVVYSHRSTYLHSLTACTANALSVSEADRVLAIVPMFHANAWGLIYAALMSGADLVLPDRYLQAEPLVSIIEDTRPTLAGAVPTIWNDVDRYLDSHPERDISSLRLVACGGSAVPLSLMRAFEEKYDVPIVQAWGMTETSPLATVARPAHRADATRRWELRASQGRPICGVEIRLRDDDGKDVPWDGQSVGEIQARGPWITGSYFGNNDTEKFDEGWLRTGDVGKIDAEGYLTLTDRSKDVIKSGGEWISSVELENTLIGHPAVYEAAVVGVADDKWQERPLALVVVHPGTDVDIDQLRSFLADKVAKWWIPERWSFVSDIPRTSVGKYDKKVIRARHSAGEYLIEIETS

SEQ ID NO: 47614 - protein, 485 aa, Mycobacterium sp. MCS
MTNHLLAPAHHVKERLSSVIMVPAPHAVDDRWRRWSRDWPVRELAPAPAGSGLKAVRGDAGLPFVGHTLDYIRFGSDFSRERYDRLGSVSWMGAFGTKMVVIAGPDATREAFTSEAKAFSQDGWSFLIDAFFHRGLMLMSFDEHLMHRRIMQEAFTRPRLTGYVEQVTPCVRSAVPAWPVGPSVRIYPLLKELTLDIATDVFMGGRGKDESDAVNKAFVATVRAASSLVRAPLPGTRFRAGVQGRRVLEDYFFRHLPAARAGETEDLFAALCQATTEDGERFSDEDVVNHMIFLMMAAHDTSTITTTAVTYFLAKYPQWQEAAAAEAAAIGDGLPDIEALEKMTVIDLVIKEALRLLAPVPLVMRKTVRDVAIDGYHIPSNTLCAITPAVNHFDRTIWSDPERFDPSRFDEPRREDQHHRFAWVPFGGGAHKCIGMQFGTLEVKAILHRMLRSFTWKVPENYHVRWDNTSLPIPVDGLPLEMKRR

SEQ ID NO: 47615 - protein, 421 aa, Coccidioides immitis RS
MADLQGRKVFKVFNQDFIVDERYNVTKEVGQGAYGIVCAASNVQTGEGVAIKKVTNVFSKKILAKRALREIKLLQHFRGHRNITCLYDMDIPRPDHFNEVYLYEELMECDLAAIIRSGQPLTDAHFQSFIYQILCGLKYIHSANVLHRDLKPGNLLVNADCELKICDFGLARGFSIDPDENAGYMTEYVATRWYRAPEIMLSFPSYTKAIDVWSVGCILAELLGGRPFFKGRDYVDQLNQILHYLGTPNEETLRRIGSPRAQDYVRNLPYMQKVPFQRLFPNANPEALDLLDRMLAFDPSSRISVEEALEHPYLQIWHDASDEPTCKTTFDFHFEVVEDVHDMRKMILDEVMRFRAHVRQPHIQMGNAGQQAAAQQTSVPIPEENIASWKQDEPRPQEAIHGGMQPNDLEASLQGGMDAMR

SEQ ID NO: 47616 - protein, 387 aa, Glycine max
MEHKVATTTEGQSIRCKAAICRKAGEPLCIEEIIVAPPMPGEARIRIICSSLCQTDISFRNMQDHPANFPTILGHEAIGVVESVGEDVTEVAKGDMVVPIFIAECGECIDCKSSKSNLCSKFPFKLSPWMPRHATSRFVDLKGEIIHHFLSVSSFSEYTVVDIAHLTKIDPEVPPSKACLLSCGVSTGVGAAWRTAGVEPGSTVAIFGLGSIGLAVAEGARLCGATRIIGVDINSEKYEIGKKFGITDFVHSGECENKSASQVIIEMTDGGADYCFECVGNASLMHEAYASCRKGWGKTIVLGSDKPGSKLSLSCSEILVSGKSLVGCMFGGLKPKSHVPILIKRYLDKELNLDGFVTHEVEFKDINKAFDLMIKGQCLRCVIWMDK

SEQ ID NO: 47617 - protein, 447 aa, Corynebacterium efficiens
MTVDEQVSNYYDMLLKRNAGEPEFHQAVAEVLESLKIVLEKDPHYADYGLIQRLCEPERQLIFRVPWVDDNGQVHVNRGFRVQFNSALGPYKGGLRFHPSVNLGIVKFLGFEQIFKNSLTGLPIGGGKGGSDFDPKGKSELEIMRFCQSFMTELHRHIGEYRDVPAGDIGVGGREIGYLFGHYRRLANQHESGVLTGKGLTWGGSLVRTEATGFGTVYFVQEMIKAEGETLEGKKVIVSGSGNVATYAIQKVQELGAVVVGFSDSSGWVSTPNGVDVAKLREIKEVRRARVSSYADEVEGAEYHTDGSIWDLTADIALPCATQNELDGDNARTLADNGCRFVAEGANMPSTPEAIDVFRERGVLFGPGKAANAGGVATSALEMQQNASRDSWSFEYTDERLHRIMKNIFKSCADTAKEYGHEKNYVVGANIAGFKKVADAMLAQGVI

SEQ ID NO: 47618 - protein, 313 aa, Triticum aestivum
MSMGRYAGATDPEAGRDGAGQAVLLRSPSGATARVSLHGGQVVSWKNDRGDELLFTSSKAIMKPPKAMRGGIPICFPQFGNCGTLERHGFARNRMWGLDEEHPALSRSDSGSRSFVDLILKPSEEDTKSWPHSFEFRLRISLTKDGDLSLVSRIRNVNGKPFSFSFAYHTYLSVSDISEVRIEGLETLDYLDNLSQRERHTEQGDAITFESEVDRVYVSSPNVIAVLDHEKKRTFVIRKDGLPDTVVWNPWEKKAKTMADFGDEEYKQTLCVDAAAAERPITLRPGEEWTGRLELSAVPSTNCSDHLDQPGIM

SEQ ID NO: 47619 - protein, 285 aa, Burkholderia mallei ATCC 23344
MSTAEASSPQGRTPQPGREREMAAKPRDEAAGYVGSGRLDGKVALVTGGDSGIGRAVAVGFAKEGADVAIVYLNESDDAAHTKHLIEQTGRRCETIALDIGERANAHVALRRAVERFGRLDVLVNNAGEQHVQTDIGQISEAQLTHTFRTNIFAMFFCTQAALTHMKAGARIVNTASVTAYHGNPVLIDYSATKGAIVSFTRSLALNLASRGIHVNAVAPGPIWTPLIQSTFDDEQRARFGANVPLKRPGQPDELIGCYVLLASDGADYMTGQTLHPNGGTIVNG

SEQ ID NO: 47620 - protein, 291 aa, Geobacillus kaustophilus HTA426
MKHEGSALPPYLHMDNGELWLTEDDRDNLKISYRIKEVIFAEPSEYQHVMILDSYDFGRMLVLDGVVQTTSIDGHIYNEMISHVPLQFHPEAKRVLIIGGGDCGAARETAKYAHLEAIDMVEIDEKVVRACKEHLPAVSGNLSDPRVRFVYDDGVVFVQEKENVYDVIMIDSSDPVGPAEALFSPEFYANVHRALKADGLMVCQSQSPIFHLDILKRTYRNIRELFPHVLVYTAVVPTYPGGLWSFTIGSKRPLDFPAQTTIPNDTKYVNDAVFRQCFALPEFLRSALEVE

SEQ ID NO: 47621 - protein, 329 aa, Pisum sativum
MSTSSINGFSLSSLSPAKTSTKRTTLRPFVFASLNTSSSSSSSSTFPSLIQDKPVFASSSPIITPVLREEMGKGYDEAIEELQKLLREKTELKATAAEKVEQITAQLGTTSSSDGIPKSEASERIKTGFLHFKKEKYDKNPALYGELAKGQSPPFMVFACSDSRVCPSHVLDFQPGKAFVVRNVANLVPPYDQAKYAGTGAAIEYAVLHLKVSNIVVIGHSACGGIKGLLSFPFDGTYSTDFIEEWVKIGLPAKAKVKAQHGDAPFAELCTHCEKEAVNASLGNLLTYPFVREGLVNKTLALKGGYYDFVKGSFELWGLEFGLSSTFSV

SEQ ID NO: 47622 - protein, 381 aa, Pisum sativum
CVFDAKSVLSSSRRKHVNGSGVRCMAVKEATSETKKRSGYEIITLTSWLLQQEQKPIIDAELTIVLSSISMACKQIASLVQRANISNLTGTQGAVNIQGEDQKKLDVISNEVFSNCLRSSGRTGIIASEEEDVPVAVEESYSGNYIVVFDPLDGSSNLDAAVSTGSIFGIYSPNDECLPDFGDDSDDNTLGTEEQRCIVNVCQPGSNLLAAGYCMYSSSVIFVLTIGKGVFVFTLDPLYGEFVLTQENLQIPKSGKIYSFNEGNYKLWDENLKKYIDDLKEPGPSGKPYSARYIGSLVGDFHRTLLYGGIYGYPRDKKSKNGKLRLLYECAPMSFIVEQAGGKGSDGHQRVLDIQPTEIHQRVPLYIGSTEEVEKVEKYLA

SEQ ID NO: 47623 - protein, 365 aa, Pythium irregulare
DNGSGMCKAGFAGDDAPRAVFPSIVGRPKHLGIMVGMDQKDAYVGDEAQSKRGVLTLKYPIEHGIVTNWDDMEKIWHHTFYNELRVAPEEHPVLLTEAPLNPKANRERMTQIMFETFNVPAMYVNIQAVLSLYASGRTTGCVLDSGDGVSHTVPIYEGYALPHAIVRLDLAGRDLTDYMMKILTERGYSFTTTAEREIVRDIKEKLTYIALDFDQEMKTAAESSGLEKSYELPDGNVIVIGNERFRTPEVLFQPSLIGKEALGIHDCTFQTIMKCDVDIRKDLYCNIVLSGGTTMYPGIGERMTKELTALAPSTMKIKVVAPPERKYSVWIGGSILSSLSTFQQMWISKAEYDESGPSIVHRKCF

SEQ ID NO: 47624 - protein, 429 aa, Geobacter metallireducens GS-15
MSEITDVYAREILDSRGNPTLEVEVFLESGVMGRAAVPSGASTGEREALELRDGDKSRYLGKGVLKAVDNVNNIIAEQIIGMEATDQIGIDQRMLDLDGTEYKSNLGANAILGVSLAVAKAAAEEVGLPLYQYIGGSNAKELPLPMMNILNGGAHADNNVDIQEFMIMPAGAKSFAEALRMGAEIFHALKGVLKGKGYNTAVGDEGGFAPNLKSNEEALEVIMDAIQKAGYKPGEEVLLALDVASSELFNDGVYTLENEAEPKKTPAQMVDFYENLVNKYPIVSIEDGMAENDWDGWKLLTDRLGKRIQIVGDDLFVTNPRILKEGIQKGIANSILIKLNQIGSLTETLDAIEMAKRAGYTCVISHRSGETEDTTLADLSVAVNAGQIKTGSLCRTDRVAKYNQLLRIEDELDTTALFRGKDVFYNIRK

SEQ ID NO: 47625 - protein, 321 aa, Saccharophagus degradans 2-40
MFMYPYIVADIGGTNARFALVTGKKGNAFNLEQIQILNGSEFPRLQDAMQHYIDTLGGEKPKAACVAIAGPIDGDNARMTNLNWEFSQAAVKAEFGFDKYDTLNDFGALAVATSSLQADNLIEIKAGTMDPKGNKAILGPGTGLGVAGLACAGDSWLPIPSEGGHVNVAPATQLECEVIRAAMAEHGHVSAETFISGPGLVRLYRALATVRGETPKNYEPKDITAGALDGTDDLCKETLDLFCSFIGSLSGNLALTYGAKGGVYLAGGVLPRFIDYFKSSDFVKRFSEKGVMSHYVENIPVNLISYEYTAFVGAAAWLDQL

SEQ ID NO: 47626 - protein, 631 aa, Marinobacter sp. ELB17
MCGLAGFLRTASTPDRDAHKGWLENMGQAIIHRGPDAGSTWLDDAVGLVHRRLSILDLSDAGTQPMVSASGRYVVAYNGEIYNFQELRDELISQGHSFRTRTDTEVLLALYEIHGPKCLQLLNGMFALAIWDRKAQKLFLARDRLGKKPLYFYEADGQFAFASELKALTPAPFVKTELRYDAIKDFFFYQYIPDPKTIYKNVHKLAPGHWLMTDGISTHQEQYWDVSFGAPSSASLGELEDGLFNLIDDAVRLRMVSDVPLGAFLSGGIDSSAVVGLMAGHTNKPVTTCAIGFDSKRFDEVHWAKKVAEQFKTDHHEFTVKDNVAESLSSIARFFDEPFADPSFVPTYFVSQLARQKVTVALAGDGGDENFAGYSKYYTDHVENRLRGMFPTALRHNLFPGLARLAGMVNSGPTRKAKSLLGTLALDPDEAFFVTNSFFRRDVWNSLVKGELKRETQDYDPADITRAHYRNADTDDHLSSILYTDIKTYLPGDILVKVDRMSMANSLETRAPLLDYRVVEYAAQIPAALKLHGKEKKYILKKAFERMLPEDILYRKKMGFSVPLAQWLRQELKPIVEQLLLSPNSGVANLFEPAGIRNLWQRHLAGDDQFTQELWSLLAFELWWQQYQVGA

SEQ ID NO: 47627 - protein, 395 aa, Oryza sativa (japonica cultivar-group)
MAAQASPPTKKVLVPIVAGTEPVEAAVPIDVLRRAGADVTVASADDGELVVEVMYGVRIVADALVAGGDCAAAHFDLIVLPGGVPGAANLGGCAALEAMVRRHAATGGLYAAICAAPPLALASWGMLNGLKATAHPLFVDKFPPEVAAVDASVVVDASAVTSRGPATSTEFALALVEQLYSKNKAEQIAKEMLVRYDAGYTIDEVNSVQWKCNGTPKVLVPVANGTEEMELITIIDVLRRADADVVVASAENAGVEIVARHGMRIVADTTLDEAAADDQTSSFDLIILPGGTPGAKTMSSNEKLVTLLKKQAAASKPYGAIGAATAHVLEPHGLLEGKKAADQDGGDECESRVVVDGNVITSGGTGTAMEFAVAAVEKLLGRDVAQRVAEGLLFA

SEQ ID NO: 47628 - protein, 627 aa, Pseudomonas aeruginosa
MCGIAGFWNITGTLLGDNARVARQMAAAIHHRGPDESGIWYEAPRAPILVHARLAVLELSPAGSQPMHSDCGRYVLIYNGEIYNHLALRARLSEAGVTHSWRGGSDTETLLACFAQWGVESTLKLTVGMFALALWDRQEKTITLARDRMGEKPLYWGWQNGVLFFASELKALKEHPLFRGDIDRDALALFLRYGYVPAPYSIYKGIGKLRAGSYLVLSERSLNETCEPAAYWSANAAIEEALSNPFQGTDAEAVDLLESQLRTSISDQMVSDVPLGAFLSGGVDSSTVVALMQQQSSRPIRTFSIGFDEPGYDEAVYAKAVAEHIGTDHTELYVNSKDALDVIPSLPKIYCEPFGDSSQIPTLIVSGLARQQVTVALSGDGGDELFGGYNPYQFTPRVWRMLERFPHSMRRFASAFAQDLPLPDKLGKLRDVFASRTAEELFYRLNSHWRNHEYPVIGAKGHTALLDTPERWPRVDSFQHWMMAMDVQGYMPDDILVKVDRAAMANSLETRVPLIDHRVFELAWRMPLHMKIRNGKGKWLLREVLYRHVSRELIERPKKGFSVPVSDWLRGPLKEWAESLLDERRLQQEGYLDSRLIRRIWNDHLAGRRDHSRRLWSVLMFQAWLES

SEQ ID NO: 47629 - protein, 374 aa, Brassica napus
MARSDPPSRIHPEPRQTDHFDHLPDSILLLVFNKISDVKSLGRCCVVSRRFHSLVTQVENVLIRVDCVISDDDNSSLSSIKSRSAASAPFSNLFRLVVGGIVKPLQALGQFLGARRSCGSSSSSSSAPSVSGDEGGEIEQGGVTHHSPTQVLKNFEEIRYLRIELPSGELGIDDGVLLKWRAEFGSTLDHCVILGASSVIQPSPTRVSQPVESSDDTGSIPESFYTNGGLKLRVVWTISSLIAASARHYLLQPIIAEHKTLRSLVLSDSDGQGVLCMNRDQLEELRVKPLSASSASKRTLVPALNMRLWYAPTLELPDGTVLKGATLVAIRPSESKKEVSDVLWVSSAAFGEPYKAAVKMLVKRKTYCLEMNSF

SEQ ID NO: 47630 - protein, 86 aa, Zea mays
  misc_feature (11)..(11): Xaa can be any naturally occurring amino acid
  misc_feature (46)..(46): Xaa can be any naturally occurring amino acid
  misc_feature (71)..(71): Xaa can be any naturally occurring amino acid
MANCGEGDKRXIVEERADGTNVHNWHWSERDCLEWARARVCSLLRXLTILDGEGGLSLRTVGLDKLDGEAXYVNIRKGKDVPGYHL

SEQ ID NO: 47631 - protein, 332 aa, Arabidopsis thaliana
MDNSAPDSLSRSETAVTYDSPYPLYAMAFSSLRSSSGHRIAVGSFLEDYNNRIDILSFDSDSMTVKPLPNLSFEHPYPPTKLMFSPPSLRRPSSGDLLASSGDFLRLWEINEDSSTVEPISVLNNSKTSEFCAPLTSFDWNDVEPKRLGTCSIDTTCTIWDIEKSVVETQLIAHDKEVHDIAWGEARVFASVSADGSVRIFDLRDKEHSTIIYESPQPDTPLLRLAWNKQDLRYMATILMDSNKVVILDIRSPTMPVAELERHQASVNAIAWAPQSCKHICSGGDDTQALIWELPTVAGPNGIDPMSVYSAGSEINQLQWSSSQPDWIGCFC

SEQ ID NO: 47632 - protein, 98 aa, Zea mays
MASLAAVSVKPVAIKGLAGSSISGRKLAVARPSARSIRRPRAAAVVAKYGDKSVYFDLDDIGNTTGTSKFFETFAAPFTKRGLLLKFLLLGGGSLLAY

SEQ ID NO: 47633 - protein, 119 aa, Glycine max
  misc_feature (59)..(59): Xaa can be any naturally occurring amino acid
  misc_feature (72)..(72): Xaa can be any naturally occurring amino acid
KKSTRWVIKSKVLPKIKKVFEKNSTKKAAAAEATKSFDESKEEYIIAFEEKKTELQTKXVEIYEASSTEIKXLVKEPKVAGLKKNFSEVQKFLDELVSFVFSGSVALSVASFLSVPFFF

SEQ ID NO: 47634 - protein, 496 aa, Arabidopsis thaliana
MEIIIISLCLATILAFLLLKPLLNRTVAKDNLPPSPWRVPVIGNLHQLSLHPHRSLRSLSHRYGPLMLLHFGRVPILVVSSSDVAHDLMKTHDLKVANRPRLKVIETILNGGREVVFSPYGDYWRQIKTVCVVHLLNKKMVQSFAKVREEERSVMMEKVEKASSDSSPLNLSKLLITLTSDVASRVSFGKKHSNEASMSDFKNQVRKITELVGGFPVSEYIPCLAWIDQIRGLYNRAEEVSKIFGDLMDKVVQEHLDATNKPTKDFVDILLSFERQSKDGIEVRRSDIKFIILDIFLGGTTTTNSLLEWTMTELIRHPECMKKLQDEIRGDATNLTIYRSHEEVEDMKYLKAVIKEGLRLHPPFPLLVLRLLTQDVKLKGYDIAAGTQVITNAWAIQRDIVTWGIDAEEFRPERHLDSPLDFRGTNFEYIPFGSGRRICPGIGFAMALVEVTLANLVNRFNWRMDARLSGDEYDLAEATGIDVCRKFPLIVFPSNA

SEQ ID NO: 47635 - protein, 509 aa, Oceanobacillus iheyensis HTE831
MYIVTAEEMYGIDRETMDSIGVDGKILMENAGREVSREIKKRITKKDVILVLVGGGNNGGDGFVVARTLHVEGYNVKVVQVVGDEKIKGDADYHKRLFLRCNGLIIYLDSLGDEVKYMIKDSAVVVDAMVGIGVKGKLKEPILSIAQNINESNKQVIAIDIPSGLTAEEHHSEFYAVQADTTIVIGALKQSLFLQNTASFYGDWVMASIGFPSEVIRRYTDKQWWDQEAFQSFFPKRKENSHKGMHGRGLVIGGNHLMPGSVMMTTKAAVRSGAGLTTMGTSKAVISMMASSCNESMYIPIQEQDGYLSDASEIDYSAYDAVAIGMGIGREKVTHQLIQNAITAVKGILLIDADGLYHTKEQLHVLPSRQTPTILTPHPGEFASLLDVSISEILQKPFSYSKEFAVKYGVYLVLKGKFTIITAPTGRQVVESGGNPGLAKGGGGDVLSGIILAMVMQDQPIFEAICNACYLHSASADNLVKEKHSVYDLTATDIIEGIPNALRTLTSSE

SEQ ID NO: 47636 - protein, 326 aa, Bacteroides thetaiotaomicron VPI-5482
MGTVKCIGILTSGGDAPGMNAAIRAVTRAAIYNGLQVKGIYRGYKGLVTGEIKEFKSQNVSNIIQLGGTILKTARCKEFTTPEGRQLAYDNMKREGIDALVIIGGDGSLTGARIFAQEFDVPCIGLPGTIDNDLYGTDTTIGYDTALNTILDAVDKIRDTATSHERLFFVEVMGRDAGFLALNGAIASGAEAAIIPEFSTEVDQLEEFIKNGFRKSKNSSIVLVAESELTGGAMHYAERVKNEYPQYDVRVTILGHLQRGGSPTAHDRILASRLGAAAIDAIMEDQRNVMIGIEHDEIVYVPFSKAIKNDKPVKRDLVNVLKELSI

SEQ ID NO: 47637 - protein, 471 aa, Oryza sativa (japonica cultivar-group)
MAFFRGLTAVSRLRSRVAQEATTLGGVRWLQMQSASDLDLKSQLQELIPEQQDRLKKLKSEHGKVQLGNITVDMVLGGMRGMTGMLWETSLLDPDEGIRFRGLSIPECQKVLPTAVKDGEPLPEGLLWLLLTGKVPTKEQVDALSKELASRSSVPGHVYEAIDALPVTAHPMTQFTTGVMALQVESEFQKAYDKGMSKSKFWEPTYEDCLNLIARLPAVASYVYRRIFKGGKTIAADNALDYAANFSHMLGFDDPKMLELMRLYITIHTDHEGGNVSAHTGHLENPGVSVWPFNALGKVGSALSDPYLSFAAALNGLAGPLHGLANQEVLLWIKSVIGETGSDVTTDQLKEYVWKTLKSGKIVCHDTFIRRLFLALVMEFYVSKLYEVVPPILTELGKVKNPWPNVDAHSGVLLNHFGLSEARYYTVLFGVSRSIGIGSQLIWDRALGLPLERPKSVTMEWLENHCKKVAA

SEQ ID NO: 47638 - protein, 493 aa, Parvularcula bermudensis HTCC2503
MIPLVSPDQMQNVDQRTIAAGTDGFVLMRRAGAAIAAVLRGRWSARPVLVLTGPGQNGGDGWIVADLLARAGWPVTVATNWAPSTLKGDAHRAAARAGLSPISLTEALSRPHTLVVDALFGAGLSRPIKGPPAAIINAVKEWGAAVIAADLPSGLDGRTGQIHGDALTASATVTFGAAKPGHFIGEGLSLCGDLHIADIGLDLRSDDAAAILNHPEAWRQDLPWPPRAAHKYDRGGVLVLAGPRHQTGAARLCAEAAARAGAGAVTLACRPSAADIIAGHETAALLAILREDDDLAALCRSKRVKAVAIGPGLGMDEAARSALRTILTAQIPAVLDADALTLIARDRSLRERLGCHHVLTPHEGEFSRLFPDWEGDALSRCAKAADELGTTLLLKGAATVIATPGARPVINAHASPVLATAGSGDVLTGIIAGLIAQDMPPHNAACAGAWLHGEGGLAADPGLTAEDLPAEVGAAMAAASQARPQRARRLGQR

SEQ ID NO: 47639 - protein, 376 aa, Arabidopsis thaliana
MDDLLHQRVEQSQVTPPHDDSNIHGDFDNEATDESRSETCSVVIEGNCDMVIELGLESGSVIVENLGDSDIDVSNDFDEPDDDDFFVGRTDFGLEFRDIASSGNDIRLITVESGSDDDDGVENERELWGIDLNEEDVYVNDDDEYEDDDVSVTIPLCWDSLQLEDREVTADEFDWEEVGGGGGGGVDDEREIRSGFAQIDMNDESLISASPIISLEGLVTRERAEGSGNLGWEVLLNHTLEINFDVDNRELYIGGDHDDYVQDYDMLFEQFADAEVSVIGLPPTSKSFLNNLPVVLLEGENDDDGGLVCAVCKDEMNIGNKAVQLPCNHKYHSECIVPWLKVRNTCPVCRYELPTDDAEYEQRKTQRTTNNFGMVL

SEQ ID NO: 47640 - protein, 283 aa, Bacteroides thetaiotaomicron VPI-5482
MSEEKWAIITGADGGMGTEITRAVAEAGYHIIMACYRPSKAEPIRQRLVNETGNANMEVMAVDLSSMASTASFADRIVERHLPVSLLMNNAGTMETGLHITDDGFERTVSVNYLGPYLLTRKLLPALTCGARIVNMVSCTYAIGHLDFPDFFRQGRKGSFWRIPVYSNTKLALMLFTIELSERLREKGITVNAADPGIVSTDIITMHQWFDPLTDIFFRPFIRTPKKGASTAVGLLLDEAVAGVSGQLYASSHRKQLSEKYLCHVQQKQLWQETEQALERWLK

SEQ ID NO: 47641 - protein, 384 aa, Zea mays
MAAAHLFCSAPAAYRAANPRPLATRGRANPATGTYLVLKGVWCSCAHFPRATPSRRFFPCRASLSPDGSLAMLGAPSPRMAPPMRKPYMREHSCLIFPPPRGRRPLAVIKFLGGAFIGAVPEVTYGYLLELLALEGFVVVCVPYNVTFDHEAAAREVFQSFHACYDALLASGLPEAGLSALDIAELPLYSVGHSNGALLQLLVGSYFSERIPEANAIVSFNNRPASEAVPYFEQIGPLFRQLMPMMEASPVYSMARNASGYAWKALFDLAGGLLREYDQEATVFLSKFIDQLPSVMNQVKFTVDAIDDTDIVEDVLRPRVDSIGGQIKKVILSGTHLTPCIQDVKWQVGSEYTPADAIAQGLKSLALSETRVLSRTIADWFTSL

SEQ ID NO: 47642 - protein, 558 aa, Geobacillus kaustophilus HTA426
MIGKRMRHIGRYHEIAASLLRHGFGMIVDELGFSSFLSLPPRWKAEQGKKEGKTVGERLRLVLEELGPTFVKLGQIASTRPDLIPAPIISELEKLQDQVPPFPFADVRRIVEAEFGSSLETLFRSFEEMPLAAASLGQVHRAVLPSGQAVAVKVQRPHIAARVETDLEILQDLAVLAERRLDWAATYQLSEIVDELARSLRQELDYTVEARHAERFARQFAGDSSVYVPKVFWDYTTKTVLTMEYVEGIKLGEIERLKANGHSLKTIAERLAEATFQQMFEHGFFHGDPHPGNVFVLDDGTLSFIDFGLMGRLRPHVKHHLSSLIIALMRQNTDGVLGAIYGLGIVPDGVDEGKLRDDIDELREKYYRVPLGEISLGEAVEDLLSVAFRHGIRIPSDLTLLGKALLTVEGVVETLDPQFRIMDVAEPFGRKLMKERLRPDRVAETAWKRIFDYGEWLLRLPDSVKEWTKMMRHGKLRLEITAPDLETLLKKLDQITNRLSFSIVLLSLSIVLAGLMIASSLGRPSTLLWKIPAVEIGLGASAFLFGWLLYSIFRSGKF

SEQ ID NO: 47643 - protein, 405 aa, Pisum sativum
MASATFSVAKPAIKANGKGFSEFSGLRNSSRHLPFSRKSSDDFHSLVTFQTNAVGSSGGHKKSLVVEAKQLKVAINGFGRIGRNFLRCWHGRKDSPLDVIAINDTGGVKQASHLLKYDSTLGIFDADVKPVGTDGISVDGKVIKVVSDRNPANLPWKELGIDLVIEGTGVFVDREGAGRHITAGAKKVLITAPRKGDIPTYVVGVNADAYTHADDIISNASCTTNCLAPFVKVLDQKFGIIKGTMTTTHSYTGDQRLLDASHRDLRRARAAALNIVPTSTGAAKAVALVLPTLKGKLNGIALRVPTPNVSVVDLVVQVSKKTFAEEVNEAFRESAAKELTGILSVCDEPLVSVDFRCTDVSSTVDSSLTMVMGDDLVKVIAWYDNEWGYSQRVVDLADIVANNWK

SEQ ID NO: 47644 - protein, 750 aa, Haloarcula marismortui ATCC 43049
MGLDEDALEYHRSKPPGKIEIATTKPTNTQRDLSLAYSPGVAAPCEEIDKDPEKAFEYTAKGNLVGVVSDGSAVLGLGDIGPEAGKPVMEGKGVLFKRFADIDVFDVELDTDNAEAMIQTVEAMEPTFGGINLEDIAAPECFEVERRLSEKLDIPVFHDDQHGTAIISGAALVNAADIADKELDELEVVFSGAGASAIASAKFYVSLGVSKDNITMCDSSGIITEERANHEELNRFKQEFARDIPEGGLADAMDGADVFVGLSVGGIVDQEMVRSMASDPIIFAMANPDPEIAYEDAKAARDDTVIMATGRSDYPNQVNNVLGFPFIFRGALDVRATEINEEMKVAAARALADLARQDVPDEVVKAYGDQPLQFGPNYIIPKPLDPRVLFEVTPAVAEAAIESGAARTELDTAAYVEELEARLGKSREMMRVVLNKAKSDPQRVVLAEGHDEKMIRAAYQLVEQGIAEPILIGDADQIESTRRKFGLEFDPVVVDPETADVADYADRLYELRQRKGVTRREADELIRDGNYLGSVMVEMGDADAMLTGLTHHYPSALRPPLQVIGTADDADYAAGVYMLTFKNRVIFCADTTVNQDPDTDVLEEVTRHTGELARRFNVEPRAAMLSYSNFGSVDNLGTKKIRRAVSRLQDDDRVDFPVDGEMQADTAVVEDILQDTYEFSELDDPANVLVFPNLEAGNIGYKLLQRLGGAEAIGPMLVGMDKPVHVLQRGDEVKDIVNLAGVAVVDAQQE

SEQ ID NO: 47645 - protein, 306 aa, Daucus carota
MADLRDEKGNPIQLTDQHGNPVQLTDEYGNPVHITGVATTGATTGHHDHGVGGASHGGVGSTGLGGVAGAAGLAGATAAAATHGGSHGGTGTHGVGPTGVGAAHGGTGTTTGLGTGTGTTGQTHGMGPTGIGGTHGVGSTGIGGAHGGTGVLGQTHGMGPTGTGAAHGGLGTGQSGLGSSYATHGGLGTGIGTGSAPASAGSHSHAPEKKTALGEQLHRSNSSSSSSEDDGQGGRRKKGFTTKIKEKLGGGKHKKDEHTTVATTKTTTAAHPGGAAVAVEHHEHEKKSMLDKIKDKLPGHHSPTSH

SEQ ID NO: 47646 - protein, 439 aa, Oryza sativa (indica cultivar-group)
MGDHQMMHAAPAAMYNGGGGGGTTSSHGVWWSNAVGVPAAATCSTTTELAGYTAWSSALAAGYDGMVADNGGKQAKSTTTASSESPGNNSSVTFQEPASIPDPAAVAAVPQPGLAGFTDWTQPFMNNGAGLHEFLQDGHHDMSASSLMNHSSNNLALQQAGHHHELLSSFGSDLLLSPTSPYGGFQSSLLRSLMEPTAKQQQQQPALAGLQQYHQYQQQMGHTPAAAAKFAQAVGARDSLQFTNDAPFWNPSAGFGMPAAVAVAAAAAQDQASVRSAKRSSPAPPRAAATLALKTAMEGVGDSSSVITKKETAFKKPRLETPSPLPTFKVRKEKLGDRITALQQLVSPFGKTDTASVLHETIEYIKFLHDQVGALSAPYLKNGAHQVPHLKNSSPDKSKHGEISLKGRGLCLVPISSTFAVASEVPVELWTPFGANFIR

SEQ ID NO: 47647 - protein, 225 aa, Saccharophagus degradans 2-40
MATISVSTRVALCVALGGFIFGFDASVISGVVPFISKLFGLSDWQIGAVVSAPTLGAVFSAMGVSTLADRFGRKPILISIAAIYAISAAYSALAPNFESLVIARFIGGLGFGSLVLAPIYISEIAPPHQRGRLVSFNQLNIVVGFSIAYFVNYFIVQAVSNAYSWAPPQSMVSAPWRWMLGLELLPALAYIALLFKIPESPRWLMLNNYSARATDVVKKSSQAIM

SEQ ID NO: 47648 - protein, 390 aa, Helicobacter pylori J99
MPYSSKVQSLSESATIAISTLAKELKSQGKDILSFSAGEPDFDTPQAIKDAAIKALNDGFTKYTPVAGIPELLKAIAFKLKKENNLDYEPSEILVSNGAKQSLFNAIQALIGEGDEVVIPVPFWVTYPELVKYSGGVSQFIQTDEKSHFKITPKQLKDALSPKTKMLILTTPSNPTGMLYSKAELEALGEVLKDTKVWVLSDEIYEKLVYKGEFVSCAAVSEEMKKRTITINGLSKSVAMTGWRMGYAASKDKKLVKLMSNLQSQCTSNINSITQMASIVALEGLVDKEIETMRQAFEKRCHLAHAKINAIEGLNALKPDGAFYLFINIGSLCGGDSMRFCHELLEKEGVALVPGKAFGLEGYVRLSFACSEEQIEKGIERIARFVKSKG

SEQ ID NO: 47649 - protein, 409 aa, uncultured archaeon GZfos26E7
MDLEMDVDADIDSTEFSKYVVDRMQQLELKNNLLEKQYQKVETEKQLAEDQRLKYERELRKLRSELDKLKTTPQLVGTLVNVLEEGKSIVRSSTGPEFIVGSSQFIKDGDLKPGVQVALNKEHLSIVAVIPGSEDPLVQAMEVIESPDIDYNQIGGLDKQIEVLRGAVEFALTKPEIFERIGIDPPKGVLLFGPPGTGKTLLAKAVATRTDATFIRVVGSELVQKYIGEGARMVRDVFEMARKKAPAIIFIDELDSIGAVRLDDASSGGREVQRTLMQLLSEMDGFNSRGDVCILAATNRWDILDPALIRPGRFDRLVYVPIPDREARVKILLIHTKKMRLAGDVDFDRIVTLTEDANGATLRAIVMEAGMCAVREDADAVYQKDFEDAIKHIMNPEGMVDRYSEGMFA

SEQ ID NO: 47650 - protein, 517 aa, Mycobacterium sp. MCS
MQLGIGQWVSRRAFLNGGRTALISNGAHITYADLDRRTNQVAAALIALGVRKGDRVAMLLVNSTEFIEVLLGCAKIGALAVPLNVRLAGPEIGYILADSGADVLVFHEPFAAQARSAVTESGVRVRHVVRAGGVPAPGELGYEDVVSGAAPEPLNGDVDGRDPAFIMYTSGTTGRPKGAILTHDNLLWNAINVLGTDIGLRGEDVTVAVAPMFHIGGLGVHTLPLLYVGGTSVIMPSFEPRATLQAMADHHVTVQFMVPAMWTALTQVPDFDSFNLSALRFAMGGGSPVPLTVIDFMRERGVPFTEGFGMTETAPLVTVLDAENVSTRAGSIGRVAMHVDARIVDDDDRDVATDTVGELIVRGPNVFTGYWMKAEASAEALRGGWFHTGDLGRMDAEGFITLVDRKKDMIISGGENVYPIEVEQVLFRHPAVFDAAVIGGKDAKWGERVVAVVVADPATQAPSAEEIVAWCRERLAHFKCPRDVHFVAELPRNATGKLLKTELRAQFTGIEGGVVLR

SEQ ID NO: 47651 - protein, 177 aa, Brassica napus
  misc_feature (40)..(40): Xaa can be any naturally occurring amino acid
MATMGQLWANTGSTLATLMFTYTIFRRWFPHVGDHLEPFXQRLFSRFYPYIQIKFHEYSGEHFKRSEVYSGIQSYLSKDSSLRAKKLKANTTKGSKSLVLSMDDREEITDEFESVTVWWQSKKVRNTRQSFSFYPGQTSDPGRRLDKCPYQSPFTSCIQLFHIQESQISLLRCAQMP

SEQ ID NO: 47652 - protein, 870 aa, Medicago truncatula
MSSLVKGLFDKHQKVKGTVVLMQKNVLDINELTAAQSAGGVVDSFFDFVGDAAGTVADTATSLFRRSVALWLISATVADGKTGKGKVGEKTYLASVITSLPTLGDKQNAFSIEFEWDNDMGTPGAFYIENYLQGGEFFLVSLTLEDVPNHGTINFVCNSWVYNAKNYKTKRIFFANKTYLPSETPAPLVYYRQEELKTLRGDGTGERKEWERIYDYDVYNDLGDVDKNASLARPVVGGSSTLPYPRRGRTGRKAARKDPKSESRSDTVYLPRDESFGHTKSSDFLVHILKSASQNVIPRLRSIVTLQFHEPEFNTFEDVRSLYEGGIRLPTDILSELSPIPLFKELFRTDGEAALKFPPPKVIQVDHSAWMTDEEFAREMIAGVNPHIIKKLLEFPPKSKLDTQLFGNNTSTITKEHLQPNMVGVTVEQAIQNNKLFILDHHDPLFPYLRKINATETKAYATRTILFLQDDGTLKPLAIELSRPHPQGDSFGPVSKVYLPASEGVEASIWLLAKAYVIVNDSCYHQLVSHWLNTHAVVEPFVIATNRHLSVVHPIHKLLLPHYRDTMNINALARNVLVNAEGIIESTFLWGKYALEMSSVVYKDWVFTEQGLPNDLIKRGVAVEDPTSAYGLRLLIEDYPYASDGLEIWAAIKSWVDEYVNFYYKSDASIAQDSELQAFWKELVEVGHGDLKNATWWFKMQTREELIEACTTLIWIASALHAAVNFGQYPYGGYIVNRPTKSRRFMPEQGSPEYDELAKDYQKSYLRTITPKNDTLTDLTIIEVLSRHASDEQYLGERIEGDLWTSDSQPKESFKRFGKKLAEIEQKLIQRNNDETLRNRNGPVKMPYTLLYPSSEEGLTCRGIPNSVSI

SEQ ID NO: 47653 - protein, 497 aa, Arabidopsis thaliana
MEMIIISLCLATILALLLLKQFLNRTYTAKVNLPPSPWRVPVIGNLHQLSLHPHRSLRSLSHRYGPLMLLHFGRVPVLVVSSSDVAHDLMKTHDLKVANRPQLKVVEKIFNGGREMVFSPYGEYWRQIKSVCIVNLLNKKKVQSFEKVREEEISEMMERVEKASSDSSPLNLSELLLTLTSDVTSRVSLGRKYSKEESMSDFKIQMRKITELVGGFPVGEYIPCLAWIDKLRGVDEKAEEVSKAFGDLMEKVLQEHLDATDKPTLDFVDVLLSLERHERNGVQIRRSDIKFLILDMFLAGTETTYALLEWIMTELIRHPECMKKLQDEIRAKATKLILYISEEDVEDMKYLKAVVKEVLRLHPPLPLLVPRELSEDIKLKGYDIAAGTQVIINAWAIQRDTMTWGIDAEEFRPERHLDSLVDFRGTNFEFIPFGSGRRICPGIGFAMALVEVTLANLVNRFNWRMEVQHSGDEYDLAESTGLDVCRKFPLIVFPSPA

SEQ ID NO: 47654 - protein, 467 aa, Oryza sativa (indica cultivar-group)
MLPFVVAHLGRLLAAAAAALPELGCTFMFRGPWLVGADFLVTCDPAVFRHCLVANFAGYDKGRDFAEMFDVVGDGLLVADAASWAAKRHLAASVFTSAAFRGFVLSTVERQTRRLLVPFLDHAGGVVELEDVFMRYSLDVSYTVAFAADLDSLSVASAAEPFPPFGEATRVTGEAVLLRHIAPAGWWKLMRWLNVGVERRLADAKAVLDEFVYREIANRRSRPAPAVAGGDDLLCMYMASPIDPAMSDQTLRDAAVGFMFAAKDLIAAALTWLFYMICTHPHVEAKILDELRSLHTTTTAGAVVFDADELRAATYLHAAVLETLRLYPSAPFEEKEAVGDDVLPGGTAVRKGTRVVFCLYAMGRVEGIWGSDCREFRPERWLSTGDGDGGAGKVLQEPSYKFAAFNAGPRSCLGKDLGLSNIKIAAAAIVYNFTVELVAGHVVEPKDSVVLHTKNGLMVRVKRRETA

SEQ ID NO: 47655 - protein, 868 aa, Medicago truncatula
MFSGVTGLFDRGQKLKGTVVLMQKNTLDINALTAAKSPTGIIGGAFGIVGDVAGNILDTATSFLGRSIALRLISATSADAAGKGKVGKETFLEGLLTSIPTLGDKQNAFSIHFEWDSNMGIPGAFYIDNFMQGEFFLVSLTLEDVPNHGSIHFVCNSWIYNSKKYKTDRIFFANKTYLPSETPAPLVYYRQEELKTLRGDGTGERKEWERIYDYDVYNDLGEPDSKPQLARQILGGSSDFPYPRRGRTGRRKTKTDPKSETRSPTVYLPRDESFGHTKSSDFLVYILKSASQNVIPQLRSVVTLQLNNPEFNTFQDVRSLYEGGIKLPTDVLSQISPIPLFKELFRSDGEQALKFPPPKVIQVDHSAWQTDEEFAREMIAGVNPHIIKKLSEFPPKSKLDSQKFGDNTSTITKENLEPNMGGVTVEQAIQDNRLYILDHHDPLFPYLRKINATETKAYATRTILFLQDDGTLKPLAIELSRPHPQGDSFGPVSNVYLPASEGVEASIWLLAKAFVVVNDSCYHQLVSHWLNTHAVVEPFIIATNRHLSVVHPIHKLLLPHYRDTMNINALARNVLVNAEGIIESTFLWGNYALEMSAVVYKDWNFIEQGLPNDLIKRGVAVEDPASPTGLRLLIEDYPYASDGLEIWAAIKSWVGEYVNFYYKSDAAIAQDAELQAFWKELVEVGHGDLKNATWWFKMQTREELIEASTILIWIASALHAAVNFGQYPYGGYILNRPTKSRRFMPEKGSPEYDELAKDYQKSYLRTITPKNDTLTDLTIIEVLSRHASDEQYLGDRIEGDNWTSDSQPKEAFKRFGKKLAEIEQKLTQRNNDETLRNRYGPVKMPYTLLYPSSEEGLTCRGIPNSISI

SEQ ID NO: 47656 - protein, 253 aa, Zea mays
HASASFIDGPTLRALLRPSTNGRRTKISDSGGGGGGGGIFKMFKLMPMLSSGCKMVALLGKHNNRALLADHATTVTLFGPRRGRVSLAIHEDTRAPPLFLIELPMLTSALHREISSGALKLALESDTRSARRRLVEEYVWAVYCNGRKAGYSIRRKEASDDERHVLRLLRGVSMGAGVLPAAPGPEKEGGVPAGPDGELTYVRARVERVVGSKDSEAFYMINPEEGGNGADNNGGGGGAGGAPELSIFLVRMK

SEQ ID NO: 47657 - protein, 378 aa, Antarctic bacterium DS2-3R
TEPTIHKGLAGVTADVTAISKVNSDTNSLLYRGYPVQELAAKCSFEQVAYLLWNSELPNDSELKAFVNFERSHRKLDENVKGAIDLLSTACHPMDVARTAVSVLGANHARAQDSSPEANLEKAMSLLATFPSVVAYDQRRRRGEELIEPREDLDYSANFLWMTFGEEAAPEVVEAFNVSMILYAEHSFNASTFTARVITSTLADLHSAVTGAIGALKGPLHGGANEAVMHTFEEIGIRKDESLDEAATRSKAWMVDALAQKKKVMGFGHRVYKNGDSRVPTMKSALDAMIKHYDRPEMLGLYNGLEAAMEEAKQIKPNLDYPAGPTYNLMGFDTEMFTPLFIAARITGWTAHIMEQVADNALIRPLSEYNGPEQRQVP

SEQ ID NO: 47658 - protein, 242 aa, Salvia miltiorrhiza
HEAQLPIIHSSLKMSEELKYTSHEPAKPANEPCETATPVAVESTDRGLFGFGAKKEEETAISAEFEEKVKVCEEEKKEEAPEEKKHEGFIEKLRRSDSSSSSSDEEEVGEDGLKKKKKKKGLKEKVVEKVSGDKEEEEVKCVDTSVPVEKYDDVVPTQEHEEKKGFLDKIKDKLPGGKKTEEVVSAPPPPAPVAHEYGATPEAEGKEKKGFLDKIKEKLPGYHPKTDEEKEKEKEKEKEAAC

SEQ ID NO: 47659 - protein, 447 aa, Bacteroides thetaiotaomicron VPI-5482
MKKEYLIYKLSEEMKEATRIDNELFPKFDVKRGLRNEDGTGVLVGLTKIGNVVGYERIPGGGLKPIPGKLFYRGYDVEDISHAIIKEKRFGFEEVAYLLLSGRLPDKEELASFRELINDNMALEQKTKMNIIELEGNNIMNILSRSVLEMYRFDPDADDTSRDNLMRQSIDLISKFPTIIAYAYNMLRHATFGRSLHIRHPQEKLSIAENFLYMLKKDYTELDARTLDLLLILQAEHGGGNNSTFTVRVTSSTGTDTYSAIAAGIGSLKGPLHGGANIQVADMFHHLQENIKDWKSVDEIDTYFTRMLNKEVYNKTGLIYGIGHAVYTISDPRALLLKELARDLAREKGKEEEFAFLELLEERAIATFGRVKNNGKTVSSNIDFYSGFVYEMIGLPQEIFTPLFAMARIVGWCAHRNEELNFEGKRIIRPAYKNVLDDLAYIPIKKR

SEQ ID NO: 47660 - protein, 447 aa, Pisum sativum
AALASTRIPTNTRFPSKTSHSFPSQCASKRLEVGEFSGLKSTSCISYVHSARDSSFYDVVAAQLTSKANGSTAVKGVTVAKLKVAINGFGRIGRNFLRCWHGRKDSPLEVIVVNDSGGVKNASHLLKYDSMLGTFKAEVKILNNETITVDGKPIKVVSSRDPLKLPWAELGIDIVIEGTGVFVDGPGAGKHIQAGAKKVIITAPAKGADIPTYVIGVNEQDYGHEVADIISNASCTTNCLAPFAKVLDEESGIVKGTMTTTHSYTGDQRLLDASHRDLRRARAAALNIVPTSTGAAKAVSLVLPQLKGKLNGIALRVPTPNVSVVDLVVNVAKKGISAEDVNAAFRKAAEGPLKGILDVCDVPLVSVDFRCSDVSTTIDSSLTMVMGDDMVKVVAWYDNEWGYSQRVVDLAHLVANKWPGTPKVGSGDPLEDFCETNPADEECKVYE

SEQ ID NO: 47661 - protein, 652 aa, Bacteroides thetaiotaomicron VPI-5482
MFNKMKYIFVSGRRFITFASIMNNHPKSPIIDLQQQQLLLRMEYEHEKEEFKRQTETMGVARKVKRGLCWYPASPGRSYYNSLNQLVIDITRTENKEIEHSFEFGRPVCFFRQSFDGKVNYMNFIATVSYADDERMVVVLPSAGALLELQTEEVLGVQLYFDETSYRAMFEALEDTIRAKGNRLAELRDTLLGTQKPGFRELYPVRFPWLNSTQETAVNKVLCTRDVAIVHGPPGTGKTTTLVEAIYETLHREPQVLVCAQSNTAVDWICEKLVDRGVPVLRIGNPTRVNDKMLSFTYERRFENHSAYPELWGIRKSIREMGSRMRRGSYSEREGMRSRMSRLRDRATELEILINADLFDSARVIASTLVSSNHRLLNGRRFPTLFIDEAAQALEAACWIAIRKADRVILAGDHCQLPPTIKCIEAARGGLDHTLMEKVVQQKPSAVSLLKVQYRMHEAIMRFPSEWFYNGELEAAPEVRNRGILDFDTPMNWIDTSEMDFHEEFVGESFGRINKQEANLLLQELEAYISRIGKARILDESIDFGLISPYKAQVQYLRSKIRGSSFLRPFRSLITVNTVDGFQGQERDVVFISLVRANEDGQIGFLNDLRRMNVAITRARMKLVILGDATTLTKHAFYRKLIQYIRQEAVSS

SEQ ID NO: 47662 - protein, 433 aa, Burkholderia mallei ATCC 23344
MTPSDVKATLSFSDNSPSVELPIYKGTMGPDVIDIRKLYGQTGKFTYDPGFMSTASCNSAITYIDGDKGELLYRGYPIDNLAQNADFLESCYLLLKGELPNAAQKKEFVATVTKHTMVHEQMQFFFRGFRRDAHPMAILVAAVGALSAFYHDSLDINDPRHREVSAIRMIAKLPTLVAMAYKYSIGQPFVYPRNDLSYSANFMRMMFANPCEEYQVNDVLVRALDRILILHADHEQNASTSTVRLAGSSGANPFACIAAGIACLWGPAHGGANEAALNMLEQIGTPENIPEFIKQVKDKNSGVKLMGFGHRVYKNYDPRAKLMRETCYEVLNELGLHDDPLFKLAMQLEKIALEDEYFVSRKLYPNVDFYSGIVQRALGIPTSMFTCIFAMARTVGWIAQWNEMIADPEQKIGRPRQLFIGETPRTAKPIEQR

SEQ ID NO: 47663 - protein, 321 aa, Pseudomonas aeruginosa
MALNPDIAAYLELVGNGRSSGKSLPMHQLTVQQAREQFDQSSALMDPGLDEPLPRVETLFVPARDGTPLPARLYSPQGLSASPPLPGVLYLHGGGYVVGSLDSHDALCASLAERAGCVVLSLAYRLAPEWRFPTAAEDAEDAWCWLAAEAARLGIDPQRLAVAGDSVGGSLCAVLSHRLALRGDASQPRLQVLIYPVTDASRTRQSIERYAVGHLLERDSLEWFYQHYQRSPEDRQDPRFSPLLGVVPADLAPTLLLVAECDPLHDEGIAYAEHLRQGGARVELCVYPGMTHDFLRMGAIVDEADEAKDMIADALVAALAP

SEQ ID NO: 47664 - protein, 152 aa, Anabaena variabilis ATCC 29413
MPKTVADVMSHNPVVVKPETPLQEAIKILAERRISGLPVVDNDGKLLGIISETDLMWQETGVTPPAYIMFLDSVIYLQNPAVYERDLHKALGQTVGEVMSKNPVTVSPEKSVKQAAQLMHDRNVHRLPVLDDAGQVIGILTRGDIIRAMANS

SEQ ID NO: 47665 - protein, 270 aa, Oryza sativa (japonica cultivar-group)
MESQVLVALALSLVGGLSTSIGALFVILNPTPNLKMLGLLQGFAAGLMLSISFLDLAHNALNSIGFLKGNLWFFAGVLFFGLVVKFIPEPTVVPTADAGKKQGLRVGLNLAIAIALHNIPEGVAVALPLYFATNSKWQAFKVATLSGFAEPLGVIIVAYLFPSSLNPEVLEGLLGSVGGVMAFLTLHEMLPLAFDYAGQKQAVKAVFVGMAFMSASLYFLEISLPKELVIVFDHFTVKMNSLGWVAKHHPESECNLRLLGRNRTQLELAD

SEQ ID NO: 47666 - protein, 469 aa, Xylella fastidiosa Dixon
MSLENVEKLVKDKKIEFVDLRFVDMRGVQQHVTFPVNILEPSLFKDGKMFDGSSIAGWKGINESDMVLLPDASTAYLDPFYADPTLVMTCDILDPATMHSYVRDPRGIAKRAEIYLNSLGIADQAFFGPEPEFFIFDSVRFANDMGHSFFQIASEEAAWNTGAEFERCNSGYRPAVKGGYFPVPPTDSLHDLRAEMVKTLEQVGIETEVHHHEVATAGQCEIGTKFDSLVKKADQLMTMKYILKNVAYRNGKTVTFMPKPIVGDNGSGMHVHQSLSKGGVNLFSGDDHAGLSQLALYYIGGIFKHAHAINAFSNSGTNSYKRLVPGFEAPVMLAYSARNRSASCRIPWVSSPKARRIEMRFPDPLQSGYLTFTALMMAGLDGIKNKIHPGPPNDKDLYHLPPEEEKLIPQVCSSLDQALEALDKDRDFLKAGGVMSDDFINGYIALKMQEVTQFRAATHPLEYQMYYAN

SEQ ID NO: 47667 - protein, 905 aa, Arabidopsis thaliana
MSRVSFEVSGGYHSDAEAGNSGPMSGGQLPPIYKKPGNSRFTAENSQRTRTAPYVDLTVDVQDDTVSVHSLKMEGGSSVEESPELTLLKRNRLEKKTTVVKRLASVSHELKRLTSVSGGIGGRKPPRPAKLDRTKSAASQALKGLKFISKTDGGAGWSAVEKRFNQITATTGGLLLRTKFGECIGMTSKDFALELFDALARRRNITGEVIDGDQLKEFWEQINDQSFDSRLKTFFDMVDKDADGRLTEDEVREIISLSASANNLSTIQKRADEYAALIMEELDPDNIGYIMLESLETLLLQAATQSVITSTGERKNLSHMMSQRLKPTFNRNPLKRWYRGLRFFLLDNWQRCWVIVLWFIVMAILFTYKYIQYRRSPVYPVMGDCVCMAKGAAETVKLNMALILLPVCRNTITWLRNKTRLGRVVPFDDNLNFHKVIAVGIIVGVTMHAGAHLACDFPRLLHATPEAYRPLRQFFGDEQPKSYWHFVNSVEGITGLVMVLLMAIAFTLATPWFRRGKLNYLPGPLKKLASFNAFWYTHHLFVIVYILLVAHGYYLYLTRDWHNKTTWMYLVVPVVLYACERLIRAFRSSIKAVTIRKVAVYPGNVLAIHLSRPQNFKYKSGQYMFVNCAAVSPFEWHPFSITSAPQDDYLSVHIRVLGDWTRALKGVFSEVCKPPPAGVSGLLRADMLHGANNPDFPKVLIDGPYGAPAQDYKKYEVVLLVGLGIGATPMISIVKDIVNNIKAKEQAQLNRMENGTSEPQRSKKESFRTRRAYFYWVTREQGSFDWFKNIMNEVAERDANRVIEMHNYCTSVYEEGDARSALIHMLQSLNHAKNGVDIVSGTRVMSHFAKPNWRNVYKRIAMDHPNTKVGVFYCGAPALTKELRHLALDFTHKTSTRFSFHKENF

SEQ ID NO: 47668 - protein, 1097 aa, Anabaena variabilis ATCC 29413
MPRRQDIQKILLLGSGPIVIGQACEFDYSGTQACKALREEGYEVVLVNSNPATIMTDPETADRTYIEPLTPELVEKVIARERPDALLPTMGGQTALNIAVALAKNGVLDQYNVELIGAKLPAIEKAEDRKLFNEAMDKIGVKVCPSGTASSLDEAKAIARRIGTYPLIIRPAFTMGGTGGGIAYNQEEFEEMAQVGIDASPVSQILIDQSLLGWKEYELEVMRDLADNVVIICSIENIDPMGIHTGDSITVAPAQTLTDKEYQRLRDMAIKIIREIGVETGGSNIQFAVNPVNGDVVVIEMNPRVSRSSALSSKATGFPIAKMAAKLAVGYTLDEIRNDITKKTPASFEPTIDYVVTKVPRFAFEKFPGSEPVLTTQMKSVGEAMAIGRTFNESFQKALRSLETGRAGWGCDKAEKLPSGEQIRAQLRTPNPDRIFAVRHALQLGMSPEEIYELTAIDPWFLDKMQQLLEVEKFLKRTPLKQLTREQMYAVKRDGYSDRQIAFATKTTEDEVRAYRKELGVTPVYKTVDTCAAEFEAFTPYYYSTYEEETEVIPASKPKVMILGGGPNRIGQGIEFDYCCCHAAYALKGAGYETIMVNSNPETVSTDYDTSDRLYFEPLTKEDVLNIIEAENPVGIIVQFGGQTPLKLALPLQEYLRQVGNGSLVIGNGNEETAITKIWGTSPDSIDSAEDRERFEKILQQLNISQPPNGIARSYEDALIVAKRIGYPVVVRPSYVLGGRAMEIVYSDAELERYMTFAVQVEPEHPILIDKFLENAIEVDVDAIADHTGRVVIGGIMEHIEQAGIHSGDSACSLPSISLPPAVLNQIRSWTVQLAQALSVVGLMNIQFAVVGASSYSPQVYILEANPRASRTVPFVSKATGISLAKLASLIMSGKTLEELNFTQEVIPSHIAVKEAVLPFNKFPGTDTILGPEMRSTGEVMGIDSDFGRAFAKAELGAGERLPLTGTVFVSMSDRDKSAAVSVVREFIDLGFKVMATFGTRRVLLENGLNVELVLKLHEGRPHVIDAIKNQKIQLIINTPSGEEAQTDARLIRRTGLAYKIPIITTIAGAKATVAAIRSMQNTTLDVKTIQEYCPNF

SEQ ID NO: 47669 - protein, 1582 aa, Aspergillus nidulans FGSC A4
MPSSKRLFLADEELGKKDDDHRLKKHPDQRWHPKLWKRPRRRRVLLIPVILYLFYVFFKNMPTDIPPARDRLISNLPSAQHSIPDVPVPPGLTQSEPPPRVESDTNEKDGLYYEGKLQFYNLAVTLKLFSDNGGKSPPSATVFAAASLGSVSDLLPLACRMALQKKNAVHFVLMGRDDVSIEGIQRVNGQNREICPLNWHDSRMEQAVAAVLPYIRAYLQPQVLITQGETFEDQFFLRAMRTAKDHEMPTIALPRAARDLMWMANLDSHALQKWNDINVEFLIYTAPESAGSVIRLINSLTRADFLGFSPGLTIELPSQVDLELLRFLEKMKWPSGMSSKITIRRRIQSHQMSSHEASLRAVESFYPRDPTLSHVLVLSPSVELAPSFFHYLIYNILYNKYSARANVLPAKLMGISLDLPSSRLTNIDPFKQPDIEDTQSSSNSAPGALPMFLWQAPNSNAALYFGDKWLELHSFLGHRLASVANAETRSTVDETDETFIPEFYPAFMKYLLELIRAKGYYLLYPAFYNDGQFSLATFHSELFQFPEGTFNKAAAAPNFEALRASTSTERPLSKASTLMPLLGTFPQGLPDITLLPILSHRGERISDYVLNRETEHIYGFLDYIQYLHLSDNMQTKLYTLEILISLHPALPSYPALLTSPSTYSTSLRRSSDSCSNMAKEGERSAPADKGKGKVDDVKDLGGSKEKPEEKTQGNGKKKDDEPQEEELSEEDQQLKSELEMLVERLQEPDTSLYGPALDAIKTFIKTSTSSMTAVPKPLKFLRPHYDDLAALYDKWSAGATKDSLADMLSVLGMTYGDEEKLETLKYRLLTKSDDLGSWGHEYVRHLALEIGQEYQNRVNDEKEVDDLIKLAVSLVPYFLRHNAEADAVDLMSELEIIEEIPQFVDENTYSRVCLYMVSMVPLLTYPEDHQFLRTAHEIYVRYKELTKAIVLAIRLNDVDLIKSDLEATSDRSLKKQMAFLVSRQQIWLDDLGDDEQDETFMECLNNTSIPKHFKSLGKELNILDPIMPEDIYKTHLESSRGAGLTNVDSARHNLASAFVNAFANAGFGNDEMMIVEGDKGSWVWKTKDDGMLSTTASMGMLLHRDVDTGLDKIDKYTYASEDQIKAGALLSIGILNSGVRLDSDPALALLCDNENLEAKNIPMRVATIMGLGLAYAGSNKQEILDALLPIVEDVSLDMQLSAMAAVSLGLVFVGSSNHQVSEAIATTLMDEERQKQLKDKWTRFMALGLALLYFGRQEEVDVILDILKAVDHPMAKPTSVLASVCAWAGTGTVLKLQELLHICNDVIEESDEKQGEELVQSYAVLGLSLIAMGEDVGQDMILRQFGHLMHYGASNIRKAVPLAMGLISPSNPQMKVYDTLSRYSHDNDNDVAINAIFAMGLCGAGTKNSRLAQLLRQLASYYHRDQNSLFMVRIAQGLLHMGKGTMTLNPFHTDRQVLSRVSAAGLLTVLVSLIDAKQFILAEHHYLLYFLITAMYPRFLVTLDEDLQPLPVNVRVGQAVDVVGQAGRPKTITGWQTQSTPVLLSYGERAELEDEKYIPLSSTLEGLVILRKNPNWEEESSA

SEQ ID NO: 47670 - protein, 148 aa, Gossypium hirsutum
MASKRILKELKDLQKDPPTSCSAGPVAEDMFHWQATLMGPSDSPYAGGVFLVSIHFPPDYPFKPPKVAFRTKVFHPNINSNGSICLDILKEQWSPALTISKVLLSICSLLTDPNPDDPLVPEIAHMYKTDRAKYEATACGWTQKYAMG

SEQ ID NO: 47671 - protein, 511 aa, Gerbera hybrid cultivar
MNTLQLIFLLFFFPTLLFLYCLPYKRNQNHRRLPPSPPSFPIIGHLHHLGPLIHQSFHALSTRYGSLIHLRLGSVPCVVVSTPDLAKDFLKTNELAFSSRKHSLAIDHITYGVAFAFAPYGTYWKFIKKLFTVELLGTQNLSHFLPIRTHEIRELLRTLMVKSRAKERVNLTEELLKLTNNVISQMMMSIRCSGTNSEADEAKNLVREVTKIFGQFNVSDFIWFCKNIDLQGFKKRYEGTHRRYDALLERIIMGREENRRRGKIKDGEGKDFLDMLLDVLEDGKAEIKITRDHIKALILDFLTAGTDTTAIAIEWALVELINNPNALEKARQEIDQVIGDERLVQESDTPNLPYIQAIIKEALRLHPPIPMLIRKSTENVIVQGYDIPAGTLLFVNIWSIGRNPQCWETPLEFKPHRFLDGGDLKSSLDIKGHNFQLLPFGTGRRGCPGVNLAMRELSVVIANLIQCFDWDVVGERLLNTDERAGLTAPRAVDFVCVPLERGNTLKILGSN

SEQ ID NO: 47672 - protein, 459 aa, Enterococcus faecalis V583
MAEKIPKKLKRSVRYVALETIERVDKGGAYSNLLLNEMMTKSELSEKDGRLFTELVYGTISRKLLLEYYLTPFVKKPQKVDNWVKNLLILSLYQLLYLDKVPDHAVINEAVEIGKRRGNPGIGKFVNGVLRAFQRNGAPSLAAISDPVDRLATEISMPRWLTEKLLAQLGEEETRQLGLSLFEKSHASGRVNTRFISREEALEELQETGIAAKESQLSPYGVVAEKGYLAGSELFINGCLTIQDESSMLVAPSMQIEPHHRVLDACAAPGGKTTHIATFLEAEAGGRVTSLDIHAHKIKLINENAQRLHVADVVQAEKLDARQVAEEFPAETFDRILVDAPCSGLGLMRRKPDIKYHKTANDFQNLPKIQLEILESVAPTLKQWGIMVYSTCTITPEENQEVVAAFLAKHPEFEKIEIVANENVQAVVKEQELVLYPHQYMTDGFFICCMRKVSSNEVK

SEQ ID NO: 47673 - protein, 869 aa, Medicago truncatula
MYSGFKSMLKRGQKVKGTVVLMQTNVFDINAINGATKNTTNLVKTGIKAVGGVAGTLIDTAGAFVGRSVALRLISATTADGSGKGKVGEKTFIEGFVTSMPILGAGQSAYDIHFEWNSDMGVPGAFYIESNMTREFFLVSLTLEDIPNHGTINFVCNSWIYSADKYKTKRIFFANKTYLPSETPAPLVYYREEELKTLRGDGTGQRKEHDRIYDYDVYNDLGDPDKYAHLARPVIGGSDTLPYPRRGRTGRKPAKKDPKSERRDDFVYVPRDEAFGHLKSSDFLVYILKSASQSFIPQLQSAITLQLNKPEFNSFDDVRSFYDGGIKLPTSILSKLSPIPFFKELFRTDGESALKFPPPKVIQVNQSAWMTDEEFAREMIAGVNPHIIKRIQEFPPKSKLNTDYGDNTSTITEEQLELNMDGVTVEEAIQNNRLYILDHHDSIYPYLRKINAADTTKAYATRTIIFLQNDGTLKPLAIELSSPHPQADSFGPVSDVYLPAKEGVESSIWLLAKAYVIVNDSSVHQLVSHWLNTHAVVEPFIIATNRHLSVVHPIHKLLLPHYRDTMNINALARSVLVNAEGIIESTFLLGSHSIELSSVLYKDWVFPDQGLPNDLLKRGVAVEDPTSPHGIRLLIEDYPYAADGLEIWDAIKSWVEEYVNFYYKSDVAVAQDSELQAFWREVVEVGHGDLKNATWWFKMQTCTELIEACTILIWIASAHHAAVNFGQYPYGGYILNRPTKSRRHMPKKGSAEYDELSKNFQKAYLRTITPKNDTLTDLTIIEVLSRHASDEQYLGQRNEGEAWTFDSQPLEAFKRFGRKLAEIEAKLIKRNNDESLRNRYGPVKMPYTLLYPSSEEGLTGRGIPNSISI

SEQ ID NO: 47674 - protein, 399 aa, Mycobacterium sp. MCS
MTPERAVIVGASHAGAQLAANLRREGWSGEVVLIGDEGGLPYHRPPLSKGYLAGKNGLDDLLIRGADFYEKQHIRLLNATVEAIHRSAKRVSLSTGDTLTYTKLALCTGARARRLPTPGVDLPGIHYLRTAADVELIRAAATPGRRVVIVGGGYIGLETAASLCSLGMNVTVLEATERVLERVTAPEVSAFYTRIHNGEGVEIRTHALVEAFSGNGRVQEVVLAGGEPIPADLVIVGVGVVPNTELASAAGLSVDNGIVIDDQARTSDPDIVAAGDCTSHTMARYGSRIRLESVSSAGEQAKIAAATICGKHSAIAALPWFWSDQYDLKLQIAGLNTGYDEVVFSGDPSRDRDFSCFYFRDRELIAADCVNRPRDFMFSKRAISQQLRVDRSELLAGSI

SEQ ID NO: 47675 - protein, 175 aa, Pisum sativum
VFVMLFALSSAIPNKRKPYKPCKNLVFYFHDILYNGKNAANATSAIVAAPEGVSLTKLAPQSHFGNIIVFDDPITLSHSLSSKQVGRAQGFYIYDTKNTYTSWLSFTFVLNSTHHQGTITFAGADPIVAKTRDISVTGGTGDFFMHRGIATITTDAFEGEAYFRLGVYIKFFECW

SEQ ID NO: 47676 - protein, 196 aa, Triticum aestivum
  misc_feature (83)..(83): Xaa can be any naturally occurring amino acid
  misc_feature (92)..(92): Xaa can be any naturally occurring amino acid
  misc_feature (139)..(139): Xaa can be any naturally occurring amino acid
RVLKPRVPPPSQAIYLHISAWPPTVRALSATSVGPFQGVKSTAGLPVSRRSNGDSLGSVSNGGRIRCMQVWPIEGIKKFETCXLPPLSTEAXLLKQVDYLIRSKWVPCLEFSKVGFIFREHNASPGYYDARYWTMWKLXPMFGCTDATQVINEVEEVKKEYPDAYVRIIGFDNMRQVQCVSFIAFKPPGCEESGKA

SEQ ID NO: 47677 - protein, 377 aa, Arabidopsis thaliana
LKRTRGKTMESTKIAPSFDRASELKAFDETKTGVKGLVDSGISKIPRIFHHSSVELANPKPLPSDLLHLKTIPTIDLGGRDFQDAIKHKNAIEGIKEAAAKWGFFQVINHGVSLELLEKMKDGVRDFHEQPPEVRKDLYSRDFGRKFIYLSNFDLYTAAAANWRDTFYCYMAPDPPEPQDLPEICRDVMMEYSKQVMILGEFLFELLSEALGLNPNHLKDMECLKGLRMLCHYFPPCPEPDLTFGTSKHSDGSFLTVLLPDNIEGLQVCREGYWFDVPHVPGALIINIGDLLQLITNDKFISLKHRVLANRATRARVSVACFFHTHVKPNPRVYGPIKELVSEENPPKYRETTIRDYATYFNGKGLGGTSALLDFKV

SEQ ID NO: 47678 - protein, 289 aa, Nostoc sp. PCC 7120
MITGKTKLLGVIGHPVEHSLSPVMHNAAIAQLGLDYVYLPFPIAPDNLEAAIALLATIGVVGFSVTIPHKQAIIPLLSEISPVAQAIGAVNTVTRQNNQWVGTNTDIEGFIAPLQTTYKRDWSQQIAVILGNGGAARAVVAGCYQLGFAEIHVVGRNVQRLEEFRHSWENSPIAENLQVHTWDYLAKLIPQANLLVNTTPIGMYPQVDESPLSAEELVNLQTGTIAYDLIYIPKPTQFLQKAQQQGAIIIDGLEMLVQQGVAALKIWLQQDDIPVDVMRQALIKHLGLK

SEQ ID NO: 47679 - protein, 545 aa, Burkholderia vietnamiensis G4
MASESSYNAPLPCRPTPMQRSELPAPLSRLFPLLTRRSLRIWRQFGVFWLGAIAVGLAAVLYARLIDWGYDTFRTMREHAAWLPLLLTPSIAAASAWITRRFFRGAEGSGIPQVIATLHASPRAFGSRLLTLRILFGKVLVSFLGILGGFTIGREGPTVQVGAALMFNLRRLYPRSNAQIERQLVLAGAAAGLSAAFNTPLAGIVFAIEELTRSFSARASGVLITAIILAGVVALGVNGNYTYFGTINAGQHFPKMLAVAVLVTAIVTGIAGGLFSWLLLNTGRWLPARLLVLYRERPIAFAALCGFVIAVVGIVSGGTTFGSGYAEARGLLDGHEQLSVFYPFLKMVSMVGSYLPGIPGGIFAPSLSIGAGFGNLLHLAFGNMSLPMLIALAMVGYLAAVTQSPITSFVIVMEMINGHALVISLMATALVSSRIARFFAPPLYETLAERYLAPPAAAPSATAPAAAAAAAAATAASGVTEPQDAPADPLDTLREEDGDAEVATQAQSPSSGSAPAAGHDAAHASAARPDADSPASTAADPRDPQ

SEQ ID NO: 47680 - protein, 245 aa, Zea mays
  misc_feature (7)..(7): Xaa can be any naturally occurring amino acid
  misc_feature (225)..(225): Xaa can be any naturally occurring amino acid
DKDYSFXLANQLGFAENKDFVELMRLYLTIHTDHEGGNVSAHTTHLVGSALSSPYLSLAAGLNGLAGPLHGLANQEVLVWLQKMKKAIGNDLSDQAIKDYLWSTLKAGQVVPGYGHAVLRKTDPRYVSQREFAQKHLPDDPMFKLVSQVYKIAPGVLTEHGKTKNPYPNVDAHSGVLLQYYGLTEQNYYTVLFGVSRALGVLPQLIIDRAVGAPIERPKSFSTEXLTPSWLAQSCKHVTATCSTV

SEQ ID NO: 47681 - protein, 907 aa, Burkholderia mallei ATCC 23344
MNDLSNGIRPVLATARRHDDTDPQETAEWLDALDGVVAHAGAERAQYLLAQLAEHAARRRLAPPHAGATPYVNTIPVDEEPPYPGDLQLEERLAAVLRWNALAMVVRANRAYGELGGHIASYASAADLFEVGFNHFFRAAGDASGGDLVYFQPHSSPGVYARAFLEGFLSDAQLEHYRREIAGPGLCSYPHPWLMPDFWQFPTGSMGIGPINAIYQARFMRYLQNRGLLRTEGRKVWGFFGDGEMDEPESIGALSLAAREGLDNLVFVINCNLQRLDGPVRGNGRIVDELESQFAGAGWNVIKVLWGSDWDALFARDATGALARAFAQTVDGQFQTFSANDGAYNRARFFGQNDALAALVAHLRDEDIDRLRRGGHDARKLYAAYERAVRHEGRPTVILAKTMKGFGLGAIGQGRMTTHQQKKLDVEHLLAFRDRFRLPLTDEDVAQLRFYRPEKDSPEMRYLHARRAALGGCLPRRRAAATAALTVPSLPSWGQFALDGGREMSTTMAIVRMLGGLLKDAALGPRIVPIVADEARTFGMANLFRQVGIYSPLGQRYEPEDLGSMLYYREDTRGQILEEGISEAGAISSWIAAATSYSVHDLPMLPFYIYYSMFGFQRIGDLIWAAADQRARGFLIGATSGKTTLGGEGLQHQDGTSHLAASTVPNCRAWDPAFAYEIAVIVDEGMREMVERQRDTFYYLTVTNENHAQPTLPADRLDAVRGGILKGMYPLDAAALPAARVQLLGSGAILGEVQAAARLLRDDWRIDAAVWSVTSFTELQRDGIAAERAQRLFDADDANERSPTPHVTSALAATQGPVIAATDYARALPELIRAYVPRRYVTLGTDGFGRSDTREALRAFFEVDRGSIVIAALRALADDGEVTRTVVRDAIARYGKRDASRTPPWER

SEQ ID NO: 47682 - protein, 552 aa, Xylella fastidiosa Dixon
MKALFRACRIGKVMLRYRLDTLLDGTAAERWLRLAKPFVPRISAEIVEQSRGRRLRLALQELGPIFVKFGQILSTRRDLVPQDIGDELVMLQDRVEPFEGQTARIIIETALGKSVESAFAHFDTVPLASASISQVHAATLHDRREVVVKVLRPDIEHQISDDIALLKSLATLVEHTHPNADKIRPREIVAEIETTLAAELDLQREGANASVLRRFWEASDDIYVPEVIWSHTAERVLTLERMYGIPSDDIALLDASGIDRKALSSKGIRVFYTQVFRDNFFHADAHSGNIWVDSDPARKSNPRFIALDFGIMGQLSQKDQYYLAENFMAIFHKDYRRIAELHVEAGWIPQHVRIEELEAAARSVCEPYFTRPLSQISLAEVLMKLFHVARRYQLTLQPQLILLQKTLLNIEGVGRQLDPELDIWVVARPVLERILRARYSPRHALKELNKRLPEIMTHAPDTPRLIHTWLVQQVESRKQNDVYLQQIRALAMTLQGLQRRVVNAIVGSGLLVAAAVLYGLHPDGLYLGTIPVWSLISGCVGALALFSAWWRS

SEQ ID NO: 47683 - protein, 148 aa, Gossypium hirsutum
MASKRILKELKDLQKDPPTSCSAGPVAEDMFHWQATIMGPSDSPYAGGVFLVSIHFPPDYPFKPPKVAFRTKVFHPNINSNGSICLDILKEQWSPALTISKVLLSICSLLTDPNPDDPLVLEIAHMYKTDRAKYEATARGWTQKYAMG

SEQ ID NO: 47684 - protein, 1003 aa, Desulfovibrio vulgaris subsp. vulgaris str. Hildenborough
  misc_feature (191)..(191): Xaa can be any naturally occurring amino acid
MRMPRRTFIKLASASAGALAFAGLGQSLAPTVARAAELKIAKAKVTPSVCCFCAVGCGLLVYTDTQTGRSINIEGDPDHPTNEGTLCPKGASIWQTTERSKRVTKVLYRAPGAAAWEEKSWDWALPRIARKIKETRDATFELTNDKGQTVNRTRGIASVGSAAVDNEEGWLMQAMMRALGLVYIESHARIXHSSTVGALAESYGRGAMTNHWIDLKNSDVILIMGSNAAENHPISFKWVTRAQERGATLIHVDPRFTRTSAKADIHAHIRSGTDIAFFGGLIRYIMENDLFFRQYVVDYTNASYIVGADYGFADGLFTGFDAEKGTYNTKKWAFAADENGMTLKDPTLNDPRCVFQLMKAHYARYDRKTVSDVTGISEEQLATLWSTFASTGKPDRAGTILYAMGQCQHTVGVQNIRALSMIQLLLGNIGIAGGGVNALRGESNVQGTTDISLLCDNLSGYLPTPKASWATFDDYVKGTTPVDKDPKSANWWSNRGKYLASYMKSVYPTASHQDGYLWHPKVDDGKITDYSWLQIFERMSKGGFKGAFVWGQNPCAGGANAGKNRKAMETLDWMVVVNLFENESSLFWKGPGVDPAKVKTEVFFLPACMSVEKGGSIANSGRWLQWREPGPKPMGDSRSDGDIVLDLYDEIRKLYREEKGAFPEPVLALDTDYRTDGKYDHHKVAKTLNGKFLTDVTIGDKTYKAGQQVPGFAMLQADGSTTSGCWIFTGCYTDAGNMMARRDRTQTPEQAAIGLFPNWSYAWPANRRILYNRAAVDMTGKPFDPKRAVIAWNGEKWVGDVPDGGWKPGEKLPFIMIREGRGQLFGPGRVDGPFPEHYEPFESPLESHPFSKQRVNPTALAFSHEPKAVRDKRYPFICTTYRVTEQWQSGTMTRNTGWLKEMQPEGFCEISRELAKELGIANGDAVVLESLRGKVQVVAIVTPRLKPFKVMGEVMHEVGIPWQFGWGQHVGKGDSANLLSPSVGDPNTGIPETKVFMVNLRKA

SEQ ID NO: 47685 - protein, 102 aa, Oryza sativa (japonica cultivar-group)
MSSDGGPVLGGVEPVGNENDLHLVDLARFAVTEHNKKANSLLEFEKLVSVKQQVVAGTLYYFTIEVKEGDAKKLYEAKVWEKPWMDFKELQEFKPVDASANA

SEQ ID NO: 47686 - protein, 148 aa, Gossypium arboreum
MASKRILKELKDLQKDPPTSCSAGPVAEDMFHWQATLMGPSDSPYAGGVFLVSIHFPPDYPFKPPKVAFRTKVFHPNINSNGSICLDILKEQWSPALTISKVLLSICSLLTDPNPDDPLVPEIAHMYKTDRAKYEATARGWTQKYAMG

SEQ ID NO: 47687 - protein, 148 aa, Gossypium thurberi
MASKRILKELKDLQKDPPTSCSAGPVAEDMFHWQATIMGPSDSPYAGGVFLVSIHFPPDYPFKPPKVAFRTKVFHPNINSNGSICLDILKEQWSPALTISKVLLSICSLLTDPNPDDPLVPEIAHMYKTDRAKYEATARGWTQKYAMG

SEQ ID NO: 47688 - protein, 335 aa, Xanthomonas oryzae pv. oryzae KACC10331
MNMAIKVGINGFGRIGRNVLRSAVQNFANDIEIVAINDLLEPDYLAYMLQYDSVHGRFKADVSVDGNTLIVNGKKIRLTQERDPANLKWDAVGADVVIESTGLFLTKDTAQKHIDAGAKKVILSAPSKDDTPMFVYGVNDKTYKGEAIVSNASCTTNCLAPLAKVINDKWGIKRGLMTTVHAATATQKTVDGPSNKDWRGGRGILENIIPSSTGAAKAVGVVIPALNKKLTGMSFRVPTSDVSVVDLTVELEKPATYAEICAEVKAQSEGALKGVLGYTEDKVVATDFRGETCTSVFDADAGIALDSTFVKLVSWYDNEWGYSNKCLEMVRVVAK

SEQ ID NO: 47689 - protein, 1271 aa, Mycobacterium sp. MCS
MAVTRTACSYCGVGCGIEVHTGSEGGRPVIARVSGDRLHPTNSGRLCTKGATHAEMMNATDGRLTSALLRPTRHEEPVPAPVDDAVAEAGRRLRAIVDEHGADAVALYVSGQMSLESQYLATKLAKGFLRTKYLESNSRLCMASAATGYKQSLGADGPPGSYTDFDVTNLFFVIGSNMADCHPILHQRMVDRLKTGAKLIVVDPRRTATADRADLYLPIRPGTDVALLNGLLHLLVERGDIDEEFIAEHTEGWAHMPEFLADYAPARVAAITGLAEADLHRAAAMIAEAGDWVTCWAVGMNQSTHGTANTNAICNLHLATGAICRPGAGPMSLTGQPNAMGGREMGYMGPGLPGQRSILSAEDRAFVEQRWGLPPGTIRTDAGPGAVDMFERLAAGEIKACWIICTNPVATMPNRRTTIAGLEAAELVITQDVYRDTATNRYADIVLPATLWAESDQVMVNSDRTLTLLQQAVPPPGQTRPDWQLICRIAAELGFGADFAYTDSAQIFDEIREFSNRRTGFDLRGATYDRLRETPLQWPVPPDDGTDRHPIRYLNDGVSQDLHVDASGHRPRLAFPTPSRRAVFYARPHVDAAELPDGDFPFVLNTGRLPHQWHTMTKTGRVRALVKLDGRPFVEVHPHDAAALDIVDGQSVELTSRRGRAVLPAVVCDRVMPGNCFAPFHFNDEHGEYLTVNALTNDAVDPDSLQPEFKVCAVALRPVQTVAAPTEELRTPAPEPVASDGPLVLWASQTGTAEDFATDVAARLPGAQLVTMDELPLPRLAEARDVVVITSTFGDGGPPDNGADFFDRLQGPDAPKLDHIRFAVLGIGDRSYSDFCGHARSLDGRLASLGATRMLDRVDCEAYDQDRMEHWAQQMTHLLNPDGVDSDGGGVTTRRRTTTVAEPFTRARPLLAPLARNTLLTPAESRKEVRHFGFDISEYDVTYAAGDSLGVYATNSAVAVDAWLAATGLDGSEKVDVDGAEHSLRDALTVSYDFCRVTPDLMRFVAEQCRDRSAAKRLRAARADLDAWLVDRNGLDVVREFEVRADPRQWQEVLVRLTPRQFSISSSPLVSPHEVQLTVSVVRYRGSDGGERGGVASTFLADRATAPLPVFLQRSPHFRPPRDGVTPMIMVGPGTGIAPFRAFLQERRALGHTGPNWLFFGDRHRDENFYYRDDLEDMVTDGFLRLDLAFSRDQPKPVYVQHRMLEHGAEVWRWLERGAHLYVCGDAARMAKDVDAALTTIIRKHGGLSESAAREYKKSLVAGKRYLRDVY

SEQ ID NO: 47690 - protein, 411 aa, Oryza sativa (indica cultivar-group)
MAMSFLSTTAAAAASSSQPPLPARRLPRRNPSLPFPLRPPHRLSPFSAPTPEPHRLTYRTHSTSSSSRTPTAAGLLSPVISTSRTLIFLLVASLLSLSGVRPLPSLASPPPPTQQPQETEEQEQQQESEEKQQQQQEEEGVEAEVEEAWLRQDEEEEVEEKEEEEEEEADDEVQMYMEILSRDPGDVDALKCALFAKMRRAEWGGALGFARRLREAEPGEVEWRFMEALLHELKGDLAEAERLFNEVLAEKPLLVRALHIAELVLAFSNVEGFVGLALCMHKRSEGPTVFEMLEKALQLAISEERVPEERNIKLLIAQMHVVKGQLDVASEKLQNLINEDPRDFRPHLCQGIVYALLDKKEEADELFDTYRSLVPDEFPDKSFISDVIQAARVESKDRLQKDFGSEFLSKK

SEQ ID NO: 47691 - protein, 277 aa, Mycobacterium avium 104
MNRTERSFDGVGGVRIVYDVWTPEVAPRAVLVLAHGFGEHARRYDHVARRFGAAGLVTYALDHRGHGRSGGKRVLVRDIHEYTTDFDTLVGIATREHHGLKCIVVGHSMGGGIVFAYGVERPDNYDLMVLSGPAVAAQDQVSPLLALAAKVLGVIVPGLPAQELDADAVSRDPEVVAAYRNDPLVYHGKVPAGVGRALLQVGETMPQRAPALTAPLLVVHGSDDRLIPVAGSRRLVECVGSADVELKVYPGLYHEVFNEPEREQVLDDVVGWITARL

SEQ ID NO: 47692 - protein, 819 aa, Mycobacterium sp. MCS
MTRRRLVVIGNGMAGVRAIEEILARGGADMFEITVFGDEPYGNYNRILLSNVLSGSDDTSEIYLNPLDWYTGNGIDLRAGVRVVRIDRYARLVHADDGTALHYDELIVATGSRSFFPPITGLWADDKTLADGVFGFRTLDDCLGMIHEAEHRTKAVVIGGGLLGLEAARGLQNRGLTVDVVHAGATLMNAQLDDTAGAILRRSVERLGITVHMDKRTTEALLGEDGKLRGIGFSDGSTVDCDMLVVAAGIRPNVGLAQRAGLTVERAIVVDDHMRSIDDDHIHVVGECAQHRGQVYGLVAPLWEQAGVLAAHLTGTDPTAAYHGSRTATKLKVAGVDVAAMGLKAPELPDDEFVQYSEPRHGVYKTIVIRDGKLVGATLLGDVSKVSFLTQAFDTGLPLPEERVSLMFDIGTPDVEVGVAELADDAQVCNCNGVSKGTLVGCVRDGEASVSGVMAKTKAGKGCGSCKELVGQIVEWAAGGAVTEDPSASWYVPGVPYDKPTLMRHIRELRLHSVSSVFAALAPDGREDAGSKMALASLLEMMWADEFVDERDARFINDRVHANIQRDGTFSVVPQMKGGVTNPWQLRRIADVADKYSIPMIKLTGGQRIDLLGVRKEDLPAVWADLDMPSGYAYGKSFRTVKTCVGSDFCRFGVGDSTALGIAIEDRYKGLASPAKMKLAVTGCPRNCAESLCKDLGVVAIDGGRWEIYVGGAAGAHIRKGDLLATVDSPDEVMTLTGRFLQYYRENANWLERTYAFVPRVGIEKIRDAIAEDAEGLDQRMQKSVDAYRDPWHDGRAPATEGQFRSSLPLLPLPQVPVR

SEQ ID NO: 47693 - protein, 541 aa, Magnetospirillum magnetotacticum MS-1
MSANPYELGLTKNDANFVALTPLTFLERAAAVWPDRLAVIHGPVRRTWAETFVRCRKLAAALAQRGIGLGDTVALMGANTPETFEAHFGVPLTGAVLNAINTRLDADAVTFILNHAEAKILITDREFSPVVKKALAALGRTIPVIDIDDPQFKGGELLGEKTYEQLLDEAQSEAPWTMPSDEWQAIALNYTSGTTGNPKGVVYHHRGAYLNAVSNALSWQMGDGTVYLWTLPMFHCNGWCFPWTMAVVAGTSVCLRHVRVDAIMSAIRDEKVTNFCGAPIVLNMINNAPAALKEGISHAVKVMTAGAAPPAPVIAGMERMGWEVTHVYGLTECYGPTVQCVWHDKWNPLSIEEKAQIKARQGVRGPMLEGLMIADPLSLEPAPKDGKTVGEIFMRGNNVMKGYLKNPAATQEAFAGGWFHTGDLAVWHPDGYVEIKDRSKDIIISGGENISSIEVEDILYAHPAVLEAAVVARPDEKWGETPCAFIALKDGAEASEADIISFCRERMAHFKVPRTIVFGGLPKTSTGKVQKFMLRQKAKEL

SEQ ID NO: 47694 - protein, 268 aa, Brassica napus
  misc_feature (234)..(234): Xaa can be any naturally occurring amino acid
AQTPFFYIFREREFVYDLFEAATGMRMMHNFFRIGGIAADLPYGWIDKCLDFCDYFLTEVVEYQKLITRNPIFLERVEGVGIIGGEEAINWGLSGPMLRASGIPWDLRKVDRYESYDEFEWEIQWQKQGDSLARYLVRLSEMTESIKIIQQALEGLPGGPYENLESRGFDKKRNPEWNDFEYRFISKKPSPTFELSKQELYVRVEAPKGELGIFLIGDQSGFPWRWKIRPPGFXINLQILPELVKRMKLADIMTILGSIDIIMGEVDR

SEQ ID NO: 47695 - protein, 542 aa, Pediococcus damnosus
MAKSPVEILNDPFLNKGTAFTKEERQSLGLVGLLPPYVQTLDEQAAQTYAQVESKTSSLEKRIFLMEIFNENRVLFYKLFSQHVVEFMPIVYDPTIADTIENYSELFVQPQNATFLSIDDPDSMKDSLKNAADGRDIRLIVVTDAEGILGIGDWGTNGVDISVGKLMVYTAAAGIDPSQVMPVALDTGTNNQDLLKDPMYLGNRHERVTGDRYYKFVDQFVNTAEDLFPKLYLHFEDFARDNDANILNTYKDKITTFNDDIQGTGIIVLAGILGALNISKQKMTDQVYLSFGAGTAGAGITKRIYDEFLQQGLSADEAKKHFYLVDKQGLLFDDDKTLTPEQKPFARSRSEFANADDLTTLEAAVKAIHPTILVGTSTQPGTFTESIVKEMAAHTDRPIIFPLSNPTKLAEAKAEDLIKWSDGKALVATGIPADDVEYNGVTYQIGQANNALVYPGLGLGVIASTAKVLNDEMISKAAHSLGGIVDGNKAGAAVLPPVSKLDQFSYTVAKAAAQSAVDQKLNQEPISDVDKAITDMKWEPKY

SEQ ID NO: 47696 - protein, 827 aa, Magnetospirillum magnetotacticum MS-1
MSLTRRDFIKANAVAATAAAAGLATPAIAQPAKANIRWDKGVCRFCGTGCSVLVGVQDGRVVATQGDPDSPVNRGLNCIKGYFLSKIMYGEDRLTRPLLRMKDGKFDKNGEFQPISWDQAFDIMAEKWKEQLKKPDGVTRVGMFGSGQWTIWEGYAASKLYKAGFRSNNLDPNARHCMASAVAGFMRTFGIDEPMGCYDDIEQTDAFVLWGSNMAEMHPILWSRVTDRRLTHEGCKVAVLSTFEHRSFELADIPMVFTPQTDLAILNYICHYIISKNAYNKEFIDKHVNFKKGATDIGYGLRPTHALEKDQANAATPDKADPMTFDEFKAFVAEYTVEKVSKLSGVPADKLEALAKLYADPKVKVVSFWTMGFNQHTRGTWVNNMIYNVHLLMGKISEPGNSPFSLTGQPSACGTAREVGTFAHRLPADMVVMNDKHREIAEGLWKLPAGTINPKIGYHAVLQHRMLKDGKLNAYWVMCTNNMQTAPNMNEEGYPGYRNPANFIVVSDPYPTVTALAADLILPTAMWMEKEGAYGNAERRTQFWRQQVKAPGEARSDLWQIMEFSKRFKIEEVWPEELIAKKPELRGKTLFEVLYKNGQVDKFPLTELQAGFENDEAKAFGFYPQKGLFEEYASFGRGHAHDLAPFESYHKARGLRWPVVDGKETLWRFREGYDPYVKAGEGVKFYGKPDGKAWIFALPYAPAAESPDKDFDLWLSTGRVLEHWHSGSMTRRVPELHKSVPNAVLYMHPNDAAKRNLRNGDVVKVASRRGEVTTRIDTRGRNKPPEGLVFMPFFDESQLVNKLTLDATCPISKETDYKKCAVKVSKA

SEQ ID NO: 47697 - protein, 127 aa, Debaryomyces hansenii CBS767
MGRKLISSGSTFEKEIGYSRAVVVGEMVFVSGTTGYDYTTMEISDNVIEQADQTIRNIENALVEAGSCLQDVVKVTYILPDASEFERCWPTLRKYFGNIKPAATMISAKLADISMKIEIEVIALKVH

SEQ ID NO: 47698 - protein, 346 aa, Zea mays
MENMLHLAPSSQAQALALDRSSVFSREHVPPAVSAVTSLPVIDMSRSRDEVRRAILDAGMEFGFFLVVEHGIPEEVMRDMLEVCEEFFQLPAASKAYMYSEDSQRPNRIFSGTTYDTGGDKYWRDCLRLACPSSFPVGSGTRDDWPHTPQRLRGVVERFTALTRGLGVELLRLLSEAMGIRPDYFEGDISAGDVVLNVNHYPPCPSPEKTLGLPPHCDRNLITLLLQGSVYGLDVAYRGEWIKVEPMPGAFVVNFGQQLEVVTNGLLKSVEHRVVTSSTLARTAVATFIMPTPDCLIGPSKEFLAGDKPPCYRTIRFGDFMRMYNTVKLGSSINQTTDLKNIQKKI

SEQ ID NO: 47699 - protein, 719 aa, Guillardia theta
MDIRCSENVFITFQIIIFNLNNLFIYCTCYNKSILFRKLKNFFKKLLSNLKYNFKLDNFQLICLNLMYFNVDIFVAAHTSSGKTLVGEQVIFSTLKLNKRVIYLSPIKALSNQKFEDFKNIFYNVGIITGDQIINPDANCVIMTTEIFRLYILNNSNWLKNINYIIIDEAHFIFDETRGFVWEEIIIITPGYINIIYLSATISNLMEMSEWIFITRKKILFTIKTDRRIIPLVNYIYLSKIDKIAKLDFFLKNKNLIFNYKKGIKINFRKNSIQDFNQLIRLLKNKNLLPLIYFIFNKKKCILLSKNFMKFSFLSIFEKNILNRLLEMIGKKKKFSIISHELDSYKNFWILLLNGIAVHNSDISIVSKKLIEILFQVNLIKILFATETFSIGLNMPAKTVVFHTLKKFDGNKIRKLRKSEFIQMSGRAGRRGIDHKGFIFTIYRNNNDFDLLNSIINKTDPNPNSIYKLSVYISLKLSCLDNKEKINYFSHLISSYKKDKNSKIFYRNSYVIIKRKNQNLNLFSGNNFSYLFFLFTDLFRYFNNYSKISLQYAFEVTSFCKRKIYRPIYLNEKFFLKIHKFLIFNKTLVMNLIIKLISSSIIYNHSKLTQKNKFFFFKMLNLEYYLNNIFDLKNKNSFLLQFEKISKSLKNMGLIGSNQRLNKKAEVCIKSRLDENLILLELIYNGFFLKKPIEVIVSILSNFELHLGKKKTSILCFPS

SEQ ID NO: 47700 - protein, 298 aa, uncultured archaeon GZfos26F9
MLKIEGVYPALITPFTKDDEVDKEGLRRLVEYVIEGGVAGIVPCGTTGESATLSHKEHEEVIDVVVDCSKVPVIAGTGSNNTKEAVEFTKHAADAGADACLLITPYYNKPNVKGLKEHFKRIGDSVEIPLILYNIPSRTGQNVSAGTMVELASEITNIKGVKEASGDLKQVGAIIRSVAEQGLDFTVVAGDDFLTLPIMSLGGKGVISVAANIAPREMTEMVAAMLKEEVEKAKEINIRLFPLFEAMFLETNPIPVKKAAEMMGLSAGHVRLPLGALSEANVEKLRKVLEKLGMVRGT

SEQ ID NO: 47701 - protein, 925 aa, Aspergillus nidulans FGSC A4
MAPTAPPILDFSPFYGTDGAAKAKLVQQVRESCEYNGFFQITGHRIPRELQVRVMDAAKRFFALPLEEKMAIDKNLNSFNRGYELLRSQMLEVGTAPELKEGLYIGEEIGADHPYYINGRLNSGPNQWPATVPDAQEFRETSMEYYHAVYELAKDVLAVLALTLDVEESFFDPLTEGGVATMRMLHYPSQPKDEDEKLNRGIGAHTDFGCITLLLQDEVDGLQVLDAPSGQWLDVQPVLGAYVVNLGDLMMRMANDRYKSNIHRVINKSGRERYSIPFFFSGNPDHVCKCLPNCCKAGEQPKYPPITVEDMVRGAYKQSYGRAEAYKKELAEKAKAHKIEAASATAMHNEYEMDKFVFNTATAGLPWITKYRMDISYPVINAGGLKNIASQIIMEIELDKRENRPTDNVPPDDIGKIEVVDDAEMEQFYGSSTTDAYRLKSELVSQCMADIGMGRFQWKLFTVAGFGWIVDNFCSQGISAVQPPIQQEFSGIKQVSYSSVAYYVGMIIGASFWGISSDLIGRKPAFNSTLAIAGIFLCAAAGTSNFIAFSALWAVIGTAAGGNVVCDSMILLEFIPGSHQYLLTALSGWWNLGQLVVSLLAWVFLANFSCPTDATPDTCSRADNMGWRYTLITLGGLSLAFTFVRIFVFKMPETPRYLLSQGNDQAAVDAVNYVARQNGKPEPLTLSMLQAIDVRLGFTPNAEERLSTKDILKENMQEFRGEHYQALFATRKLSQHTALIWAVWLIIGIAYPLYFNFLPSYLATRFTQDSSLDLTYRNYCIQSAVGVVGPLSAAVLVNTFLGRRWMMGISSIVTGVFLFAYVGVKTPMSSLAFSCVTGLLANFANQLSEYAIMYAFTPESFPAPHRGTASGTAASLLRFGGLVASLIASETGFTTAPIYASAALWVGVGVLCFGLPFETHGHAAI

SEQ ID NO: 47702 - protein, 811 aa, Alkalilimnicola ehrlichei MLHE-1
MQRERLVLVGNGMAGVKTLEELLAVAPERYEITVFGAEPHGNYNRIMLSPLLSGEKTVDDIMLNRPEWYAENGITLHTGCPVTEINRRHREVISGDGRRTPYDRLLLATGSNPFIIPVPGNDLPGVLAYRDIGDVEAMLEASRQHRHAVVIGGGLLGLEAAWGLHQQGMAVTVVHLAPHLMERQLDALAGGMLEQSLRERGVEFRLEAQTQALLGDDRVEAVRFADGEEIPADLVVMAAGIRPNIHLAKAAGILCERGIVVNDTMQTFDPRIYAVGECVQHRGQCYGLVAPLFEQAKVCANHLAEAGFAAYEGSVTSTKLKVTGVDLFSAGDFSEAEGTEAIVYQDPAGGIYKKLVLQEDRIRGAVLYGDTSDGAWYFQLLKDGTSVSDFRDSLLFGQAHLGDAGHGGQSHAEAMPMDAQVCDCNGVCKGDIVNAIQEQGLFSLEEVQSHTKASASCGSCTGLVEQILQSTVGGGYAEPRVKPLCACTDHSHDQVRKAIREQHLTCLQQVFDTLEWKTPDGCDKCRPALNYYLISTWPEEAQDDEMARLVNERMHANIQKDGTYSVVPRMWGGTTTPAELRKIAEVAERYDVPTVKVTGGQRIDLLGVKKEDLPGMWGELAEAGFVSGHAYGKALRTVKTCVGSEWCRFGVQDSTSLGIALERMCWGAWTPHKVKLAVSGCPRNCAEASIKDLGVVAIESGWEILVGGNGGVKVRACDTLCRVETAEEVMEYAAAYLQLYRETGRYLERTAPWIERVGLSWVREQVVDDDVNRKRLAERFERAQSIYRKDPWATLARQGQRDRFQPLRQVG

SEQ ID NO: 47703 - protein, 904 aa, Alkalilimnicola ehrlichei MLHE-1
MNTSIQPPRQPGEVHTTCPYCGVGCGVLARMDKDNRVHVRGDPEHPANFGRLCSKGAALGETTGLNGRLLHPRVHGQRTDWDTALATVADGLNRVIRRDGPEAVGFYVSGQLLTEDYYVANKLMKGYIGSANIDTNSRLCMASSVAGHIRAFGEDLVPGCYEDLERADLVVLTGSNLAWCHPVLYQRLEAARARRPGMRVVVIDPRETETAAQADLHLPLRPGSDVALWNGLFRRLVETDQIHRDIRPETEAADSNLKRILHEAGDADAVASACDLNPRALHLFYDWFAGTERTVSVYSQGVNQSSQGTDKVNAIINVHILTGRLGRPGCGPFSVTGQPNAMGGREVGGLSNQLAAHMGFSQGDRIRVQRYWDSPRIARQPGMKAVELFRAAAQGRVKALWIMATNPVVSLPDADLVKRALARCELVVVSDCIANTDTTGYAHVLMPAAAWGEKSGTVTNSERCISRQRAFRTPAGEARPDWWIISQVARLMGFDRGFAYGSPREIFDEHARLTAVHNPGPGMGGRTLHLGALAGMNAKQWDTLQPVQWPCPGPGLDTAGPGRGTQRLATNGGLPTEDGHPRLHPVCAETPGNTPDARFPLVLNTGRTRDHWHTLTRTGLSVSLSTHQPEPRCDLHPEDATRFGLADGHLVRVRSAWGSVLLRARYQTGQRRGELFVPMHWNDCYAAQARIGAVANPITDPISGQPELKHTPVAVEAVPAAAYGFVLSRADDLPPPETAYWVRINGHAHQRFVFASTEAPDSWRDWAGRWLGTEGTVVEMADRARGVYRFARLVDDRLVACLFIAADPAALPGCDWLAGLLDNNRPLGAEERLALLAGRPAGEAETGETVCACFGVGERIIESAVAAGAHDTEAVTRHCKAGGYCGSCRPAINAIIQRLARSAA

SEQ ID NO: 47704 - protein, 125 aa, Hordeum vulgare
QQANDVRATYHYYRPAQNNWDLGAPAVSAYCATWDASKPLSWRSKYGWTAFCGPAGPRGQAACGKCLRVTNPATGAQITARIVDQCANGGLDLDWDTVFTKIDTNGIGYQQGHLNVNYQFVDCRD

SEQ ID NO: 47705 - protein, 401 aa, Clostridium difficile 630
MSKKVLIMSASTGGGHNRAALAIKEELTSKTLDGEPIECEIIDSLKLVNNTMDKIISRGYEKSAIYTPKAYGSVYRLSETNLLSKNEFKDNLLITFMAKKFKKLIRSEKPDLIIGTHPFPMIALSTLKKNFNLHNNESNAYTEHFYKHYTNTINVPPLISVLTDYTTHSTWIQNEIDYYIVGHEYVKELLVFDGVEPSKIRTFGIPVEKSFLSHRDKDIVLSELNLSPDKLTVLLMGGSFGAGNIKETLDELLDTDRDFQILVITGKNESLKEKIEKKLMSRYHDKNVCVLGYTDKMNDILASIDVLVSKPGGLTTTEALLKDVPMIVPYYIPGQEEENLDFLSNCGAALRTTKKYNLSILLKVLIDDPSRLEMLKRNIKSIRKSNSAQNIANLILNIISG

SEQ ID NO: 47706 - protein, 355 aa, Burkholderia mallei ATCC 23344
MKIAVLPGDGIGPEIVNEAVKVLNALDEKFELEQAPVGGAGYEASGHPLPDATLALAKEADAILFGAVGDWKYDSLERALRPEQAILGLRKHLELFANFRPAICYPQLVDASPLKPELVAGLDILIVRELNGDIYFGQPRGVRAAPDGPFAGAREGFDTMRYSEPEVRRIAHVAFQAARKRAKKLLSVDKSNVLETSQFWRDVMIDVSKEYADVELSHMYVDNAAMQLAKAPKQFDVIVTGNMFGDILSDEASMLTGSIGMLPSASLDQRNKGLYEPSHGSAPDIAGKGIANPLATILSAAMLLRYSLNRAEQADRIERAVKAVLEQGYRTGDIATPGCKQVGTAAMGDAVVAAL

SEQ ID NO: 47707 - protein, 786 aa, Haloarcula marismortui ATCC 43049
MATGTSLIVVEDGTNESMPTLWLDEIGADDLARVGGKAASLGELTGAGLPVPSAFVVTADTYRSFIEATGIDEPLFEAVDVDSDDSQALAEAAERAQELILETDTPPSVREDLLAAYDEMGDEDVAVRSSATAEDLPDASFAGQQDTYLNVSRTDLLQRVKECWASLFTQRAIYYRNENDFAHDAVDIAVVVQQMVDAEKSGVMFTSHPSTGGPTAIIEAAWGLGEAVVSGAVSPDNYIIDRETETIDEVTVADKKVMCVRGEDGETIERSVPEEKRNERVLSDEEIHRLLEVGERVEEHYDTPQDVEWAVYEDEVYLLQSRPITTIDDPEGSAGSANEAESQPPGAKSGVADGGAMESQSEAVRLSGIGSAPGRVTGVVRIVDKLDNLDKVEDGDIIVAEMTTPDMVPAMKRANGIITDEGGMTSHAAIVSRELGVPAVVGAEDATQKLRDGETITLDGDKGTVEKGANVPETTEEDKDAGPVETHSAVKPMTGTEVKVNVSIPEAAERAAATGADGVGLLRIEHMILSTDKTPSRYVEDHGERAYVDEIVEGVRSVAEAFYPRPVRVRTLDAPSDEFRQLQGGEDEPSEHNPMLGYRGIRRSLDRPGEFKLELRAFERLYDLGYDNVELMLPLVTDAEDILRAKALMQEVGIDPEKRDWGVMVETPASALSIEGICEAGIDFVSFGTNDLTQYTLAVDRNNGNVADRFDELHPAVLELMRQVIGTCREHDVATSICGQAASKPQMVDFLVDEGVTSISPNIDAVRDVQHEVKRVEQRLLLESVR

SEQ ID NO: 47708 - protein, 350 aa, Haloarcula marismortui ATCC 43049
MLQRAEPQDFERVLSSMCTVPHPSAREAAERFLATNPGDPGTYETIAGLEREAVEYLGDITGLSDPAGYVASGGTEANLQAIRIARNRADTDDPNVVAPVHAHFSFTKAADVLGVELRTAPAADYRVNMAAMAELVDEDTVCVVGVAGSTEYGYVDPIPAIADLAETVDALCHVDAAWGGFYLPFTDHDWHFGHADIDTMTIDPHKVGQAAVPAGGLLARDRTLLDELAVETPYLESTDQLTLTGTRSGAGVASAVAAMESLWPAGYRQQYETSMANADWLADQLSARGHDVVGPELPLVAADLSMPMTDELRDRGWRVSKTGAGEMRVVCMPHVTRSMLRSFVADLDWY

SEQ ID NO: 47709 - protein, 277 aa, Arabidopsis thaliana
MLYIIGLGLGDEKDITLRGLEAVKKSQKVYMEAYTSLLSFGLSADGLSNLEKFYGKPIILADREMVEEKAGDMIDEAIDNDVAFLVVGDPFGATTHSDLVVRAKTLGVKVEVVHNASVMNAVGICGLQLYHYGETVSIPFFTETWRPDSFYEKIKKNRSLGLHTLCLLDIRVKEPTFESLCRGGKKQYEPPRYMSVNTAIEQLLEVEQKHGDSVYGEDTQCVGFARLGSEDQTIVAGTMKQLESVDFGAPLHCLVIVGETHPVEEEMLEFYKYKSGN

SEQ ID NO: 47710 - protein, 678 aa, Candidatus Kuenenia stuttgartiensis
MDFFFVNSKISERKVKIWNSNGLHARPATKFSEIANKYTSEIRVEAKGKNIDGKSIIELLTLGAENGTELLISAKGVDCAEALDALEELVNSKFEEEFMEIRKGIAVSPGVVIRQAFLFESEGFRIPRHVIKNEAVEDEVCRLEKAIDASKKEIEDLEKKVSENLGSEIGSIFGTHRMVLQDARLKDEIIKRIRKTNFTPEFAVSLALRVYIRKFQDIKDSYLAERVTDIFDVERRLLRNLLGEKREELKNLEEEVVLVAHDLTPSQTAMLDPQKVKGFATDGGGRTSHTAIVARALGIPAVVGLGTVTSDVFGGDIVIVDGNRGLVIVRPDDETLATYQSKVKSIDVFEKKLAIELKDQPSTTADGRHISIFGNIEFPREIGVNLNYGAEGIGLYRTEFLYLNSPTPPTEEQHLEAYTTVVQELKGRPVIIRTLDLGADKLPYLEHRKEGNPFLGCRSIRYCFENPSIFKIQLRALLRASALGEVKILFPLISSIQELRRAKQMVYETMEDLDKENISFDKNVKMGTMLEVPSSVMISDMLAKECDFFSIGTNDLIQYSLAVDRNNERVAYLYCPVHPAILRFLKFAIKSAHENDIPVGICGEMGGELEYTIPLVGLGLKEFSVAPATIIPEMKKIIRSVSFEEAREVAETVFKFDNPEKTKKYLNDFVRKILPEVY

SEQ ID NO: 47711 - protein, 408 aa, Xanthomonas oryzae pv. oryzae KACC10331
MSTAADSPLSLAHYYLPVYRPRQVVLERGQGSRVWDDQGREYLDLSSGIAVSGLGHNDPDLMAALTEQAAKLWHTSNVFFSAPPLKLAEELVTASRFALKVFLCNSGTEANEAAIKLVRKWASSHGRPADKRVIVTFGGSFHGRTLASVTATAQPKYQEGYEPLPGGFRHVDFNDVTALEAAMASGDVAAVMVEPIQGEGGVMPAAPGFLSRVRALCDQHDALLVLDEIQCGMGRTGTLFAHWQDQVTPDIVTLAKALGGGFPIGAMLAGPKVAETMQFGAHGTTFGGNPLAAAVARVALRKLASPQIADNVARQSAALRAGLEALNADFDLFAQIRGRGLMLGAVLAPAHAGQAGAILDLAAKHGLLLLQAGPDVLRFVPALNLTDAELADGLACLRLALAEYVAQS

SEQ ID NO: 47712 - protein, 217 aa, Triticum aestivum
MVSLQSALLPEAGKRPPCLSLADASVVASTATSKKRKRDGEVEEEEGEEHDGIELNFDAAPLPLEWQRCLDIKSGQIHYYNTRTHKRTSKDPRRHGGAAPAVEEDVANCGPQGLDLDLNLAFEPRRSSPVKELQKKAEAKPAAAGGDRHGDQAPGSASGGMEMVAAVCMRCHMLVMMCRACPACPNCKFLHPTSRPTPPPPEPAPLKLGLQLLCCRD

SEQ ID NO: 47713 - protein, 175 aa, Triticum aestivum
MAPAVMASSATSVAPFQGLKSTAGLPVSRRSSSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 47714 - protein, 149 aa, Glycine max
MSTYRDEDPRLHDIKTKIRVVPNFPKPGIEARGFIFGSPIALAIGAKFVPLRKPKKLPGKVISQEYILEYGRDCLEMHVGAVEPGERALVVDDLIATGGTLCAAMDLLERVGAEVVECGCVIELPELKGRERLNGKALYVLVECFECCQ

SEQ ID NO: 47715 - protein, 462 aa, Triticum aestivum
  misc_feature (118)..(118): Xaa can be any naturally occurring amino acid
  misc_feature (131)..(131): Xaa can be any naturally occurring amino acid
MTTGAVTESFPESSEPLLPTKRRWEGEDGGGDEAAFHEFNGASFAGAVFNLSTTIVGAGIMALPATMKVLGLVPGLVMIVLAAFLTDASVELLMRFSRVVGAPSYGAVMGDAFGWWGXRRLLQVCVVVNNXGVMIVYMIIIGDVLSGTSSGGEHHYGVLEGWFGTHWWNGRFFVLLVTTLGVFTPLACFKRVDSLSYTSAISVALAVVFVVITAGIAIVKLIRGQIPMPKLFPAVPDLASVWELFTAVPVLVTAYVCHYNVHPIHNELKESSQIKPIVHTSLALCSTVYITTSFFGYLLFGESTLADVLANFDSNLGIPYSSVLSDAVRVSYAIHLMLVFPMIFHALRLNLDGLLFSSARPLSSDNRRFGVMTAVLLLVIFISANFIPSIWDAFQFTGATAAVCIAFIFPAAITLRDPHSIAKKWDKILAIFMIVLAVTSNVVAVYSDAYSIFHKKSASSNA

SEQ ID NO: 47716 - protein, 189 aa, Glycine max
MALRLSVSSPQSTASSPAISSCRPAACGRFLACVAASQKRSLMVVSGADARAVAPVKSGGLETATTGADEVEAPTAAVAVTGQVTEVCKDTFWPIVKAAGEKPVVLDMYTQWCGPCKVMAPKFQEMSEKDHDVVFLKLDCNQDNRPLAKELGIRVVPTFKIFKDGKVAKEVTGAKIDELARAIEEVKSS

SEQ ID NO: 47717 - protein, 900 aa, Arabidopsis thaliana
MNGKQLRIMYSRNQMESMRYAHIANQKKLWSDLYARLLPELVTEYEEDYVVKEEKTEDNDDYNSILRPAFAVDGEPDFDSGPPEDGIEYLRRVRHIWLSCFHHLRWEAKRIPNVKVAKVSGSKYREKEQSVYMPQIPRAPATGEGMGGLVAFRLLTHSSGIPFFQLAYLSVFLLTDKDTRNGLSDTGIKAEKADMFGEKESGLESSDCKWVVALCASVDTPPDADTSACLRALVRKCASLRALEVGVLEMNKLSLWQICSSPSQADILAKWNERRTDSENTGSGSSNQNSHPSRPAYVPPHLRNRPAASEPVAPLPANDRVGYGGPPSGSRWAPGGSGVGVGGGGGYRADAGRPGSGSGYGGRGGGGWNNRSGGWDRREREVNPFENDDSEPEPAFTEQDNTVINFDAYEDIPIETSGDNVPPPVNTFAEIDLGEALNLNIRRCKYVKPTPVQRHAIPILLEGRDLMACAQTGSGKTAAFCFPIISGIMKDQHVQRPRGSRTVYPLAVILSPTRELASQIHDEAKKFSYQTGVKVVVAYGGTPINQQLRELERGVDILVATPGRLNDLLERARVSMQMIRFLALDEADRMLDMGFEPQIRKIVEQMDMPPRGVRQTLLFSATFPREIQRLAADFLANYIFLAVGRVGSSTDLIVQRVEFVLDSDKRSHLMDLLHAQRENGIQGKQALTLVFVETKRGADSLENWLCINGFPATSIHGDRTQQEREVALKAFKSGRTPILVATDVAARGLDIPHVAHVVNFDLPNDIDDYVHRIGRTGRAGKSGLATAFFNDGNTSLARPLAELMQEANQEVPEWLTRYASRSSFGGGKNRRSGGRFGGRDFRREGSFGSGRGGYGGGGGGYGGGGGYGGGGGYGGGGGYGGGYGGASSGGYGGEPPSAWD

SEQ ID NO: 47718 - protein, 556 aa, Phytophthora erythroseptica
MINDTPAWKALAEHAAEIKSTHLRELLNDDARNAAMRTEQQGIYLDFSRQNATSKTLDSLFELAETAELKKKLQAIASGEHVNATEDRAVMHMALRAPKTEKIVVDGHDVVPDVHEVLDAIRAFTSNVRDGKFVGATGKQLKNVISIGIGGSHLGSEFVFESLRYEPVAKAAAEGRILRLLANVDPVDVARATSGLNPEETLVVVVSKTFTTAETMLNARTLRKWLVDDLTKKGSSEAGAVAKHMVAASSAVPLVQQFGIDRANIFGFWDWVGGRYSVTSAVGILPLALQYGFDITEKFLAGAHATDKHLLETPLRNNLPVIMGLLGVWNSSFLGHSSRALLPYSQALLRFAAHIQQVDMESNGKRVTVEGVDLPFQAGEVNFGEPGTNGQHSFYQLIHQGRVVPCDFLGFCESQNPVQLAGEPVSNHDELMSNFFAQPDALARGKSIEDLRAEGVPEKLQNHKLFPGNRPSISLLFKKLDAFSTGQLLALYEHRTVVQGAIWGINSFDQWGVELGKVLAKQVRAQLSASRTENAPVKGFNSATTSMLEAYLAHKA

SEQ ID NO: 47719 - protein, 104 aa, Guillardia theta
MTVGKGKVGKGLGKRGTKRHKKVLRDSIQGITKPAIRRLARRGGVKRISGLIYEETKIVLKLFLENVVKDAVTYTEHARRKTVTAMDVIYALKRQGRTIYGFGY

SEQ ID NO: 47720 - protein, 418 aa, Bacillus clausii KSM-K16
MATKMTMPQLGESVTEGTISRWLVGPGDTVQKYEPIAEVLTDKVSAEIPSSYTGTIEQLLVDENETVAVGVDICTIVEEASSEAEESNKEIKTEQKPNPPAKEQTKAEPSQKSRYSPAVVRLAQEHGLDLTTISGSGRGGRITRKDVEAYIAGNHTPEPQQPPAQAKQQEPVRSTPSQAIAAHDQEIPVTGVRKAIAENMVKSKMEVPHAWTMVEVDVTNLVKLRDKKKAAFKEQEGISLTYFPFFMKACVEALKEFPEINAQWNGTTIVRKKDINLSLAVATEDALYVPVIHQADELTIKGLAKKADELAKKARTGKLTGADMQGGTFTLNNTGSFGSILSQPIINSPQAAILSVESIVKRPVVRETEEGDVIAIRHMVNLCLSLDHRVLDGLVCGRFLASMKRRLEQMNEDSTSIY

SEQ ID NO: 47721 - protein, 560 aa, Candida albicans SC5314
MSELSIKTIETKPFQDQKPGTSGLRKKVTVFQQPHYTENFIQSILDAIPEGSQGSTLVIGGDGRFYNDVVIQLIIKIAAANGVKKLILGQNGILSTPATSHVIRIKQATGGIILTASHNPGGPQNDLGIKYNLGNGGPAPESVTNKIYEISKQINQYKLIELPNVDLSKIGTIVEGPIEIEIIDSTKDYVDMLKSIFDFPLIKSFIDKATKEQDFKVLFDALNGVTGPYGYEIFVNELGLPESSIQNYKPLPDFGGLHPDPNLTYAHTLVERVDKENIAFGAASDGDGDRNMIYGAGTFVSPGDSVAIISEYADSIPYFQKQGVYGLARSMPTSGAIDLVAANKNLQCYEVPTGWKFFCSLFDAKKLSICGEESFGTGSNHIREKDGLWAIVAWLNVLAGYNKQNPQSKTSIEIVQNSFWEKYGRTFFTRYDYENVSSEGAQKLIDLLQSIVNEKSVGDELAPGYIIKQADNFSYTDLDGSVSSNQGLFIKFDNGLRFIVRLSGTGSSGATVRLYLEKHCDDKSKYHLKVDEYLTNEIQFVLELLKFKQFLNKEEPDVRT

SEQ ID NO: 47722 - protein, 327 aa, Bacillus clausii KSM-K16
MAVMSYIEAVTRALEEEMEKDKRVFVLGEDVGKRGGVFRATKGLYERFGEERVIDTPLAESAIAGVAIGAAMYGMRPVAEMQFADFIMPAFNQIISEAAKIRYRSNNDWSCPVTIRAPYGGGIHGALYHSQSIEALFSSTPGLKVVMPSTPYDVKGLLKASIQLDDPVLFLEHKRAYRLIKGEVPEEEYTLPIGKADVKREGDDVTVITYGLAVHFALQAAERLEKDGISTHILDLRTVYPLDQEAIKAAASKTGKVLLITEDNKEGSVLGEVAAIIAEHCLFDLDAPIERLAGPDIPAMPYAPTLEKEFMINPDKVERAIRKLAEF

SEQ ID NO: 47723 - protein, 556 aa, Phytophthora erythroseptica
MINDTPAWKALAERAAEIKSTHLRELLNDDARNAAMRTEQQGIYLDFSRQNATSKTLDLLFELAETAELKKKLQAIASGEHVNATEDRAVMHMALRAPKTEKIVVDGHDVVPDVREVLDAIRAFTSNVRDGKFVGATGKQLKNVISIGIGGSHLGSEFVFESLRYEPVAKAAAEGRILRLLANVDPVDVARATSGLNPEETLVVVVSKTFTTAETMLNARTLRKWLVDDLTKKGSSEAGAVAKHMVAASSAVPLVQQFGIDRANTFGFWDWVGGRYSVTSAVGILPLALQYGFDITEKFLAGAHAMDKHLLETPLRNNLPVIMGLLGVWNSSFLGHSSRALLPYSQALLRFAAHIQQVDMESNGKRVTVEGVDLPFQAGEVNFGEPGTNGQHSFYQLIHQGRVVPCDFLGFCESQNPVQLAGEPVSNHDELMSNFFAQPDALARGKSIEDLKAEGVPEKLQNHKLFPGNRPSISLLFKKLDAFSTGQLLALYEHRTVVQGAIWGINSFDQWGVELGKVLAKQVRAQLSASRTENAPVKGFNSATTSMLEAYLAHKA

SEQ ID NO: 47724 - protein, 398 aa, Pneumocystis carinii
MQSEAYQTNLQCSGETSHKLGIKEAKSTSKTSLIDQIPILTLSIPSRRSIPHIFDATRITDNSDNSHNENQDFKGILEENGSPDPFSYNRSYFTKIMLDEVWQRSAHSDEIIELEKLGEGISGSVSKCILKNTGTLFALKTILVDTNPEIQQQILRELSINRTCSSEYIVQYYGTFVDEASSNISMAMEYCAGGSLDRLYKKVRANGARIGEYPILKIAENALKGLNYLHTRKIIHRDIKPSNILMTLEGQAKLCDFGVSGELVSSMAKTFTGTSYYMAPERIKGETYSITSDIWSLGLTLMEISQNRFPFPPEGPPLVPIELLNYIVNISNFELVDEPDNKIKWSEDFKHFLKTCLERDGAKRPNSQRMLEHPWVMKHSIIKIDMAKWIKQILELPL

SEQ ID NO: 47725 - protein, 473 aa, Bacillus clausii KSM-K16
MAENYDLVIVGGGIGGYVSAIRAAQEGLKTALVEQALLGGTCLHKGCIPSKALLRSAEVLRTAKEASVFGVATGPVAFDFAGAQKRKQEIVDRLAQGVKALMSKGKIDVYEGRGRMLGPSIFSPSPGTISVDLANGDNQMLIGKNVILATGSVPRPLPHTPFDGKQILSSDDVLQLKELPASMVIVGGGVIGIEWASMLVDFGVSVTVVEASETILPTADQAVAAEMEKQLKARGVVFYTNAQLDEQTVATTSSGIKATVHQNQEEHTIEADKMLVAIGRVANVSDIGIDNTDIALAHGCIAVNEYGQTKESHIYAVGDCVGGLQLAHVAAHEGIAAVSHIIGKQVEPVDPLAVPSCVYSFPEAAQVGMTETQAREAGHAVKIGTFPFAMNGKALIHGEAGGFVKLIADKDTSDLLGVHIIGTHATDLISEAALAKFLDAADFELAETVHPHPTLAEAIGEAALAVDGYAIHK

SEQ ID NO: 47726 - protein, 556 aa, Phytophthora erythroseptica
MINDTPAWKALAEHAAEIKSTHLRELLNDDARNAAMRTEQQGIYLDFSRQNATSKTLDLLFELAETAELKKKLQAIASGEHVNATEDRAVMHMALRAPKTEKIVVDGHDVVPDVHEVLDAIRAFTSNVRDGKLVGATGKQLKNVISIGIGGSYLGPEFVFESLRYEPVAKAAAEGRNLRFLANVDPVDVARATSGLNPEETPVVVVSKTFTTAETMLNARTLRKWLVDGLTKKGSSEADAVAKHMVAASSAVPLVQQFGIDRANIFGFWDWVGGRYSVTSAVGILPLALQYGFDITEKFLAGAHAMDKHLLETPLRNNLPVIMGLLGVWNSSFLGHSSRALLPYSQALLRFAAHIQQVDMESNGKRVTVEGVDLPFQAGEVNFGEPGTNGQHSSYQLIHQGRVVPCDFLGFCESQNPVQLAGEPVSNHDELMSNFFAQPDALARGKSIEDLKAEGVPEKLQNHKLFPGNRPSISLLFKKLDAFSTGQLLALYEHRTVVQGAIWGINSFDQWGVELGKVLAKQVRAQLSASRTENAPVKGFNSATTSMLEAYLAHKA

SEQ ID NO: 47727 - protein, 292 aa, Escherichia coli O157:H7 EDL933
  misc_feature (11)..(11): Xaa can be any naturally occurring amino acid
  misc_feature (210)..(210): Xaa can be any naturally occurring amino acid
MFTGSIVAIVXPMDEKGNVCRASLKKLIDYHVASGTSAIVSVGTTGESATLNHDEHADVVMMTLELADGRIPVIAGTGANATAEAISLTQRFNDSGIVGCLTVTPYYNRPSQEGLYQHFKAIAEHTDLPQILYNVPSRTGCDLLPETVGRLAKVKNIIGIKEATGNLTRVNQIKELVSDDFVLLSGDDASALDFMQLGGHGVISVTANVXARDMAQMCKLAAEGHFAEARVINQRLMPLHNKLFVEPNPIPVKWACKELGLVATDTLRLPMTPITDSGRETVRAALKHAGLL

SEQ ID NO: 47728 - protein, 396 aa, Medicago truncatula
MEPKSVNPTRRPQREAKKKAVAALCEQQRKRKRVPLGEITNDVNTNANANANDVVLPTQKKRNVSTSSNSDGTPVPEKLEKFEDPQLCETYVSDIYDYLRNMEVDSSKRPLCDYIQKVQRDVNASMRGVLVDWLVEVAEEYKLVSDTLYFSVSYIDRFLSLNDLTRQKLQLLGVASMLVASKYEEIKPPEVEDFCYITDNTYSKEEVLTMEADILKSLKFELGGPTIKTFLRHVCFIDYVSLYVEWYYCFCIVAHISFSFSVCRRFITKVGLEGVDASELQFEFLCSYLAELSLLDYNCVKFLPSMVAASVVFLARFMLSPKTHPWNSAIYEFTRYKPADLKECVLNIHDLYLGRKGGSLQAVRDKYKQHKFKCVATTPSPPEISLSFFEFRGADP

SEQ ID NO: 47729 - protein, 556 aa, Phytophthora infestans
MINDTPAWKALAEHAAEIKSTHLRELLNDDARNAAMRTEQQGIYLDFSRQNATSKTLDLLFELAETAELKKKLQAIASGEHVNATEDRAVMHMALRAPKTEKIVVDGHDVVPDVHEVLDAIRAFTSNVRDGKLVGATGKQLKNVISIGIGGSYLGPEFVFESLRYEPVAKAAAEGRNLRFLANVDPVDVARATSGLNPEETLVVVVSKTFTTAETMLNARTLRKWLVDDLTKKGSSEADAVAKHMVAASSAVPLVQQFGIDRANIFGFWDWVGGRYSVTSAVGILPLALQYGFDITEKFLAGAHAMDKHLLETPLRNNLPVIMGLLGVWNSSFLGHSSRALLPYSQALLRFAAHIQQVDMESNGKRVTVEGVDLPFQAGEVNFGEPGTNGQHSFYQLIHQGRVVPCDFLGFCESQNPVQLAGEPVSNHDELMSNFFAQPDALARGKSIEDLKAEGVPEKLQNHKLFPGNRPSISLLFKKLDAFSTGQLLALYEHRTVVQGAIWGINSFDQWGVELGKVLAKQVRAHLSASRTENAPVKGFNSATTSMLEAYLAHKA

SEQ ID NO: 47730 - protein, 616 aa, Aspergillus nidulans FGSC A4
MIMNAWLAAKMKLVAVLLALATVEARPTVDTTYPYNGPDVPIGDWVNPTINGNGKGFPRLVEAPAVKPRSAHPKNNVNVISLSYLPDGMHIHYQTPFGLGEAPSVRWGTSPANLNKVAHGWSHTYDRTPSCAQVKAVTQCSQFFHEVSLPHLKPETTYYYRIPAANGTTESDILSFTTARAPGDKRSFTVAVLNDMGYTNAQGTHRQLLKAANEGAAFAWHGGDLSYADDWFSGILPCADDWPVCYNGTSTQLPGGGPIPEEYKQPLPQGETANQGGPQGGDMSVLYESNWDLWQQWMTNLTVKIPHMVMPGNHESACAEFDGPGNPITAYLNEGIPNGTWPAENLTYYSCPPSQRNFTAFQHRFHMPGKETGGVGNFWYSFDYGLAHFVSLDGETDFANSPFSTFERDLTGNETHPRPEETETTDSGPFGTIDGDRYDDNTAYAQYQWLKRDLASVDRTKTPWVFVMSHRPMYSSAYSSYQTNVRNAFENLLLQYGVDAYLSGHIHWYERMFPMTANGTIDESSIADNHTYTTNSGKSMTHIINGMAGNIESHSWFDEGEGLTEITAKLDRTHFGFSKLTVVNETVVNWEFVKGDDGSTGDWLTLVKGETCTINV

SEQ ID NO: 47731 - protein, 509 aa, Xanthomonas oryzae pv. oryzae KACC10331
MPVATGITLSEHLQRSANDCTPSAHSQTVDLVAFDYRQPSSPTRPFRRVGARGRRPDNGQRDARCRASMPPIGISQGSARMNHSRSHALFAQAQTVLPGGVNSPVRAFKSVGGEPFFVARADGSYLFDVDGNRYIDYVGSWGPMIAGHNHPAVREAVERAIRDGLSFGAPCAAEVTMAETITGLVPSCEMVRMVNSGTEATLSAVRLARGATGRNRIIKFEGCYHGHGDSFLVKAGSGMLTLGVPTSPGVPAGLSELTATLSFNDFEGATALFDEIGPEVAAVIIEPVVGNANCIPPQAGYLQHLRTLCTRHGALLIFDEVMTGFRVALGGAQAHYGVTPDLSTFGKIIGGGMPVGAYGGRRDLMEQIAPAGPIYQAGTLSGNPVAMAAGLAMLELVQEPGFHMRLSEATSALCEGLKDAARTAGIAVTTNQVGGMFGLFFTDDIVESYAQATACDITSFNRFFHAMLQRGVYLAPSAYEAGFMSSAHDATVIEATLAAARDAFADVAR

SEQ ID NO: 47732 - protein, 476 aa, Solibacter usitatus Ellin6076
MPNQLQDFLTLSYAELEELNLQAKAERLGRAPTHQIQEQRLKYLTDEKRIKAVTVLFSDLEGRLHMLDYDKKFLVKSWDNLTFDGSSIRGFTAQRESDLRLSMDWSSFYWAPSDVFGAGKVLVFGEVIDKDGTPYSADIRGVLKAYAQSLYEKQGYTLNAANEIEGFLFNGSDAERRYHETAKFDYVNTGGYYHSLPGDPLRTFIDSCAEVQRAMGFQNEKDHPEVAPSQFEINYSYAEVVAAADQIQLYKLICRQVATRMGLTASFLPKPVVGVNGSGMHTNVSITKGGKNIFWDPKGEEKMSKFAWQFVDRILTHGNDLCLLLNASVNAYRRLDPHFEAPNQIKASAVDRGSMIRIPIGNERSSRVEVRSVGPDANPYMVMLGVFRTGLEGEISRIKNLRGAERYLPDNIYDAMANFKNAEWTTKLLGEDVKGRYADLKQASADRCPRLLGTFVKTPEVQYHHEVYNQFLWNMF

SEQ ID NO: 47733 - protein, 500 aa, Oryza sativa (japonica cultivar-group)
MELPCPRLLLLLRLLVFLVAVSWPLCGAGTEGLGVGEEGLSSIGASSGSRNVRRLLQTGGVNQGAPAPLPLEQSPSASGPVSSPSPSPWVSPPKGSPSPSPSSKIIAHRSPHHPFTTPPQLVRPKPTTRRAEHDHSVETTGRSWFKRSWTTYGFIAAGIAALLIISAAGAFYCRAKKMGTVRPWATGLSGQLQKAFVTGVPALKRSELETACEDFSNIIGCTSTCTLYKGTLSSGVEIAVASSLVTSADDWSKECESRYRRKITSLSKVSHKNFMNLLGYCEEEQPFTRVMVFEYAPNGTLFEYLHVREAEKLDWMTRLRISMGIAYCLEHMHQLKPPVVPRNFDSTTIYLTDDFAAKVSDLEFWSGAKEPNPATSNSSSSSDLENTVRKYGMVLLEMLTGRVPDSEEDGPLERLASRYFDGETRLAELIDPSIGSFSEEAARSLCEVVRSCIDPDPKRRPTMAEVAARMREITALGPDGATPKVSPLWWAELEIMSSES

SEQ ID NO: 47734 - protein, 464 aa, Vibrio vulnificus YJ016
MNRVINRSKIFLTAVERGTMPATWSEQSEEDKPMTKSAELYQKAQQTIPGGVNSPVRAFNGVGGSPIFVERADGAFIFDADGKAYIDYVGSWGPMILGHNHAVIREAVIEAAQRGLSFGAPTEMEIKMAELVSELVPSMEQLRMVSSGTEATMSAIRLARGFTGRDKILKFEGCYHGHADSLLVKAGSGALTLGQPSSPGVPADFAKHTLTATFNDLDSVRELFAANKGEIACIIVEPVAGNMNCIPPVEGFHEGLREICDQEGALLIFDEVMTGFRVALGGAQAHYNIKPDLTTLGKVIGGGMPVGAFGGRKEVMQYIAPTGPVYQAGTLSGNPVAMAAGYACLTLLREEGNEKRLASKTKHLADGFKSLAAQHGIPLVVNQVGGMFGFFFTEQEQITCYEDVTKCDLERFKRFFHLMIDHGVYLAPSAFEASFTSLAHGSKEIEATLEAADRCFAILAAESK

SEQ ID NO: 47735 - protein, 97 aa, Glycine max
MAALGGNRDVTGSQNSVEIDALARFAVEEHNKKQNALLEFEKVVTAKQQVVSGTLYTITLEAKDGGQKKVYEAKVWEKSWLNFKEVQEFKLVGDAPA

SEQ ID NO: 47736 - protein, 750 aa, Chlamydomonas reinhardtii
MAGVPAPASQLTKVLAGLRHTFVVADATLPDCPLVYASEGFYAMTGYGPDEVLGHNCRFLQGEGTDPKEVQKIRDAIKKGEACSVRLLNYRKDGTPFWNLLTVTPIKTPDGRVSKFVGVQVDVTSKTEGKALADNSGVPLLVKYDHRLRDNVARTIVDDVTIAVEKAEGVEPGQASAVAAAAPLGAKGPRGTAPKSFPRVALDLATTVERIQQNFCISDPTLPDCPIVFASDAFLELTGYSREEVLGRNCRFLQGAGTDRGTVDQIRAAIKEGSELTVRILNYTKAGKAFWNMFTLAPMRDQDGHARFFVGVQVDVTAQSTSPDKAPVWNKTPEEEVAKAKMGAEAASLISSALQGMAAPTTANPWAAISGVIMRRKPHKADDKAYQALLQLQERDGKMKLMHFRRVKQLGAGDVGLVDLVQLQGSELKFAMKTLDKFEMQERNKVARVLTESAILAAVDHPFLATLYCTIQTDTHLHFVMEYCEGGELYGLLNSQPKKRLKEEHVRFYASEVLTALQYLHLLGYVYRDLKPENILLHHTGHVLLTDFDLSYSKGSTTPRIEKIGGAGAAGGSAPKSPKKSSSKSGGSSSGSALQLENYLLLAEPSARANSFVGTEEYLAPEVINAAGHGPAAVDWWSLGILIFELLYGTTPFRGARRDETFENIIKSPLKFPSKPAVSEECRDLIEKLLVKDVGARLGSRTGANEIKSHPWFKGINWALLRHQQPPYVPRRASKAAGGSSTGGAAFDNY

SEQ ID NO: 47737 - protein, 236 aa, Glycine max
  misc_feature (104)..(104): Xaa can be any naturally occurring amino acid
  misc_feature (167)..(167): Xaa can be any naturally occurring amino acid
LCRYCVVFDPLDGSSNIDCGVSIGTIFGIYLIKEDHEPTVEDVLQPGKNMLAAGYCMYGSSCTLVLSTGSGVNGFTLDPSLGEFILTHPDIKIPKKGKIYSATXAPPPNEGNAKNWDRPTATYVEKCKFPEDGSSPKSLRYIGSMVADVHRTLLYGGIFLYPADKKXPNGKLRVLYEVFPMSFLMEQAGGQSFTGKERALDLVPTKLHERSPIFLGSYDDVEEIKALYAAAEGEQE

SEQ ID NO: 47738 - protein, 393 aa, Zea mays
  misc_feature (219)..(219): Xaa can be any naturally occurring amino acid
EPASTEDPALSIAGAVQSQKLAVRAISRLQALPGGDVKLLCDTVVEHVRELTGYDRVMVYRFHEDEHGEVVAESRRDNLEPYLGLHYPATDIPQASRFLFRQNRVRMIADCHATPVRVIQDPGLSQPLCLVGSTLRAPHGCHAQYMANMGSIASLVMAVIISSGGDDEQTGRGGISSAMKLWGLVVCHHTSPRCIPFPLRYACEFLMQAFGLQLNMELXLAHQLSEKHILRTQTLLCDMLLRDSPTGIVTQSPSIMDLVKCDGAALYYHGKYYPLGVTPTESQIKDIIEWLTVFHGDSTGLSTDSLADAGYLGAAALGEAVCGMAVAYITPSDYLFWFRSHTAKEIKWGGAKHHPEDKDDGQRMHPRSSFKAFLEVVKSRSLPWENAEMDAIH

SEQ ID NO: 47739 - protein, 302 aa, Glycine max
MTLLSSHLLVFSAVHHRAPPTTTTRNSPTTNHTVRFLCSPGVPPAVRLDQRLPRFVVPGAGAEDLLYNAGATVGVLGGGYALVRAFDELTRRNILQQGLSRKLVHILSGLLFLVSWPIFSNSPKARYFAAFVPLVNCLRLLVNGLSLASDEGLIKSVTREGDPLELLRGPLYYVLILILSALVFWRESPIGVISLAMMCAGDGIADIIGRRYGSMKIPYNEHKSLAGSMSMLVFGFLVSIGMLYYYSVLGHVQLDWASTLPRVAFISFVATLVESLPITKVVDDNISVPLATMAVAFFTFHH

SEQ ID NO: 47740 - protein, 749 aa, Chlamydomonas reinhardtii
MAGVPAPASQLTKVLAGLRHTFVVADATLPDCPLVYASEGFYAMTGYGPDEVLGHNCRFLQGEGTDPKEVQKIRDAIKKGEACSVRLLNYRKDGTPFWNLLTVTPIKTPDGRVSKFVGVQVDVTSKTEGKALADNSGVPLLVKYDHRLRDNVARTIVDDVTIAVEKAEGVEPGQASAVAAAAPLGAKGPRGTAPKSFPRVALDLATTVERIQQNFCISDPTLPDCPIVFASDAFLELTGYSREEVLGRNCRFLQGAGTDRGTVDQIRAAIKEGSELTVRILNYTKAGKAFWNMFTLAPMRDQDGHARFFVGVQVDVTAQSTSPDKAPVWNKTPEEEVAKAKMGAEAASLISSALQGMAAPTTANPWAAISGVIMRRKPHKADDKAYQALLQLQERDGKMKLMHFRRVKQLGAGDVGLVDLVQLQGSELKFAMKTLDKFEMQERNKVARVLTESAILAAVDHPFLATLYCTIQTDTHLHFVMEYCDGGELYGLLNSQPKKRLKEEHVRFYASEVLTALQYLHLLGYVYRDLKPENILLHHTGHVLLTDFDLSYSKGSTTPRIEKIGGAGAAGGSAPKSPKKSSSKSGGSSSGSALQLENYLLLAEPSARANSFVGTEEYLAPEVINAAGHGPAVDWWSLGILIFELLYGTTPFRGARRDETFENIIKSPLKFPSKPAVSEECRDLIEKLLVKDVGARLGSRTGANEIKSHPWFKGINWALLRHQQPPYVPRRASKAAGGSSTGGAAFDNY

SEQ ID NO: 47741 - protein, 596 aa, Prunus persica
MSNCTLPETQEKLTLPDAWDFKGRPAERSKTGGWTAAAMILGGEACERLTTLGIAVNLVTYLTGTMHLGNATSANTVTNFLGTSFMLCLLGGFVADTFLGRYLTIAIFATFQAMGVTILTISTTIPSLRPPKCTSDTSTPCIPASGKQLMVLYIALYLTALGTGGLKSSVSGFGSDQFDESDKQERRQMTNFFNWFFFFISIGSLAAVTVLVYIQDNLGRQWGYGICVCAIVLGLIVFLSGTRRYRFKKLVGSPLTQISGVCVAAWRKRNMELPSDMSFLYNVDDIDDGLKKKKKQKLPHSKQFRFLDKAAIKEPKTTSGTAMIINKWSLSTLTDVEEVKLIIRMLPIWATTIMFWTVYAQMTTFSVSQATSMDRHIGKSFQIPPASLTAFFVGSILLTVPVYDRLIVPMARKALENPQGLTPLQRMGVGLVFSIFAMVAAALTEVKRLNIARSHGLTDNPTAEIPLSVFWLVPQFFFVGSGEAFTYIGQLDFFLRECPKGMKTMSTGLFLSTLSLGFFFSSLLVTIVHKTTGHNKPWLADNLNQGKLYDFYWLLALLSALNLVIYLFCANWYVYKDKRLAEEGIELEEPEICAHA

SEQ ID NO: 47742 - protein, 346 aa, Candidatus Kuenenia stuttgartiensis
MRVAVYEKFAQPLTIQEVPDPAPEKTGVVIRVGATGMCRSDWHGWMGHDPCIRLPHVPGHEIAGVVEETGKEVSLWKKGDRVTLPFVCGCGACPQCASGNHQVCDRQSQPGFTHWGSFAQYVAIDYADVNLVQLPEDIDFVTAASLGCRFSTSFRAIVAQGKVSAGQWVAVHGCGGVGLSAIMIASALGANVVAVDIQKEKLDFAGSVGAVALVNAGEVEDVAGAILDITKGGVHVSVDALGSSNTCFNSIATLRKRGKHLQVGLMLAEHRHPPIPMDKVIANELEILGCHGMQAHEYGAMLEMVCEGKLRPEKLIGKTIGLEDAARELPDMNRFGSVGVIVINEF

SEQ ID NO: 47743 - protein, 198 aa, Candida albicans SC5314
MVNGPAELRRKLVIVGDGACGKTCLLIVFSKGTFPEVYVPTVFENYVADVEVDGRKVELALWDTAGQEDYDRLRPLSYPDSNVILICFSVDSPDSLDNVLEKWISEVLHFCQGVPIILVGCKSDLRDDPHTIEALRQQQQQPVSTSEGQQVAQRIGAADYLECSAKTGRGVREVFEAATRASLRVKEKKEKKKKCVVL

SEQ ID NO: 47744 - protein, 72 aa, Glycine max
VRRREMPFYNVGPVTTDLDHDYDHIPSRIAAANIAAIIADFMRFETSKVHVVLPHHDDIKALNVAYYIELHA

SEQ ID NO: 47745 - protein, 556 aa, Phytophthora infestans
MINDTPAWKALAEHAAEIKSTHLRELLNDDARNAAMRTEQQGIYLDFSRQNATSKTLDLLFELAETAELKKKLQAIASGEHVNATEDRAVMHMALRAPKTEKIVVDGHDVVPDVHEVLDAIRAFTSNVRDGKLVGATGKQLKNVISIGIGGSYLGPEFVFESLRYEPVAKAAAEGRNLRFLANVDPVDVARATSGLNPEETLVVVVSKTFTTAETMLNARTLRKWLVDGLTKKGSSEADAVAKHMVAASSAVPLVQQFGIDRANIFGFWDWVGGRYSVTSAVGILPLALQYGFDITEKFLAGAHAMDKHLLETPLRNNLPVIMGLLGVWNSSFLGHSSRALLPYSQALLRFAAHIQQVDMESNGKRVTVEGVDLPFQAGEVNFGEPGTNGQHSFYQLIHQGRVVPCDFLGFCESQNPVQLAGEPVSNHDELMSNFFAQPDALARGKSIEDLKAEGVPEKLQNHKLFPGNRPSISLLFKKLDAFSTGQLLALYEHRTVVQGAIWGINSFDQWGVELGKVLAKQVRAQLSASRTENAPVKGFNSATTSMLEAYLAHKA

SEQ ID NO: 47746 - protein, 160 aa, Candidatus Kuenenia stuttgartiensis
MIIILMGVSGSGKTTIGRILADDLGWTFYDGDDYHPPSNIENLKKGIALTDAERMPWLEVLQKIIEKTIAKKEHAVIACSALKQSYRRFLADKHESVRFVYLKGERELICQRLNRRKGHFLNENLLLSQFETLEEPEDAFVVDIIQSPEAIVTSIKKEFL

SEQ ID NO: 47747 - protein, 377 aa, uncultured archaeon GZfos26G2
MEDIFRFADELGPAKVIHVYEPSVGLKAVLVVDNVARGPAIGGLRIAPDVSAEECFRLARAMTLKNAAADLPHGGAKSVIYGDPKMPTKEKESLIRAFASSLREIQEYIFAPDMGTDEECMAWVKDEIGRVVGLPSDFGGIPLDEIGATGWGLSHATEVALEYCDFDMEGARVVVQGFGAVGKHTARFLTEKGAMLVGVADSRGTIYNPQGLDVLALIELKTAGKSVADYPDGKKLDRDAVINIECDVWIPAAQPDVIDENNVNLLKTKLVIEAANIPITEGAEKYLHENGVLYVPDFIANAGGVICAAMEYQGADQSAAFEAIEEKLCRNTRLVLEEAASRGILPREAAVDLAVQRLKKSMSYRRWSLFSSAPGFV

SEQ ID NO: 47748 - protein, 181 aa, Escherichia coli O157:H7 EDL933
MLKLLKTIMRAGTATVKYPFAPLEVSPGFRGKPDLMPSQCIACGACACACPTNALTIQTDDQQNSRTWQLYLGRCIYCGRCEEVCPTRAIQLTNNFELTVTNKADLYTRATFHLQRCSRCERPFAPQKTVALAAELLAQQQNAPQNREMLRAQASVCPECKQRATLINDDTDVPLVAKEQL

SEQ ID NO: 47749 - protein, 440 aa, Medicago truncatula
MHPWLENIVNLCRNRKNDNLALFDEWPSLASSINLKNHCYGEFSSAFVQANEDMEDRSQVEVASRNALFLGVYDGHGGFEASQFISEHLFDDLLRLTNENENKITEATLRDAVSATEASFLDSVKRNYMINRNLGKVGSCCLAGIIWKGTLHVANLGDSRAVIGTMVNKRIRAEQLTRDHNCSDPAIREELKSMHPGDPTIVKEKNGVWRVKGIISVSRSIGDTYLKRLEFTLCESFPKFKKVPEPFTRGVVSAEPEMRTRVLTYSDKFLIFASDGLWDFLSNEQAVEIVQNNPRNGIAKRLVSTVLAKAAANGNVTCNSMMHANLGRGDGNRRSFHDDISVIVVFFDKTSFLRMPVHNLSYKSSSDRPTPSAFARSGLTTHWLQRLKKTIKDRFKGSSSNASGSQDQNPETPEGESSQTQSLLGQSSRAQSPWKNLKQN

SEQ ID NO: 47750 - protein, 454 aa, Medicago truncatula
MHPWLENIVNLCRKRKNDNINMALFDQDPHASSIDLKRHCYGQFSSAFVQANEAMEDHSQVEVASRKALFLGVYDGHAGFEASVFITQHLFDHLLRAVRANENKITEPTLRDAVSATEAGFLEYVEKNYRQKNNLGKVGSCCLAGIIWKKTLHVANLGDSRAVIGTMVNNKIQAEQLTRDHNCKDEAIRKELMSEHPDDTTIVMYEREVWRVKGIITVSRSIGDTYLKRPEFSLDESFPKFEEVPEPFIRGVLSAEPEMRSRDLTENDKFLIFASDGLWDFLSNEQAVEIVQNNSRNICGIAKRLVSTVLAQAAANRNSTYNTMKNANLGRGDGNRRYFHDDISVIVVFLDKKSILRMPLHNLSYKSSSARPTTSAFAESGLTMHGLQRLQKTIKNRFQASSSQEGESSQTQDPEGESSQTQSLLASEYCDAEAAEEGVLPTGTFWLLLQDTNQ

SEQ ID NO: 47751 - protein, 530 aa, Triticum aestivum
  misc_feature (208)..(208): Xaa can be any naturally occurring amino acid
  misc_feature (232)..(232): Xaa can be any naturally occurring amino acid
MDVNEEAMAANKRAFLDFLDQDVGKGVYMQAVRDMVQSKRHRLTIGMDDLRNHNLDLARRVIRSPGEFMQPASDAVTEVARNLDPKFLKEGERVLVGFTGPFGFHRVTPRDLMSSFIGTMVCVEGIVTKCSLVRPKVVKSVHYCPATAAFMSREYRDITSFVGLPTGSVYPTRDENGNLLVTEYGMCQYKDHQTLSMQEVPENAAPGXQLPRTVDVIVEDDLVDCCGPGDRXVPSVGLYRALPGTSKGRVSGAFRMLLCPVLIANNVSLLNKEANAPVYTREDLKRMKEISRRNDTFDLLGNSLAPSIYGHIWIKKAVVLLMLGGVEKNLKNGTHLRGDINMMMVGDPSVAKSQLLRAVMNIAPLAISTTGRGSSGVGLTAAVTSDQETGERRLEAGAMVLADRGVVCIDEFDKMNDQDRVAIHEVMEQQTVTIAKAGIHASLNARCSVIAAANPIYGSYDRSITPTKNIGLPDSLLSRFDLLFIVLDQMDAEIDRQISEHVARMHRYCADDGGARSFDKAGCAEEEDGD

SEQ ID NO: 47752 - protein, 346 aa, Zea mays
MMASRQSGNNAQEAASPLASPPHSNIASIIPSLPLETRCPPFPLRRYANFWVPEVILKADLPGIHSCFKPRPTDVFVASFPKSGTTWLKALAFATLKRSTHPPLDGDHPLRRCNPHDCVRFLDANFNQQKDELEALPSPRVLATHLPYSLLPGSITGDPDRERSGCRIVYVCREPKDALVSAWLFTRKAASALGADARSFTIQEALELFCDGRCMCGPQWEHVLQYWEESVRRPDRVLFLRYEEMLIDPEAHVRKLAKFMGCGFSEEEEEHGVVSAIVELCSLGKMRDMEVNRNGSNMLGVKNESYFRKGVAGDWSNHMTPDMAQRLDKVVEDALQGTGFSFTSKA

SEQ ID NO: 47753 - protein, 381 aa, Triticum aestivum
  misc_feature (185)..(185): Xaa can be any naturally occurring amino acid
  misc_feature (194)..(194): Xaa can be any naturally occurring amino acid
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGXATLNVAKPXKKGSTVAIFGLGAVGLAAMEGAKMAGAARIIGVDLNPAKYEQAKKFGCTDFVNPKDHTKPVQEVLVEMTNGGVDRAVECTGHIDAMIAAFECVHDGWGVAVLVGVPHKEAVFKTSPMNLLNERTLKGTFFGNYKPRTDLPEVVEMYMRKELDVEKFITHSVPFSQINTAFDLMLKGEGLRCVMRMDE

SEQ ID NO: 47754 - protein, 208 aa, Brassica rapa
  misc_feature (161)..(161): Xaa can be any naturally occurring amino acid
MAFLSKVGKIFRQTSAHVTASNSMLQSIRCMSSSKIFVGGISYSTDEFGLREAFSKYGEVVDAKIIVDRETGRSRGFAFVTFTSTEEASNAMQLDGQDLHGRRIRVNYATERGSGFGGRGFGGPGGGNAGGYGAPSGGYGGGGGYGGGAGGYGAPGGGYGXWWWLRRRCWWLRCSSWWLWRRWLQCSRWWLRRWLILWWKCCWWRLWR

SEQ ID NO: 47755 - protein, 1499 aa, Arabidopsis thaliana
MIMKNSAAIFLTSSLILLLQTLHGVKAGFICVGSSFPTNSSYQKNRDSLFSTLSDKVTTNGGFYNASLDGVHVVGLCRRDYDRQGCINCVEESIRQIKTSCSNRVQSFHCNSDDRERVSCLVRTTDQSTYRILELGPATNDPSPVAIDTFAKNMTLFRQEWEAMVDRTLEAVTIDNSTTVLKYYGALKSEFSEFPNVYMMMQCTPDINSGACKRCLQASVTYFRDQNWGRQGGGICRPSCVFRWEFYPFYGAFANVTRVPAPPRALIPRTEAISITRLKGGIIAIFVVPIVINLLVFIGLIRAYTRIRKSYNGINEAQYDYGGQSKLRFDFRMILTATDDFSFENKIGQGGFGSVYKGKLPGGEEIAVKRLTRGSGQGEIEFRNEVLLLTRLQHRNLVKLLGFCNEGDEEILVYEFVPNSSLDHFIFDEEKRLLLTWDMRARIIEGVARGLVYLHEDSQLRIIHRDLKASNILLDAYMNPKVADFGMARLFNMDQTRAVTRKVVGTFGYMAPEYVRNRTFSVKTDVYSFGVVLLEMITGRSNKNYFEALGLPAYAWKCWVAGEAASIIDHVLSRSRSNEIMRFIHIGLLCVQENVSKRPTMSLVIQWLGSETIAIPLPTVAGFTNASYQAEHEAEERCCVEQNKVVNWGIWEVLLKTQPFIADEKRMDEGVMVLVGGWECKDNGEWRFKMSDNKYGKWVDLSFWFEGGDTVYTHQKMSPVSVDNESSLKKFKEKRQEKGGLNMYLSIDDVDVAEISSPEIRGHKDNNVVERKASLLELACAKRGREKEVDVELATETRGWASDSEDESLREVSDSEDYDFDNMRDMIDTDYLPDWDPWKDWRNSTLTSFDECKMSIQLGQSRMRAELPDTQATTLEESLDKDCPRCLDNVHGQSLQGRAVPNMRTDSMTETLDTCLVPESGEYVGPVDVVVTSLEASASEEEGQSDVEVARALAEDMSRRLTDGETIFTELAGDEMLMCRDAVPFKDNAAGVASDKANMNLRKGGDAIYIGWVFNNKVELHKTLTMYSMKRLFNFRIKASDKTRVIAVCDDKKCDWRVYATFHENSEKVEIRTATLKHTCDVEARSKYGMKATRSMLGELLKTKYTHGKKGPRACELPEIVLAELPYMKAWYAKEIAMKKARGSEEEDGAQTKGKYKSCLVAASGQDENYQIFPLAFGIIDNENIAGWQWHAAIYVGLRTVHSLAKHACCTVHLFRNVVHNFQCEGLVKMVSMAARSYTVGDLRYWFEEIQKRNIQCAKYLVEIKLSHRTLAYFPGMRYIVMRSNISESLNAAIQKAIDFPVVTMVEFIRTMLMRWFCERRQTAAKTKTRCTPKIEDLLIDHLKLATDCAVIAADEWIYQVNDSFGMIFTVDLEKKTCTCRVFDVLMVPCCHALAAVGREHILPPPKEKDTEVPNDISLVVVYPPNTRRPVGRPRTVQIPSRGEPGKGWKKKKTRQCSTCGKDGHNRGWGKKQWKSKNAERCIKSAGSKVNVKTESAGR

SEQ ID NO: 47756 - protein, 501 aa, Glycine max
MAALSNGHGSSFFKMPPIKFTKLFINGEFVDSLSGREFETRDPRTGEVITRIAEGAKEDVDVAVKAARAAFDYGPWPRMPGAERAKIMMKWADLVDQNIEEIAALDAIDAGKLYHWCKAVDIPAAASTIRYYAGAADKIHGEVLKASREFHAYTLLEPIGVVGHIIPWNFPSTMFVAKVSPSLAAGCTMVLKPAEQTPLSALFYAHLAKLAGIPDGVLNVVPGFGQTAGVAISLHMDIDKVSFTGSTEVGREVMRAAANSNLKPVSLELGGKSPVIVFDDADVDKAAELALLGILFNKGEICVAGSRVLVQEGIYDEFEKKLVEKAKAWVVGDPFDPKVQQGPQVDKKQFEKILSYIEHGKKEGATLLTGGKRVGNKGYYIEPTIFSNVKEDMLIVQDEIFGPVMALMKFKTIEDAIKIANNTRYGLASGIVTKSLDTANTVSRSIRAGIVWINCYFAFGDDIPYGGYKMSGFGRDFGMEALHKYLQVKSVVTPIYNSPWL

SEQ ID NO: 47757 - protein, 233 aa, Zea mays
  misc_feature (155)..(155): Xaa can be any naturally occurring amino acid
  misc_feature (221)..(221): Xaa can be any naturally occurring amino acid
METMSALARTAPPLAGTIRRPSCALRPTASLSFAAASTTPRGRLGLGLSTAPAGSGRAARARAVPQRIVASSEVERSYIMIKPDGVQRGLVGEIISRFEKKGFLLKGLKLFQCPKDLAQEHYKDLKDKPFFPKLIDYITSGPVVCMLQSCYSILXKAWEGAGVVASARKLIGATNPLQAEPGTIRGDLAVQTGRNVVHGSDSPDNGKREIELWFKEGELCXKWESVQAPWLIE

SEQ ID NO: 47758 - protein, 352 aa, Oryza sativa (japonica cultivar-group)
MGGLSMDQAFVQAPEHRPKASVAEADGIPVIDLSPLLAAGDGDADGVDALAAEVGRASRDWGFFVVVRHGVPAEAVARAAEAQRTFFALPPERRAAVARSEAAPMGYYASEHTKNVRDWKEVFDLVPRQTPPPPTTAVADGDLVFDNKWPDDLPGFREAMEEYGEAVEELAFKLLELIARSLGLRPDRLHGFFKDDQTTFIRLNHYPPCPSPDLALGVGRHKDAGALTVLYQDDVGGLDVRRRSDGEWVRVRPVPHSFIINVGDIIQVWSNDRYESAEHRVAVNVEKERFSIPFFFNPAGHTMVEPLEEVVSDESPARYNPYNWGEFFSTRKNSNFKKLDVENVQITHFRKN

SEQ ID NO: 47759 - protein, 176 aa, Triticum aestivum
MAPTVMSSAATAVAPFQGLKSTAGLPVSRRSSSAAGLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 47760 - protein, 273 aa, Candida albicans SC5314
MVAESSSIDNTPNDVEAQRPVYEPKYDDSVNVSPLKNHMIAFLGEFFGTFIFLWVAFVIAQIANQDPTIPDKGSDPMQLIMISFGFGFGVMMGVFMFFRVSGGNLNPAVTLTLVLAQAVPPIRGLFMMVAQMIAGMAAAGAASAMTPGPIAFTNGLGGGASKARGVFLEAFGTCILCLTVLMMAVEKSRATFMAPFVIGISLFLGHLICVYYTGAGLNPARSFGPCVAARSFPVYHWIYWVGPILGSVIAFAIWKIFKILKYETCNPGQDSDA

SEQ ID NO: 47761 - protein, 468 aa, Anabaena variabilis ATCC 29413
MLQLIHNVFADNLFIPHGHCYLWQPGLVWLHTLSDFLIAVAYYSIPITLVYFVRKRQDLPFKWIFLLFGAFIVSCATSHVMEIWTLWHPTYWLSGFMKAITAFISIYTAIVLIPIVPQLLALPSPAQLEAANNRLKTEIIERKTAEAALLQIKADLENRVEERTNQLHQSMLASLATAAKAKDQAEKLQVALNDLANAQVQLIQTEKMSSLGQLVGGIAHEINNPVNFIYGNIHFIYEYTKALWQLIILYQQYYPKPAWEIAAYIQEIDLDFVQNDFEKILASIKNGADRIREIVLSLRNFSRLDEAEIKQVDIHEGIDNTILLLKNRLKGQGKHPDIDVVREYNNLPLVECYPGQLNQVFMNILTNAIEAAKESANKPLIQIQTKALDSSQVMIQISDNGCGMTEEVRNKIFDPFFTTKPIGSGTGLGMSISYQIINKHGGTLKCVSAPNEGTEFIICIPTRLKSST

SEQ ID NO: 47762 - protein, 429 aa, Escherichia coli O157:H7 EDL933
MTRRAIGVSERPPLLQTIPLSLQHLFAMFGATVLVPVLFHINPATVLLFNGIGTLLYLFICKGKIPAYLGSSFAFISPVLLLLPLGYEVALGGFIMCGVLFCLVSFIVKKAGTGWLDVLFPPAAMGAIVAVIGLELAGVAAGMAGLLPAEGQTPDSKTIIISITTLAVTVLGSVLFRGFLAIIPILIGVLVGYALSFAMGIVDTTPIINAHWFALPTLYTPRFEWFAILTILPAALVVIAEHVGHLVVTANIVKKDLLRDPGLHRSMFANGLSTVISGFFGSTPNTTYGENIGVMAITRVYSTWVIGGAAIFAILLSCVGKLAAAIQMIPLPVMGGVSLLLYGVIGASGIRVLIESKVDYNKAQNLILTSVILIIGVSGAKVNIGAAELKGMALATIVGIGLSLIFKLISVLRPEEVVLDAEDADITDK

SEQ ID NO: 47763 - protein, 347 aa, Guillardia theta
MKLLLYDDLKTLFNYKIKKKNNTIVHFLYLLYENVHESLNINNTRNFLWCFMIKFSVEIKKRIKFDYKSCHINFYSFFDNLLEAGNVLNFEKLILNILFNFRKIQFLYIPFTNVMKVQTEINKNMRKILIDWIIDVHHKFKLLSKTLFLTINIIDRFLCLKKIGKQKLQLLGITSMFIASKYEEIYAPEIRDFIYICDNAYSKEDIIKMEQLICFVLRFKFNLPSPQSFLSLWMKILCLKLDSIFFSNKCLELCLIEINTLRYNFEIISLSCIFLSLKFSGNISLKILMNIFRIDSKKNFSLVKSCGLIGSLLLLYQSSYCGQNHLHFKYSSNKHKEFMSRRFHIYF

SEQ ID NO: 47764 - protein, 469 aa, Propionibacterium acnes KPA171202
MKNYCMPDPGEGLTEGEVVSWQVSPGDTVKINDVLCEVETAKSIVELPSPFAGTVAKLCAEPGETVAVGTPLVTIDDGSEDEPEFLVGHVTAEPGRRRRRRRGAAVSTERAREEGADTHPEQSVSESRHDAEAKPEQRLTEPAPRQDPPRMDRTAHILAKPPARRLAADLGVDLSQVTGTGPQGAVTRSDVKAAAHHGAAAAGDGGACPGDAELASLSVMSRRLLGGAPTEPDGHTRKVPVRGVRKVTAKAVKDSLDTKALVTAFLTCDVTPTMELVNRLRADRRFKGLRVSPLTVWCKAVCLAMGRTPIINAAWDDAADQIVFRDHINLGIAAATPRGLMVPVVRDAQDMAMLELATEITRIVAIAKEDKLQPPDYADGTFSITNVGVFGLDAGTPVVNRTESAILVLGALARRPWVVGTGDDERVVPRWVTTMSLGFDHRLIDGEQGSTFLHDVAEILSDPASAMLY

SEQ ID NO: 47765 - protein, 334 aa, Propionibacterium acnes KPA171202
MSGEVLHSARPQGETTLAKALNAGLSDALAADDRVVLMGEDVGTLGGVFRITDGLKAQFGGRRVIDTPLAESGIVGTAIGMAMRGYRPCVEIQFDGFSAPAFDQIVSQLARYRARVGGRWSLPVTIRIPFGGGVGSPEHHSESPEGFYANTPGLKVVTCSNPDDAYWMLRQSIDSPDPVIFFEPKRRYYTRGHVAQTPTLGLHQARIARSGEEATLICYGPMVDTCVEAAKEASQEGRKLEVIDLRSLSPLDMATVYESVRRTTRAIVVQEAPRTQGVGAEIAARLGEELYYVMEAPVLRVTGWSTPYPPAKAEGEHIPDVDRILDAVDRSLAF

SEQ ID NO: 47766 - protein, 413 aa, Triticum aestivum
MSLVPRRPPLSPTLVRPIHHSIMFASICRRRLALRIHQIAGGGGGTNPLEFIPGTIPLAHCYTSPAVAEVPSSEPCPDTVSYLISCGLSPAAAGAATTAQHLRIRSTDKADAVRALLKLYGFTDADIVRTLRSAPVILVADPERILRPKLDFFASLGFETHKLATEPLLLARSLDKHLVPAIQFLRGIIGSDDDLRRAFHRVPRGLAVDLDNNMRPAVEALRRGGLTKADISKLLVIRLGVLLSSPDRISEIFEELKAMGMSVLDPRFLYCFRAMSGVKRDSWLRKMAFYQSFGLSEGELLQAFKKQPTIFLFADESINKKVRFLLDELKLGISDVIARPVVLGYSLEKCILPRCAVLSVLMREGRIRRDIKLLQALLGSSRNFETRYVLRHADDVPDVVKAYQGKIKFEGFK

SEQ ID NO: 47767 - protein, 381 aa, Propionibacterium acnes KPA171202
MTETICADEGGTDPFVLPARQHPVNRPDPAMVRILDEQGRLTTHPDFPVDLVDDDLVKALEMMVMTRRLDVEATALQRHGELGLWPPLLGQEATQAGAWLALREGDQVFPTYREQGLAHAMGVSLADILGAWDGTSHCGWDTVATHFSAYPVMIGSGTLHAVGYAMGVQRDVEAGGGPAAVLDFHGDGAMSEGDTNEAYVFAASMNAPVVFVCVNNQWAISEPTTVQSPTSLFRRATGFGIPAVQVDGNDVIAMMAVLRSALEYARSGKGPVFVEAWTYRMGAHTTTDDPTRYRTAEEESTWGKTDPIVRLRTYLQNRGIINQVWLDGLAEREDAFGAEVRAAVHENATPVMADLMADVYAEPTPDVLADAEEIASWEEDK

SEQ ID NO: 47768 - protein, 456 aa, Propionibacterium acnes KPA171202
MAVIGAGMTGLAAAHHLHSHGCRPVVLEAGQGVGGQVRSRRLGSDVVDMGPEAVPLRAPGVAALVAELGLTDSMRHPVPGRVLLSSRRGVVEMPSGVTPVGPTKLLPTIASRILSPAGLLRAGLEPFNARPHLDDVSVGQFIAERFGDEVSRAVVDPLLGGIHAADLNTFSLAVAAPALEQTVRNGDSIVAGTLKRNAAGRWSQLRHRSQRSGPRTPATATWKHGLMMLPEALARELTIHTNTRARGIRQVGHEWVVDVTGPHGVGSVAVDDVIIATPARVAGALLATACPRASELLSQCESTTVATLVMQADLTDHPIATAQTWFIGSAWSALVRQVTNLSTTWHLAKPTFRIAMGRQRGTPIDDLSDDDLVAMSVAELRRLGLALDPHDYVIERHRGAMPQPAPGHRERMAQLAATLNGTGLHVGGAGIDGAGVGTAIAAGRRLARHITSKEEN

SEQ ID NO: 47769 - protein, 532 aa, Solibacter usitatus Ellin6076
MLTDREAYKKLAAHFEQVKNVHLRELFAADSRRGERLTAEAAGLYLDYSKNRVTDETLGLLLALAEECGLRGRIDAMFRGDKINTTEGRAVLHTALRAPRGKSPAAAQVPEAGEPVQAVLEQMSVFATSVREGRWAGFTGKPIRNVVNIGIGGSDLGPVMAFEALRYYSQRNLTFRFVSNVDGTDFREATRDLDPAETLFIVASKTFTTLETMANAQSARAWTLAALGDPAAVARHFVAVSTAAEKVAKFGIDTANMFGFWDWVGGRYSMESAIGLSTMIAIGPENFLEMLGGSYAMDEHFRTAPFAKNLPVLMGLLTVWYNNLFKAQTVAVLPYDQYLKRFPAYLQQLTMESCGKHVTLGGEPITTYETGPIFWGEPGTNGQHSFYQLIHQGTKLIPCDFIGFRQTLNPLPSPMGNHHDLLMANVFAQSKALAFGKAAPAGQPYREFDGNRPSNTILAERLTPAVLGALVTLYEHSVLTQATIWDINPFDQFGVELGKVLAAEILPSLAKDAPLPDDDSSTVALIKRYKKQ

SEQ ID NO: 47770 - protein, 372 aa, Campylobacter jejuni
MEISYYEILEITQNADKETIKKAYRKMALKYHPDRNQGDKEAEDKFKLVNEAYEVLSNDEKRAIYDRYGKMLKGGGFGSSSSGFGGFEDLGDIFSSFFGEGFGSSRRRKSSNDEKIPSDFIVNLKLSFKEAVFGCKKNIDFTYKCSCKTCNGTGAKDGKLQTCPKCQGRGQVGVSQGFITFAQTCPDCQGIGEKASEKCSDCKGLGYNESKDSVELNIPEGVDTGMKLRVNAKGNILKNGTRGDMYVKIIAAEDDTFIRDDDDIYIEFPVFFTQAILGESIKVPTIRGEATLNLPKGAKDGQRFVLEKEGVKDVHSSRMGNQIVQISIKFPTSLNDEQKELLEKLSESFGIKDGMHQEQKGLFEKITNWFKS

SEQ ID NO: 47771 - protein, 394 aa, Amycolatopsis orientalis
MNRVLSALAPHSSKRISEYAQRHPGTVDLTVGLPAFGPPRSFDERLAMLSSAPHVNARPEDQYAHSRGAIELRAAIAHVYKSEQGVDLDPDTQILVTNGAAGALWIAVLTLTEPGDEVLLADPGYMIYPPMIELLGRRVVRIPTSPADGFRLHLSDLRSRLTQRSRVVLVNSPGNPTGRVSSEDELADLCAFAVEHGLYVVHDEVLDRFAYGIEHRSVVALDHQGVGIAVNGLSKRFGMSGWRIGWLASSSAVIAEAAKAHTFFMLAVSHAVQLAAAAALSDPKADGEVSVYAAEIRRRGEVFLADLARIPGLGKTTVPDGGFYAFVDVGEFARLRGIRVAESTSAAVAEYLLHECGVAVVPGSVFGRAGEGFVRMSFAGSAEQLDRAVKRLAG

SEQ ID NO: 47772 - protein, 525 aa, Oryza sativa (japonica cultivar-group)
MERVLKDDAVEEKGERARMAAFIGAMAIADLVKTTLGPKGMDKILQSTGRGRSVTVTNDGATILKSLHIDNPAAKVLVDISKVQDDEVGDGTTSVVVLAGELLREAEKLVNMKIHPMTIIAGYRMAVECARNALLERTMDNKENIDKFRSDLMNIAMTTLSSKILSQDKEYFAELAVDAVLRLKGSTNLEAIQILKIPGGSLKDSFLDEGFILDKKIGLGQPKRIENAKILVANTAMDTDKVKIYGARVRVDSMAKVAEIEAAEKQKMREKVQKIIGHGINCFVNRQLIYNFPEELFADAGILAIEHADFEGIERLALVTGGDIASTFDNPESVKLGHCNVIEEIMIGEDKLIHFSGVAMGQACTIVLRGASEHVLDEAERSLHDALCVLSQTVNDTRVLFGGGWPEMVMAKAVDDLARKTPGKKSHAIDAFSRALQAIPTIIADNAGLDSAELISQLRAEHHKENCTAGIDVITGSVGDMQKRGISEAFKVKQAILLSATEAAEMILRVDEIITCAPRRREDRM

SEQ ID NO: 47773 - protein, 187 aa, Glycine max
  misc_feature (54)..(54): Xaa can be any naturally occurring amino acid
  misc_feature (133)..(133): Xaa can be any naturally occurring amino acid
MRTKKKEVAYSMISCPVVTTRQRAHGDRYWTVPFTGLKSMAGFPTRKTNNDITXIASNGGRVQCMQVWPPIGKKKFETLSYLPHLADAQLAKEVEYLIRKGWIPCLEFELEHRFEYREHNGSPGYYQGLYWTXWKLPMSGCTDASQVLKELQEAKTAYPNGFIRIIGFDNVRQVQCISFIAYKPPGF

SEQ ID NO: 47774 - protein, 194 aa, Debaryomyces hansenii CBS767
MSDDTGSVSSNLPSKSNESRVGRENQRYNPETNARMVAGCICMNATKDKVIMILSTAHKNRWVFPKGGIELDEGDDFVVSAARETWEEAGCEGKILNKLPIALDSRGKKAPILEKGKEFEPSGVIPKSEFHFYEMVVDKLSSKWPESKKRQRRWCTYSEAKHELLKAKRPELVEALDNSCIIKDVEGIAGVDEY

SEQ ID NO: 47775 - protein, 266 aa, Arabidopsis thaliana
MGGVKRKIAIEKIQNKNPRAVSFSKRRKGLYSKASELCLLSDAEIAIIATPVSSNSNAAFYSFGHSSVDNVVAAFLANQRPCDERFWWEDESLLKSENLEELREAMDSMSTMLRDLKELEKQRDHQTQTLIHQPCSARVCIQDYVTVNFDGFNTEEQTLAVSDNSNNNGLLGNLDECNEDFDDLDQIFDTVTNSEFLSVNLEMDDVTVNSEGNTEEQTLAVSDNSNNNGLLGNLDECNEDFDDLDQIIEYLTSSEALSMNLKMDDV

SEQ ID NO: 47776 - protein, 90 aa, Brassica napus
  misc_feature (77)..(77): Xaa can be any naturally occurring amino acid
MGFSAGKRKSRDEQDYTVTLASTAFPMDDLSDDVLERVLSWLPTSSFLRMTSVCKRWKSTKTSKSFNLACSQVPLRXPWVFMITGRLKVF

SEQ ID NO: 47777 - protein, 463 aa, Lactobacillus sakei subsp. sakei 23K
MSKHSLFAKKKIDASQFKNGLLERNLTAVGLTAMGVGAVVGAGIFITPGIIAAKYAGPGAMLSYLLAAVVCALAALCYSEFASTIPLAGSAYTYVYTVFGELVAWILGWALVSEYLFAVASVAVSWSAYFQNLMAGFGLHLPTALSAAWEPGKPAGVNLIAGIVVLIVGFLLSNGMRESTRINTIMVGVKIAVIVIFLGVAVFYVKPANFQPFLPYGASGVLSGAALAFYAYIGFDAVSTASEEVINPQRDMPIGIIASLLIASLLYAAVATVLVGVVHYTKLNVGDPVAFALQLMHQNWVAGIISLGAVAGMTTVLLVMTYGGTRLIFAMSRDGLLPAVFAKINPKTHVPVANTWIFAVVTSIVAALVPLDKIAELVNIGTLFAFATVSLGVIFLRRIPNYNELPQGFKVPLYPIVPILSCILCVLLMTQLQITTWIVFVIWLVIGLVIYFSYSYHHSQQRM

SEQ ID NO: 47778 - protein, 309 aa, Bacillus clausii KSM-K16
MLRDLLRLFPQPVQSFIESLRTAELEELEEIRLRVGQPVECLFASRSVYSTNPLYRFSVADASYVLNQLSQYSLYAFEEELQKGYITVAGGHRVGLAGKTVLENGAVQTIRPVSSFNVRIARQKIGAAEKVIDKLYDRQTRSWQNALLIGPPQTGKTTVLRDVARIVSTGSKKNHIPSCKVGIVDERSEIAGCVAGVPQHELGVRVDVLDGCPKAEGMMMLIRSMSPDVLIVDEIGREEDVKAILEARHAGVSLIATAHGHTLEDVAKRPVFKGLFEQEAFTCVIELGKSPHPGSIKRVRRPQQTRIMR

SEQ ID NO: 47779 - protein, 525 aa, Escherichia coli O157:H7 EDL933
  misc_feature (83)..(83): Xaa can be any naturally occurring amino acid
  misc_feature (127)..(127): Xaa can be any naturally occurring amino acid
  misc_feature (154)..(154): Xaa can be any naturally occurring amino acid
MTENIHKHRILILDFGSQYTQLVARRVRELGVYCELWAWDVTEAQIRDFNPSGIILSGGPESTTEENSPRAPQYVFEAGVPVXGVCYGMQTMAMQLGGHVEASNEREFGYAQVEVVNDSALVRGIEXALTADGKPLLDVWMSHGDKVTAIPSDXVTVASTESCPFAIMANEEKRFYGVQFHPEVTHTRQGMRMLERFVRDICQCEALWTPAKIIDDAVARIREQVGDDKVILGLSGGVDSSVTAMLLHRAIGKNLTCVFVDNGLLRLNEAEQVLDMFGDHFGLNIVHVPAEDRFLSALAGENDPEAKRKIIGRVFVEVFDEEALKLEBVKWLAQGTIYPDVIESAASATGKAHVIKSHHNVGGLPKEMKMGLVEPLKELFKDEVRKIGLELGLPYDMLYRHPFPGPGLGVRVLGEVKKEYCDLLRRADAIFIEELRKADLYDKVSQAFTVFLPVRSVGVMGDGRKYDWVVSLRAVETIDFMTAHWAHLPYDFLGRVSNRIINEVNGISRVVYDISGKPPATIEWE

SEQ ID NO: 47780 - protein, 595 aa, Andrographis paniculata
MAALRRRSSKDSAGEVAPPGHDYSSPPTKASDALPLPLYLTNAVFFALFFSSVYYLLLQWREKIRSSIPLHVVTLSEICSIVSFVASFIYLLGFFGIGFVQSLVIPRTSHDDLLDDDDELIDQDFTAAMLKDDSRAAPCMPSAGDDCKIASSKITPKFVSDDGELPSPVVNPSLDEEDEQIVKSVIDGKIPSYSLESKLGDCRRAAAIRREALQRATGKSLAGLPLEGFNYDAILGQCCEMPVGYVQIPVGIAGPLLLDGREYSVPMATTEGCLVASTNRGCKAILASGGAFSAVLRDGMTRAPVVRFATAKRAAELKFFLEDPLNFETLSMVFNSSSRFGRLQSIKCAVAGKNLYIRFSCSTGDAMGMNMVSKGVQNVIDFLGNEFSDMEVIGLSGNYCSDKKPAAVNWIEGRGKSVVCEAIIKEEVVKKVLKTNVSSLVELNMLKNLTGSAVAGALGGFNAHASNLVSAVYIATGQDPAQNIESSHCITMMEAVNDGKDLHISVTMPSIEVGTVGGGTQLPSQSACLNLLGVKGASKEVPGSNSRLLATIVAGTVLAGELSLMSAISAGQLVNSHMKFNRASHNKDAAPKLST

SEQ ID NO: 47781 - protein, 157 aa, Pseudomonas putida
MSQFDELAPQQLFKALESATTTASLPKLATLLDAIRFNEDGLIPAIAQQHDTGEVLMMAWMNREALEETLTTQRVCYFSRSRQKLWRKGETSGQQQRLKSAALDCDGDTLLVQVEQTGPACHSGRRSCFYVSLGADSAKITSEPLIDPATLYGKKAP

SEQ ID NO: 47782 - protein, 102 aa, Brassica napus
MEVPGSSKKMIATQEEMVAAKVPLGYRDQCAHLLIPLNKCRQAEFFLPWKCEDERHVYEKCEYELVMERMLAMQKIREEEAKAKQNKLQGNGVPLIPKTANA

SEQ ID NO: 47783 - protein, 729 aa, Triticum aestivum
ARGRSPTAAEQDPSPVFPETSNTKFLKQKNVEVASKDPEKGSTHDNRIEDEKSDLLGYEVYSGKLTLDNKGRSVSGEQSGSGSSGNCFDARLTTEALVWGSNILKLEDIVSVSYNSGLRHFTVHACPLEKRSNGLSCFMKPRRIQKDLRFLSTAPHEAFRWVNGFADQQCYVNLLPHPMASSKKHSSELIPFDAMLDPYVKCRSPPKILVILNPRSGHGRSSKVFHGKVEPIFKRQLAGFKMEVIKTTHAGHAKSLVSTIDFSTCPDGIVCVGGDGIVNEVLNGLLCRDDQIEAGSLPIGIIPAGSDNSLVWTVLGVKDPISAALSIVRGGFTPIDVFSVEWIQSGTTHFGTTVSYFGFVSDVLELSEKYQKRFGPLRYIVAGFLKFLCLPKYSFELEYLPVADVDGAGHKIVEGQEKVDTSDLYDDVVQRSRAECLPRASSLSSIDSIMSTSIMSGGEPEVSSPRANNEPSELVRALDPKSKRQSLGRTSTFKEPEESLHPQASTPSWRRSKSKSRTEKAWPGLTATNDTKSSKGTTTHDKEDTSSTISDPGPAWDTGPKWDMEPKWDNQPNWEPETPIELHGPSDDIELGLTKELVPSLDERWVIRKGRYLGVLVCNHSCKTVQSLSSQIVAPKAEYDDNCLDLLLVGGSGRLRLLRFLVLLQFGKHISLPNVEYVKVRSVRLKAGPNTHDGCGIDGELLHVKGQVRCSLLPQQSRLIGRPAKNPVQ

SEQ ID NO: 47784 - protein, 450 aa, Brassica rapa
MYPITLKFEEVVYKVKIEQTGQCLGSWSCKEKTILNGITGMVCPGEILAMLGPSGSGKTTLLSALGGRLSKTFSGKVMYNGQPFSGCIKRRTGFVAQDDILYPHLTVWETLFFTALLRLPSSLTRDEKAEHVDRVISELGLTRCTNSMIGGPLFRGISGGEKKRVSIGQEMLINPSLLLLDEPTSGLDSTTAHRIVTTIKRLASGGRTVVTTIHQPSSRIYHMFDKVVLLSEGSPIYYGPASSAMEYFSSVGFSTTMTVNPADLLLDLANGIPPDSQKETSEQEQKTVKETLVSAYEKNISTKLKAELCNADSHSYEYTKAAAKSIKSEQWCTTWWYQFTVLFQRGVKERRFESFNKLRIFQVISVAFLGGLLWWHTPKSHLQDRTALLFFFSVFWGFYPLYNAVFTFPQEKRMLIKERSSGMYRLSSYFMARNIGDLPLELALPTALCS

SEQ ID NO: 47785 - protein, 103 aa, Cucumis sativus
  misc_feature (78)..(78): Xaa can be any naturally occurring amino acid
MSGSGKGGKGLGKGGAKRHRKVLRDNIQGITKPAIRRLARRGGVKRISGLIYEETRGVLKIFLENVIRDAVTYTEHAXRKTVTAMDVVYALKRQGRTLYGFGG

SEQ ID NO: 47786 - protein, 202 aa, Arabidopsis thaliana
MRPPMRGGGGFRGRGGRDGGGGGRFGGGGGRFGGGGGRFGGGGGRFGGFRDEGPPSEVVDVATFVHACEGDAVTKLSQEKIPHFNAPIYLENKTQIGKVDEIFGPINESLFSIKMMEGIVATSYSPGDKFFIDPYKLLPLARFLPQPKGQSTGGRGGAGRGRGDSRGRGRGGSFSRGRGAPRGGRFPPRGGSRGSFRGRGRF

SEQ ID NO: 47787 - protein, 566 aa, Arabidopsis thaliana
MDSLSSMGFQTASFFLILLFLFYHLPCVPSQQERSRLCKPFQCGDITVGFPFWGENRQSDCGHFSLKLNCNKPSNTTSLTISGHNYSVLHIDNKSNILSLSRQDFSGPFCSASFSSTPLRSDLFQNLQPYRNLTVFYMCDPRRHFFGNFTCPVKGLGSVVQNSTYRKLCDKSFSVTVPTSYVPEEEALNLTHLESVLRKGLEVKLKISEMSGQECVTTDGNSGFTRFCCTNVSGPEISCLTSITTMNNGTYSDNRPFLVTIGTEVVGRGGFGTVYRGRLRDGRKVAVKVLKDSKGNCEDFINEVASMSQTSHVNIVTLLGFCYEGSKRAIIYEFLENGSLDQSLNLDVSTLYGIALGVARGLEYLHYGCKTRIVHFDIKPQNVLLDENLRPKVADFGLAKLCEKQESILSLLDTRGTIGYIAPELFSRMYGSVSHKSDVYSYGMLVLEMIGARNKERVQNADPNNSSAYFPDWIYKDLENFDNTRLLGDGLTREEEKNAKKMILVGLWCIQFRPSDRPSMNKVVEMMEGSLDSLDPPPKPLLHMPMQNNNAESSQLSVESSIYSEV

SEQ ID NO: 47788 - protein, 222 aa, Vibrio vulnificus CMCP6
MPEIKQLFENNSKWSEEIKSHQPEYFSKLEEGQNPGFLWIGCSDSRVPAERLTGLYSGELFVHRNVANQVIHTDLNCLSVVQYAVDVLKVKHIIICGHYGCGGVNAAIENPRLGLINNWLLHIRDLYLKHRNWLGELPKEKWGDKLCEINVAEQVYNLGNSTIMESAWERGQDVEIHGVVYGIGDGLLQDIGVRCYSRESLEVNYQAAMAKILNSDVMKFHE

SEQ ID NO: 47789 - protein, 352 aa, Aspergillus oryzae
MSGRVWPRSEVSDCHGELGEDDMRREGANKRGLSSAYDQITQQHVAVKKMMNPFANASIAKRTYREVKLLKQLRHENLIGLCDIFISPLEDIVLMPGFARYLVTELLGTDLGRLLRARPLDNKFAQYFMYQILRGLKYIHSAGVIHRDLKPSNLLVNENCDLKICDFGLARVQEPQMTGYVSTRYYRAPEIMLTWQRYGKMVDIWSAGCILAEMLRGKPLFPGKDHIHQFFLITEVLGNPPPEVVQKITSGNTQRVVNSLPNQEPRPLRAVFHEFDNDVISLLEQLLLFDPDKRLTAETALQHPYLAPYHDPDDEPAALEKFDWSFNDADLPIDTWKLMMCVAIGSAKCAPN

SEQ ID NO: 47790 - protein, 100 aa, Glycine max
RREENTAASHGSAISYIYKFELLSFEIVTLWPEKCRFCLGNGNVTVELGGGEEEVSRCINCDGVGSLTCTTCQGSGIQPRYLDRSMKFCSLLGQFIYSSF

SEQ ID NO: 47791 - protein, 453 aa, Arabidopsis thaliana
MDTDLISNLPDDVLGKILSLVPTKLAAATSVLSKRWRNLLPLVDSLDFDETMLFYPDNKDGEDEASSYESGQRRRHSFSHFVDKTLALLSNAPLTEKFSLKCYHEDDGARINRWIRTALERGCLELNLEAANYLPIDSQYFTSNTLVKLTISDGFYPGGHLLPFGGVFFPALKTLTLVSVCFTSVEMINFFIHGCPALEELFLCVWMQYMSSPNVRRVTITSDFDDDIQRPSMVLKTPSLVYLDYSSYVAGNYYVVLDSLVEARLDLRLYEPIIYDEDGLWNAEVFGNITNLIEAIRTIKILHLSPSSLEVFYYCCDLPVLEDLVNLSIESDKEKGWEVMPRLLNKSPNLQTLVVKGLVHRVTYCCGDACACIRMKDREIVSCLSRCRVKVLKILGYGGSFRELKQMRHFLGKLKCLETVKVGVKEGSKKSNYLVANVMALPRVSSKCKIQFI

SEQ ID NO: 47792 - protein, 377 aa, Solibacter usitatus Ellin6076
MSKRDYYEVLGVGKQAADSELKAAYRELAKRFHPDRNPDDPHAEEKFKECSEAYSVLSDAQKRAAYDRFGHAGVQGAGGGPAGFNPEQFADFGDILGDFFGFGDLFGQGGGAGGRRRTRAQRGEDVRYDLEITFEDAMFGMGADIQVPRMERCERCKGGGSEPGSGPTTCPTCHGRGEILYQQSFLSIRRTCSTCNGSGQIIRNPCGECHGHGYKQVQRKLKVNIPAGVDDGNRLRLAGEGQPGVNGGPPGDLYVFLKVKEHPFFERHEADLHCTIPINMAQAALGCEIEIPTLEQPSKLKIPEGTQNGAQFKLRHKGVAVLNSSSRGDLYVHIAVKTPTRISREQRKMLEQLRDTLPVDNRPAEKGLFEKVKDYFM

SEQ ID NO: 47793 - protein, 383 aa, Lactobacillus sakei subsp. sakei 23K
MAEKRDYYDVLGVGRDASDDEIKKAYRKLSKKYHPDINKAPDAEAKFKEVTEAYEALSDPQKRAAYDQYGHAGMNGGFGGGAGAGQGFGGFGGGAEGFGGFDDIFSSFFGGGARQQPNGPRQGSDLQYRMDLKFEEAVFGKETKISYSREAECHTCHGSGAKPGTSAETCHKCHGAGQIQVERQTPLGRMMSRETCDVCGGTGKEIKSKCDTCHGTGREEERHTVKVKVPAGVEDGQQMRLQGQGEAGSNGGPYGDLFIVFRVAPSDEFERDGAQIFVEVPISFVQAALGDEIEVNTVHGPVKLKIPAGTQTNTVFRLRGKGAPKLHGTGNGDQNVTVNVVTPKTLNSKQRDALKAFAVASGDSVNPQDSNLFDKILNKKYKK

SEQ ID NO: 47794 - protein, 193 aa, Prochlorococcus marinus str. MIT 9303
MVVALTMAAMMPGLRPLRHHSLDLRHLIQDIPDFPKPGILFRDISPLLRDPDGWGEVMRQLGDLCTEFKPDLIVGIESRGFIVGTALATNRKIGFVPVRKPGKLPGDVLGIDYSLEYGSDRLEIHADALQGHPRVLMVDDLLATGGTAKATVELIEQAGGDLVGCGFVIELAALGGRQQLPVEIPVKSLIIYS

SEQ ID NO: 47795 - protein, 1168 aa, Oryza sativa
MGVPEAVALEIPAAAEAEEEVEEEEGSPSPPVVARVPPRIRRRLLLRHRGGAPATAEEIEAKLRDADLRRQQFHEALSCKARCTVRYPSCPSQEEDPKKRLEAKLVAAEQKRLSLLAKEQSRLAKLDELRQAAKNDAELRFKKEREELGMKVESRVRQAEEKRTQLMHARSQRRAALEERTTKYLVQRVAWENKYRERVHSAILQKRTAAEKRRTGLLEGEKRRAQGRFSQVQLAARTLSCQREADRSKLKEQLEDKLQRAKRQRAEYLKQRGSTHSFTYTASVKHGDFLSRNLARCWRRFITSRKTTVVLARAFDMLRINEESVKPMPFEKLALCIESPTVLQTTRAFLDRLESRFTLSQSSSPSSPENIDHLLKHLGSPKRTLSKSGGRTRVTPTKAARNSDVSKLPRYSPRIVLCAYMILGHPSVVFNERGEREKLLVESAENFVKEFELLIKTILDGSSGACILKQPILDDLSPGSSNYQESSAVVADRKKFRSQLASFDKAWCAYLYHFVVWKAKDAKSLEEDLVRAACKLELSMMQTCKFTAEGQPENLNDNLKAIQKEVMVDQTLLREKVRHLGGEAGIERMEVALSEARTKFFEAKGNRSPLATTIKNVAATCSSGESPISDMKENSNINDKRPSQAVQSMFRVPSSPSESNTAGITMSNPMTVSSTLSEKRPTENEQMVNEILHGFLADSSSNIGTVEGGFKEKVRETMEKAFWDVVVDSLRGDMPDYSYLVQLVKEVRDTLYEMVPKGWKEEIINNIDLEILLQVLESGTQDMQYLGQILQYSLGMLRKLSSPAKEDEMKRSHDKLLGELTEHSECNNSGSNSFVIAVIKGLRFTMEELKALKTEVSRARIQLLEPIIKGSGGVEYLQKAFADRYGFPSNASVALRSTAQWISTSKDTVEVEWNEHAQPFVATLRSGHGVPDQRQSTIPVSDDTGLPECTGQRLDQLIRIGLLQLISGIEGVQMQSVTETFKLNWLRLRSVQSQFQQVIVIATSMLVQRQVLATDDPNITPTELESATSQLFNTLAELLDNFPDVSTAKIMEVMLRSSSSSSSSSGSTTGSPSDERTESRKQILARVFLKSLQTDDPVFKKVSRSVYCAFRAITLGGSGARGRKLADAALRRIGATKLTDRVVRSAEILIRAASISQQVHGPWYNHLV

SEQ ID NO: 47796 - protein, 521 aa, Medicago truncatula
MAGANKHPPTSSSTSRLLLLLTILPLTLAAFAFLLQWRGGVTDPVTRWSPDQNLFPGMSTSDHIQQRSQPRSRSDCSSLFGNSHSPSFPYFRDWTLDFSSDLSPKICITTSTSAGLEQTLPWIYYHKVMGVSSFLLFVEGKAASPNVSRVLETIPGVKVIYRTRELEEQQAKSRIWNETWLSSFFYKPCNYELFVKQSLNMEMAIVMARDSGMDWIIHLDTDELIHPAGTQEYSMRQLLSDVPGNVDMVIFPNYESSVERDDITEPFSEVSMFKKNYDHLPKDVYFGNYKDATRGNPNYFLTYGNGKSAARIQDHLRPNGAHRWHNYMKTPNEIKLEEAAVLHYTYTKFSDLTSRRDRCGCKPTKDDVKRCFMLDFDRAAFIIASTATEEEMLQWYRERIVWTDKTLNMKLMRKGILTRIYAPMAIIQSLRETGVFNSVIAKAAQTTISKDNFLKSVDSSNATRNARSEMLSSRKIDAGGASQAIARRILEVIDDSIPSAIPPLSPPYHDDADADTDFLTS

SEQ ID NO: 47797 - protein, 143 aa, Escherichia coli O157:H7 EDL933
MAIERTFSIIKPNAVAKNVIGNIFARFEAAGFKIVGTKMLHLTVEQARGFYAEHDGKPFFDGLVEFMTSGPIVVSVLEGENAVQRHRDLLGATNPANALAGTLRADYADSLTENGTHGSDSVESAAREIAYFFGEGEVCPRTR

SEQ ID NO: 47798 - protein, 547 aa, Yarrowia lipolytica CLIB122
MASASSELSRLANLTPRSISGSSSTSSSTTCPPRNTSRPSTAGSNSSIRSRHYSADQFELLEELGSGSFGVVYKAIDKVSGQIVAVKKIDLESSEDDIEEIQKEIAILSGCQDEHITTYYGCFVRGYKLWIIMEYLAGGSGLDLLKPGIFHEPEIAVMCRELLEGLIYLHDNGKIHRDVKAANVLVSSEGSVKLADFGVATQLSNNMSRRNTFVGTPFWMAPEVIRQEDYDTKADIWSLGITAIEFAKGEPPLSEYHPMKVLFLIPKAEPPTVPAGGNWSADFRDFVACCLRKNPAERPSGRQLLKHRFIRKAGKTSQLKLLVDRRERWMERHRKTKPKKMAVETVVSMDQVEEEDSWDFGTVKMETYLDKSMDSSSSTINPAVLRQLTISENNAPEVTLKNPLRKVFMSSESLGNSVKSVSSVSTAADGDTIKAGPPNVHALVRQCIEETYMEIGGESATNTQQHAMRRFAKGWNTLEQVDSKAEFFFVKQLFNQIIKNPKLVEQMTNKRTSKRISVGQQKERKRDQVEELMLGRWIEEFEEYDRY

SEQ ID NO: 47799 - protein, 458 aa, Arabidopsis thaliana
MAATRQLRTLQSQPENKVCVDCAQKNPQWASVSYGIFMCLECSGKHRGLGVHISFVRSVTMDSWSAIQIKKMEAGGNERLNKFFAQYGIAKETDIISKYNSNAASVYRDRIQALAEGRPWNDPPVVKEANKKPPLAQGGYGNNNNNNNGGWDSWDNDDSYKSDMRRNQSANDFRASGNREGAHVKSKSSEDIYTRSQLEASAAGKESFFARRMAENESKPEGLPPSQGGKYVGFGSSSAPPPRNNQQDDVFSVVSQGFGRLSLVAASAAQSAASVVQTGTKEFTSKVKEGGYDHKVSETVNVVANKITEIGHRTWGIMKGVMAMATQKVEEFTKEGSTSWNQQSENEGNGYYQNFGNGNKAANSSVGGGRPQSSSTSGHYNNSQNSNSWDSWGENENKKTEAVAPKGSSASNDDDGWTGWDDHDAKDDGFDGHYQSAGDKKSAGHNGKSDPLDWWRFL

SEQ ID NO: 47800 - protein, 202 aa, Zea mays
VMMQTPMCRWLNSIVLGAIISLGLIGAGTNNARIAGMLRNLSSYYYKEAAHLFCVRIAQGLVHLGKGLLTLSPYHSDRFLLSPMALGGLVTVLHACLDMKSTILGKYHYILYIIVLAMQPRMLLTVDEDLKPLSVPVRVGQAVDVVGQAGRPKTITGFQTHSTPVLLAAGERAELATEKYIPLTPVLEGFVILKKNPEYHEE

SEQ ID NO: 47801 - protein, 923 aa, Corynebacterium efficiens
MADQAKLGGKPTDDTNFAMIRDGVASYLNDSDPEETKEWMDSLDGLLQDSSPERARYLMLRLLERASAKRVPLPPMTSTDYVNTIPTSMEPDFPGDEEMEKRYRRWMRWNAAIMVHRAQRPGIGVGGHISTYAGAAPLYEVGFNHFFRGKDHPGGGDQVFFQGHASPGMYARAFLEGRLTESDLDSFRQEVSYEGGGIPSYPHPHGMPDFWEFPTVSMGLGPMDAIYQARFNRYLHNRGIKDTSEQHVWAFLGDGEMDEPESRGLIHQAALNNLDNLTFVINCNLQRLDGPVRGNTKIIQELESFFRGAGWSVIKVIWGREWDELLEKDQDGALVEVMNNTSDGDYQTFKANDGAYVREHFFGRDPRTLKLVEDMTDEEIWKLPRGGHDYRKVYAAYKRALETKDRPTVILAHTIKGYGLGHNFEGRNATHQMKKLTLDDLKLFRDKQGLPITDEELEKDPYLPPYYHPGEDAPEIKYMKERRQALGGFLPERREKYEPLQVPPLDKLRSVRKGSGKQQVATTMATVRTFKELMRDKNLADRLVPIIPDEARTFGLDSWFPTLKIYNPHGQNYVPVDHDLMLSYREAKDGQILHEGINEAGSVASFIAAGTSYATHGEAMIPLYIFYSMFGFQRTGDGIWAAADQMTRGFLLGATAGRTTLTGEGLQHMDGHSPILASTNPGVETYDPAFSYEIAHLVHRGIDRMYGPGKGENVIYYLTIYNEPTPQPAEPEDLDVEGLHKGIYLYDKAAEGEGHEASILASGIGMQWALRARDILAEDYGIRANIFSATSWVELARDGARRNLEALRNPGADVGEAFVTTQLKKGSGPYVAVSDFATDLPNQIREWVPGDYIVLGADGFGFSDTRPAARRYFNIDAESIVVAVLRGLVREGVIDASVAAHAAEKYKLSDPTAPQVDPDAPIE

SEQ ID NO: 47802 - protein, 450 aa, Ralstonia solanacearum GMI1000
MTPSTTSVFHRDPRKTLPTAVGGESMMLIDAEGKRYLDASGGAAVSCLGHGHPRVVEAICKQVRALAYAHTSFFTTAVAEELAARLAAAAPGDLGHVYFVSGGSEAIEAALKLARQYFVEIGQPQRQYFIARRQSYHGNTLGALAIGGNAWRREPFLPLLVPAHHVSPCFAYRERRDGETDAQYVQRLADELDAKIVELGADRVAAFIAETVVGATAGAVPPVADYFRKIRAVCDRHGVLLILDEVMSGMGRTGHLFACEEDGVVPDLIAIAKGLGGGYQPIGAMIASDRIYDAITRGSGFFQHGHTYIGHATACAAALEVQKVIAEENLLANVLARGEQLRAALRERFAAHPHVGDVRGRGLFVGVELVADRGTKAPLPPARKTHARVRAEAMQRGLMVYPMGGTIDGQRGDHILLAPPFIATAQDIDAIVARLGDAVEAATANALEAA

SEQ ID NO: 47803 - protein, 398 aa, Mycobacterium avium 104
MSSDASASNGIVIVGGGLAAARTAEQLRRSEYSGPITIVSDEVHLPYDRPPLSKEVLRKEVDDTALKPRQWYDDNDITLRLGSAARSLDTAAQTLTLEDGTTLGYDELVIATGLVPRRIPTIPDLDGIRVLRTFDESLALREHASAAQRAVIIGAGFIGCEVAASLRSLGVDVVLVEPQPTPLAAVLGQQIGELVARLHRAEGVDVRLGVGVSEVRGDRHVEAVVLTDGTELAADVVVIGIGSRPATDWLEGSGVAIDSVDRGVLCDEAGRTSAPNVWALGDVASWRDATGHQGRVEHWSNVADQARVVVPAMLGKEVPPVVVVPYFWSDQYDVKIQCLGEPEADDIVHIVEDDGRKFLAYYERDGALVGVVGGGMPGKVMKTRAKIAAAVPIAEMLG

SEQ ID NO: 47804 - protein, 165 aa, Capsicum annuum
MASQREENVYMAKLAEQAERYEEMVEFMEKVVAALDGGDELTVEERNLLSVAYKNVIGARRASWRIISSIEQKEESRGNEDHVTSIKNYRSKIEIELTSICNGILKLLDSKLIGSAATGDSKVFYLKMKGDYYRYLAEFKTGAERKEAAENTLSLISLLRILLMP

SEQ ID NO: 47805 - protein, 107 aa, Oryza sativa
  misc_feature (8)..(8): Xaa can be any naturally occurring amino acid
  misc_feature (26)..(26): Xaa can be any naturally occurring amino acid
  misc_feature (36)..(36): Xaa can be any naturally occurring amino acid
  misc_feature (46)..(46): Xaa can be any naturally occurring amino acid
  misc_feature (52)..(52): Xaa can be any naturally occurring amino acid
MLGRGKGXKGLGKGGAKRHRKVLRDXIQGHHQARPXPERLAKEGAXVKPHLXGLIYEETRGVLKIFLENVIRDAVTYTEHARRKTVTAMDVVYALKRQGRTLYGFGG

SEQ ID NO: 47806 - protein, 666 aa, Arabidopsis thaliana
MINFSLSLTKSMSYSFIWMLFVIHISCVLSADGNHILCSPSFTCGNQRGLLYPFWIAGRKECGHPDFELDCNAGVPELSISSVKFRILGADYDSGIITLARSDNIDDPCLPNSFTTSFNETVLPLASTTDLLTIYYDCNRNVSSFVSTFVKELDCPDDGTDDRRNYYLTRNLTFLPPSLKLEGNSFLLNDFGGSCSRNVSNPASRTALNTLESTPSTDNLKIALEDGFALEVNSDCRTCIDSKGACGFSQTSSRFVCYYRQEPQNPTRNKVILKLFFIVIYVLGIGAASFAMMGVILVVTCLNCLIRRQRKTLNDPRMRTSDDSRQQNLKALIPLKHYSYAQVTSITKSFAEVIGKGGFGTVYRGTLYDGRSVAVKVLKESQGNGEDFINEVASMSQTSHVNIVTLLGFCSEGYKRAIIYEFMENGSLDKFISSKKSSTMDWRELYGIALGVARGLEYLHHGCRTRIVHFDIKPQNVLLDDNLSPKVSDFGLAKLCERKESILSLMDTRGTIGYIAPEVFSRVYGRVSHKSDVYSYGMLVLDIIGARNKTSTEDTTSSTSSMYFPEWIYRDLEKAHNGKSIETAISNEEDEIAKKMTLVGLWCIQPWPLDRPAMNRVVEMMEGNLDALEVPPRPVLQQIPTATLQESSTFSEDISAYTEICSINVA

SEQ ID NO: 47807 - protein, 896 aa, Xylella fastidiosa Ann-1
MNRLKEALHNDPNPLETQEWLESIKAVIDIAGPERAHQLLEGVAEQIHRTGTNLPFSPITEYVNTIPTADEAKNPGDPALERSIRSIIRWNAMAAVVRANRKPGDLGGHIASFASSATLYDVGFNHFWRAPSPQHPGDLLYIQGHSSPGIYARAFLEGRISESQLDHFRMEVDGKGISSYPHPWLMPQFWQTPTVSMGLGPLSAIYQAQFMKYLEHRGLIAPSDRKVWCFIGDGESDEPETLGAIALAGREGLDNLIFVVNCNLQRLDGPVRGNGKIIQELEGVFRGGGWNVIKLLWGAHWDPLLAQDTQGVLRKLMMETVDGEYQNCKAFGGEYTRKHFFDKYPETAAMVAHLSDNDIWRLNRGGHDPHKIYAAYHRAVNTQGMPTVILAKTVKGYGMGTAGESLNPTHQTKKLDHDAIKHFRDRFNIPISDQQLDAADHIPFYHPGTDSPEIKYMIARREALGGFLPQRRTKSSKSFIVPGLDKYERLLTSSGERTYSTTMAFVQSLNITLRDKALGPHIVPIVADEARTFGMEGLFRQIGIYAPFGQKYKPVDADQLMYYREDESGQVLQQGITEPGAIASWMAAGTSYSVSDVPMLPFYIYYSMFGFQRIGDIAWQAADMRTRGFLLGGTAGRTTLNGEGLQHEDGHSHLMAGAIPNVRSYDPTFGYEVTVILQHGMKAMMQDQIDEYYYLTLMNENYAHPDMPAGAEQGIIKGMYLLKDAGKPKKGELRVQLLGSGTILREAIAAAELLHQDFGITADIWSCPSFSELRKDGFDAERWNRLHPDNQPRTPYVTQQLENRQGPAIAATDYVRLFADQIRAFVPMHYTVLGTDGFGRSDTRSNLRRFFEVDRYFIAHAAIAALAKEGKMTGKDVTRAIEQYNINPEKPNPVDI

SEQ ID NO: 47808 - protein, 236 aa, Vibrio vulnificus YJ016
MYSDARIFREVRRNMPEIKQLFENNSKWSEEIKSHQPEYFSKLEEGQNPGFLWIGCSDSRVPAERLTGLYSGELFVHRNVANQVIHTDLNCLSVVQYAVDVLKVKHIIICGHYGCGGVNAAIENPRLGLINNWLLHIRDLYLKHRNWLGELPKEKWGDKLCEINVAEQVYNLGNSTIMESAWERGQDVEIHGVVYGIGDGRLQDIGVRCYSRESLEVNYQAAMAKILNSDVMKFHE

SEQ ID NO: 47809 - protein, 475 aa, Vibrio vulnificus YJ016
MSKEIKAQVVVLGAGPAGYSAAFRCADLGLDTVLIERYNTLGGVCLNVGCIPSKALLHVAKVIEEAKALAEHGIVFGEPQTDIDKIRLWKEKVINQLTGGLGGMAKMRKVNVVNGFGKFTGPNTIEVEGEDGKTVVNFDNAIVAAGSRPIKLPFIPHEDPRIWDSTDALELKEVPGKLLIMGGGIIGLEMGTVYHSLGSQIDVVEMFDQVIPAADKDIVKVYTKRISKKFNLMLETKVTAVEAKEDGIYVSMEGKKAPAEAERYDAVLVAIGRVPNGKLIDGEKAGLEIDERGFINVDKQMRTNVPHIFAIGDIVGQPMLAHKGVHEGHVAAEVISGKKHYFDPKVIPSIAYTEPEVAWVGKTEKEAKAEGINYEVATFPWAASGRAIASDCADGMTKLIFDKETHRVIGGAIVGTNGGELLGEIGLAIEMGCDAEDIALTIHAHPTLHESVGLAAEVFEGTITDLPNAKAKKKK

SEQ ID NO: 47810 - protein, 101 aa, Galega orientalis
MGNFGVCFLVVLTLGCLIATTIAEQCGRQAGGKTCPNNLCCSQYGYCGNTDDYCSPSKNCQSNCQGGGGGGGGGGGGGESASNVRSTYHYYRPETVGGTKR

SEQ ID NO: 47811 - protein, 405 aa, Methanosarcina acetivorans C2A
MKAIILAAGEGLRCRPLTLTRSKVMLPVANRPILEHVISSLEKNGIKEIILIVGYEKERIMNYFEDGLNFGVNITYVEQKAQLGTAHAIEQAKKLISPEDSEFLVLNGDNLVESKTIADLLNNYKGDASLLTVRMEDTAGYGVVLKENKRVTRILEKRPGDLSHIVNTGIYIFTPQVFETIEKTPISENGEYAITDTLQLMIDEGKIVTSIPTESKWLDAVHAWDLLKANSTVLNSSRNLKQEGELEEGVIIRGKVAIGKNSRIRAGTYIVGPVVIGENCDIGPNVVILPSTTIGDNVSIRSFTEIQNSIIMNDCRISSHGQISNCIIGSNNTLGPGFTAEEKENLEININCKIHSAPKLGTIFGDDNRIGGRVLVKAGVMIAVNCQVESGNTIYRDLPRDSVVL

SEQ ID NO: 47812 - protein, 130 aa, Oryza sativa
MVRMNSLADALKTLYNAEKRHKRQVLLRPCSKVIVKFLTVMMKHGYIGEFEIIDDHRAGKIVVNLNGRLNKCGVISPRFDCSINDIETWTKNLLPSRQFGYVVLTTSYGIIDHEEARRKHTGGKVLGFFF

SEQ ID NO: 47813 - protein, 183 aa, Arabidopsis thaliana
MSGNKEEEDPRIHGIKTKIRVVPDFPKKGIMFQDITTVLLDPKAFKDTIDLFVERYRDKNISVVAGIEARGFLFGPPIALAIGAKFVPLRKPKKLPGETIFEEYELEYGNDRLEMHIGAVEAGDRSLVVDDLIATGGTLCAAINLLERVGAEVVECACVIELPELKGRQRLKGKPLCMLVEYR

SEQ ID NO: 47814 - protein, 608 aa, Candida albicans SC5314
MSQSDVPIKKEVTVKKEDGSTPTSPSKQQEWQTIPLKSCTEEDVKDIRFHIMKFATKQDVNITKDFTRPVRLHRKDPRNMQFHLTREELDQRKREKQQMEKLKQEEKEATAKPTEESEEKEEKDKPTADAAKVAPEKPTLNKNQADMSQVAPDGGARKNRKNLFKRKTRQINLMNEEKRKLRYEEHYPWVIEDYDGKNVFVGNYEAGSTEQQHVLFVFDKDGFKMIPAEKVYRFTPRNRYATLTLEEAEAKMERNSSVPRWLMKHMEDRSISEGTPDQRFRYNSPAANGSVIANVGNGSAGRRMRTVLGGSGSGNDRDSDHDDLDYDEEFADDEEAPIMDGDEEENKLSEKKIKKEMLKAAHFDGQSEAEAEDDLDDLFETEKTRKVDKEGKKLRKVLNKREGGVYDSDEEDGLMPYISKSDLESDEESDDEVQVKKEPSSDSQTDNNTNKTSRAREVGVKSIGDGFVVIKAPPSFLGTMPPGDWNPQARKRPTPEIASPRKKIKLDETIKVKKERTLSPPPVSPTTNAATNTSSPGNGMDLNDAGPDNLLVTVKDVLDIVKDQPLTTKELLMGLKSRVSAHKDNKLRIISIVKQNLRLVDGKLVLKD

SEQ ID NO: 47815 - protein, 412 aa, Zea mays
MASHRHFLRLLEDPFSPFPPPPPSSSSCPFLLDGVSDYPSPFPAASPFPDLDDLLLPPAPALDPFLAFTPTPLILRDLTNRVAALEVAVATARRRPGPPATRKRTYVTEAGGRKVKWTSVEKPRAGERTLKWEAEIKSPDDDGFDRKWKWEAKGGSSAASARKLKWGAAVKGKGCLEPWSQAYTWEEDFTASDSDKEEEERAADKNKAKKITMNKNEKKEVKAVKKEKKCPFATVKIEEISEDNDAGCVAIKKAFAKGNGKGKRKELSPQDAALLIQMTYRAHLAHRSQVLRCLRDLAVAKAKLKELRSLFYNISYRHRIAHDHEERQRFSEKIIVLLITVDALEGPDYMVRTAKKSMLEELEAMLEVVDPQPPGKQRSLSRRKFDLPEGGAIPDEKTAAVNKAIRIIEEGK

SEQ ID NO: 47816 - protein, 135 aa, Zea mays
MRKHRIVSLVAALLVLLALAAVSSTRSAQKESVADNAGMLAGGIKDVPANENDLQLQELARFAVNEHNQKANALLGFEKLVKAKTQVVAGTMYYLTIEVKDGVVKKLYEAKVWEKPWENFKQLQEFKPVEEGASA

SEQ ID NO: 47817 - protein, 390 aa, Arabidopsis thaliana
MNSPQEISILFFFIIFLDYVSAQSPPPPNLYATSDLFKPSLAIITGVFSIVFTLTFVLLVYAKCFHNDLRSETDSDGERIRHDRLWQGLFNRSSRFSGLDKKAIESLPFFRFSALKGLKQGLECSVCLSKFEDVEILRLLPKCRHAFHIGCIDQWLEQHATCPLCRNRVNIEDDLSVLGNSSTSLRILNQSETREEDSRLEIYIEREEGTNDGSSRFSSFRKILKKSLLLEREGNENIDEKKLMHKFNHRIVVSDAVFKNRWSNITSSDLTFLTSEMLNSVSSDRFSSVDRVHRGNLRDKEDMEMKRMLIKHKDSSRRTVSEITTVSREKAVGGSYRGSTASTSQNYAVTATTEERRRRLWLPIARRTAQWFVNREKSNDLNTTRQNLNV

SEQ ID NO: 47818 - protein, 455 aa, Yarrowia lipolytica CLIB122
MHIKISTDFAIQNLHCTTMIRPLLRLCGQRTAATPFVSFFRPPKKPLSGISFARHYSPTKKPPSEVPTPTPGNYLVPITGPPGDTPRDTDLLIKSLTHKSLLPENNLVRCTVFDSDGNVTVASGEFKRTELLNKHGLLPRDLRKLDTGVNSIVPTILVRDNSILINLLHIRALIKADKVLLFDVFGSTDSKTQSLFMYDLGHKLKKSNKTMGSLPYEMRALEAIFISVIAALDAEMKVHTTVINGILSELEQDIDREKLRHLLIQSKKLSAFLQKATLIRDVIDELLDTDEDLAGLYLTEKKAGHPRAIDDHSEVEMLLETYYKHCDEIVQTVGNLVSNIRNTEEIVNIILDANRNALMHLDLKFQIGALGLAGGTFIASLYGMNLKNFIEESYWGFLGVTGVASLLTVWIIAHFLKSLRQVQRVTMTSDKKKAMKKKDTVAEKRRNHLRNWLTK

SEQ ID NO: 47819 - protein, 103 aa, Zea mays
MSGRGKGGKGLGKGGAKRHRRGLATTFKALTNPPFLSLPRRGGLNPFFGLFYKETRGVLKIFLENVFRDAVTYTEHARRRTVTAMVVVYALKRQGRTLYGFGG

SEQ ID NO: 47820 - protein, 173 aa, Blastopirellula marina DSM 3645
MKPIQLEDYIRDITDFPKPGILFKDITPLLADPTAFEAAIDKMAAHYQGKKIDVIVAAEARGFIFAAPLPLKLGVGFVPVRKPGKLPFSTHSFQYELEYGTDTLEIHIDGVSEGQNVLLVDDLLATGGTIKACANLVERIGATVAGCCFLIELKFLDGAAKVAPHECFSLIEY

SEQ ID NO: 47821 - protein, 610 aa, Oryza sativa (japonica cultivar-group)
MDKGALVVQVMDDSSNGGVGAAAAGGSFSSLRAYGRALAQTPRRLARRACAATSPGEEMSRVRARSGARMARRLRWHDLVGLGLGGMVGAGVFVTTGRATRLYAGPGVVVSYAIAGLCALLSAFCYTEFAVDMPVAGGAFSYLRVTFGELAAFLTGANLIMEYVFSNAAVARSFTAYLGTAVGVDAPSKWRIAVPGLPKGFNEVDLIAVGVILLISVCICYSTKESSVVNMVLTAVHVAFILFIIVMGFWRGDTRNLTRPVDLAHNPGGFFPHGAAGVFNGAAMVYLSYIGYDAVSTMAEEVERPSRDIPVGVSGSVVLVTLLYCLMAASMSMLLPYDAIDTEAPFSGAFKGSSGWGWVSNVIGAGASLGILTSLMVAMLGQARYLCVIGRSGVMPAWLAKVHPCTATPVNASAFLGVFTAALALFTELDVLLNLVSIGTLFVFYMVANAVVYRRYVAADDDDADHRRAWPTLVFLAAFSLVALCFTLLWQFAPAGRARTGLLAACGAAAVATVGAFRALVAEARRPELWGVPAMPWVPAASVFLNVFLLGSLDRPSYVRFGFFTAAAVLVYVLYSVHASYDAEEGGGAGAGAAALDGAKVQDEAADFKV

SEQ ID NO: 47822 - protein, 274 aa, Zea mays
HTSGRQAVDRRMAPGGSGERWSLAGATALVTGGSKGIGQAVVEELARLGARVHTCARSAADLEECRRRWAEKGLRVTVSVCDVAVRADRERLVLDTVSGAFDGKLDILVNNAALLLLKPAAEWAAEDYARIMATNLESCLHISQLAHPLLLNASVAGGASIVNVSSIASVLGFPQEVMYSVTKGGLNQMTRSLAVEWACDRIRVNCVAPGVIMTDMGKELPAALVEQERSRIPLRRTGEPEEVASLVSFLCMPAASYVTGQVIFVDGGRTISGA

SEQ ID NO: 47823 - protein, 560 aa, Propionibacterium acnes KPA171202
MPTLIDATSTPAWGTLSGLKSRFADGPHKLRRLFDADPHRAERYTLDVADLHVDLSKNLLTDEIRDALLELAAQMRVTERRDAMYAGEHINVTEDRAVLHTALRRSRTDELHVDGQDAVADVHEVLDKIYAFADKVRSGEWKGVTGKPIRTVINVGIGGSDLGPVMAYEALKPYVKDGLECRFISNIDPTDAAVKTADLDPETTLVIIASKTFTTLETLTNARCVRAWLLDGLVAAGAISDTEQARRDAVAKHFVAVSTALDKVEEFGIDPVNAFGFWSWVGGRYSVDSAVGTSLAVAIGPKGFEDFLAGFHAVDEHFATAEPERNVPLFMGLLNIWYTNFWDAHSHAVLPYSQYLHRFPAYLQQLTMESNGKSVRWDGSAVTTDTGEIFWGEPGTNGQHAFYQLIHQGTRVIPADFIAVANPVHPTKDGGTDVHELFLSNFFAQTAALAFGKTADEVRAEGTDEAIVPARVFAGDRPTTSIMADELSPKVLGELIALYEHITFVQGVVWGIDSFDQWGVELGKKLALQIAPAVSGNDEALATQDPSTQGLVTWYREHRR

SEQ ID NO: 47824 - protein, 270 aa, Arabidopsis thaliana
MGDTAEDQDDRAMMEAEGVTSFSELLMFSDGVLSSSSDHQPEGNVGDGGEDSLGFVFSGKTGSRMLCFSGGYQNDDESLFLEPSVPTSGVSDLDPSCIKIDCRNSNDACTVDKSTKSSTKKRTGTGNGQESDQNRKPGKKGKRNQDKSSVGIAKVRKERLGERIAALQQLVSPYGKTDAASVLHEAMGYIKFLQDQIQVLCSPYLINHSLDGGVVTGDVMAAMKAKDLRSRGLCLVPVSSTVHVENSNGADFWSPATMGHTTSPSLPQGF

SEQ ID NO: 47825 - protein, 485 aa, Gossypium hirsutum
MPDSEPIFLLLPSILSLILFFILIKRKQRRYNLPPGNMGWPFLGETIGYLRPYSATSVGEFMHQHISRYGNIYKSNLFGEKTIVSADAGLNKFILQNEGRLFECSYPRSIGGILGKWSMLVLVGDMHRDMRIISLNFLSNARLRTHLLREVEKHTLLVLNTWKEKCIFSAQDEAKKFTFNLVAKNIMSMDPGHPETEQLKKEYVTFMKGVVSAPLNLPGTAYRKALQSRSTILKFIEKKMEVRIRKMKEGKENSEEDDLLEWVLKHSNLSTEQILDLILSLLFAGHETSSVAITLAIYFLPGCPLAIQQLREEHLEVARAKNQSGETELNWDDYKKMEFTQCVINETLRLGNVVRFLHRKALKDIRYKGYDIPCGWKVLPVIAAVHLDPCLFDHPQLFNPWRWQQNNGSRGAGTATSSASSSNYFMPFGGGPRLCAGTELAKLEMAVFIHHLVLNYQWELADTDEAFAFPFVDFPKGLPIRVFKS

SEQ ID NO: 47826 - protein, 640 aa, Arabidopsis thaliana
MTMMMSDLPNDLVEEILSRVPITSLGAVRSTCKRWNGLSKDRIVCKGDANQQFTGFTRYVNESTVCSMRLDLNEIQNEDVELVELSINKINKFIELELFQVYYSDGLLLLVTDEVDSKIVVWNPYLGQTRLIQCRDTEHFKYRYALGYDNNRNHKILMYNRKNCEIYDFKSDSWKVLDIIPDLHTNIYVRDMSIKGNTYFFYRGEKIGEGLAGCLLSFDFTRERFVSCLPLPFQIAKFDDNVALSSVREEHLVVLFNNWEESEMEIWVTTKIEPNAVSWSNFLTFTHFRIKFLVTSFFIDQEKKLAVVFGRSLSKQMRCNIAYVIGDNGYLRILDFGVTFIPSNLPVSYAPSLVKITQGQELSVIEEKKRSRLLASLVYTSNNLLGLMSWVSFSMQFHMDCGRDSARDHDRERSKNPDFHLKTTMMISDLPEDMVEEILSRVSIISLGALRWNDLSKARVICKAEARQQFAGFMIKGSKEVSNTRLVVWNPYLGKIWSIQHRSAYHSENRYTLGYDNNRKPQNLEEQLAVLLHNWGAFAMEIWVTTNIEPNAKKHAVIFDSSLSCGSVACIIGETGNLRTVDLGVAAVPYRQLPVCSYAPSLEQINQGQELPLIGLTQIFMEQHKYWVSTFLDNLITKYG

SEQ ID NO: 47827 - protein, 277 aa, Synechococcus elongatus PCC 6301
MRYRAFLAAFLAVCLGVLTACSSGPTAADLGTLTYDQIKDTGLANKCLSLKESARGTIPLEAGKKYALTDLCLEPQEFFVKEEPGNKRQKAEFVPGKVLTRYTSSLDQVYGDLALKADGTVSFTEKGGIDFQAITVLLPGGEEVPFLFTVKGLVASTSEPATSINTSTDLRGGYRVPSYRTSNFLDPKARGLTTGYESAVAIPSAGDAEDLTKENVKRFVTGQGEISLAVSKVDGATGEVAGVFTAIQPSDTDMGGKEAVDVKLVGQFYGRIEPADA

SEQ ID NO: 47828 - protein, 496 aa, Oryza sativa (japonica cultivar-group)
MARKMLKDEEVEVAVTDGGSYDYDLFVIGAGSGGVRGSRTSASFGAKVAICELPFHPISSDWQGGHGGTCVIRGCVPKKILVYGSSFRGEFEDAKNFGWEINGDINFNWKRLLENKTQEIVRLNGVYQRILGNSGVTMIEGAGSLVDAHTVEVTKPDGSKQRYTAKHILIATGSRAQRVNIPGKELAITSDEALSLEELPKRAVILGGGYIAVEFASIWKGMGAHVDLFYRKELPLRGFDDEMRTVVASNLEGRGIRLHPGTNLSELSKTADGIKVVTDKGEEIIADVVLFATGRTPNSQRLNLEAAGVEVDNIGAIKVDDYSRTSVPNIWAVGDVTNRINLTPVALMEATCFSKTVFGGQPTKPDYRDVPCAVFSIPPLSVVGLSEQQALEEAKSDVLVYTSSFNPMKNSISKRQEKTVMKLVVDSETDKVLGASMCGPDAPEIIQGMAVALKCGATKATFDSTVGIHPSAAEEFVTMRTLTRRVSPSSKPKTNL

SEQ ID NO: 47829 - protein, 482 aa, Vibrio vulnificus CMCP6
MAYGPFPKGDRIMIKFGTGGWRAFIGEEFTKDNVRLVAQAVANIINNEQVAERGFVIGYDRRFLSDKAGAWFAEVLAANGIVVSFINKFVPTPIVMFKAKEMGCAYSACITASHNPADYNGVKVFIEGGRDADEVITQKIEAQIAHLTLDQVQSVDFEQAVEDKQIVIINPMNEFVDSIINFIDIEAIKKANLRVLIDPMFGVAKNALQTVLINGRCDVDVINDGKNPDFGGLMPSPSAATLYRLKHLVAAQGYDIGIGTDGDADRLGIIDEKGNFIHPNEVLILLYYYLLKYKGWTGSVVRNIATTHLLDKIAADHGEKCFEVPVGFKHISSQMEADDSLIGGESSGGLTIRGHIKGKDGVFASSLLVEMISVTGKKLSELLEEIYSKYGYAYMAEGDCKFKPAAKQSLYDKIYIEKQLPEFGFEIEKVSYDDGAKVYFKNGGWVIARFSGTEPLLRIFAEMQDKETAELVVHQFKEFLAL

SEQ ID NO: 47830 - protein, 404 aa, Triticum aestivum
  misc_feature (11)..(11): Xaa can be any naturally occurring amino acid
  misc_feature (64)..(64): Xaa can be any naturally occurring amino acid
  misc_feature (80)..(80): Xaa can be any naturally occurring amino acid
  misc_feature (114)..(114): Xaa can be any naturally occurring amino acid
MATKRSVGTLXEADLKGKKVFVRADLNVPLDDAQKITDDTRIRASIPTIKYLLEKGAKVILGQXHWGRPKGVTPKFSLKXPLVPRLSELLGLEVVMAPDCIGEEVEKLAAALPXDGGVLLLENVRFYKEEEKNDPEFAKKLASVADLYVNDAFGTAHRAHASTEGVTKFLRPSVAGFLMQKELDYLVGAVANPKKPFAAIVGGSKVSSKIGVIESLLAKVDILILGGGMIFTFYKAQGLPVGKSLVEEDKLELATSLIETAKSKGVKLLLPTDVVVADKFAADAESKIVPATAIPDGWMGLDVGPDSIKTFAEALDTTKTVIWNGPMGVFEFEKFAAGTDAIAKQLAELTGKGVTTIIGGGDSVAAVEKAGLADKMSHISTGGGASLELLEGKPLPGVLALDEA

SEQ ID NO: 47831 - protein, 893 aa, Gibberella zeae PH-1
MKTDFKFSNLLGTVYCQGNLLYSPDGTHLFSPVGNRVTVFNLVENKSYTLPFAHRKNIARIGLTPRGNLLLSIDEDGHAILTNVPRRISIYHFSFRSSVTSLSFSPSGRHFAVGLGRRIEVWHVPSTPDASAEGELEFAPFVRYHSHTGHFDTVTNIEWSSDSRFFLTTSKDLTARIWSLTPEEGFTPTVLSGHKQAVIGAWFSENQETIYTISKDGAVFDWQYVKPINRIEDEDKMQDDDDEDMRWRIVQRHYFMQGSAHVRCASFHPETNLLVAGFSNGLFGLYEMPDFNMIHKLSISQNDIDFVTINKSGEWLAFGASKLGQLLVWEWQSESYILKQQGHFDAMNSLVYSPDGQRIITCADDGKIKVWDIQSGFCIVTFTEHTSGVTACEFAKKGNVLFTSSLDGSIRAWDLIRYRNFRTFTAPTRLSFSCMAVDPSGEVVAAGSLDSFDIHIWSVQTGQLLDQLSGHEGPVSSLAFTPNGNSLISGSWDRTARIWSIFSRTQTSEPLQLQADVLDIAVRPDSLQLAISTLDGQLTFWSVTDAEQTSGVDGRRDVSGGRKLTDRRTAANMAGTKSFNTIRYSTDGSCLLAGGNSKYICLYSVTTMVLLKKFTVSVNLSLSGTQEFLNSKLLTEAGPAGELDDQEASDREDRVDSTLPGSKRGDPSARKKVPEVRVTGIGFSPAGTAFCAASTEGLLIYSLDQDIQFDPFDLNMEITPASTLAVLETEQDYLKALVMAFRLNEAGLIKRVFQAIPSHEIPLVVADLPTIYVSRLLRFVAAQTEESPHIEFCLVWIKAIVDKHGAWLSANRAKADIELRVVARAVAKMRDEIRRLADENVYMVDYLLGQAQEKTEKKDVTALDSGKDVDVKLMAADGDEESDAGSDEWIGLD

SEQ ID NO: 47832 - protein, 242 aa, Oryza sativa (japonica cultivar-group)
MLAKGRKVAGRGGDMSAHYAFGPQEDDAIIKHRLLTRTTTTRGEPPLKKLQKKFMSFATEVEKDADNISDCERLYKAFLQEINTFELPLLKSKAVVDANLREKESFNELQDEIQRQILQAQTDIEDLKKQLEQSKIERQHKEECEAIRKMISLQPPRSETEKLIADLEKEIANLEAENTACIRTLELRKKQFALLLHVVEELQISIDDEQRSIADELRAATEEQKMSIEEVSGGASDAMAVD

SEQ ID NO: 47833 - protein, 226 aa, Methanocaldococcus jannaschii
  misc_feature (44)..(44): Xaa can be any naturally occurring amino acid
  misc_feature (84)..(84): Xaa can be any naturally occurring amino acid
  misc_feature (163)..(163): Xaa can be any naturally occurring amino acid
  misc_feature (187)..(187): Xaa can be any naturally occurring amino acid
  misc_feature (208)..(208): Xaa can be any naturally occurring amino acid
GAMGGMHLVGVLDIAKDILKANKRLADKNRKLLNKHGVVAFDFXGAIGSGKTLLIEKLIDNLKDKYKIACIAGDVIAKFDAERXEKHGAKVVPLNTGKECHLDAHLVGHALEDLNLDEIDLLFIENVGNLICPADFDLGTHKRIVVISTTEGDDTIEKHPGIXKTADLIVINKIDLADAVGADIKKXENDAKRINPDAEVVLLSLKTXEGFDKVLEFIEKSVKEVK

SEQ ID NO: 47834 - protein, 538 aa, Glycine max
MFLILHILLRNHIATFHLPPPSLRQPPFSLSLAQMSALSNSSSSHGNSFLKMPAIKFTKLFINGDFVDSISGRTFETIDPRKEEVIARVSEGDKEDIDIAVKAARQAFDSGPWPRLPGSERAKIMMKWADLVDENIEELAALDTIDAGKLYYINKVAEIPSATNALRYYAGAADKIHGDVLKMNGDFHAYTLLEPIGVVGHIIPWNAPSLSFFIKVSPSLAAGCTMVLKPAEQTPLSALFYAHLAKLAGIPDGVLNIVPVFGPTAGAAISSHMDIDAVSFTGSIEVGREVLQAAAWSNLKPVSLELGGKSPLIIFNDADIDKASELALFGIMSNKGEICVAGSRVFVQEEIYDEFEKKLVEKAKSWVVGDPFDPKSLQGPQADRNQLEKILSYIEHGKREGATLLTGGNTVGNKGYYIEPTIFSNVKEDMLIARDEIFGPVLALMKFKTMEEAIKSANNTKYGLAAGIVTKNLDTANTMSRSIRAGIVWINCYFTVGSDVPFGGYKMSGFGRDLGLQALHKYLQVKSVVTPIHNSPWL

SEQ ID NO: 47835 - protein, 400 aa, Escherichia coli O157:H7 EDL933
MKEKTIIIVGGGQAAAMAAASLRQQGFTGELHLFSDEQHLPYERPPLSKSMLLEDSPQLQSVLPAHWWQENNVHLHSGVTIKTLGRDTRELVLANGESWHWDQLFIATGAAARPLPLLDALGERCFTLRHAGDAARLREVLQPERSVVIVGAGTIGLELAASATQRRCKVTVIELAATVMGRNAPPPVQRYLLQRHQQAGVRILLNNAIEHVVDGEKVELTLQSGETLQADVVIYGIGISANDQLAREANLDTTNGIVIDEACRTCDPAIFAGGDVAITRLDNGALHRCESWENANNHAQIAAAAMLGLPLPLLPPPWFWSDQYSDNLQFIGDMRGDDWLCRGNPETQKAIWFNLQNGVLIGAVTLNQGREIRSIRKWIQSGKTFDAKQLTDENIALKSL

SEQ ID NO: 47836 - protein, 199 aa, Podospora anserina
MNCQRIAGRGGFQQRDMGPPAQVLEMGKFIHSCEGEMVVESTNAKIPHFNAPIYLENKTPVGKVDEVLGPINQVYFTIKPTEGIQATSFKVGDKFYIAGEKLLPLEKFLPKPKPPPGASKVKKPSRGGASRGGRGGPGGRGGRGGFGGRGGGGFGGGRGGGGFGGGRGGGRGGSGFGGRGGGGRGGGGFSRGGRGGFSR

SEQ ID NO: 47837 - protein, 402 aa, Desulfitobacterium hafniense Y51
MKANIAIVQAGGPTSVLNASLAGFLEAAASSERYHHVLGFCNGIEGLIKNQVMHLEGLSKAQLDALKSQPGAVLGAGRYPLTPERLSKVCCNLQLREISQLVLVGGNGTMWAADQIAEACPDVQIVGIPKTVDNDLWGTDHSPGYLSAAKFIGEAVRSLALDLWAMRNFERVRVVEVMGRNVGWLAAAGSLAQTSLPDYPPLHFYLPEHPFELEKFFTKVDEHLHRHPCLLVIVSEGIRLADGSPVAEFEIGRCKVPGGAAQMLSSELRNRGIPSRSEVLGILQRANTWSVCERDRQEAIFLGKQAIGVLGQGKSKVMLGLPAETVDFAEDSKAQWVDLKSVAGLERPVAPCYLTESGIDPSFTAWLQNKMGEPLAEANSALQVWKLAAEQLSSNPVNRQSR

SEQ ID NO: 47838 - protein, 171 aa, Arabidopsis thaliana
MSVASPIQCIRILNPSSSSSSSTASSSFRFSTTTKPCVFIIRCSQTEGPLRRPSAPPALREPQKPVPASQPSSSPPPPPPQKSVAIDGKSVTTVEFQRQKAKELQEYFKQKKLEAAGQGPFFGFQPKNEISNGRWAMFGFAVGMLTEYATGSDLVDQVKILLSNFGILDLE

SEQ ID NO: 47839 - protein, 479 aa, Desulfitobacterium hafniense Y51
MKKEIRESLFIDGEWQEAINKEVKGVINPATGKVFCEIGYGEVDDALSAVDAADRAFGAWSKTSVRERADILNRTADLLRQRADHIGLILAAESGKPLPQAVGEVKFSAEYFQWFAEEIRRPYGQSIPSDAANKRHHVYTQPAGVALCLSPWNFPVSIQARKLAPALAAGCTVVARGSEVAPLSLIELFQCLQDAGIPKGVANLIQGPAAVTTAAMMKHPAVRVVSFTGSTPVGRSLMRQAADGVIRLALELGGNAPFIVFADADIEKAVEGAMIAKFRNNGQSCIGANRFYVHERIYDKFTALFAEKILRMKIGNPTEEVDLDLGPMVNLKDKARIESLIYEAEALGAKPLVPKAEVPAEGYYVPPVILENVPESAALAREELFAPVAPLFKFADENEVIEKANSSDMGLAAYVYTNDLSRSIRVTESLKFGIIGLNNALPSVAYAPMGGVKQSGIGREGARIGLEEFMDVKYVATEI

SEQ ID NO: 47840 - protein, 365 aa, Brassica rapa
MAENQNSTRMTRAAAKRKASVTDENPVSKKRVVLGELPNNSNVPAPLIPLQERETQKPKSTLFAAKKQTKTPPIPQTVDFESGSSDPQMCGPFVADICAYLREMEGKLKQRPLHDYIEKVQSDLTPSMRGVLMDWLVEVAEEYKLVSDTLYLTVSYVDRFLSAKPINRQRLQLVGVSAMLIASRKYEEISPPKVEDFVYITDNTFTRQDVVSMEADILLALQFELGCPTIKTFLRRFTRVAQEDFNESLLQIECLCCYLSELSLLDYSCVKFLPSMLAASAVFLARFIIRPKQRPWNQMLEEYTKYKASDLQQPVGIIHDLYLSRRGNSLEAVRNKYKQHKFKCVATMPVSPELPQAFFEDVTIR

SEQ ID NO: 47841 - protein, 358 aa, Aspergillus oryzae
MGAPPKTAQNLSFVLEGIHKVKFEDRPIPQLRDAHDVLVDVRFTGICGSDVHYWEHGSIGQFVVKDPMVLGHESSGVISKVGSAVTTLKVGDHVAMEPGIPCRRCEPCKEGKYNLCEKMAFAATPPYDGTLAKYYVLPEDFCYKLPENINLQEAAVMEPLSVAVHIVKQANVAPGQSVVVFGAGPVGLLCCAVARAFGSPKVIAVDIQKGRLEFAKKYAATAIFEPSKVSALENAERIVNENDLGRGADIVIDASGAEPSVHTGIHVLRPGGTYVQGGMGRNEITFPIMAACTKELNVRGSFRYGSGDYKLAVNLVASGKVSVKELITGVVSFEDAEQAFHEVKAGKGIKTLIAGVDV

SEQ ID NO: 47842 - protein, 541 aa, Rhizobium leguminosarum bv. viciae 3841
MNAIVEQLKSTADATKATDIRAAFAADSQRFSRFSVSLDDLLMDFSKTAVNDDILKLLVKLAEEGGVEKKREEMFSGKAINFTEDRAVLHTALRNRSNAPVLVDGKDVMPDVNAVLAAMGKFADDVRSGTLKGATGKAITDVVNIGIGGSDLGPVMATLALAPFHDGPRAHFVSNIDGAHIADILKLVQPETTLFIVASKTFTTVETMTNAQTARNFIAKALGEAAVQHHFAAVSTALDKVAAFGIDSARVFGFWDWVGGRYSIWSAIGLPLMIAVGPENFGKFLDGAHAVDNHFRKAPITENLPILLGLIGFYHRNVLGYPTRAILPYDQRLSRFPAYLQQLDMESNGKGVTIDGTPVEGNSGPVVWGEPGTNGQHAFYQLIHQGTSIIPAEFMIAANAFEPELRHQHQLLISNVLAQSEALMKGRTFAEAKKQLTDKGMDDKKADFIAPHRVFTGNRPSITFVYDKLTPYALGRLIALYEHRVFVEGVLFRINSFDQWGVELGKELATGLLPVVEGKESAASHDSSTQGLVAALAKLAK

SEQ ID NO: 47843 - protein, 164 aa, Zea mays
MGSVAPAELVLKAACERCGAASGLYATSCRHTTLCSDCGMTLALARGRCTVCSAPVTRLIREYDVRVDTSAEKEKTHYIGRFTTGLPPLSNERSAGNRWTLRKDVPHGQQLTGNMRDKHYSKMPWILEDETGEHQYQGQTEDPPATYYSLTQKGNDMIAVQVGS

SEQ ID NO: 47844 - protein, 1313 aa, Yarrowia lipolytica CLIB122
MSKQPPAVGKKPEGLKTEVAASKIEKSKPEIPPKPGKKPPKPLPKPETANKQEQTSPQRPKVAAKPVHLSGTLRDLQIAPTIEKTDPISPKQHVHRTGPPDTPKRDFLKPQPPPSREQSRERGNIQLDNSHDQLGPRDPTTPLRSPTRSPARSPAPPPPRSRDVSRARDLATGSGPSSRDVSMSSDSKSSSNSDLGGPLLLPPGAREGAVAPITASTPAKSREVSETLSRENMVRDDSPRGRVVTPHVTKREGAIAPSSSRVPSIVEPQSPLTVRKSRDTHVTTPEQIRTSNHVSQYTPPAPADRVASSSSSSSTYTPPAPPKSHIPNLESPSISRDSSVVPMTVSRDCSVTPVAVTRESVAPAPVVVSRESAAPPIRESSTPPVAAANDPQSAPPAITPAAVVRDPPASVGSPAPGVAPTVATHPPPPTRDVASSSSGSRDSVTSRDSTVAPSARKPLPDPSSFAAPPVHHAVVSRREELKREEAQSHIPVSASSGAPPALPKRRETFNDAMEPRDMDYPPPPRRATESSSAPRFSRQSSSASIDSREPLYKDRHGSTASVDHLRHADRPRQGSSASLASMERPRQDSATAENSDGMYSSKSVLNSHLEPPPTRQTVMTSETGELDNELNPSAAIDGYQDYPDSSNVNRKPPVNPRRAQCSLKHDVKCMDCNDEYLVACSSGYTFVLSADSLELLFSEPHNDLKIHTVKVTSTNHAILGFKEGELWEVDLDDGTVSVKRSTSHSTPVVLIHESPNGLYTLSEDGRICVWPGDDESPLCGTPRQHKLSFGFIRQAVGVQDTIWVGKSRNAFVFHESMNFMNPLVVSSTVPGNRPSLDFSCIFYDAGNVYFGHENGNITVFSTATTQVVAQKFVSPSCPQTVYCNNGMLWIGFKNGSIQIVNVREPQWKIIKSFEGHQSGVSGIVGSYKAVTSFGSSPNLRFWDATLREFWEDDFMSQRQEEYCDYHNLSVAVITWNCGALKPSQMQRAKKNDKYWIDQVLEDADYPDIVVFGFQELVELSDKGLSAKALLGLHKKDDISDQYQLWEDELCHLMGKEYRRVKSHYLVGLFSIVFSRDDLRLGHVQCGEVKTGLGGYHGNKGAVCIRFTIADSSLCFVNVHLAAGQSKVSDRVKDLESCFSKELFKKDSSRDEDGTRVYINGGDGALIGDHENLFILGDMNFRVNQHPKLAAQHVNNNRLEKLLLSDQLTIQMKKNISFPLRSFAEHEISFAPTYKFDVGTDTYDSSEKKRVPSWCDRILYRGHVDCLKYDSKVVRLSDHRPVIGQFDVKVKRIDADKYERIRAEVRQELDKAVY

SEQ ID NO: 47845 - protein, 474 aa, Oryza sativa (japonica cultivar-group)
MIVITVELHDKHSIISRRLSKAIPSISVIGQNGVMLWCHEGYISSKDLKENIEKAWATLHLQGTAAAFLTASLASRMTEPVNTTPTTLPTQGGSSAAENPSTSSNQSTGTSGASGFANPTDSVAQPPRSTSRDETPSISEKESSNLDSSPGNRTVQERPDSDSAQVKGSLPDHPRSSNIEGCANPVQSGNTASLKQKNKVDDGFTKVSSESVPTRVASRGKSSKVAVDQDKATTTSTPIEPAPVRSNDIQLVVRIPDGPSLQIKLTKDDNLRKVKNFVDENRANGAGSYDLAMLYPRKVFTEQDMEATLHELGIETRQALTIVPHHKTIRAAKRQSSSSPHEGDNNMDADSSGGSGYFGYLRTALSFVNPLSYLRANAAPSNPDQLANQGSPQYRPSTGPWNRPGEDTASESRIPDSARQQAARDTSSGSTLRRRPRQFGGNVHSLRSDDQGPSDDRNVYWNGNSTEFGGEDKK

SEQ ID NO: 47846 - protein, 226 aa, Methanocaldococcus jannaschii
GAMGGMHLVGVLDIAKDILKANKRLADKNRKLLNKHGVVAFDFMGAIGSGKTLLIEKLIDNLKDKYKIACIAGDVIAKFDAERMEKHGAKVVPLNTGKECHLDAHLVGHALEDLNLDEIDLLFIENVGNLICPADFDLGTHKRIVVISTTEGDDTIEKHPGIMKTADLIVINKIDLADAVGADIKKMENDAKRINPDAEVVLLSLKTMEGFDKVLEFIEKSVKEVK

SEQ ID NO: 47847 - protein, 360 aa, Pseudomonas putida KT2440
MSKQILILPGDGIGPEIMAEAVKVLELANDKFQLGFSLAHDVIGGAAIDKHGVPLADETLERARKADAVLLGAVGGPKWDKIERDIRPERGLLKIRSQLGLFANLRPAILYPQLADASSLKPEIVSGLDILIVRELTGGIYFGAPRGQRELEGGERQAYDTLPYSESEVRRIARVGFDMARVRGKKLCSVDKANVLASSQLWREVVEDVAKDYPDVELSHMYVDNAAMQLVRAPKQFDVMVTDNMFGDILSDEASMLTGSIGMLPSASLDADNKGMYEPCHGSAPDIAGLGIANPLATILSVSMMLRYSFNQSAAAEAIEKAVSLVLDQGLRTGDIFSEGCRKVGTQEMGDAVVAALRNL

SEQ ID NO: 47848 - protein, 440 aa, Oryza sativa (japonica cultivar-group)
MLWCHEGYISSKDLKENIEKAWATLHLQGTAAAFLTASLASRMTEPVNTTPTTLPTQGGSSAAENPSTSSNQSTGTSGASGFANPTDSVAQPPRSTSRDETPSISEKESSNLDSSPGNRTVQERPDSDSAQVKGSLPDHPRSSNIEGCANPVQSGNTASLKQKNKVDDGFTKVSSESVPTRVASRGKSSKVAVDQDKATTTSTPIEPAPVRSNDIQLVVRIPDGPSLQIKLTKDDNLRKVKNFVDENRANGAGSYDLAMLYPRKVFTEQDMEATLHELGIETRQALTIVPHHKTIRAAKRQSSSSPHEGDNNMDADSSGGSGYFGYLRTALSFVNPLSYLRANAAPSNPDQLANQGSPQYRPSTGPWNRPGEDTASESRIPDSARQQAARDTSSGSTLRRRPRQFGGNVHSLRSDDQGPSDDRNVYWNGNSTEFGGEDKK

SEQ ID NO: 47849 - protein, 445 aa, Vibrio vulnificus CMCP6
MPATWSEQSEEDKPMTKSAELYQKAQQTIPGGVNSPVRAFNGVGGSPIFVERADGAFIFDADGKAYIDYVGSWGPMILGHNHAVIREAVIEAAQRGLSFGAPTEMEIKMAELVSELVPSMEQLRMVSSGTEATMSAIRLARGFTGRDKILKFEGCYHGHADSLLVKAGSGALTLGQPSSPGVPADFAKHTLTATFNDLDSVRELFAANKGEIACIIVEPVAGNMNCIPPVEGFHEGLREICDQEGALLIFDEVMTGFRVALGGAQAHYNIKPDLTTLGKVIGGGMPVGAFGGRKEVMQYIAPTGPVYQAGTLSGNPVAMAAGYACLTLLREEGNEKRLASKTKHLADGFKSLAAQHGIPLVVNQVGGMFGFFFTEQEQITCYEDVTKCDIERFKRFFHLMIDHGVYLAPSAFEASFTSLAHGSKEIEATLEAADRCFAILAAESK

SEQ ID NO: 47850 - protein, 449 aa, Arabidopsis thaliana
  misc_feature (59)..(59): Xaa can be any naturally occurring amino acid
  misc_feature (117)..(117): Xaa can be any naturally occurring amino acid
  misc_feature (141)..(141): Xaa can be any naturally occurring amino acid
  misc_feature (183)..(183): Xaa can be any naturally occurring amino acid
  misc_feature (214)..(214): Xaa can be any naturally occurring amino acid
MATITVVKARQIFDSRGNPTVEVDIHTSNGIKVTAAVPSGASTGIYEALELRDGGSDYXLGKGVSKAVGNVNNIIGPSHLLERTQLSQTAIDNFMVHELDGTQNEWGWCKQKLGANXAILAVSLAVCKAGAVVSGIPLYKXIANLAGNPKIVLPVPAFNVINGGSHAGNKLAMQEFMILPVGXAASFKEAMKMGVEVYHHLKSVIKKKYGQDAXTNVGDEGGFAPNIQENKEGLELLKTAIEKAGYTGKVVIGMDVAASEFYSEDKTYDLNFKEENNNGSQKISGDALKDLYKSFVAEYPIVSIEDPFDQDDWEHYAKMTTECGTEVQIVGDDLLVTNPKRVAKAIAEKSCNALLLKVNQIGSVTESIEAVKMSKKAGWGVMTSHRSGETEDTFIADLAVGLSTGQIKTGAPCRSERLAKYNQLLRIEEELGSEAIYAGVNFRKPVEPY

SEQ ID NO: 47851 - protein, 1537 aa, Gibberella zeae PH-1
MLGNTVDGDALRRTQSSMWQQQQQQPISQQTVEDGQHNPTSSRSSDTDVVQEGKWGERGQEDVTAQEAMQEFESLRHNLMSLHKTRTTETQASRGNASRRASTAARVSSAKNRHNVDDDDSKTDVEAGPEKSEGFELGQFMREGHFEKRSEQDGSLKRVGVVYENLTVKGVGSTTSFVRTVPDAILGTFGPDLYKILTRYFPSLRFGKAPTRTLINDFTGCVRDGEMMLVLGRPGAGCSTFLKAISNSRESYAAVEGEVSYSGISAADQKKYYRGEANYNGEDDIHFASLSVWKTLAFALMNKTKVKEKADIPVIVEALMKMFGISHTRGTVVGDEYTRGVSGGERKRVSIAETLASKSTVMAWDNSTRGLDASTALDYARSLRIMTDISNRTTLVTLYQAGEGIYELMDKVLVIDQGRQIFSGPANKAKQYFIDLGFECPERQTTADFLTAITDPIERRFRPGFENRAPRTPEDLESAFRNSPNYQELLADVAAYKESLQQSNYEDAKRFQGAVQEAKSKHVSDKSSYTISFPRQVLACTKREAWLLFGDTTTLWTKLFIIISNGLIVGSLFYGQSEDTESTFSRGGTIFFSILFLGWLQLSELMKAVSGRAVVARHHDYAFYRPSAVSLARVLLDFPVIAVQVCIFGVTMYFMTGLDVEVSKFWIYLLFVYTTTIMVTAMYRMFASLSPEIDTAVRFSGIALNLLVIYTGYVIPKTQLLKDYIWFGWIYWINPISYSFEAVLTNELSDRNMACSPSQTVPQGPGVEPGYQGCAISGASVNARSVSGSDYLEAAYNYSRSHLWRNFGVVIAFAILYILVTVLATEVVSFAEGGGGALIFKKSRRAKEQAREAEAPVDDEKAVGNGATGSFGVVSDPNLGSEEEALEQITDSESIFTWRDIEYTVPYLGGEKKLLNKVSGYAKPGIMVALMGASGAGKTTLLNILSQRTNVGVVTGEMLVDGRSLGTDFQRNTGFCLQGDLHDTTQTVREAIEFSAILRQDASVSRADKLAYVDKIIDLLELNDLQDAVIMCLGVEQRKRLTIGVELAAKPSLLLFLDEPTSGLDSQSAYSIVRFLRKLSRAGQAIICTIHQPSSVLIQQFDMVLALNPGGNTFYFGSMGENGQDVVKYFSDRGAVCPPNKNVAEFILETAARPHRRPDGTKVDWNQEWAESEEAQQVLEEIDGLKRVRSSATEGTMSTKKEHSEFAASTWLQTVELTKRMFRQHWRDPSYIYGKLFVSVIFGIFNGFTFWNLGYTMQDMQNRMFTCFLIITVPPTVVNGVVPKFFTNMALWQAREYPSRIYGWVAFCTANIVSDIPAAVVSAVLYFVLWYWPTGLPTESSVSGYVFLMTLLIYLFMTSWGQWICAFAPSFTVISNVLPFFFVMFGLFNGVVRPYTSLPIFWKYWMYYANPSTYWIGGILAATLDGAPVRCSSEETAKFDAPPGKTCQEYAGNFASSAGGYLLNPSATSSCEYCPMSSGNDYLASLNISASDKWRNFGIFLTFFRVKGWSFGFGKVFGALGKLVDLIKKPFQRKNKE

SEQ ID NO: 47852 - protein, 392 aa, Prochlorococcus marinus str. MIT 9303
MPLPPHLSDRVVALQPSLTLAISARAKALQQEGRDICSMSAGEPDFNTPEFIIDATVKALRDGITRYGPAAGDPELREAIATKLSKENTVPTNAEQVLVTNGGKQAIFNLFQVILNPGDEVLIPAPYWLSYPEMARLAGAKVTTLPSTPENGFCLDLNNLEASIGSKTRLLILNSPGNPTGRVMARKELEALADLLRNYPQILVMSDEIYEFILEDGQQHHSFSAIAPDLSDRTFIVNGFAKGWAMTGWRLGYLAGPAHAVKAATALQSQSTSNVCSFAQRGALAALQGSRECVKKMVNSYNTRRELLASGLLGLEGISLISPKGAFYAFPKLPEGSLDSVSFCQQALENYGLAMVPGAAFGDDSCIRLTCAVSHKTICDGLERLRKALKQS

SEQ ID NO: 47853 - protein, 423 aa, Xylella fastidiosa Ann-1
MVWGAVRWADVWWMLRSMGRYSDAHSVDFAFFYVLTRDKSFMQVTSKLPQVGTTIFSVMSQLEDVYGAVNLGQGFPDFPVPLRLQEALEGAVREGHNQYPPMIGVAVLRQGIAVKVLRCYGAQVDADVEITVTSGATEAIFNAIHAVVGAGDEVIVLDPAYDCYEPGIVLAGARAVHVPLDAVSFKVDWERVGAAITSRTRLLIVNSPHNPSGALFSADDMRALATLLDGTDILLISDEVYEHIVFDGCGHESVLRWPQLRARAFVISSFGKTYHCTGWKIGYAIAPPALSAEFRKVHQYNTFTSFGPAQYAFAAMLHEEPGYVDQVGLFYQARRDCFREQLLTTKLVPLPVSGGYFQLVDYGAVSDLSDVEFSRWLAVEKGVASIPLSPFYETAPAGQRLVRLCFAKNDMTLGAAIERLQRL

SEQ ID NO: 47854 - protein, 460 aa, Xanthomonas axonopodis pv. citri str. 306
MSFESLGLAPFLLRALAEQGYETPTPIQQQAIPLVLAGHDLLAGAQTGTGKTAAFGLPLLQHLGTAPQTVNGPRKPRALILTPTRELATQVHDSLRGYSKYLRIPSAVIYGGVGMGNQLDALRRGVDLLIACPGRLIDHIERRSVDLSGIEVLILDEADRMLDMGFLPSIKRILTKLPRQDRQTLLFSATFEENIKQLALEFMRNPVQIQVTPSNTVAESITHRVHPVDGARKRDLLLHLLAQDSREQTLVFARTKHGSDKLALFLEKSGIKTAAIHGNKSQGQRMRALSDFKAGRVTVLVATDIAARGIDIDQLPKVINYDLPMVAEDYVHRIGRTGRNGSTGEAISLVAQDEAKLLRQIVRMLGRDVEIRDVPGYEPQTPIRWGNSAPGRAEQPGGDRAPRKSHARRPHGDAPRQAHAHAGPKKPGGQRSNGPRQANTGAGAGRRDGGRGGQRPSGTR

SEQ ID NO: 47855 - protein, 631 aa, Ralstonia solanacearum GMI1000
MPQAKNAPAASFDSLQTELDQKFAYPASSKTYIAGSRPDLRVPMRTIKQTATRTDQGEMLNPPIPVYDTSGPYSDPDVHIDLKAGLAPLRAKWIDERGDTVVLPSLSSEYGQARAHDPATAHLRFAQLTNPRRAKPGANVSQMHYARRGIITPEMEYVALRESLNLQALQDKPEYRKLLKQHPGFSYGANLPQRPEDITPEFVRQEIAAGRAIIPANINHVELEPMAIGRNFRVKINGNLGNSAVTSSLAEEVEKMVWSIRWGADTIMDLSTGKHIHETREWILRNSPVPIGTVPIYQALDKTGGVAEDLTWEMFRDTLIEQAEQGVDYFTIHAGVLLRYVPLTADRITGIVSRGGSIMAKWCLAHHKENFLYTHFDEICEIMKAYDVSFSLGDGLRPGCIADSNDAAQFGELYTLGELTKKAWEHDVQVMIEGPGHVPLQRVQANMDEELKHCFEAPFYTLGPLVTDIAPGYDHITSGIGAANIGWYGTAMLCYVTPKEHLGLPDKEDVREGIITYKIAAHAADLAKGWPGAQLRDNALSKARFEFRWEDQFNLGLDPEKARAFHDETLPAEGAKIAHFCSMCGPKFCSMKITQEVRDYAASLDANATAAEHGMEEKSIEFRKAGAKIYS

SEQ ID NO: 47856 - protein, 336 aa, Desulfitobacterium hafniense Y51
MSVRVAINGFGRIGRLTLRAILKQSLPVEVVAINDLGNPDLLAHLFKYDSLHGILPNSVEIDGNTMLVDGKSIAILSERNPLDLPWRKLGVDIVIESTGRFTKRAAASQHLTAGAKKVVISAPAKNEDITIVMGVNDDQYQPQEHHIISNASCTTNCLAPVAKVLLDAFGIEQGMMTTTHSVTNDQRILDLEHSDWRRSRAAYQSIIPTTTGAAQAVTLVIPELAGKMNGLAVRVPTPNVSLVDFVANLTKSTTKEEVNAALRESAEGKLKGYLEYTELPLVSRDFNGNSASSIVDGLSTMMIGERMVKVLAWYDNEWGYSNRIVDLVKLIVMKGL

SEQ ID NO: 47857 - protein, 306 aa, Arabidopsis thaliana
MENKTEEEVSIIKVSSLTCIDLDNSDLHQSAVLLKQACLDSGFFYVINHGISEELKDEAFEHSKKFFALPLEEKMKVLRNEKYRGYAPFHDSLLDPENQVRGDYKEGFTIGFEGSKDGPHWDKPFHSPNIWPNPDVLPGWRETMEKYYQEALRVCKSIAKIMALALDLDVDYFNTPEMLGNPIADMVLFHYEGKSDPSKGIYACGAHSDFGMMSLLATDGVMGLQICKDKDVKPQKWEYTPSIKGAYIVNLGDLLERWSNGYFKSTLHRVLGNGQDRYSIPFFLKPSHDCIIECLPTCQSENNLPK

SEQ ID NO: 47858 - protein, 311 aa, Solibacter usitatus Ellin6076
MLTNSSQIVLITGGTGGIGQAIAVRMAKLGATTIVVGRDQARGEAAKAEIRTQSGNRSVELMLADLSSQGDIRRLAGEFMARYGRLDVLVNNVGGLYGKRWETVDGIECTLALNHLCPFLLTHLLLPVLRAGAPSRIVNINSEGHRAAKSVNFGDFDAARWKRGFLIYSQSKLANLLFTFEMARRLSPSEITVNAVHPGIVDTQLFRRFIEERFTLIGGVLSKAAAFVARKVAYRISHFDTVETAAECPVYLASSSEVAGITGKYFGLNKKIVETSAASLDADLSREVWRMSAEMVGLSGNEASQVQRRFA

SEQ ID NO: 47859 - protein, 158 aa, Zea mays
MLNRKIVMVFFPESWRCTRATTCGDPSLTMSSEKEAALAAVLDDSPTIFDKIIKKEIPSTVVYEDEKVLAFRDINPQAPTHILIIPKVKDGLTGLAKAEERHIEILGYLLYVAKVVAKQEGLEDGYRVVINDGPSGCQSVYHIHVHLLGGRQMNWPPG

SEQ ID NO: 47860 - protein, 174 aa, Oceanobacter sp. RED65
MKLLSLDQFNSMTEREARDTLSFCCTSSQWIERVADQRPYDSVSKLQEVALSVWQSCQEQDLLEAFEGHPKIGDVSSLREKYRNTQSLAEHEQSSVAQAQEAVIQELAEKNQAYLDKFGFIFIVFATGKSAQQMLDILNGRIGNERHQELENAAVEQSKITALRIDKLFGLTDS

SEQ ID NO: 47861 - protein, 345 aa, Thermus thermophilus
MKVAVLPGDGIGPEVTEAALKVLRALDEAEGLGLAYEVFPFGGAAIDAFGEPFPEPTRKGVEEAEAVLLGSVGGPKWDGLPRKIRPETGLLSLRKSQDLFANLRPAKVFPGLERLSPLKEEIARGVDVLIVRELTGGIYFGEPRGMSEAEAWNTERYSKPEVERVARVAFELARKRRKHVVSVDKANVLEVGEFWRKTVEEVGRGYPDVALEHQYVDAMAMHLVRSPARFDVVVTGNIFGDILSDLASVLPGSLGLLPSASLGRGTPVFEPVHGSAPDIAGKGIANPTAAILSAAMMLEHAFGLVELARKVEDAVAKALLETPPPDLGGSAGTEAFTATVLRHLA

SEQ ID NO: 47862 - protein, 113 aa, Oceanobacter sp. RED65
MKSPITTHILDTHLGKPATSVSVALYRLEGSDYQKIASGETNDDGRITDWMSETQRKSGTYRVVFDIQAYFDRQNIRCLYPSIAIDFNLDHEDEHYHIPLLVSANGYSTYRGS

SEQ ID NO: 47863 - protein, 76 aa, Triticum aestivum
  misc_feature (61)..(61): Xaa can be any naturally occurring amino acid
WDADFVKVDQATLFDLILAANYLNIKGLLDLTCQTVADMIKGKTPEEIRKTFNIKNDFTPXEEEEEIRRENQWAFE

SEQ ID NO: 47864 - protein, 355 aa, Nectria haematococca mpVI
MSRSNPPNPTGSRKISFNVSEQYDIQDVVGEGAYGVVCSAIHKPSGQKVAIKKITPFDHSMFCLRTLREMKLLRYFNHENIISILDIQKPRNYESFNEVYLIQELMETDMHRAIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEEALKHPYLEPYHDPEDEPTAPPIPEEFFDFDKHKDNLSKEQLKQLIYQEIMR

SEQ ID NO: 47865 - protein, 420 aa, Gibberella zeae PH-1
MADTTNADPSATAAPAPEILAGITEESLAKGENPLPKEEHPSGKDGYGTFMQIVRGSCFALYFNTCIVIIFLTQLIGLPLYFVNRDWYYAYVAMTKGFFGLTITLMTQIWGPTTIRVSGDESVAGQIKLRSDGGVQFEFPERLVLIANHQIYTDWLYLWWIAYANSPSMHGHIYIILKESLRRIPIVGLGMQIYGFIFMSRKMASDQPRMAYRLNKLKQPKVDPNGKSYMNPMWLLLFPEGTNLSNNGRRKSAGWAAKMDLKDPEHVLLPRSTGMFFCLNELKGSLDYVYDCTVAYEGIPRGGFGEQYFGLVSTYFQGRPPKSVNFHWRRFRLSDIPLDDQKAFDLWLREEWYKKNALMEEYMTTGRFPRMEGGKVDYIETEVKTRQPWEILQLFTVVGTAALIWHNVKKTFTTVTTVFQ

SEQ ID NO: 47866 - protein, 513 aa, Coccidioides immitis RS
MPNEDGAAGLPRSMEPAATVVDQPSNKAADLILQRRQAPEISLAKSDQGLLAQLSSNPFFTAGFGLAGLGAGLTLAQRGIRYGAALLRRRMLVDVEISIKDDSYPWFLHWMTLYQRSQLANVSQKAGFFESFLRKITPGMRHLSIQTEKVELANGALQTHFSLIPGPGRHVLRYKNAFIFVNRVREAKSRDLQTGRPWETVTLTTLYSQRHIFEDLFREAHEYAAKSHEGKTVIYNSWGTEWRPFGQPRRKRPLDSVILEAGVKERIVADVKDFIGSASWYHDRGIPYRRGYLLHGPPGTGKSSFIQALAGELDYDIAILNLSERGLTDDRLNHLLSIIPSRTLVLLEDVDAAFSTRRVQADADGYRGANVTFSGLLNALDGVASAEERIIFLTTNHVERLDEALVRPGRVDMTVRLGEATRYQAAQLWDRFYGEFEHSEAYKQQFLEKLEKLGILEDENGRKPDLFRATSTAALQGLFLYNKGDMAGAIAMAEGLVGDEAADQVSVTGSVHS

SEQ ID NO: 47867 - protein, 172 aa, Lactobacillus sakei subsp. sakei 23K
MSINFKDYVASVPDFPEAGVTFRDISPLMSDGEAYAAATDKIVEYAKNKGVEMIVGPEARGFIVGCPVAYKLGVGFAPARKKGKLPRETVSASYGLEYGKSTLYMHKDAVKPGQKVLVTDDLLATGGTIAATIKMVEELGGIVVGTAFFIELKDLNGREKIKDYDIFKLMEY

SEQ ID NO: 47868 - protein, 363 aa, Blastopirellula marina DSM 3645
MDGAALRLTAETPQEEVLRFGRTIIQQEAAALSAIAERLDARFGQALDLVMQCPGDIIVTGMGKAGLIGQKIAATFASTGTPSHFLHPAEAIHGDLGRVDEKDVVLAFSQSGETDEIVRLIPCLKSLGAQIVAVTANENNTLARAAKIVLPLGPIVEAGANRLAPSTSTAAMLALGDALALTCSWRRGFRPEDFARYHPGGSLGRKLALVEDVMRPLTECRISRYDQLVRDVFVSACRPGRRTGAIMLVDEQGKLAGIFTDSDLARIFETGRTELLDQPISIVMTQSPKTVTSGVRVLEALSAIAKSKISELPVINDTGEPIGMLDITDLVDLAASSPSGETAIAEPETPWTVPFPNQNGSDA

SEQ ID NO: 47869 - protein, 372 aa, Zea mays
MGGAAGEAMWAAVVAATVVFLAVEVSGAASALPRFAEAPEYRNGEGCPAAAAGVCDPGLVHIAMTLDTHYLRGSMAAVYSLLKHASCPESIFFHFLAAEAGAVDGADPEPELLRRAVAASFPSLRFEIYPFRAEAVAGLISASVRAALEAPLNYARNHLADLLPRCVPRAIYLDSDVLAADDVRRLWETRLPAAAVVAAPEYCHANFSRYFTPAFWSDPVLGARVFAGRRRPPCYFNTGVMVIDLRRWRAGNYRQRIERWMEIQKQKRIYELGSLPPFLLVFAGEVEAVDHRWNQHGLGGNNVHGSCRPLHAGPVSLMHWSGKGKPWDRLDAGRPCPLDHTWKSYDLYIPGDSGGAASPASGPALSASVFSW

SEQ ID NO: 47870 - protein, 275 aa, Magnetospirillum magnetotacticum MS-1
MVVGSANVDLVVDVPRHPGGGETILGGELRRNPGGKGANQAVGAARAGGAGTTFVGALGHDDAADLLLASLDRGGVRTDLVERVDAATGTALITVSPDGENAIVVAPGANSHVTVGAAQAERIAAADVVLAQLEIPLDVVRAAAAARRPGALLVLNAAPSRDLPGDVWAAVDVLVVNEHEAADLAGASGDADPSALAGLLLERVPAVVVTLGGEGSLVAERRPAGPLLTTVPAIAVEAVDTTGAGDTFCGVLAAALARGADLPDAARLAAAAGAL

SEQ ID NO: 47871 - protein, 353 aa, Podospora anserina
MSNAQARGGARKISFNVSEQYDIQDVVGEGAYGVVCSAIHKPSGQKVAIKKITPFDHSMFCLRTLREMKLLRYFNHENIISILDIQKPRSYESFNEVYLIQELMETDMHRVIRTQELSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPNTSDMALDLLEKLLAFNPVKRITVEEALKHPYLEPYHDPEDEPTAPPIPEEFFDFDKHKDNLSKEQLKQLIYQEIMR

SEQ ID NO: 47872 - protein, 336 aa, Streptococcus dysgalactiae
MVVKVGINGFGRIGRLAFRRIQNVEGVEVTRINDLTDPNMLAHLLKYDTTQGRFDGTVEVKEGGFEVNGNFIKVSAERDPENIDWATDGVEIVLEATGFFAKKEAAEKHLHANGAKKVVITAPGGNDVKTVVFNTNHDILDGTETVISGASCTTNCLAPMAKALHDAFGIQKGLMTTIHAYTGDQMILDGPHRGGDLRRARAGAANIVPNSTGAAKAIGLVIPELNGKLDGAAQRVPVPTGSVTELVVTLDKNVSVDEINAAMKAASNDSFGYTEDPIVSSDIVGVSYGSLFDATQTKVMEVDGSQLVKVVSWYDNEMSYTAQLVRTLEYFAKIAK

SEQ ID NO: 47873 - protein, 328 aa, Salmonella typhimurium LT2
MSHLALQPGFDFQQAGKEVLEIEREGLAELDQYINQHFTLACEKMFNCTGKVVVMGMGKSGHIGRKMAATFASTGTSSFFVHPGEAAHGDLGMVTPQDVVIAISNSGESSEIAALIPVLKRLHVPLICITGRPESSMARAADVHLCVKVPKEACPLGLAPTSSTTATLVMGDALAVALLKARGFTAEDFALSHPGGALGRKLLLRVSDIMHTGDEIPHVNKHATLRDALLEITRKNLGMTVICDESMKIDGIFTDGDLRRVFDMGGDMRQLGIAEVMTPGGIRVRPGILAVDALNLMQSRHITSVLVADGDQLLGVLHMHDLLRAGVV

SEQ ID NO: 47874 - protein, 806 aa, Yarrowia lipolytica CLIB122
MNFLRNILGSGSKQELAVIPSGQLFLKRSPHSVKGVSECIYKEAAAIIRKTEVEFQSQLIVQRVYEEGEEAFEGTEEEDQLDDEEWCYLIDEALRISYFMQDGHVVVTWNDLNGDPGDRFEFICDTSIKPEVYDKFSKVAQECMYERKYTASAKGVSEDDLNEFDYPPPVTEVEANESTAVDESVAADFNEVDKRVAHDTEGIFVKEEEEGKKENKAHASVPTAAPETVAAAVAAPASAPVVQDLPQFDALLGENNAELHLFDAGTGAFELQAASTTVRIEEVAKQWEYWLTVTNGTKPVLGMPITSEMNPCFNYEHLSFIFNYFAPTGAGFSWLLKFGSFEELEIFQQVFMQALWQRLHRQKYTTAPETEKDYLSEAFGAMDIDDEGTTGLEDLPEEDEDEDEFEDCPQGPARDFSDDEEYDNDEVFGKNDDLDKNKLLAVGTSNDRSYVVRGNRIGVFKNTADNELEFATTIENISKPDKTSFNPDKMMLHYQDKHIVLQDKSEGNNLYKMDLEYGKVVDEWKVSDDSKNGVVSFAPSAKFAQMTGEQTFLGMANSGLFRIDPRLSGSKLVDSEHKKYATNNQFSALTSTEGGHIAVASQKGEIRLFDRLGINAKTALPALGDPILGVDVSADGRWILATCKTYILLIDATIKDGKYEGETGFKRSFAKDAKPRPKRLQISPEHVAFMLAETGSGLNFTKAHFNQGPNSREQTVVTSSGPYVVTWSLKKLLRGDANPYLIKRYSDQVTAGDFRFGTDKNVIVATEDDVNMVSKKSFRKPTRESLATPGMRRGTLGRSSIVNELY

SEQ ID NO: 47875 - protein, 332 aa, Aspergillus oryzae
MSSSLEQLKATGTVVVCDSGKYLGHWNSSHDAIGKYKPQDATTNPSLILAASKKPEYAALIDAAVEYGKQHGSNVDEKVDATLDRLLVEFGKKILEIIPGKVSTEVDARLSFDTQASIDKALHIIKLYEENGISKDRVLIKIASTWEGIKAAQVLQRDHGINCNLTLMFSTVQAIAAAEAGAYLISPFVGRILDWYKAAHKRDYTAQEDPGVKSVQNIFNYYKKHGYNTIVMGASFRNTGEITELAGCDYLTISPNLLEDLYNSTAAVPKKLDAASATGLDIPKKTYINDEALFRFEFNEEAMAVEKLREGISKFAADAVTLKDILKQKVQA

SEQ ID NO: 47876 - protein, 149 aa, Glycine max
  misc_feature (145)..(145): Xaa can be any naturally occurring amino acid
MAFRIASQLRSTGKKIGGSRRFATTVADGTKETYNKFSVTGEFAPVAIIGGFVALAVAMAGHSLKQQLMHAPGVSTRKNRRAAVAEVDDPDNCVSSADKYINKSWLRKVGQIQDKSSAILSDPTRPNPFTTPRNAETLKSVGVAXIGNL

SEQ ID NO: 47877 - protein, 273 aa, Triticum aestivum
  misc_feature (50)..(50): Xaa can be any naturally occurring amino acid
  misc_feature (113)..(113): Xaa can be any naturally occurring amino acid
KPPRGEIPQVLAKTLEAQFAVIPEILDDYPYLPMDTEFPGFVFRPFGTFXSKREFHYATLKANVDMLKLIQLGLTFSDERGGLPALGPDARPCVWQFNFRGFDPRTDDAAADXVGDLLRRSGIDFARHAAEGADSRRFAELLMSSGVVLNAEIHWVTFHSGYDFGYLLKLLTGSNLPDTSSGFFDLIRIYFPVIYDIKHLMRFCNSLHGGLNKLAELLDVERVGICHQAGSDSLLTALSFNKLKESYFGGLTEKYAGVLYGLGTEGGETTSVH

SEQ ID NO: 47878 - protein, 130 aa, Yarrowia lipolytica CLIB122
MTRTSVLADALQSITNAEKAGKRQVLIRPSSKVIIKFLTVMQQHGYIGEFEYVDDHRSGKIVVQLNGRLNKCGVISPRFNVKIDDVEKWIQNLLPSRQFGYIILTTSAGIMDHEEARRRHVAGKILGFFY

SEQ ID NO: 47879 - protein, 117 aa, Brassica napus
SMFMWMLPIAILYAFNHDLLPGSTTLSPHSLTLLSGFLAVVSVNVVIVFYICLALKEPTDKHKPDASFVAEAKDSVKKLTSGVPSTDPALKKQENFWLVVHPLLRHLVVWFKQQKLQ

SEQ ID NO: 47880 - protein, 696 aa, Kluyveromyces lactis NRRL Y-1140
MAPVATVGLNNTLDGVAHALKQTKSSEGTFPEAENVQDMKKILHEEDFYNKEVYPPILHEAVSDDLPLEKVYGVNVTASPELIADESKIGPLVDEWFEQFNVLMNKINSGSTSVSEEDWSRLFGNHGTWRDHLGVTFDLHSFIGLENLSNDLQPLLSKAKLSNFQLDKLADYRYTSGYGKVLMHEPKSGRPPVEWVQVYYTFENKLGSGKGIARLTAVYDEKLQKSTLKAFTFYTGLEDYKEYPEAIFGNRPEGVNHGQHVGRESWVERRAKESTFTEDHQPTVLIVGGGQGGLTVAARLKMFGVNSLIIEMNPKIGDNWRNRYKFLVLHDPVWYDHLPYLNFPPSWPIFTPKDKIGDWFEGYAKTMDLNYKCSSMVTGATFDDVSNKWTVQVKDFNTGKIITYTPDHLVMATGHSGEPRMPKFQDQELFKGKIVHSSKHGSGAEFSGGKALVVGGCNSAHDICQDFYEQNVDVTMLQRSSTCVITVEHGMYHNIRGVYDETGPLTETADRIFHSMPLSLLNGVMQQQYRASCQDDVELLKALERRGFKTNAGYGGTGLFGLYFRQGSGYYIDVGCSKLICDGKVKIKQGQSIKRFLPSGTGVEFTDGTILEGLDVIVMATGYTNMKETARRLFGDRVADRLDPVWGLDKEGELKTIWRDSGHPNFWYMGGNLAVSRYYSKRLALRIIQQVKGLEY

SEQ ID NO: 47881 - protein, 387 aa, Pseudomonas aeruginosa PAO1
MSIKVEDYFAPETFQRMKAFADKQETPFVVIDKQTIADAYDQLTDCFPFARIYYAVKANPATEITELLRDKGSNFDIASIYELDKVMKTGVGPERISYGNTIKKSKDIRYFYEKGVRLFATDSEADLRNIAKAAPGAKVYVRILTEGSTTADWPLSRKFGCQTDMAMDLLILARQLGLEPYGISFHVGSQQRDISVWDAAIAKVKVIFERLKEEDGIVLKMINMGGGFPANYITKTNDLETYAEEIIRFLKEDFGDDLPEIILEPGRSLIANAGILVSEVVLVARKSRTAVERWVYADVGKFSGLIETMDESIKFPIWTEKQGEMEEVVIAGPTCDSADIMYEHYKYGLPLNLASGDRLYWLSTGAYTTSYSAVEFNGFPPLKAFYL

SEQ ID NO: 47882 - protein, 539 aa, Paxillus involutus
MSLSKHVNAESLIRESKDKKHPHHHRSTTTSISTISYGARYGTQSIPKFHLPSKGTSAENAYQLIHDELALDGSPSLNLASFVHTWMPEPANKLMVENMSKNLIDQDEYPMTQLIHTRCVSILADLWHAPSTKQAIGTATTGSSEAIQLGGLAMKRIWQEHRKAAGKSIHEPGPNIVMGANAQVALEKFARYFEVECRLVPVSAESKYRLDPKKAMEYIDENTIGVFVILGSTYTGHYEPVKEMADLLDEYEKQTGHSVPIHVDGASGAFIAPFAQPKLLWDFKIPRVVSINTSGHKFGLAYVGVGWVVWRSKEYLPKDLIFELHYLGSVEYSFSLNFSRPAAPIIAQYFNFLHLGFEGYRAVALDDLKNARLLSRVLEGTGWYTVLSDIHRQKSNSLLTKGMQATIGIDEEHLENYMEGLPVVSFRFSDKFQEQYPEIQQKWIQTLLRAKGWIVPNYELPPNLEKVQILRVVVRENCTEVLIDRLVTDIVEITQNLVDRDSSTHALDMLGNGQHCKTVIGQMEEGSGSRSSGTYAKQC

SEQ ID NO: 47883 - protein, 526 aa, Chlamydophila pneumoniae CWL029
MERKRFIDCDSTKILQELALNPLDLTAPGVLSAERIKKFSLLGGGFTFSFATERLDDAILAALISLAEERGLHESMLAMQQGQVVNYIEGFPSEMRPALHTATRAWVTDSSFTGEAEDIAVRSRVEAQRLKDFLTKVRSQFTTIVQIGIGGSELGPKALYRALRAYCPTDKHVHFISNIDPDNGAEVLDTIDCAKALVVVVSKSGTTIETAVNEAFFADYFAKKGLSFKDHFIAVTCEGSPMDDTGKYLEVFHLWESIGGRFSSTSMVGGVVLGFAYGFEVFLQLLQGASAMDQIALQPNARENLPMLSALISIWNRNFLGYPTEAVIPYSSGLEFFPAHLQQCCMESNGKSIAQDGRRVGFSTSPVIWGEPGTNGQHSFFQCLHQGTDIIPVEFIGFEKSQKGEDISFQGTTSSQKLFANMIAQAIALACGSENTNPNKNFDGNRPSSVLVSSQLNPYSLGELLSYYENKIVFQGLCWGINSFDQEGVSLGKALANRVLELLEGADASNFPEAASLLTLFNIKFR

SEQ ID NO: 47884 - protein, 451 aa, Triticum aestivum
  misc_feature (180)..(180): Xaa can be any naturally occurring amino acid
  misc_feature (423)..(423): Xaa can be any naturally occurring amino acid
  misc_feature (444)..(444): Xaa can be any naturally occurring amino acid
LGLLRFCHFPQLRRPTSLISFAQARSSLACPPLRPHARLMAANTAAARALLLLLLAVAVPSLLRTGEASVHEYSGLSFLNKGNAFILHAGSEGLYAPVSPANATAEEDDDEAAADAFIRFDKITFRRPEEANDSVKETSSSKVQIIVFEIEDREMIGGSAYGGQKAICCTSDLAKLGACXKALFIYRPSQVNPGWPQLFVASFDGSDLIATLPSRTIPVKKTGMYNMYFIHCDPALAGLEIDGKTIWKNPTGYLPGRMAPLKNFFGLMSFAFVILGIYWFYQYMKFWREVLPLQNCITLVITLGMLEMALWYFEYAEFNETGVRAKAITFWAVTFGTIKRTVARLIILIVSMGYGVVRPTLGGLTSKVVLLGGTFFVATEILELVENLGTVNDLSGKARLFLVYPVAILDASFIVWIFISLAXTLSQLQARRLMAKLDIYRKFXIALAITV

SEQ ID NO: 47885 - protein, 511 aa, Glycine max
MAGGGYVDSGNAKQFEGKVTAFVLVTCFVAAMGGLLFGYDLGITGGVTSMEPFLIKFFPGVYKQMQDDVGHRSQYCKFDNELLTLFTSSLYLAALVASFFASSTTRMMGRKASMFLGGLFFLVGALLNGFAVNIEMLIIGRLLLGFGVGYCNQSVPVYLSEMAPAKIRGALNMGFQMMITIGILAANLINYGTSKLENGWRISLGTGAIPAVMLCVGALFLGDTPNSLIERGQKEEAKKMLQKIRGIDNVEEELQALIDASESAKEVEHPWKNFTQAKYRPQLIFCTLIPFFQQLTGINVVMFYAPVLFKTLGFGNDASLMSSVITGGVNVVATLVSILTVDKVGRKVLFLEGGVQMFICQIATGVMIAMKFGVSGEGSFSSGEADLILFFICAFVAAFAWSWGPLGWLVPSEICPLEIRSAGQATNVAVNMLFTFAIAQVFLAMLCHLKFGLFFFFAAFVLIMTLFIALLLPETKNIPIEEMHLVWRSHWFWSKIVPQVDNDRKPTTAQS

SEQ ID NO: 47886 - protein, 430 aa, Synechococcus sp. RS9917
MFDSLDLVIDTIVAREVLDSRGNPTVEAEVLLEGGASGRAIVPSGASTGAHEAHELRDGGSRYMGKGVTQAVDHIEERIAPALCGLSALDQASVDAAMQELDGSANKSALGANAILAVSLATARAAANGVGLPLYRYLGGPMASLLPVPLMNVINGGAHAANSLDFQEFMLVPHGAPSFREALRMGTEVFHTLKGLLQERGLSTSVGDEGGFAPDLGNHEAGDILVQAIEKAGYKPGEQIALALDVASTEFYADGRYAFGGGSFSSAEMVDQLEALVNRFPIVSIEDGLAEDDWDGWKLLTERLGSRVQLVGDDLFVTNSQRLQQGIDHNTANSILIKVNQIGSLTETLQAIDLAGRSGYTSVISHRSGETEDTTIADLAVATRAGQIKTGSLSRSERVAKYNQLLRIEDELGSQAVYAGAVGQGPRGRG

SEQ ID NO: 47887 - protein, 544 aa, Emericella nidulans
MGIASLERDTKGGTRFTGCTSIREFEFLGKLGEGTFGEVYKARAKRDGSIVALKKILMHNERDGFPITALREIKLLKMLSHTNIMQLREMAVERSKGEGRKKPSMYMVFPYMEHDLSGLLENPEVHFSEAQIKCYMIQLLEGLKYLHGNCILHRDMKAANLLISNQGILQIADFGLARPFDEAPPQPGKGAGEAKRDYTTLVVTRWYRPPELLLQLRRYTSAIDMWGVGCVFGEMFKGKPILAGNSDLNQAQLIFSLVGTPTEENMPGWSSLPGCEGVKHFGNRPGNLAEVFKDQGPMAISLLTELLKLDWRKRVNAIDALKHPYFSTPPLPARPGDLPSFEDSHELDRRRFRGQRAAMPPAPAGGSVGMSRNGGWSTNSGSRTGAETRNPRISSAARSQGNQLRDAWSNEPQQAWQRRGNEELKDPNHSFSSRHRDGGLPPKPPAPIQHSWASGHSDKTGRDRGYGARYGGPEGSVDSYVPNYGGSDRNRDRDQGTAISDRRGSYYDKSHQTSKLDYSREIPSRRRSRSPNYRERVDRGPYRR

SEQ ID NO: 47888 - protein, 219 aa, Desulfitobacterium hafniense Y51
MCAGRVMVTEKLLKGIVNFRNGDFETHRQLFEELKDNQKPHTLFITCSDSRIDPNMITGTLPGELFIVRNVANIVPPCRETSEYVSTTSAIEYAVQMLGVENIIVCGHSNCGGCSASLNAPEKLDQLPHTKKWLELMESVRERVLSEFAEDEPTVREWMMEQINVVEQLRHLMTYPYIYEKVMAKELMLSGWHYMIETGEVFIYDYRAGEFRLANGSRA

SEQ ID NO: 47889 - protein, 522 aa, Xylella fastidiosa Ann-1
MTPNIHHDKILILDFGAQYTQLIARRIREIGVYCEVWPWDHSPEEILSFGAKGIILSGGPESTTSPGAPAAPQHVFDSDLPIFGICYGMQTMAVHLGGATEAADKREFGHASLQVIYPDTLFSGLSDHPSEFRLDVWMSHGDHVSRVPPGFTITAATDRIPIAAMSREDKRWYGVQFHPEVTHTLQGQALLRRFVVDICGCQTLWTSANIIEDQIARVRERVGCDEVILGLSGGVDSSVVAALLHKAIGSQLTCVFVDTGLLRWGEGDQVMAMFSEHMGVNVVRINAASRYFDALQGVYDPEAKRKIIGNLFIQIFEEEASKRKQAKWLAQGTIYPDVIESAGSKTGKAHVIKSHHNVGGLPEQMTLGMVEPLRELFKDEVRRLGVAMGLPHAMVYRHPFPGPGLGVRILGEVKPEYAELLAKADSIFIDELHQADLYDKVSQAFAVFLPVKSVGVVGDARAYEWVIALRAVETVDFMTAHWAPLPYDFLSTVSNRIINELRGVSRVVYDISGKPPATIEWE

SEQ ID NO: 47890 - protein, 490 aa, Podospora anserina
MLSQRLLLGRTAVRSALKPSGCAEEKDLVIIGGGVAGYVAAIKAGQEGMKVACIEKRGTLGGTCLNVGCIPSKSLLNNSHLYHQILHDTKHRGIEVGDVKLNLQQLMKAKETSVTGLTKGVEFLLKKNGVEYIKGTGSFQDEHTVKVELNDGGETSVTGKNILIATGSEVTPFPGLTIDEQTVISSTGAIALEKVPEKLVVIGGGIIGLEMASVWSRLGSKVTVVEYLDQIGGPGMDTEVAKGIQKILKKQGITFKTGTKVLSGEKTGDEVKVQTEAAKGGKEETLDADVVLVAIGRRPYTGGLGLENIGLELDERGRVIIDAEYRTKIPHIRCVGDATFGPMLAHKAEEEAVAVVEYIKKGYGHVNYGCIPSVMYTFPEVAWVGQSEQDLKKADIPYRVGTFPFSANSRAKTNLDTEGFVKILADPETDRLLGIHIIGPNAGEMIAEGTLALEYGASSEDIARTCHAHPTLSEAFKEAAMATHAKAIHF

SEQ ID NO: 47891 - protein, 590 aa, Podospora anserina
MAKLTKERTYPLMSRREIEAQIADGRHMVIVDGHVLKVDAFMQFHPGGDKAMKHMVGRDATDEVNGLHSPEARAMMNKYRVGRIEGRWNNFLPPIQGGKFRKRLEDGAMEVEEEDDSGRLSAPAVTITADTPSSELESRPPSPVFDVDGSALRKRQVKESMGSSAASITSASSLEESHGDGSLPLDGMAHLDILTRKEIKLDLDKYPAVDQDTQEVIVEKYRKLHDRIKADGLYDCNYYAYAIECSRYITFFGLMLLFLKWKWYIPSAFFLGVFWHQLVFSAHDAGHMGITHNFQVDTIIGIIIADFLGGLSLGWWKRSHNVHHIVTNSPEHDPDIEHMPFFAISHRFLASLRSTYYERIMPYDAAAKFFISMQHNLYYVIMLFGRFNLYRLSMEYLILGQGPKKGVAAWHRWFEFAGQVFFWYWFGYELLYKSVDGGWNRFWFVMVSHMVTCPLHVQITLSHFAMSTADLGVDESFPQKMLRTTMDVDCPTWLDFFHGGLQFQAIHHLFPRIPRHNLRKTQRLVQEFCDEVGIPYALFGFVDGNKEVIGRLGEVARQAAILKKCQGVMIGEGEGGGASSSSSSLRGEDE

SEQ ID NO: 47892 - protein, 182 aa, Yarrowia lipolytica CLIB122
MSLQTLQTELKAKLRQYQDFPSKGIVFEDILPIFQDPKSFQQLIDAFKLHIKDTFGDKKIDVIVGLDARGFLFGPTLALAIGAAFVPVRKQGKLPGKTVHAEFQKEYGKDVFEIQEDAIKPGQTVIVVDDIIATGGSAACAGDLVTKLKGEVLEFIFILELLFLKGRDKLCAPAYTLLSGQE

SEQ ID NO: 47893 - protein, 305 aa, Oryza sativa (japonica cultivar-group)
MDHEADAYRTDLMTITRFLAPEIEIGEEQKKLDVLSNEVFVKALVSSGRTCVLVSEEDEEATFVDPALRGKYCVCFDPLDGSSNIDCGVSIGTIFGIYMIKDKENVTLEDVLQPGKNMVAAGYCMYGSSCTLVLSTGNGVNGFTLDPSLGEFILTHPDIKIPKKGKIYSVNEGNAKNWDEPTAKFVEKCKFPKDGSSPKSLRYIGSMVADVHRTLLYGGVFLYPADKKSPNGKLRVLYEVFPMSFLMEQAGGQSFTGKERALDLVPTKIHERSPIFLGSFEDVEEIKGLYAAQANVIVLRPGTAS

SEQ ID NO: 47894 - protein, 464 aa, Synechococcus elongatus PCC 6301
MVSTPAAPSLNPQYPALFGTDRPSNSPNQNLFPLTASVTADGQLEVGGCRVSDLVERYGSPLYILDEQTLRAACQSYRSALAHHYPGAALPIYASKAWNCLAVCALVAQEGLGIDVVSAGELYTALQAGVPSDRLYFHGNNKSLSELAMGVEAGCTIVVDNWQELRNLEAIAAEQQREVRVMIRFTPGIECHTHEYIRTGHLDSKFGFDPDQLDALLAALVDQPYLRCIGLHAHIGSQIFELQPHADLAGVLVGAYAKALALGLPIAELNVGGGLGIRYTESDDPPSIDEWVRQVSESLVAACQAADLPLPKLICEPGRSLIGTACVTAYQIGSRKEVPGIRTYLAVDGGMSDNPRPITYQSTYRAVIANRLNVSDRETVTVAGKHCESGDVLLKDAELAPSQPGDILVVLATGAYNYSMASNYNRIARPAAVLVNNGEAQIILARESLQDLLRQDRLPVGLQA

SEQ ID NO: 47895 - protein, 430 aa, Methanosarcina acetivorans C2A
MRKRIKRSTGDFMFLNDYELGEEEKLLLQKVLDGDIAFRKIEEFAEPLTAVKIRRLAIQEYAKLEFEHIQNFSLDVEIVTKRNIENMIGAVQIPLGTAGLLKVNGEYADAEYYIPLATTEGALVASVNRGCSVITKSGGANVRVFEDEMTRAPVFKLESLDRAKKFYEWVKRPEIFEQMKEVAEKTTRFGKLVSVKPFVTGTYVYLRFSYDTKDAMGMNMVTIATDAVMHLIEDEFGAHPITLSSNMCTDKKPASISTILGRGKTVVAEVTIPEEIVKETLKCTPESMFEVNYSKNLLGSARAGAMGFNAHAANVIAALYLACGQDAAHVVEGSTAITSMELTKYGEIHCSVTLPALPVGTVGGGTGLGTQRDCLNILGVAGAGDEPGINSLKFAEIVASAVLAGEISLIGAQAAGHLARAHAQLGRGKF

SEQ ID NO: 47896 - protein, 411 aa, Anaplasma platys
MKENAVLMCGDKKVSLPMLSGTDGIQLIDITTLYRDHKVLTYDPGFMSTAACSSEITFIDGEKGILRHRGLDIADLIGIKGGFCSVAHLLLYGVLPSDTVFEQFSAAIGAQHALSSDVLGVISSFRRDAHPMAILMACFSTLAAKYHGDNRGNEELAVLAIAQVPSLVAAIYRHRMGLELVSPDTSLSYTGNFVKMMFGALEKTRADAIEEALDAIFIMHADHEQNASTATVRMAGSAGTELFACLAAGTATLWGPAHGGANEAVIRMLESIGSPDKVEEFIGFVKDNNSKVRLMGFGHRVYKSYDPRAKILGQISRSVLDNLGCSDELLGVAEELERCALQDEYFVERKLYPNVDFYSGIVLRAMGVPVEMYTTFFALARTAGWVSQWCELLRGSESLKICRPRQLYAGK

SEQ ID NO: 47897 - protein, 399 aa, Pseudomonas syringae pv. syringae B728a
MSGNRGVVYLGAGKVEVQSIPFPKMEDPRGKRIEHGVILRVVSTNICGSDQHMVRGRTTAQTGLVLGHEITGEVLEAGRDVEHLKVGDLVSVPFNVACGRCRSCKEQNTGVCLTVNPARPGGAYGYVDMGDWVGGQAEYVLVPYADFNLLKLPDRDAAMEKIRDLTCLSDILPTGYHGAVTAGVGPGSTVYVAGAGPVGLAAAASARLLGAAVVIVGDVNPTRLVHAKAQGFEIADLSQDTPLHEQIAALLGEPEVDCAIDAVGFEARGHGHAGAQAEAPATVLNSLMGVVRVAGKIGIPGLYVTEDPGAVDAAAKMGSLSIRFGLGWAKSHSFHTGQTPVMKYNRQLMQAIMWDRIKIADIVGVEVISLDDAPRGYGEFDSGVPKKFVIDPHGLFGAA

SEQ ID NO: 47898 - protein, 489 aa, Glycine max
MALNLIHRPATKPPSSSSSFVTPRPLRTTQSIPVRNSRRSIAVRAAATEAPVATITAARECRVKSVKARQIVDSRGNPTVEVDLVTDGLFRAAVPSGASTGIYEALELRDGDKSVYGGKGVLNAVRNINEVLAPILVGVDVRNQADVDAIMLEIDGTPNKSKLGANAILGVSLSVCRAGAGAKGVPLYRHIQEISGTKELVMPVPAFNVINGGSHAGNNLAMQEFMILPVGATSFAEAFRMGSEVYHVLKGIIKAKYGQDACNVGDEGGFAPNVQDNREGLVLLMDAIDKAGYTGKIKIGMDVAASEFYTKDGKYDLNFKKQPNDGAHVHSAQSLGQLYKDFVKEFPIVSIEDPFDQDDWGSWASLLASVDIQLVGDDLLVTNPKRIAEAIKKKACNGLLLKVNQIGTVTESIQAALDSKAAGWGVMVSHRSGETEDNFIADLSVGLASGQIKTGAPCRSERLAKYNQLLRIEEELGSVRYAGETFRSP

SEQ ID NO: 47899 - protein, 521 aa, Zea mays
MQFSSVLPLEGKACMSPVRRGSGGYGSERMRINCCSIRRNKALRRMCFSARGAVSSTQCVLTSDAGPDTLVRPNHPFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFQGTADAVRKFIWVLEDYYKHKAIEHILILSGDQLYRMDYMELVQKHVDDNADITLSCAPVGESRASDYGLVKFDSSGRVIQFSEKPKGAALEEMKVDTSFLNFATCTLPAEYPYIASMGVYVFKRDVLLDLLKSRYAELHDFGSEILPKALHEHNVQAYVFTDYWEDIGTIRSFFDANMALCEQPPKFEFYDPKTPFFTSPRYLPPTKSDKCRIKDAIISHGCFLRECAIEHSIVGVPSRLNSGCELKNTMMMGADLYETEDEISRLLAEGKVPIGVGENTKISNCIIDMNCQGWKERLHNKQRGRSKSPDRPGRRILIRSGIVVVLKNATIKDGTVI

SEQ ID NO: 47900 - protein, 268 aa, Aspergillus oryzae
MLLIAGQMFSILNEIANNSHFRTTGVVFASIGSSAATYILVAITGYLSFGDTVGGNIVGMYPPGLWATIGRAAIVILVMFSYPLQCHPCRASVDAVLKWKPKASNSNDNSPHRHPLLGPRGNRTPEPMSDLRFSVITTTILVLSYVVAMTVSSLEAVLAYVGSTGSTSISFILPGLFYYKISSPDSPAHQRLMKEDDEAAEGIFSDDGDDNDDLDNQAQSLTESGILRRGTRHWRKAVLRKLSLALAIYGVVVMIVCLITNSLFIASH

SEQ ID NO: 47901 - protein, 210 aa, Paxillus involutus
MPPPHYDFLIKLLLIGDSGVGKSCLLLRFCDDAWTPSFITTIGIDFKIRTIELDGKRIKLQIWDTAGQERFRTITTAYYRGAMGILLVYDVTDERSFNNIRTWHANIEQHASDGVNKILIGNKSDWTDKRAVTEDQGRELANELGIRFMETSAKVNDGVEDAFFTLARDCKTRLIDSQADATGSPGSAGNADGSVKVNQPTTQAAGGCCS

SEQ ID NO: 47902 - protein, 437 aa, uncultured crenarchaeote DeepAnt-EC39
MKNNIEIYKSKTRKSSKLFEKSKKYHVNGVHHNIRFFEPYPFVTKSANSKFLVDIDSNKYVDYWMGHWSLILGHKPKKIINVIKKQLNYDWMHGVLNKNSIELSEKISKVVPVAEKIRYASTGTEATMYAVRLARTVTKRKIIAKIDGGWHGYTTDLLKTVNWPFSKSESSGLTDEKYIISLPYNDLENSIKILKSKKNELAAVIIEPVLGGGGCIPATKEYMFGIQEFCRKNKTVFILDEIVTGFRFRFGCLYNTMKLDPDLLTLGKIVGGGLPIGVICGKDELMKYANTEIYSKIERAYIGGGTFSANPLTMIAGNSMLSTIKNKSNQLYRKLNSFGTETRKMLDKKFDGKVITTGMGSLFLTHFLNDSICEINNATDVAKCNIKKLHDYHFHMIANDDIFFLPGKLGAFSDVHTKSDIKTMERSTDEFLTKFKK

SEQ ID NO: 47903 - protein, 208 aa, Oryza sativa (indica cultivar-group)
MPYAAVRPSPPPQLSRPIGSGAGGGKACPAVPCEVARYHEHAVGAGQCCSTVVQAIAAPADAVWSVVRRFDRPQAYKKFIKSCRLVDGDGGEVGSVREVRVVSGLPATSSRERLEVLDDDRRVLSFRIVGGEHRLANYRSVTTVHEAAAPAMAVVVESYVVDVPPGNTWEETRVFVDTIVRCNLQSLARTVERLAPEAPRANGSIDHA

SEQ ID NO: 47904 - protein, 254 aa, Paxillus involutus
MPESREDSVYLAKLAEQAERYEEMVENMKRVASSDQELTVEERNLLSVAYKNVIGARRASWRIVSSIEQKEESKGNEAQVAMIKGYREKIETELAKICEDILDVLDKHLIPSAASGESKVFYHKMMGDYHRYLAEFATGDKRKDSADKSLAAYKDASDVAVTELPPTHPIRLGLALNFSVFYYEILNSPDRACHLAKQAFDDAIAELDTLSEESYKDSTLIMQLLRDNLTLWTSDMQDTDKTDSKDEGENAGDD

SEQ ID NO: 47905 - protein, 303 aa, Prochloron didemni
RIGRNFLRCWAGRENSQLDLVGINDTSDPKTNAHLLKYDSMLGIFDGDVDADENSLIVNGKTIKCVSDRNPLNLPWADWGIDLIIESTGVFVTEEGASKHLTAGAKKVLITAPGKGGNIGTYVVGVNEKDYEHHKHNVVSNASCTTNCLAPFAKVLNDTFGIVKGTMTTTHSYTGDQRLLDASHRDLRRARAAAINIVPTSTGAAKAVALVVPELKGKLNGIAMRVPTPNVSVVDLVVQVEQGCIKEQVNDALKAAAEGPLKGILRYNDLPLVSCDYRGTDCSSIVDGSLTMVMGGDMVKVVA

SEQ ID NO: 47906 - protein, 542 aa, marine gamma proteobacterium HTCC2207
MTSSTNQAADYTPTTTSAWKSLEQQAEKAQHQNISGFFDQNPSRSSQMSVQCGEIFLDYSKNLVSDESWQALLELANQSPLEQHRAAMFSGEKVNTTEGRAVLHGALRAEIGDQRVASAAVESDQRVTLVKQQLVDVELVSEQIRSGQWLGSTGKAITDVVNIGIGGSDLGPKLACSALQEFAHPDIKLHFISNVDGAEILTTLKKLNPETTLVALASKTFTTHETLLNAKTARNWFAETLGLENAQSTRHFVGLTANRANALAYGIPADQILEFAEWVGGRYSLWSSIGLSIAISIGFEKFVEMLAGAREMDLHFQQAPLAENMPVIMALLGIWYSNFLDAQSTAVIPYCERLLLLPSYLQQLDMESNGKSTTLNGDSIDYQTGAILWGQTGTNGQHAFFQLLHQGTRMVPVDFIAAAVDNLSNEEHHRVLLGNMLAQASALMCGQDAPDGEPYRYYPGNKPSNTLLLDTLSPKNFGALIALYEHKVFVQGSIWNINSFDQWGVELGKKMANQLLASDNSGQAELDPSTTALFAHIKKCQE

SEQ ID NO: 47907 - protein, 246 aa, Oryza sativa (indica cultivar-group)
MSVYYETLCPFCSGFVVNDLARIFRDGLSPVVDLRLVPFGNGRVSPDGSITCQHGEEECQLNAIEACVIRLWPDAEQHFPFINCIEHLALTQKWNAWQSCFQETGLASQPVMDCYNSGYGTQLQLQYAAETNALQPPHQFVPWVTVNGRPLGDDYTNFEAYICRAYDGELPEACRGKHLAIAQQTRASRGGKIHKPDRCPCSCNAEESTKVGRSTCLLHRGVVLTSLERHFVEKTQTVQDQMKLTK

SEQ ID NO: 47908 - protein, 352 aa, Prochlorococcus marinus str. MIT 9303
MQLSSRPSSLVLDHHQNKFLTPWSDPADPQILFPIQPLEHLLVQLGWPDPQAWLIHWQNRGGISLKRPFWHPSTRTDWIWGLGLPLLTLVEGCLGKSDRSLLGITGLPGCGKTSLGCWLEAAAGELGWPIKVISLDDFYWPFPELDRSMSGNPWRVPRALPGSHDLDLLASVLDTWQSTGHLKAPMFDKALRHGRGDRDGWHLSDPKVLVIEGWILGCLPCKFEEADKFSDQLVPPLNKLEHDYRLVVQDALNGYVPIWDRLDTLWHLKAIDPSSTRIWKANQESLMQLNRGVCLDQESFEGFVRMILASIPLTCLDGIEADVVATLTPARQLMWVGQRGYQDSSSSDSCIG

SEQ ID NO: 47909 - protein, 324 aa, marine gamma proteobacterium HTCC2207
MTEQRWNLVADIGGTNARFAALHEGQLESEFEFYHSVEEYPQFSDLIIKLRDEIALATGFVGAPHSVCLAVACPADVEHVSFTNSHWEFTKTHLLEWFDCQELVVINDFEAVAHGITELGADDCIKIGGGEPQAHKPIGILGAGTGLGMAALISHSDGYHVLDTEGGHADFAPVGQRQMDVLTCLRQNFKRVSLERVLSGKGIVNIYNAICQMEGTDPTLTTPPDVVTAALANSNPQALTALDTFCESMGAAAGNLALTLGARGGIYIAGGVVPRFSEFFVNSGFREKFEDKGRFASYLQPIPVYLVTRNNLGLLGAAKKLQNT

SEQ ID NO: 47910 - protein, 1693 aa, Gibberella zeae PH-1
MATKTLARPDEPGVHARDPRSLHPQDETSKIVGNSASIPSDNNEPPTNSNEFESAEHSSKKSLVQIATVMASLCACVFLAALEVTIVSTALPTIAAHFTSDSGYTWIGTSFVLAHTASTPSWGKISDIWGRKPILLIANVIFFAGSLLCALVDDLAIFIAGRAIQGLGAAVWAVASGVGPILGGAFTVRLSWRWCFWINLPITVAVFFLLVLTLRLPSPNTPVWAGLKAIDWPGSFLIVGGTLMLLLGLYLGGVYEPWNSATVVCLIVFGIITALLFVWNEWKLAEYPVIPVHLFKTWSSSAAYAVTFFHAFVFMGVAYYFPLYFQAVLLASPLRSGIYLLPFILSISISAAITGIYIQFSGKYLLVSRAGLALMTLGMGLMMNLGMDLNWAKMITFQLLTGIGVGMNFEGPLLSVQAVVPHEDVAAATTSMGFTRTIATAISVVIGSVLFQNEMKGKNKALLGALGPELARMFDGASASANIDLINTLPAESQLIVRAAFFHSLDKMWILLIVYCILERWAVAQFLYEGSAPEQRPQRRTSGHCQRFEQNDENHELRHIPTKARGSDESVTRYFERSTLAQQAITTAMNKSFPSSPLTVRNASTLDSLSDAPITNKTDDSPTIPLLQDHRGNSASSEVSMHQEFIDNEAAIKTLAKIDRTIIPLLFITYMFNFMDKVILSSAAVFGLREDTYSWVGSVFYLGYFLWTYPTTILIANLPAGKYLTVNTIFWGLVVVFTAACQNFGGLLTMRFLLGIAEATITPGFMFLTSTWYTRDEMPTRVGIWFSGNSVGGLVASLLAFGVGHIESTTIRPWRWMYMILGTMTFLWSIPLFFLLPDNISKAAFLSPEERKIAAKRVSTSGTGKTEGTRWRWDQLRECLVDPKSWFIVGIELFTQIPNGGSQSFANIVVASFGFTNLQSTLINIPYSLLSAGVIAGSGYLAGRFRTLNCLLIIAVIVPCVIGSAVIYKRSHVPQSLHLFAYFLLSTGSAAMPLTMTLVQSNYRGVTKKMTITAMLFVTYCLGNMAGPHFFLKSEDPLYETAFKAITVCYSLAILCALGLRVYLKRLNASRTKEEGVVGSAGSGGFARECAEEQSSDLATDSEDVTDWQSTSECEVAVAKCSQSFQHQFVKLADYHSKMSWRNQGITGSNNIPLGKRRFGDEEEEKFDGGDAAVDRDLKRGRDPEPRSEADGPRRRKKRNRWGDASENKAAGLMGLPTAILSNMTSEQLEAYTLHLRIEEISQKLRIDDVVPADGDRSPSPAPQYDNHGRRINTREYRYRKRLEDERHKLIEKAMKTIPNYHPPQDYRRPTKTQEKVYVPVNDYPEINFIGLLIGPRGNTLKKMEGDSGAKIAIRGKGSVKEGKGRSDAAHASNQEEDLHCLIMADTEDKVNKAKKLIHNVIETAASIPEGQNELKRNQLRELAALNGTLRDDENQACQNCGKIGHRKYDCPEKQNYTASIICRVCGNAGHMARDCPDRQRGASWRNTDAAARPAGRIGSGDAVDREYEQLMQELGGGSSGPPARIEAGPGAQDNGSAKPWERGPTGGPAPWRSRNQDSNEGGSAAPWARERGGRNQDNAAGNGGDSYYGQAYGGASGAAAPWQQQAPGTQAGYGAYPGYGAYGAAPGMAAPPGLGAAGGAPPPPPGAPPGLGDINAFIQQYAGAAPPPPPPSGDAPPPPPSDQPPPPPPPGA

SEQ ID NO: 47911 - protein, 477 aa, Chlamydophila pneumoniae CWL029
MLCATVSGPSFCEAKQQILKSLHLVDIIELRLDLINELDDQELHTLITTAQNPILTFRQHKEMSTALWIQKLYSLAKLEPKWMDIDVSLPKTALQTIRKSHPKIKLILSYHTDKNEDLDAIYNEMLATPAEIYKIVLSPENSSEALNYIKKARLLPKPSTVLCMGTHGLPSRVLSPLISNAMNYAAGISAPQVAPGQPKLEELLSYNYSKLSEKSHIYGLIGDPVDRSISHLSHNFLLSKLSLNATYIKFPVTIGEVVTFFSAIRDLPFSGLSVTMPLKTAIFDHVDALDASAQLCESINTLVFRNQKILGYNTDGEGVAKLLKQKNISVNNKHIAIVGAGGAAKAIAATLAMQGANLHIFNRTLSSAAALATCCKGKAYPLGSLENFKTIDIIINCLPPEVTFPWRFPPIVMDINTKPHPSPYLERAQKHGSLIIHGYEMFIEQALLQFALWFPDFLTPESCDSFRNYVKNFMAKV

SEQ ID NO: 47912 - protein, 689 aa, Gibberella zeae PH-1
MADLITLATCSLNQWVLDWEGNLGRIRKSIILAKEAGATLRTGPELEITGYGCLDHFLEADVYDHSLESLLAILTDTELHGILIDVGLPLMHRGCRYNCRAIILDGKLLCLRPKIYLANDGNFRENRFFTPWNRPRYVEQYNLPPALQKHQGVRQVPIGDVILSLNDTTVAAETCEELFTPQAPHINMALNGVEIFTNSSGSHHTLRKLNERLALISEATRKSGGVYLYANQSGSDGDRLLYDGSSLIMVNGNIVAQGSQFSLDDVEVITATVDLEEVRAYRFAPSRNFQAVQAPVYERIEVDFSLGVEDLDLLRAPTPPRPARYHVPEEEIALVLVRRSKASGYLVPLSGGIDSCATATIVFSMCRLVVAAIKAGNEEVIADVKRIAVYSDKLPETAEEFCNQIFHTVYMGMEKQSSKETRQRAKDLSARIGSYHTDMNIDDTFNATKNLLTQATGFEPKFKVHGGSATENLALQNIQARSRMVVAYYYAQMLPTVRQRPGGGSLLVLGSSNVDECLRGYLTKYDCSSADVNPIGSVSKTDLKRFIAWSAKSFNMPILEEFIHATPDMGMTYDELSRFGRLRKESKLGPYGMFLRLLEEWGGEGKMTPRDVATKVKRFHGFHYINRHKQAVATPAVHVENYSPDDHRFDLRPLVYPSPWNSWSFEKIDKRVEAIERAMEKKKKTEISK

SEQ ID NO: 47913 - protein, 582 aa, Blastopirellula marina DSM 3645
MRILQGIAVSPGVAIGEAVVIDDKGYRIPRRFIARGAVESEMQRLEGAFAAVGKQIEQSRDEIAGELGQQYGAIFSAHLQMLQDAKLRTEIDHLVKQRHYSAEYAITRALGKYSKFFENLPTAYLRERANDVHDIERRLMGELIGNRREALEEIKSPVVVLANNLTPSETANLNREMVLGFVTEVGGPGGHTAIVAEALEIPAVVGVGDFLNEVSGGDLVIVDGDQGRVIFQPDDETIARYEQEVEEHRSLAARLDLLRDLPSELLSGEQIHLYANIEFPHEVDACLQRGAEGIGLYRTEFLYLGQEQEPTEEDHYQVYAKVVQDMGGAPVVIRTLDLGADKIARAPNESRVAEANPFLGLRSIRLSLRNISLFRTQLRAVLRASMIGEIHVMFPLVSTLHELRQAKMLLTDIMEDLDEEGIPYDRNLKIGMMVEVPSSVIMLDHFAKEVDFISIGTNDLVQYTLAVDRSNKEVAALYNNCDPAVLRLIEMTVRLAKEADIKTTLCGQMGGNPIYAMLLIGLGLRSLSITPSAIPEIKKVCRSVSLAQCEEVARRVREMENAREIKRYLREEVRRAVPELMM

SEQ ID NO: 47914 - protein, 258 aa, Desulfitobacterium hafniense Y51
MFDERALIALLLSFIAGMATLLGALIIFVTKSKNEKILSASLGFAAGVMLSVSFLDLWTQSQASLISYMGHKMGLLLSVVFLLGGILFALGIDHFVPHEEPSPNEKDKPHQNLYRVGFVSMLAIMFHNFPEGIATFSAGYEDLTMGISIAVAISMHNIPEGITVAMPLYYATGKKKDAFKYTFLSGMAEPFGALLAFLVLRPFINSFNLGAIFAIVAGIMIYIAIEELIPSSRQYGHPRLALFATFAGIIIMPLSHIF

SEQ ID NO: 47915 - protein, 517 aa, Brassica napus
MIEITAVRKVFLIGFLILILNWAWRAVNWVWLRPKRLEKYLKKQGFSGNSYRVLMGDMSESNKMDQVAHSLPLPLTADFVPRMMPFLHDTVLNHGKKCFTWYGPYPNVTVMDPETLREIMSRHELFPKPKIGYHVFLSGLLNHEGPTWSKHRSILNPAFRIDSLKSILPAFNSSCKEMLEEWEKLASPKGTVELDAWTYCHDLARNMLARASFGDFYKDGINIFQIHQEQIDLSLQTIRSVYIPGSKFLPTKFNKRLRETERDMRAMFKAMIETKEKEIQRGRDTNKNADLLCSMLASNTKQIIEQGPASGLSLDDLIDDCKAFYLAGQSVTASLFVWTLVALSQHQEWQNKARDEISKAFGNNEPGFEGLGHLKVVSMILHEVLRFYSPAYFTCRITNQEVKLERFSLPEGVVITIPMILVHHDPDLWGEDVKQFKPERFVNGVASATKGRLSFLPFGSGPRTCIGQNFSMLQAKLFVAKVLQMFSVELSPSYTHAPFPAATTFPQHGVHLIIKKV

SEQ ID NO: 47916 - protein, 309 aa, Nicotiana tabacum
MAGSGVVTLYGNGALTETTKQSPFSVKVGLAQMLRGGVIMDVVNAEQARIAEEAGACAVMALERVPADIRAQGGVARMSDPQLIKEIKQAVTIPVMAKARIGHFVEAQILEAIGIDYVDESEVLTLADDENHINKHNFRIPFVCGCRNLGEALRRIREGAAMIRTKGEAGTGNIIEAVRHVRSVMGDIRVLRNMDDDEVFTFAKKLQAPYDLVMQTKQLGRLPVVHFAAGGVATPADAALMMQLGCDGVFVGSGIFKSGDPAKRGRAIVQAVTHYSDPGLLAEISCGLGEAMVGINLDDKVERYANRSE

SEQ ID NO: 47917 - protein, 487 aa, Zea mays
MNTNYSALPLTSPSIELQPNGAKSSAAANGVLNGHAKISRQDSFLGEVEDDGGGAGEHDELPLIGDGPAGPPEGSDVTAAVFNLATSIIGAGIMALPATMKVLGVAAGLVSILVMGVLSEITVELLVRFSAHCRALSYGEVVHRAMGRPASIVAQMCVIINNAGVLVVYLIIIGDVMSGSLKHIGVMDQLVGHGEWDNRKLLILVVLVIFLAPLCALEKIDSLSMSSAASVALAVVFVVVSSIIALIKIAEGKISMPRMGPDFSSRAAMLDLLVVIPIMTNAFICHFNVQPIYNELKEKTPQNMYKVGRISTVLCVAVYALTALSGYLLFGEDTESDVLTNFDKDLGIRFSSLLNYIVRIGYVIHLVLVFPVVHFSLRQTVEALIFGELATPSRKRTFTLTVVLLALIYLGSTMIPNIWMAFKFTGATTGLALGFMFPALVALRLDKEGSHLGHGERLLALGLLGLSILVSVIGVVGNVYTLKSKSE

SEQ ID NO: 47918 - protein, 297 aa, Salmonella typhimurium LT2
MAKALQGVMAALLTPFDHQQQLDSESLRRLVRFNIGQGIDGLYVGGSTGEAFVQSLAEREQVLEIVAEEAKGKITLIAHVGTVSTAESQQLASAAKRYGFDAVSAVTPFYYPFSFEEHCDHYRAIIDSADGLPMVVYNIPALSGVKLTLDQINTLVTLPGVSALKQTSGDLFQMEQIRRAHPDLVLYNGYDEIFASGLLAGADGGIGSTYNIMGWRYQGIVQALREGDVAKAQRLQTECNKVIDLLIKTGVFRGLKTVLHYMDVVSVPLCRKPFAPVDEKYLPALKALAQQLMEEKA

SEQ ID NO: 47919 - protein, 456 aa, Myxococcus xanthus DK 1622
MRQFPNDFLWGVATSAFQIEGATSADGRGESIWDRFAATPGKISDGSDGKVACDHYHRWREDVALMRWLGVKSYRFSVAWPRVLPTGRGAVNAAGLDFYSRLVDGLLDAGIEPFVTLYHWDLPQALQDLGGWPSRDTASAFVEYADVMSRKLGDRVKRWITHNEPWCISVLGYGNGEHAPGHKNWGEVLATAHHTLLSHGQAVPVIRANVKNAEVGITLNLSPAEPASPSPEDAEACRRHDGSFNRWFLDPLYGRGYPKDVVEDYVKDGRLASSALPFVRDGDMAAIAVPTDFLGINYYSRAIMRSDRIPESQNAPRTVHPEPERTDMDWEVYAPALTRMLVHLHTDYQPGPLYITENGCAYATGPSEDGKVHDDKRVAYLRSHLEASLEAIRQGVPLAGYFAWSLMDNFEWAFGYQKRFGMVYVDYDSQRRIPKDSAHLYKALVEKNGLDVELAA

SEQ ID NO: 47920 - protein, 353 aa, Synechococcus elongatus PCC 6301
MSKIRVGINGFGRIGRLCLRAGFDDPQLDFVAINDLVPAKNLAYLLHYDSTHGRLQQTVRAEEDRICAGDRCIQCFSETDPAAIPWGELGVDVVIEATGRFTDYAAASRHLEAGAQRVVISAPTSEKDPDRVPTFVYGVNHQNYDPQQHRILSNASCTTNCLAPIAKVLQEHCGIEDGLMTTIHAVTATQPTVDGPSRKDMRGGRSAAQNIIPASTGAAKAVGLVLPELQGHLTGMALRVPTADVSVVDLTFRSRQSTTYAAICEVMQKAANTQLQGILGYTEDDLVSSDFIGDARSSIFDATAGMALNDRFFKVIAWYDNEWGYSNRMLDLIRYMRSVEQQPAWAPRSLTPA

SEQ ID NO: 47921 - protein, 463 aa, Moorella thermoacetica ATCC 39073
MTGEKIISLETALQAGRQETRDLYRRYINPGLATMLALLDFDKAFVRAEGMAVWDKDGKRYLDFLGGYGALNLGHNPPEVLAAVKEAMGRPNLLQASLNPLAAALAHNLAQVTPGDLERVFFSNSGTETVEGALKLARASTGREKIIYCQNSFHGKSFGSLSVTGRQKYQRPFGPLLPGCEAVPYDDLEALEAKLSRRDAAAFIVEPIQGEGGVIVPHDGYLKGARELCDRYGSLLIIDEIQTGFGRTGYLFACEHEGVVPDIMCLAKSLGGGVMPIGAYIARPAVWDRAYGGMDKALLHTSTFGGNSLATAAGLAALQSILDQDLAGRAAAMGRYFLERLRQLKEKYDLIKDVRGRGLIIGLEFNQPVGGLLDKLTRGKVNELAGEYFGSLVAGELMNKYQVITAYTLNNPNVIRLEPPLIVGEEEIDHVVNALEAVLRGHGFLGVTLSSTRTALGSLFKRK

SEQ ID NO: 47922 - protein, 342 aa, marine gamma proteobacterium HTCC2207
MYRIAINGFGRIGRNIVRALYERPELREKIQIVAINDLGSLEISAHLLQFDTVHGRFNQQVEVTDNAIVINGDVINWSSERNPTDLPWADLNVDLVCECTGVFTSREKAAMHIEAGAKKVIISAPGTNVDATVVYGVNDHILDGTQEIISNASCTTNCLAPMVQPLQESIGILSGYMTTVHAYTNDQQLSDVCHSDVYRSRSATQSMIPTKTGAAVAIGLVLPELAGKLDGLAVRVPTINVSLVDLTFNAGRETSVEEVNELLLKASQGTLKSVLCYNDKPLVSVDFNHTPFSCNFDATQTRVNGSLVKVMAWYDNEWGFSNRMLDNSLVLLASTTEQKDAA

SEQ ID NO: 47923 - protein, 375 aa, Arabidopsis thaliana
MEVRVSTTTSEGHLTSAAAFVEGGIQDACDDACSICLESFCESDPSTLTSCKHEYHLQCILEWCQRSSQCPMCWQSISLKDPTSQELLEAVEQERNFRFNPTRNATIFRHPTLGDFELQHLPVGVDNAEIEERIIQHLAAAAAMGRARHGVRREGHRSRSSSQGHQQFMVFSSQPNASSPPPHPPMPSSPSQRDESDTVSNLPHNALGEGSHQSNTQPPTSSHPRQVSPSASDSNSRPLNQSSPSEQDRAGPSELQSFSESLKSRLNAVSTRYKESISKNTRNWKDRLFSRNTSMADLGSEVKREVSAGIATVSRMMERLETRENSRPSTASVSDVSENHTPETNNEHNRAAAGDEHSVNERGVKETCATGSGSS

SEQ ID NO: 47924 - protein, 490 aa, Pseudomonas syringae pv. syringae B728a
MARFELQKLYIDGGYVDASNPETFDAINPANGEVLAQIQRAGKDDVERAVVAAEKGQKIWAAMTAVERSRILRRAVDILRERNDELAALETLDTGKAISETRYVDIVTGADVLEYYAGLVPAIEGEQIPLRDSSFVYTRREPLGVVAGIGAWNYPIQIALWKSAPALAAGNAMIFKPSEVTSLTTLKLAEIYTEAGVPNGVFNVLTGSGREVGTWITEHPRIEKVSFTGGTDTGKKVMASASSSSLKEVTMELGGKSPLIVFDDADLDRAADIAMMANFYSSGQVCTNGTRVFVPNALKAEFEAKILERVKRIRAGNPEDENINFGPLVSFEHMESVLGYIAKGKEQGARLLCGGDRLTGGVFDKGAFVAPTVFTDCTDEMTIVREEIFGPVMSILGYDTEDEVVRRANDTDFGLAAGIVTRDLNRAHRVIHLLEAGICWINAWGESAAQMPVGGYKQSGVGRENGISSLAQYTRIKSVQIELGDYASVF

SEQ ID NO: 47925 - protein, 671 aa, Oryza sativa (indica cultivar-group)
MFGRARCSTSAPAAGERRALPVDPLSLPRLLVSAATTPGAAAPAVSTLHAAALKLGVLPSSLPASNALVSAYSLSGLLPCALRAFSLIPHPSTGSYTAILSALSRHGRPREALSLFSAAAVARPDAELLSCVVSCCRRASASLPARAAHAYGVKTAPLLAFYASAGPALVALYAMCGRVSAAKRIFDRMDGEDVVSWNAMIGGFAGAGMNGEAWDCFRVMRARGVRGNARTAVAVLGACDLESGRQVHGHMVRNHGDSGSNAILWNALMNMYSRVGCVDNAEHVFFEIERKDVVSWNVMIGAFAKNGHGERALELVDAMLRCGMQPDSVTFTTLLMACCHCGLVDEGLALFERFVENSALIPTMEQCACIVDLLSRAGRFREAAGFIDQMPIRPNAVVWGALLSGSRMHHDVDHAQIAFEKLVQLEPDNPGNFVTMSNIYAKAGMVEDAKRVRMMIDREELVKPSGQSRVQAIHHDLSTVLQSAATLMHPLPTVHLVSTIGYGQGLFTKRGFKGLFSTQGPLPRHLAHNINLSDQSFAVLSGVHCLVVCLLRRLRGKDDIVNAGIAGCCTGLALSFPGDRVPARSRRWSAGVVPQVDGGGGDDDGTGPKPRGRGRADREETWCPDLEKTFHSEADGGGGRQRWLGLEMFAPALSPVTKRPASNSSGSPMSG

SEQ ID NO: 47926 - protein, 547 aa, Lactobacillus plantarum WCFS1
MTKTASEILNNPFLNKGTAFTKEERQALGLTGTLPSKVQTIDEQATQAYAQFKSKPSRLEQRIFLMNLFNENRTLFFHLMDEHVVEFMPIVYDPVVADSIEQYNELFLDPQNAAFVSVDAPEDIEATLKNAADGRDIRLVVVTDAEGILGMGDWGVNGVDIAIGKLMVYTAAAGIDPSQVLPVSIDAGTNNQKLLDDPLYLGNRHKCVSGEQYYDVIDKFVAAEQQLFPDSLLHFEDFGRDNAQVILDKYKDQIATFNDDIQGTGMVVLAGILGALNISKESIKDQKILSFGAGTAGMGIANQILDELMQAGLTEEEAKQHFYAVDKQGLLFDDTEGLTPAQKAFTRKRSEFSNADELTNLEAVVKAVHPTVMIGTSTQPGTFTESIIKEMAAHTERPIIFPLSNPTKLAEAKAEDLIKWTDGRALVATGIPADDVEYKGVTYQIGQGNNALMYPGLGFGLIASTAKVLNAETLSAACHALGGIVDTSKPGAAVLPPVAKITEFSQKLAEVVAQSVIDQKLNKEPIADAKQAVADMKWVPEYRAISK

SEQ ID NO: 47927 - protein, 435 aa, Pseudomonas aeruginosa PAO1
MSHRIVIVGGGAGGLELATRLGRTLGKRGKAQVTLVDANLTHIWKPLLHEVAAGSLNSSEDELNYVAQAKWNHFEFQLGRMQGLDRAGKRVRLAALVDENGVELVPERDIAYDTLVIAVGSTTNDFGTEGAAEHCIFLDTRAQAERFHRQLLGQYLRAHTGHDANNNAVSIAIIGAGATGVELAAELHHAAQMLAAYGLDRIRPEDLHISLVEAGPRVLPALPERISQPVHQTLSKLGVRVMTGSAVSKVDADGLWTGDGEFVPATLKVWAAGIRAPAFLKELDGLESNRINQLVVRPTLQTTRDDDIFAFGDCAACPQPAQPGEQPRNVPPRAQAAHQQASLLVKSLRARLEGKPLGEYHYRDYGSLISLSRFSAVGNLMGNLMGSVMLEGWLARMFYVSLYRMHQMALYGPLRTAMLMLSGRLRSTEPRLKLH

SEQ ID NO: 47928 - protein, 179 aa, Zea mays
MDHAAEAQRTDLMTITRHVLNEQSRHPESRGDFTILLSHIVLGCKFVAAAVNKAGLAKLIGLAGETNVQGEEQKKLDVLSNEVFVKALVSSGRTCVLVSEENEEAIFVDPALRGKFVNPLLLHPDLVKVPQRRTVAFPDRVLVLSLSLFRYCVCFDPLDGSSNIDCGVSIGTIFGIYMV

SEQ ID NO: 47929 - protein, 471 aa, Kluyveromyces lactis NRRL Y-1140
MFKRYLLQYPRQFHTARLLRQEFKDPYKVLGINKNSSQSDIKKAYYKLAKKYHPDINKEEDSQKKFHDLQNAYEILSDEDKRKQYDQFGAAAFSQAGGAGGPGGAYGGAGAGGAQGFGGFGGFDFGGLNFEDLFGSAFGGGGGGGAGGRRAGSHGAGFGGSDFVREYKGENVTVPFQVSFKDAVFGVKNVKLNYQCYDPCSSCDGSGLKAGHSRSVCPTCHGTGTQVHVRAGFQMASTCQTCDGEGSTIKDSDKCGTCHSHGFKLNSNKTITVDLPHGLQDGDTIRVPNQGSYPGMAIDPSMKSELHLTRGDLLIRVRVRKDTRFQVSNNYDIIYTQEIPITTAALGGVIEVPTVEEEKIRLKVSSGTQHDQVIRIPNKGVPRGARGDRGDMLVKFKIVIKKPKDETERYLWETLAHLTNDTTARRTITPSGSSAKDNSSSADKDTVENNEGTIKKLENFLSNTLKKIRGE

SEQ ID NO: 47930 - protein, 475 aa, Lactobacillus plantarum WCFS1
MKASQRLLVKKSVNPANFNKGGLEKTLSAFSLTMMGVGAIVGSGIFITPGIIAAKYAGPAAMLSFVIAAVVCSLAALCYAEFSSTIPLAGSAYTYVYTVFGEFLAWILGWSLISEYLFAVSSVAVSWSSYFQNLMSGFGLKLPTFLTAAAGTAGVSGAGFNLIAFVVVLAVSLLLVGGLQESTRVNSIMVIVKILVIVLFIGVAIFFVKPANYHPFMPHGVSGLVKGASLAFYAYIGFDAVSTASEEVKNPKRNMPIGIVGSLVVASILYVAMAAVLVGVVHYSKLNVGDPVAYALAVIHQNWAAGIVSLGAVVGMTTVLIVMLYGGTRLLFAISRDGLLPKVFRTVSPHTKVPVKSTWIFGIIASVFAAVIPLDKIAELVNIGTLFAFAMVSIGVVFLRRHETLQQINSSFKVPFYPVLPVVSFLACVYLMLNLQAFTWHMFGIWLVIGIVIYFAYSYRHSRIRAGLRAKESKS

SEQ ID NO: 47931 - protein, 291 aa, Chlamydophila pneumoniae CWL029
MHLLTATVTPFFPNGTIDFASLERLLSFQDAVGNGVVLLGSTGEGLSLTKKEKQALICFACDLQLKVPLFVGTSGTLLEEVLDWIHFCNDLPISGFLMTTPIYTKPKLCGQILWFEAVLNAAKHPAILYNIPSRAATPLYLDTVKALAHHPQFLGIKDSGGSVEEFQSYKSIAPHIQLYCGDDVFWSEMAACGAHGLISVLSNAWPEEAREYVLNPQEQDYRSLWMETCRWVYTTTNPIGIKAILAYKKAITHAQLRLPLSIEDFDLENVSPAVESMLAWPKLRTSVFSYS

SEQ ID NO: 47932 - protein, 515 aa, Prochlorococcus marinus str. MIT 9303
MMTYTITTPLYYVNDKPHLGSLYTTMASDALARFQRLEGKQVMFVTGVDEHGQKIQRTAEVNNISPQQHCDQITRSYQNLWSRWDISNDRFIRTTSHRHQLLVEAFFQRVETSGDVYLGRQQGWYCVDCEEYKDEPPQAQSPSCPIHQKPLEWRDEENLFFRLSRFQSQIEDLISQPDFIWPVSRRNEIQNFVAQGLRDFSISRIDVDWGLPVPGYPKHTFYVWFDALVGYLSALLDDGGQVRIERLVECGWPASVHLIGKDILRFHAVYWPAMLSSAGLPLPKQVFGHGFLTREGQKMGKSLGNVLDPEKLIEVCGEDAVRWYLLRDIQFGHDGDFQQKRFMDLVNNDLANTIGNLLNRTSTMARKWFEGSVPSHRNEIDYAHPLVTTAETTITIVRQSMPSMAFHDAAEAILKLAIAANVYLNETAPWSRMKTPGNEAEVADDLYSVLEACRLVGLLINPLVPSLSERLLNQLGLSIDSNDWSNSLAWGQLQSGALLPPSQPVMQRLELSSSL

SEQ ID NO: 47933 - protein, 363 aa, Gibberella zeae PH-1
MTPVEFDCLSEPRATCICNSPVQSSYIALGCEGSANKLGIGVILHTPTETKILSNLRDTFVSPPGTGFLPKDTAAHHRAHFVRLAREALAEAKITPADVDCICYTKGPGMGAPLNSVAVAARALSLLWDRPLVGVNHCVGHIEMGRYITGAENPVVLYVSGGNSQVIAYAEQRYRIFGETLDIAVGNCLDRFARTLEISNDPAPGYNIEQLAKKGSKLLDIPYAVKGMDCSFSGILASADALAAQMKAGADFTPEDLCFSLQETVFAMLVEITERAMAHVGSSQVLIVGGVGCNERLQEMMGHMARERGGSVYATDERFCIDNGIMIAHAGLLAYETGFRTSLEESTCTQRFRTDEVFIKWRD

SEQ ID NO: 47934 - protein, 560 aa, Podospora anserina
MSSARPATPASPKNYKVKAAQQGQPMYGCEHLQKLFNQDQVTTNTSIHHYKMILRTIFDQTPVVSQTVKVVDTQQVVTTLTPTYLCLQCPSTVTEEDRIKHGNKKSHRFYVDSRSAALYCQMCDDMVYDPTFEELRLKKLGTSTFSNTRKRKQDELFSPDPVKDSPAYISQNTTTATCKANGLRGIYNAGATCYQNVVLQSFLHNPILRNYYLSDGHSGCDTPHCLSCAMDDMFQDFYAVENTNGYTAANILSGFWISERKAFENLVTTKEQDAHEFFQFLAEELHERNGDGKKPEIGSEHSCNCIIHQTFYGKLQTQTTCQNCQGVTNQVQSFLDLSLPLENLTQKKGGKKLLGGKGTMTLQECLDEEYVKLDKCEYRCNGCNSTQQARRQTSIKRLPNVLSIQLKRFEYKQGRHERAAKIDTPVQFPLQLNMLPYTTVGRSGDTKDSYELARQCTYDLLSVVVHVGEIDTGHYVSYCRVGDQVCPFFSLWKMAMLTRLKVVRFQRPQGGSCPEVGRAQRKSLPLVLYCQVVDVGTLLGFLGRAGWTVSISSNGTGPTF

SEQ ID NO: 47935 - protein, 487 aa, Silene latifolia
MSTQAHRNRLLGTENGNGGGGVKVVNNPKLTKKRPPLSNLTNHPRPSLVPSAITKSTKAKRDSSTGVRSTSFPAENPSATLNSKPSAVVPLKTAFTRSNVLVSCKASLPNGKGEQSHITRHPASCTMDTTPTPEDAQSVSMDESMSTCDSLKSPEVEYMDENDVAALCSIERKTSKNLYISDDMETTGSFCKREIVSAMEIDKVVDVDDNHMDPQFCSTIACDIYKHLRESETQKRPSTDFMEQTQKDINASMRAILVDWLVEVAEEYRLVPDTLYLTVNYIDRYLSGNAMNRQRLQLLGVACMMIAAKYEEICAPQVEEFCYITDNTYFKEEVLQMESGVLNFLKFEMTAPTTKNFLRRFVRAAQVMNEVPAFQLECLANYVAELSLLEYSMLKYAPSLIAASSVFLAKYMLTSSRPWNATLRHYTLYEASDLEECVKALHQLCLNSHISSLPAIREKYSHHKYKSVAKKHCPSSIPAEYFQNSSC

SEQ ID NO: 47936 - protein, 899 aa, Oryza sativa
  misc_feature (866)..(866): Xaa can be any naturally occurring amino acid
MAPPENPNGAGPAAPSDPAQPQPQPPAKSKWKKKDEKKDDDLSEEDLALKEQLELYVVRAQDADPGVQKLALESMRQEIRSATSSMTSVPKPLKFLRPHYGTLKSYFETMPESSDLKRYMADILSVLALTMSAEGERESLKYRLLGSEGDIGSWGHEYVRNLAGEIAQEFQKRQDDDMPIDALMELVQQIVSFHMKHNAEPEAVDLLMEVEDLDLLVEHVDSTNYKRTCLYLTSSSKYLPAPDDMLALDIAYTIYMKFEDLTSALRIALLLDNKSMQYVKQVYTATEDLQLKKQFSFIIARHGLAMEIDDEIAADGNDKEGLQEIVNNSKLSEGYLTLARDIEVMEAKSPEDIYKVHLIDGRGASSSLDSARQNLAATFVNAFVNAGFGQDKLMTAPSDSSSSGASGNWLFKNKEHGKASAAASLGMILLWDTDSGLAQLDKYLHSNDAHVVAGALLGIGIVTCGVKNDCDPALAILMEYINKDDTNIRIGAILGLGIAYAGSQKEELKSYLSTVLGDSEKSTLEVLIFSAIALGLVFVGSCNEEIAQSIIFALMERSEAELAEPIIRLLPVALGLLYLGKQESVEATAEVSKTFDEKIRKYCDVTLMSLAYAGTGNVLKVQKLLGICSQHLEKGETHQGPAVLGIALIAMAEELGAEMAVRSLERLLQYGEQNIRRAVPLALGILCISNPKVNVMDTLSRLSHDADADVSMAAIISLGLIGAGTNNARIAGMLRNLSSYYYKEAAHLFCVRIAQGLVHLGKGLLTLSPYHSDRFLLSPMALGGLVTVLHACLDMKSTILGKYHYILYIIVLAMQPRMLLTVDEDLKPLSVPVRVGQAVDVVGQAGRPKTITGFQTHSTPVLLAAXGERAELATEKYILLTSVLEGFVILKKNPEYNEE

SEQ ID NO: 47937 - protein, 409 aa, Oryza sativa
MEYGAATRGALLAAAPLSGARRSWLPLSSPPSPPSIQIQNRLYSISSLPLKARGVRRCEASLASDYTKASEVADLDWENLGFGIVQTDYMYITKCGQDGNFSEGEMIPFGPIALNPSSGVLNYGQGLFEGLKAYRTTDDSILLFRPEENALRMRTGAERMCMPAPSVEQFVDAVKQTVLANKRWVPPTGKGSLYIRPLLMGSGAVLGLAPAPEYTFIIFVSPVGNYFKEGLAPINLIVEDKFHRATPGGTGSVKTIGNYASVLMAQKIAKEKGYSDVLYLDAVHKKYLEEVSSCNIFVVKGNVISTPAVKGTILPGITRKSIIDVALSKGFQVEERLVSVDELLEADEVFCTGTAVVVSPVGSITYQGKRVEYAGNKGVGVVSQQLYTSLTSLQMGQAEDWLGWTVQLS

SEQ ID NO: 47938 - protein, 543 aa, Burkholderia xenovorans LB400
MKHMFEAGLERREANYIPVTPIDFIVRAAEVYGDRLAVVHGEIRRNWRETYERSRRLASALQRAGIERGDTVAALLPNIPPMIEAHFGVPMAGAVLNTLNTRLDISSLLFMLRHGEAKALIVDTEYGEFAHRASLEFPDLRVISVADAMPANADQFIRATDYEAFLQSGDPEFAWTMPADEWDAIALNYTSGTTGDPKGVVYHHRGAYLNAVSNILEWDMPKHAVYLWTLPLFHCNGWCFPWTVAARAGVNVCLRKFDAKTVFDLIRNEGITHYCGAPIVQSALANAPAEWRDGINHRVSTMVAGAAPAPAVIAKMKEIGFDLTHVYGLTETYGPAAVCAKQEAWETLDDSARAELNARQGVRYHLQAAVTVLDPQTLALVPNDGETIGEIMFRGNICMKGYLKNERATEAAFEGGWFHTGDLGVRMPDGYIRIRDRSKDIIISGGENISSIELEDTLYRHPAVAVAAVVAMADPKWGEVPCAFVELKEGAQVSAEEIIAHCRLFLAGYKLPKAVRFGELPKTSTGKIQKFELRARIKTEENQ

SEQ ID NO: 47939 - protein, 119 aa, Synechococcus elongatus PCC 6301
MTVGILGVGRWLVLGLLVIGLSVVNPARAIAADLQVGARLFQSNCTTCHLNGGNVINGQKTLRQEALRRYGMDSVAAIQKQVTYGKNAMPAFGQRLSPEQIEAVATYVFDRAERGWTAL

SEQ ID NO: 47940 - protein, 524 aa, Oryza sativa (indica cultivar-group)
MANRRKFSQAGGGGGGGVFDPFGTKQAVSSLRKGGRLPVYVAGVFFVIFVIIMYGEDIRSLTLDPIARAGTTPARIVEPVVTEERHVARVNPPRREVSSAEKAAALPLDVDERPKLATPTPTEAAKEVPKVEKIRKPKKPKTTKKKPRKPRPAKKTVAAAAGGLLGVPETCDLSKGEWVFDNTSYPLYREEQCEFLTSQVTCMRNGRRDDTYQKWRWQPKDCSMPRFDAKLFMERLRGKRFMFVGDSLNRNQWESMVCLVQSAMSPGKKYVTWEDQRVVFHAVEYNATVEFYWAPFLVESNSDDPKIHSIQHRIIKADAIAAHAQNWRGVDYLVFNTYIWWMNTLNMKIMRPGGQSWEEHDEVVRIEAYRKVLTTWASWVNDNIDPARTSVFFMSISPLHISPEVWGNPGGIRCAKETMPLLNWHGPIWLGTDWDMFHAAANVSRTAAPRVPITFVDVTTMSERRKDGHTSVHTIRQGKVLTPEQQADPGTYADCIHWCLPGVPDIWNLILYTRIMSRPQLGLG

SEQ ID NO: 47941 - protein, 393 aa, Oryza sativa (japonica cultivar-group)
MLSAAMEYLRSCWGPASSPAGRPRKGSDAAGRQDGLLWYKDAGQLVAGEFSMAVVQANNLLEDHSQVESGPLSTTDPNLQGTLVGVYDGHGGPETARYINDHLFNHLRGFASEHKCMSADVIRKAFRATEEGFFSVVSSQWSMRPQLAAVGSCCLVGVICAGNLYIANLGDSRAVLGRLVKGTGEVLAMQLSAEHNASFEEVRRELQAAHPDDPHIVVLKHNVWRVKGIIQITRSIGDVYLKKPEFNREPLHSKFRLQETFRRPLLSSEPAIVVHQLQTTDQFIIFASDGLWEHISNQEAVDLVQHNPRNGIARRLVKAAMQQAAKKREMRYSDLKKIDRGVRRHFHDDITVVVVFFDSNAITTANWSRPSVSLRGGGVTLPANSLAPFSVPT

SEQ ID NO: 47942 - protein, 295 aa, Pseudomonas putida KT2440
MSTPVIRGVIGYTITPFTADGTLDLDALGTSIDSLIAGGVHAIAPLGSTGEGAYLSDSEWETVVRFSQARIAGRVPSVVSVSDLTTARTVQRARLAQACGATAVMVLPISYWKLTEAEVVAHYKAVGAAIDIPIMLYNNPGTSGTDLSVELILRILGEVPNVTMVKESTGDIQRMHRLFTATDGQVAFYNGCNPLTLEALVAGATGWCTAAPNLIPALNLALWDAVQQGDLAEARALFYRQYELLEYITRRGLPTTIKAGLKMLGQDVGAPRLPLQPLDAQGSNHLKSLLVALTN

SEQ ID NO: 47943 - protein, 325 aa, Lactobacillus plantarum WCFS1
MMQTIWQPESLVAKELAALKPYLATNVKIDNAAINDRVHDLLAAGGKFLRPGFFYLFSQFGPDHNTARLRAGAAAMELLHVATLIHDDVIDESPERRHVTTIHQDYGQRNAIYAGDLLFTCYFDQVLIAAKTADDVKINTAAMRAILQGELDQMAHNFDPTTTVDDYLAIARGKTARLFSLSCEQGAHFAGADASVVKLAQQIGERMGLAYQMLDDVLDYAGDEALTQKPVLNDLRDGVYSLPLIYALTAEPQLAEQLPQPGDHISNEQLLTIRDQVIALGGVTQAQQLATHYTKTALNLIDQLPTGETQQTLRRLVTELLVRNH

SEQ ID NO: 47944 - protein, 200 aa, Triticum aestivum
  misc_feature (57)..(57): Xaa can be any naturally occurring amino acid
MTRRKLPLAKFLPRLRVVTQVCSTCENLTNKAVSYLSEKQTQDEIMEILHGACSQDXSLEQKCPEMVDSYATPLFAKITEIKPDEFCKQYGLCREVSFLSVEKSESTCAFSHHLVDEVLSKMKDPDAQFEILQLLIKECNKVKGHVQECKRMVLEYTPLILVNGERFLEKKDVCTLMQACDASKTRAGGSFFDGELRSDA

SEQ ID NO: 47945 - protein, 473 aa, Gibberella zeae PH-1
MEKLSETTPNGTSPRTFALNHSRPRSSFKGCSRISDYELLGKLGEGTFGEVHRARLRKTGALVALKKIIMHHEKDGFPITALREIKLLKLLSHKNILRLEDMAIEHPTRQTDKRKKPIVYMATPYMDHDLSGLLDNPSVQFKEPQIKCYMLQLLEGLRYLHDSRILHRDMKAANLLINNKGILQIADFGLARHYDGRTPESGVPMGEGKRDYTGLVVTRWYRPPELLLQLRQYTPAIDVWGVGCVFGEMLYGKPILAGESDAAQLDIIWDLMGSPNEENMPRWKSLPGADHLTPRPRTGNLETRFRQYGSGAVSLLKELLRLDWRTRINAVDALQHPWFKMQPLPLEPHEIPTYEESHELDRRKFHDRKAALPPAPKGGTVGVGPDANGATAGFNSNEPYGNGRNGVNGGRRRDDRPPPPRDDRPPPRDDRRRRNSREDRRFDRDRGTMSRSRSPRHDRSRDRDRPDHNGYRR

SEQ ID NO: 47946 - protein, 503 aa, Ralstonia solanacearum GMI1000
MSPSPETLLQRLHLDTLTGGDGPLAARSPIDGAVLARLPVETAADADRIVAQAHAAFRNWRTVPAPRRGELVRLLGEELRAHKADLGALVTLEAGKITQEGLGEVQEMIDICDFAVGLSRQLYGLTIASERPAHRMMETWHPLGPCLVITAFNFPVAVWAWNATLALVCGDPVIWKPSEKTPLTALAVERLFLRACQRFGEAPPHLAQVAIGAHDLGEALARHPGVPLVSATGSTGMGRAVAQAAAPRFARTILELGGNNAAIVCTSADLALAERAIAFAAMGTAGQRCTSLRRLFVQRPVYDALVPRLTTLYARVQVGDPRDDGTLVGPLIDGHAYERMQAALARARAEGGTVHGGGRVTVGAGDGAYYVRPALVEMPAQDGVVCEETFAPILYVMPFDSLDEAIALNNAVPHGLSSSLFTLDMREAERFVSATGSDCGIANVNIGPSGAEIGGAFGGEKDTGGGREAGSDAWKAYMRRATNTVNYGTALPLAQGIRFEVGG

SEQ ID NO: 47947 - protein, 129 aa, Oryza sativa (indica cultivar-group)
MGEVMSKEYELEYGADCLEMHVGAVQPSERALVVDDLVATGGTLCAAIVLLERAGAEVVECACVIELPELKATESVASHTCLTLPKSRLAVWNAYMKKREEKIEVVKRWDRGRERLNGKPLYVLVESHS

SEQ ID NO: 47948 - protein, 607 aa, Xanthomonas axonopodis pv. citri str. 306
MAVIEIKVPDIGDYSDVPVIEVLVAVGDSVAKDQGLVTLESDKATLEVPSSAAGVVKELKVKVGDTLSEGALVLLLETEGEAAAPAKAEPKAAPAAAAPAAAPGSKPPVTPSHRAPAEPAAPKPALASGKPADIECKMVVLGAGPGGYTAAFRAADLGLDTVLIERYASLGGVCLNVGCIPSKALLHAAAVIDEVAHAGDFGVDFGQPKITLDKLREYKEKVVGKLTGGLASMAKQRKVRTVTGVASFVSPNELEIVGDDGKTQLLRFEHCIIAAGSQAVKLPNFPWDDKRVMDSTDALELHDIPKTLLVVGGGIIGLEMATVYSALGSKVTVVEFMDQLMPGADKDLVKPLADRLKKQGVEVHLKTKATDVKADKSGITVSFEAAVEGEKPGLQATAYDRVLVAVGRSPNGKKIGAEKAGVTITERGFIPVDRQMRTNVPHIFAIGDIVGNPMLAHKATHEGKLAAEVAAGEKKEWVARVIPSVAYTNPEIAWVGVTETEAKAKGLKVGVAKFPWAASGRAIGIGRTEGFTKLIFDEQTHRVIGGAIVGVHAGDLLAEIGLAIEMGAEAEDIGHTIHAHPTLSESVGMAAEVYDGTITDLYIPKKK

SEQ ID NO: 47949 - protein, 402 aa, Synechococcus sp. RS9917
MAKRSLASLSGTDLSGKRVLVRVDFNVPLNDAGAITDDTRIRAALPTIKDLLGKGAKVILAAHFGRPKGQVNEGMRLTPVAARLGELLGKPVVKTDSCIGPDAEAKVAAMANGDVVLLENVRFFAEEEKNDAGFAEKLAGLADVYVNDAFGAAHRAHASTEGVTKFLKPAVAGFLMEKELQYLQGAVDEPKRPLAAIVGGSKVSSKIGVLEALIDKCDKVLIGGGMIFTFYKARGLAVGKSLVEDDKLELAKELEAKAAAKGVQLLLPTDVVLADNFAPDANSQVASINAIPDGWMGLDIGPDSIKVFQEALADCQTVIWNGPMGVFEFDKFAAGTNAIATTLADLSGKGCCTIIGGGDSVAAVEKAGLADKMSHISTGGGASLELLEGKVLPGVAALDEAA

SEQ ID NO: 47950 - protein, 83 aa, Oryza sativa
TFIHSFWDFVGLSFYTTEEELKNVFSPFGAVEEARLVRDNPTGRPKGFGFVKYSSQADAEKAVKAMDGRIIRGRLIFVEIAKE

SEQ ID NO: 47951 - protein, 488 aa, Aspergillus nidulans FGSC A4
MRFLVPLALLGATATTVVAETPQDLIQNSIPACMQSCFTDAIEKLTGCDLSDTDCVCKAGIPDSETISTSRDSLTSCVKDSNCTASEAQQIADLDVNSLMSQSSDVCSGAVTVSANVVLAAEYIKITDATYRVTTEIAKSAFLADLRYALVNVGFFYLVNAPIKPQIRQDLVKKCRAIFDLPLEKKLEIEMVNSKHFLGYSRLGAEITARKQDYREQFDFATELPAPAPDEPLYRNIRGPNQWPDENAIPGFRQSVEAYLAELSPVAENFQVLIAEALDLPPNALKQFFDKPVQQKMKLIKYPPPPSDAESQGVGPHKDSEFLTFLLQATPHHGLEVQNKSGVWISAPPIEGSLVVNIGRALEAITGGVCTATTHRVSLAPSNYVDAEGTPLGPRFSIPVFQGMSLDLSAEDISLEFPDHIKMLAGDEKARSDAEATFNKIFRGRTGEGTLIHRIISHQDVGRRWYPELLARALGEYEKQGRGLNSSQ

SEQ ID NO: 47952 - protein, 579 aa, Zea mays
  misc_feature (437)..(437): Xaa can be any naturally occurring amino acid
MGKSPAKWIKSVLFGKKSSSRSGSTKAKDLSKGASNKGAAAAGKEPVFSESSPVISEPVLVSAHNNETVREVAKGENSSVQEVPVTDVSQDLEKQGSVGSDTSNDAERVREERAAVKAQAAFRGYLARRAFRALKGIIRLQALIRGHLVRRQAVSTLRATWLIVKFQALVRGRNLRLSEASIQATMELSQQNLAGAKPGSWKEKLSSNAFARKLLSSSIVVEALHFQYDEMDPNSAFNWLERWTISHVWKPASQPRRVSADAKPHTRKASYAMETESVKLKRNARRSSAGPFEPSQTNTAIEIEKTRRNPRKLSSTPAESVPDGQLTELEKVKRSLRKVTNSVAETSKAPSPKTEIPNHQEVQCERPLRRAKQVPIHLENQEPDNVNLLDNAKMDILVPDIQPDVEVASDPVTITNEENVDEPPSVVAPVAEIMPLXQDINNDENALVNDVEERSKEEHPCTESLKGSKRRSSFSAKPEYPENGSKNSPALPSYMAATQSAKAKLRGNSSPKLSSDSAEKNGFTRRHSLPSSNNGKMVSHSPRTQRPANAGCKDGAKGDKAMLSSRDASERPLKAEWRR

SEQ ID NO: 47953 - protein, 341 aa, marine gamma proteobacterium HTCC2207
MKALVKRNSTVGLWLEDVPKPEMGINDVLIKIKRTAICGTDMHIYNWDSWAQETIPVPMVVGHEFVGEIVDVGSNVNDFRPGQIVSGEGHVVCGRCRNCLAGRRHLCAHTSGIGVDRSGAFAEYLALPMSNVWEHRADIDLDVAALFDPLGNAVHTALQYDLLGEDVLITGAGPIGAMAAAVCRHAGARNVVITDINPQRLALAKELGATCTVDVRTEKLADVQRALGMSEGFDVGLEMSGNPAGFRDLLSNMCHGGKVAMLGIPAEEVAIDWSLVIFNMLTLKGIYGREMYETWYKMSVMIESGLDISSVITHRMHYTDFQKGFDAMNAGEASKVILNWD

SEQ ID NO: 47954 - protein, 256 aa, Brassica napus
SSLSFFQRPNLKVLSRNYRVDSSLLKTCNCSVVNDTTSVGWEGRRSKRYSDPIADSTNAEPENFRVHENFLFDDVVPAATTMMMPGQMSYRLIASKQMVGLFLSVWARKELIPHISHLRLDSVGRGIMGRLGNKGCIAISMSLHQTSFCFVCSHLASGEKEGDEMRRNADVAEILKHTQFPKLTKSPSCRAPERIVDHDRVLWLGDLNYRVALTYEETRVLLEDNDWDTLLEKDQLNMERGAGRVFSGFQEGQIFF

SEQ ID NO: 47955 - protein, 163 aa, Zea mays
  misc_feature (114)..(114): Xaa can be any naturally occurring amino acid
  misc_feature (126)..(126): Xaa can be any naturally occurring amino acid
QSLKKYLYNHAAFTKGILVSFCQESFYTLPEAVIIGSKIQIVSIPFLHASVDLVKLPEMENCGTTSCFIKLFLDKKYALPCRALYAVLALIMRFVDDDRIMPVKWHQSLLAFVXRSRTESDLKDKXNLPVRWTSQWIYLVTPLSQMNLQRTCNRGKKDSHLHT

SEQ ID NO: 47956 - protein, 239 aa, Saccharomyces cerevisiae
DLSKNKIVIVDSLNYIKGFRYQLHCEVKNLSTTFCVIQTLCPPETIFEWNKTSNPNPWEPELLNQLIQRYEEPNSSNRWDSPLFAILTPQDNITDYIDDICKVVFQTSKSAKNSGHNDPLSKGLQKPNSATVLKPASQSNFIQVLDIETSKIIKTIMNHIKSLTSIGGVSNGTRVIVSEGITDINDDGCFFVDLPIGNVVTLAQLQRLKRQFINFNKLRDIDQDRIGPLFADYLNKNLN

SEQ ID NO: 47957 - protein, 254 aa, Chlamydophila pneumoniae CWL029
MTRQSYVLGNWKMHKTIQEAKEYVQTLASLLQGEPLSCTIGIASPFTSLRAIHEVINTTGAFLWLGAQNVHPELSGAFTGEISLPMLKEVGVEFVLVGHSERRHIFGESDAFIASKVKSVAQAGLVPVLCVGESLEVREEGKAHQVIKKQLLLGLEQMDNGSEFLIAYEPVWAIGTGKVAEASDVQDIHMFCREVVAERFSEATAEEISILYGGSVKVDNAQRFGQCSDVDGLLVGGASLEGQSFFEVAKNFNV

SEQ ID NO: 47958 - protein, 828 aa, Xanthomonas axonopodis pv. citri str. 306
MRGHRADSLRPAPRCTAPCPHPPSDRKRPDRAGPVDADRDRRRRQLSQSERRHDRSHRASGLTQERITHHASPSCTPATTQVGYARRPDLSRRSASPHDVCPPAGHRAMTLSRGALPFVLGLLPLAACADPAFDRCLAGLQTQAAAKGVDAASFQRFTAGLAPDSSVLPLLDAQPEFTTPIWDYLASLVDSQRVTDGQAMLVTHRELLSRLSDQTGVDPATIVAVWGVESDYGRVTGKRPLLVSLATLSCAGRRQPFFRGEFLALLSLLQQGDLSADGLTGSWAGAFGQTQFMPSTYARIAVDGDGDGRRDLVTSIPDALASTANYLVKAGWERARPWGMEVTLPRGFDASKAGRTRRQPLQAWQSAGLLGTDGKPLAPTGLPAETPAALLLPAGATGPAFLVFRNYDAIYAYNAAESYALSIALLADRLRGGAGLIAAWPTDDPGLGRPERRELQQLLLARGYQIGEADGMVGSATRRAIQVEQTRLGLQPADGRPGQRILAALRAAPPVAGAAAMRATAFKLPAAYPAFAQSPSVQKASPMSDTTGLTTGDFHGFPSLLIDTPFSTAAISLFGGQLLSFVPEGGQDVMWLSPSAQQPPTPIRGGAPVCWPYFGRQDQAGDVPAHGFVRTVAWQLTESHREDDGTVVLTLTPPRFDDLALRLRMTLRIGRTLEQRLITENTSVAPVRFTQALHNYFRVGDALKVSVQGLDGLDYLDKYENYATAHRQQGDWSLRDPRDPGRSDRIYTNAGGRYTLTDPVLGRRIVIATEGSRSLVAWNPGEDAGKKMADVGEGWRDYVCLEAANAGPDVIELAPGASHTLTQTISVE

SEQ ID NO: 47959 - protein, 306 aa, Prochlorococcus marinus str. MIT 9303
MHQFLPYAWFQGACVPFEEAKISVATHALHYGTGAFGGMRAIPDPQNSNTMLLFRADRHAKRLSQSARLLLTELSETRILSALEAMLQANRPTTPIYLRPFVYTSDLGIAPRLHNIETDFLIYGLELGDYLSPEGVSCRISSFTRQEDRSLPLRGKISGAYITSSLAKTEAVLSGFDEALLLNSRGKISEASGMNLFLVRDGQLITPGVDQDILEGITRSSVLELARVMGLSVIERPVDKTELFIADEVFLTGTAAKITPIRQLESTILATERPIMNALRDRLLEITQGRDKDYEHWITRICMTKD

SEQ ID NO: 47960 - protein, 777 aa, Synechococcus sp. RS9917
MLNVTSAPEQPQTDAVRAAEPCDQPVQRVHPIRTIEDYGIDLPDWLRECLTHVPPGEGYSCPTDPEALLAAAFDFAFQLHQGQFRASGDPYIVHPVAVADLLRDIGASAPVIAAGFLHDVVEDTDLTPAQLESHFGAEVRELVEGVTKLGGLHFTNRTEAQAENLRKMFLAMASDIRVVLVKLADRLHNMRTLGALKEEKRQRIARETREIYAPLANRLGIGRFKWELEDLAFKLLEPDAFREIQQEVATKRSEREERLGVTVKLLSDRLAAVGLDSCEVSGRPKHLYGIWSKMQRQQKAFHEIYDVAALRILTPNVESCYRALAVVHDTFRPIPGRFKDYIGLPKPNGYQSLHTAVIGRHRPIEVQIRTLEMHQVAEFGIAAHWKYKEGGSPAAGGDTERFNWLRQLVDWQQEGGADDHNDYLASIKEDLFDEEVFVFTPKGDVVGLRKGSTAVDFAYRIHSEVGNQCHGVRINDRLSPLSTPLQNGDFITILTSKTAHPSLDWLNFVATPTARNRIRQWYKRSHRDETIQRGKDLLEKELGRNGFDALLHSDAMTRVAERCNLHSTDDLLAALGFGAVTLHQVLNRLREEIRLQTAAAAQPLSNEDVARRLVEQAEASSPRPSQGSTVPILGVEGLDYRLGGCCSPLPGEAIVGTVALGNHGITIHRQECANVEAIPSERRLPVSWNPAVTRHGLRFPAQLRIEVIDRVGILKDILMRLSDGSINVSDARVKTAYDKPARIDLRVEISSVEQLQRTMAQIRSMADVLDIARTGQS

SEQ ID NO: 47961 - protein, 377 aa, Gossypium hirsutum
MADTEEIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYMFTTTAEREIVRDMKEKLAYVALDYEQELETAKSSSSVEKNYELPDGQVITIGAERFRCPEVLFQPSLIGMEAAGIHETTYNSIMKCDVDITKDLYGNIVLSGGSTMFPGIADRMSKEITALAPSSMKIKVVAPPERKYSVWIGGSILASLSTFQQMWISKGEYDESGPSIVHRKCF

SEQ ID NO: 47962 - protein, 290 aa, Glycine max
PRVRLSIIGSLRHRNLVRLQGWCHEKGEILLVYDLMPNGSLDKALFEARTPLPWAHRRKILLGVASALAYLHQECENQVIHRDIKTSNIMLDEGFNARLGDFGLARQTEHDKSPDATVAAGTMGYLAPEYLLTGKATEKTDVFSYGAVVLEVASGRRPIEKDANGGGKGGISCNLVESVWSLHREGRLLMAADPRLGGEFDDGEMRRVLLVGLACSHPDPLTRPTMRGVVQMLVGEAEVPLVPRTKPSTGFSTSHSHLLLSLQDSVSDCDGIITISTSTSENSFNLGDIV

SEQ ID NO: 47963 - protein, 377 aa, Gossypium hirsutum
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTSIVLDFRDGVSHTVPIYEGYALPHAILRLDLAGRDLTDALMKILTERGYMFTTTAEREIVRDMKEKLAYVALDYEQELETAKSSSSVEKNYELPDGQVITIGAERFRCPEVLFQPSFIGMEAAGIHETTYNSIMKCDVDIRKDLYGNIVLSGGSTMFPGIADRMSKEITALAPSSMKIKVVAPPERKYSVWIGGSILASLSTFQQMWISKGEYDESGPSIVHRKCF

SEQ ID NO: 47964 - protein, 303 aa, Podospora anserina
MMIQIALRAPNGQSRIQVEDESTLSDLVALIKSKTELERFSLKYGYPLKNLDISLSSQSSSIKDLKLRGETIVVAPIDTTPVPAPEPAKPAKPAFVPKGIEPDETSLEVMPDDNSCMFTAVGGALSIDNPSSRLRAQITEYILTHPEKYTAAILGSPPQKYCSHLMEQDTWGGAIELSILSDIYDIEISSIDVKSLRVDRFGEGKETRIIILYSGIHYDRIAFALDLSYPVDCDVTKWDTQDEEVLTKARQLAAQLQRMHYYTDTTDFVIKCEVCQWIGKGMKEAGVHQKETGHKEFGEMTIQ

SEQ ID NO: 47965 - protein, 377 aa, Gossypium hirsutum
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYMFTTTAEREIVRDMKEKLAYVALDYEQELETAKSSSSVEKNYELPDGQVITIGAERFRCPEVLFQPSLIGMEAAGIHETTYNSIMKCDVDIRKDLYGNIVLSGGSTMFPGIADRMSKEITALAPSSMKIKVVAPPERKYSVWIGGSILASLSTFQQMWISKGEYDESGPSIVHRKCF

SEQ ID NO: 47966 - protein, 377 aa, Gossypium hirsutum
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDALMKILTERGYMFTTTAEREIVRDMKEKLAYVALDYEQELETAKSSSSVEKNYELPDGQVITIGAERFRCPEVLFQPSFIGMEAAGIHETTYNSIMKCDVDIKKDLYRNIVLSGGSTMFPGIADRMSKEITALAPNSMKIKVVAPPKRKYSVWNGGSILASLSTFQQMWISKGEYDESGPSIVHRKCF

SEQ ID NO: 47967 - protein, 516 aa, Clostridium acetobutylicum ATCC 824
MKELNEILLGEIEEFRKLGHDFLDGKVSKVDFKGASGGMGVYAHRSGKEFMIRLRIPSGIASRKDLELIRDFARRYELDSVHLTTRQAIQLHGISIDTVCDIMEEGIRNGLYSRGAGGNFPRNVAISPLSGVDKNEAFDVSPYAEAVGKHFLKKIYTYKFPRKLKVAFSNNADDIGHATIADLGFLAIKENEHEYFKVFIGGGLGRNPKVAATFIELAEPKDVLYHVEAMTRLFINEGDYKNKAKARIRYILERMGEEEFIRCYSKYLSEVKSEEKLDLEIDKKAYTKHGIETTVKNKRLISQKQNGLYSVYVHPVGGQLSIKDLEDILKETSNIEDVEIRLSMSEGFYIRNLNGNEAERILEITEHIGGNTRLEYSTACIGVPTCQIGLLESQATLRNIIDYFKKMKFEYDVLPAVHISGCPNSCSCHEISGIGFCGKKKRVSEEVKDVFELYLKGKLKSGATRLGDYYGDVLKEEVPYLLYDIAKIVHESGEEFYNWVESNDEKLKSIVNKYLV

SEQ ID NO: 47968 - protein, 557 aa, Coprinopsis cinerea okayama7#130
MSLAIHNAARIPPYLFNTDHAQRVLAQLRSKHNGLEKYIYLNGLKERDPNLFYELLLANMLEMVPILYTPTGLLQVGDACSNYSHIWRRPEGLYVTIENKGHIREVLRTWPAGQAARIAVVTDGSRILGLGDLGANGLPISIGKLDLYVAGAGIKPTTTLPICLDLGTNTQRFLEDPLYIGVRRKRPATAEMDEFMHEFMEAMREVFPQLLVQFEDFSTDNAFRYLDLFRNQYRVFNDDTTYPRGIGSVILSGFLNAARIASEAAGTPLTEHRILFFGAGSAGIGVAKQLLSFFTLQGMSVEEAKKRIYTVDSKGLITADRKGLQEHKIFFARTDYQGPPLTNLVDVINYVKPTALLGLSTVRNAFPEEVVRLMASLNTRPIIFPLSNPVSLCEVDYADAIKWTNGSVIFASGSPYKPVEYEGKTYEPGQGNNMYVFPGIGMGAILSKARHVTDSMVEQASIALASSLTPEEKAAGLVYPRLVRIRDISAQVALAVIRAAQKDHALQNVDENSLFRNLSDDALLEYIKAKQWQPASSHLPRLPLHLASSGTARRPLL

SEQ ID NO: 47969 - protein, 422 aa, Clostridium acetobutylicum ATCC 824
MTNKEIFEESKEYMPGGVNSPVRAYMDLNIDPPIIKSGKDSHLFDEEGKEYIDFIEAWGPMILGHKNQKVLNEVKEVLDEGVGFGAPTSLELKLAKYICTTVDNVEMIRMVNSGTEATMSAVKLARGYTKRDKIIKFAGCYHGHFDGFLVEAGSGVLTQNIPGSPGVPKGSIENTLIAEYNNVESVEVLFNKYKDEIAAVIIEPVAGNMGVIPAKKEFLVKLRELCTENQSILIFDEVMSGFRVAYKGAQSLYGVTPDLITFAKIMGGGFPCGAYGGKKEIMKQLSPLGPVYQAGTMSGNPVVMAAGYASLRQLHENPEYYTYMDKLGSKLEAGILEISKEKGIPLVVNRCVNMMTIFFNKAKEVKSYSDAKASDTKMFARFAEHMITSGIYVPPSQFEAMFLGVKHTEEDIERFLDVMKKL

SEQ ID NO: 47970 - protein, 409 aa, Clostridium acetobutylicum ATCC 824
MKFSTKLIHGNYNLENTGATNVPIYMSNAYAHSSPQELENVFKGKFPGYVYSRFSNPTVLEFERRMASIEGGLTATSAASGMSAIYMAITNIVHPGDEIIASTGLYGGTYTLISNLQNIGVKVIFLEDISKKTLLNNINENTKLVYTETIGNPKLDILDIESVGRVCKEKGIIFMVDSTISTPYLINPSKYGADVIIHSTSKYINGTSNAIGGMIVDCGSEKYKNHRYENFQKYAEKYDKLAFTAKLKSTSGLDIGASMSPFNAFLSLTGIETLSLRMKKHCENAMKIASYLEKSDKVTNVNYPNLKSSKYYDLATKYYADGASGILTFRLGTKENAYKFLAKLKLILDTTNIGDCKTIIIHPASTICINNTEEEREKMAVYDDLLRLSVGIEDIEDILEDIDRALEAI

SEQ ID NO: 47971 - protein, 172 aa, Brassica napus
HWLVLTNGIEVKLQRNALSVIEAPTGNEEDDDIEVEHIQWNTPSHMTSEDTLKTHKSKQRGYKSARLSQKTVCKALSCDSHSKSQSIITPRANMRVDLSKLDMPALQRYIQHFNLVDALPNPSIEQLLDIVQRHFVSQEMDELQVIVGFVHAAKGMKKACRWKSKELQKHSS

SEQ ID NO: 47972 - protein, 523 aa, Bordetella parapertussis 12822
MPENAQPHAVIPAADLQLSAQSPQWRVFAAAAAGASLVARPLRVIEAAGIYVDLSMQRHSSALAQAGLALLQARDVLGARAALFAPGAPDAAHGRYPVLRAGYGAHPEEQCDIEVEIEYARMLEFVRELDRGGACPAVLYLGGGAGQWALRLALQAFGGPAQRRQLRFVSGGDAAALHEALAGLGPRRTLVVAASRGFEPSETLDNARAAIDWLRRAGIDDVSAHLVTVTGNESAARALGVAAARVFRLPSWLQPRHELWSVGALPVALALSVDMLKALRSGAAAMDQHFLQAAPAVNAPMQMALAAVANTSAMHWPTHALAVYSARLAALPACVQQLEMTLAGRAPASLPAYSVVWSPAGAPGPGAFFEWLHRAPAGAPVDFIAGLDEYPASPPAHRALLANCLAQREALLRGLPAGPGQPAAGGGRPSTLVVLRQVDPRAVGALLALYEHKAFVQAALWGAALGGADQAQACQRLAQDIARQLAVPPAAGPVDWGHDSSTAFWIDRYREQGGAGAAAGRTA

SEQ ID NO: 47973 - protein, 283 aa, Moorella thermoacetica ATCC 39073
MRGIWFSELQTPDLAISVRLNQTLHHEKTPYQELAVVDTEAYGRMLLLDNIIQTTVKDEFFYHEMIAHVPLNTHPNPRTALVIGGGDGGVVREIVKHPSIEKVTLVEIDARVVANAREYLPEIACGLDDARVEIRFEDGIEHVRQRENTYDVIIVDSTDPIGPAVGLFSAEFYRNVYRALKADGVFVAQTESPIFNSRLIRRIQRDLKEIFPIARLYLTTVPTYPGGLWAFSLGSKKYDPLEVDWRQAPKVATRYYTPAIHQAAFSLPPFVQEFLEAPEEEEF

SEQ ID NO: 47974 - protein, 158 aa, Zea mays
MAMGLINANPIIHEKKERRIRQAPETTDENAAESIDQLEIFDHIRDIKDPEHPYSLEQLNVVTEDSIELNDESNHVRVIFTPTVEHCSMATIIGLCIRVKLVRSLPPYYKVDIRVAPGSHATEAAVNKQLNDKERVAAALENPNLLDMVEECLSPTFD

SEQ ID NO: 47975 - protein, 322 aa, Pseudomonas aeruginosa PAO1
MQPQAFYRVVAEDFTAVDGIIRRQLTSRVPLVEKIGDYIISAGGKRLRPLLVLLAGKTLGYKGDDLCLLAATIEFLHTSTLLHDDVVDASGLRRGRSTANALWGNAPSVLVGDFLYARSFEMMVELGSMPVMRIISQATRVIAEGEVLQLSKVRDASTTEETYMEVIRGKTAMLFEASTHSAAALCQAGEEQSEALRRFGDYLGIAFQLVDDLLDYRGDAATLGKNVGDDLAEGKPTLPLIVTMRDGTEEQAALVRKAIQQGGSQDLESVCAAVEAAGALDYTANLARDYAARAIACLDTLPDNEYRSALVELSEFAVARTH

SEQ ID NO: 47976 - protein, 127 aa, Triticum aestivum
  misc_feature (123)..(124): Xaa can be any naturally occurring amino acid
MVRISVLNDALKSMFNAEKRGKRQVMIRPSSKVIIKFLIVMQKHGYIGEFEYVDDHRSGKIVVELNGRLNKCGVISPRFDVGVKEIEGWTARLLPSRQFGYIVLTTSAGIMDHEEARRKNVGXXVLG

SEQ ID NO: 47977 - protein, 421 aa, Methylococcus capsulatus str. Bath
MKARIESVQAMPIYDSRGVPTVRVRLTLTDGTAATASIPSGASTGENEAVELRDGDPKAHGGKGVLKAVSNVNDVIAPAVMGLEPWRQAEIDRLMIELDGTANKERLGANAILGVSEAVAAAAAKSAGLPLYAYLGGAGQARLPIPMINILNGGKHADSSLDFQEFMIMPVGAPSFAEAMRYATETFQALKSILKAKGHATSVGDEGGFAPQLQSNDEACDLIVEAITKAGYEPGEDIAIALDPAASSFHENGVYRLTRSGQGDKTSSEMTDLYRRWIDKYPIVSIEDGLAENDWDGFREHTAVLGEKIQIVGDDLLVTNTRFIQRAIEEKSCNAVLIKLNQIGTVTETVEAIHLCRKAGWGFVISHRSGETEDTFMADFAVAMGGGQIKTGSVCRSERMAKYNRLLEIESDLGKAARFGR

SEQ ID NO: 47978 - protein, 687 aa, Oryza sativa (indica cultivar-group)
MAILTVLPLVLVMLLLPLAAIASGDPPWQHYCGSSGNYTAGSKYQANLQALAATLPSTASSSSPALFAKDAAGAGDAEPDRVFALTLCRGDTASANASSSSCADCASRAFRDAQSVCPYSKEVAVYYDPCLLYFSGDDFLSSPANPAQVRLYDVDRSTRRGGGGADFVTLVRALLSYTMQWAVPYNSTGGGAAAVRWYTTVRMDVVTPPLFSLMQCTPDMSGGDCRQCLQDLVGNTTFNGSVSGVRNIGARCGYRYDTYKFYGGEPKLKIGSLSEINSTAPSSPPPPPPVTETRSGRKKVLTVALLVPLIALCPVVIFCFAWIRRLRNHKSMLRKKDTMAREEVLKLWRLEESDSEFMLFDFSQIEDATSNFSEDKKLGEGGFGSVYKGQLPNGLEVAVKRLAAHSSQGLVEFKNEIQLIAKLQHTNLVNLRGCCIQGEENLLIYEYMPNKSLDFFIFDLKRAALLNWKTRLNIIEGITQGLLYLHKHSRLCIIHRDLKASNILLDRDMNPKISDFGLAKIFDSNDVQRNTKRVVGTYGYMAPEYASEGCFSLKSDVFSFGVLVLEIISGKRNAGFHQYGDFFNLLGYAWQLWKDGSWHELVDPSLVSEGQMMEIKKCMKVALLCVQENAVDRPTMSAVVKMLSSELKILPEPKQPAFFNVRVKHGELSNTALSSINDVTITIVNGR

SEQ ID NO: 47979 - protein, 377 aa, Gossypium hirsutum
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFTVPAMYVAIQAVLSLYASGRTTGIVLDSGDGVSHTVPIYEGYALPHAILRLDLAGRDLTDALMKILTERGYMFTTTAEREIVRDMKEKLAYVALDYEQELETAKSSSSVEKNYELPDGQVITIGAERFRCPEVLFQPSFIGMEAAGIHETTYNSIMKCDVDIKKDLYGNIVLSGGSTMFPGIADRMSKEITALAPSSMKIKVVAPPERKYSVWIGGSILASLSTFQQMWISKGEYDESGPSIVHRKCF

SEQ ID NO: 47980 - protein, 377 aa, Gossypium hirsutum
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTHIIFETFNVPAMYVAIQAVLSLYASGRTTGIVLDSGDGVSHTVPIYEGYALPHAILRLDLAGRDLTDALMKILTERGYMFTTTAEREIVRDMKEKLAYVALDYEQELETAKSSSSVEKNYELPDGQVITIGAERFRCPEVLFQPSFIGMEAAGIHETTYNSIMKCDVDIRKDLYGNIVLSGGSTMFPGIADRMSKEITALVPSSMKIKVVAPPERKYSVWIGGSILASLSTFQQMWISKGEYDESGPSIVHRKCF

SEQ ID NO: 47981 - protein, 273 aa, Podospora anserina
MADRQLTTLLTQLRTPSLPFPQSTTLLSKAKLLLLQLSALTPSPTILPANLTLAREVYELGALHSLRAKNPDSFTRYVSQLQPFYELPPSAFSSPSQNQNKVTALWLLFLLTQGRYTEFHSDLEGLSTRGSVAEVENDKFLGYPIKLERWLMEGAYDRVWKAMKKGEVPSENANINKKVLTPQIRREIASSSERAYPSLPFLSAQSLLFLDSEGAVVDFAHSRGWVIKDRTIYFPTAAELNADEEGEQEQEKEVGQMVIENTLGYARQLETIV

SEQ ID NO: 47982 - protein, 377 aa, Gossypium hirsutum
MADTEEIQPLVCDNGIGMVKAGFAGDDAPKAVFPSIVGRPRHTGVMVGMGQKDAYVGDEAQSKRSILTLKYPIEHGIVSNWDDMEKIWHHTFYNKLRVAPEEHPVLLTEAPLNPKANREKMTRIMFETFNVPAMYVAIQAVLSLYASGWTTGIVLDSGDGVSHTVPIYEGYALPHAILRLDLAGRDLTDSLMKILTERGYMFTTTAEQEIVRDMKEKLAYVALDYEQELETAKSSSSVEKNYELPDGQVITIGAERFHCPEVLFQPSLIGMEAAGIHETTYNSIMKCDVDIRKDLYGNIVLSGGSTMFPGIADRMSNGITALAPSGMKIKVVAPPERKYSVWIGGSILASLSAIQQMWISKGEYDESGPSIVHRKCF

SEQ ID NO: 47983 - protein, 290 aa, Arabidopsis thaliana
  misc_feature (151)..(151): Xaa can be any naturally occurring amino acid
MPLHMKIQPIDESDVSEEVPYPETMRQMPKSRLKRLFERQFTNKNVSEKFTGSDVEAPLSRGNSGDFEPSSVCLAKMVLNFMEDNNGGEKQRCGRSRCNCFSGSGTESSDDETECSSGEACEILKSLVLCKSIRVRNLLTDVTKIAETSQXYDAALCKSRWEKSPSCPAGEYEYVDVIMKGERLLIDIDFKSKFEIARATKTYKSMLQTLPYIFVGKADRLQKIIVLICKAAKQSLKKKGLHVPPWRRAEYVKSKWLSSHVRVDQNSNGEVKQESVEVIAESVSSIVFGV

SEQ ID NO: 47984 - protein, 572 aa, Emericella nidulans
MQSSMLLRVRALPKTASVLSRTKTATYATYKVPRIDNEPNKHYAAGSPDRKALQEALARTQRNAPLSVPLVIAGKEVKSSSSLTQSNPASHGPVATYSNATAKDVQAAIESALEARKSWASTPFADRASVFLKAADLISTKYRYDVMAVTMHGQGKNAWQAEIDSAAELCDFFRFGVKYAEDLYAQQPVHHAPGVWNRVEYRPLEGFVYAISPFNFTAIGGNLAGAPALMGNVVVWKPSPSAIASNWLVHQILLEAGLPKNVIQFVPGEAEEVTKTVLDHPDFAALHFTGSTNVFRNLYGQISTRVAAGKYRSYPRIVGETGGKNFHLIHKSADIRNAAVQTVRGAFEYQGQKCSATSRVYVASSIADSFLEQVASEAKSLKVGPPSDFTNFCGPVIHEASFTKLAKVIDEAKNDPELELLAGGSYDSSKGWYIQPTVYRTTNPDHPLLTRELFGPILVVYAYPDATEADFARIAQKIDATGEYGLTGSVFAQDREALAVANDVLRNAAGNFYINCKSTGAVVGQQPFGGARASGTNDKAGSGNLLSRFVSLRSIKEEFVPTYKVAYPSNEA

SEQ ID NO: 47985 - protein, 377 aa, Gossypium hirsutum
MADTEEIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYMFTTTAEREIVRDMKEKLAYVALDYEQELETAKSSSSVEKNYELPDGQVITIGAERFRCPEVLFQPSLIGMEAAGIHETTYNSIMKCDVDIKKDLYGNIVLSGGSTMFPGIADRMSKEITALAPSSMKIKVVAPPERKYSVWIGGSILASLSTFQQMWISKGEYDESGPSIVHRKCF

SEQ ID NO: 47986 - protein, 141 aa, Ricinus communis
HVNPAVTFGAFVGGNITLLRGILYWFAQLLGSTVACLLLKFSTGGLTTSAFALSSGVGVWNAFVFEIVMTFGLVYTVYATAVDPKKGSLGTIAPIAIGFIVGANILAGGAFDGASMNPAVSFGPALVSWSWENHWVYWVGP

SEQ ID NO: 47987 - protein, 891 aa, Oryza sativa
MASSQGLKKNYRCDRSLQQFYTGGPFAVGSSPGGGEGEVEGGEAEAEAFLACACGGEVRLVSAADASAIGEPIEGENEAVTALALSPDSRLLFTAGHSRLIRVWDLASRTCTRSWKGHDGPIRAMACHASGGLLATAGADKKVCVWDVDGGFCTHFFRGHAGVVTTVMFHKDPKRLLLFSGSEDATVRVWNLESKKCVAVLKEHFSAVTSLALSEDGQTLLSAGRDKIVNVWDVRKYNSKKTIPAFEMIEDVSFIGPGSNLLSCLGEPANIKRKTDGYFLTVGERGVVRIWCLESAQCIYEQQSSDVTVNTENEESRRGFTSAVMLSDDQGLLCATADQQFLFYCPTRTDGGDFQLNLYKRLVGYNDEILDLKFVGEDEQYLAVATNLEQVRVYDVASMSCSYVLSGHTEIVVCIDTCISSSGKTLVVTGSKDSTVRLWDMERRSCIGIGKGHLGAIGSVAFSKKSKNFFVSGSSDRDIKIWSWDDTLDDVGSEVPLKAKAVVAAHDKDINSLSVSPNDGLVCSGSEDRTACIWKLPNLVPSVVLKGHKRGIWSVEFSPVEQCVITSSGDRTVKIWAVADGSCLKTFEGHTSSVLRASFLSHGTQFVSCGSDGLVKLWTIKTNECIATFDKHDGKVWALAVGKKTEMLATGGTDAVLNLWHDCTMEDKQEDFRKKEEELLRGQELENAVSDYDYAKAIQLAFELRRPHRLLELFTQLCRESDLEDPIEKALIGLPKEGLRVLLEYIREWNTKPKLCHVAQFVLFRVLRSLPPTDILEIKGISELLEGLIPYSQRHFSRVDRLVRSTFLLDYTLTRMSVVDPDIDEGTTRDDANGSSVENCEIAQAKPDALVAEENLQKSVKKRKSSKSSKKGGKKVKIASTGGSKDVPIEA

SEQ ID NO: 47988 - protein, 303 aa, Coprinopsis cinerea okayama7#130
MNNGQEAFRRIVLQLRSGGGGKRPGKGAFAGGGLLAAVVGGAVLINSSLYNVDGGHRAIKYSRIGGLRPDVYGEGTHFAIPWFETPIIYDIRAKPRNIASLTGTKDLQMVNITCRVLSRPDIRNLPGIYRELGLDYDERVLPSIVNEVLKSVVAQFNASQLITQRAEVSRLVRENLTARGMRFGIVLDDVSITHVAFSPEFTSAVEAKQIAQQTALRAAFLVDQAVQEKQSIIVRAQGEAQSAELVGEALRKNKGFLELRRLEAAREIANTLSGSGNKVMLDSQSLLLNVAGDSVKDILKVSK

SEQ ID NO: 47989 - protein, 489 aa, Bordetella parapertussis 12822
MTQLTQPLSRAELLRDACYIDGKWVGAGNGPSIPVDNPSTGKTIISVPKLGRKEAEQAIDAAEAALPAWSARTGKERAAILLKWAQLTMENQQDLAVIMTSEQGKPVAEAAGEIAYAASFLEWFAEEAKRIDGDILQSPKGGQRLMVLKQPIGVTAAITPWNFPAAMITRKVGPALAAGCTMVVKPAQQTPLTALALAVLAEQAGVPAGVFQVVTGSSREIGAALCESEVVRKLSFTGSTEVGRTLMEQCAPTIKKLSLELGGNAPFIVFDDADLDRAIDGILASKYRNAGQTCVCANRIYVQAGVYEEVAKRLVEKVNAMKVGDGFEQGVTQGPLIDTAAVAKVQEHIADATAHGAKVIAGGQPHALGGSFFQPTVVRDVTQSMRFAVEETFGPVAPLFKFESEDEVIGMANNTIFGLAAYFYTRDYARIWRVSEALEYGIVGINTGIISNEVGPFGGVKQSGLGREGSKYGIEDYLELKYLCVDLGA

SEQ ID NO: 47990 - protein, 433 aa, Bordetella parapertussis 12822
MHTAFHLPNEPEMKNRDLNTRRTLATPRGVGVMCDFYAVRAENSTLWDAEGKEYIDFAGGIAVLNTGHRHPKVKAAIAAQLDNFTHTAYQIVPYEGYVSLAERINAVAPIEGLKKTAFFTTGVEAVENAVKIARAYTGRSGVVAFSGAFHGRTMMGMALTGKVAPYKLAFGPMPGDVFHVPFPNATQAISVADSLKALDLLFKVDIDPKRVAAIIIEPVQGEGGFNVTPPELMQALRKVCDEHGILLIADEVQTGFARTGKLFAMQHHSVQADLITMAKSLGGGMPISGVVGRAEVMDGPAAGGLGGTYAGNPLAVAAAHAVLDVIAEEKLCERAAELGKRLMDRLEGLRAKCPAIADVRGLGSMVALELNDPATGKPDAEAVKRIQQQAIERGLILLSCGVYGNVLRFLYPLTIPDDQFARALDILAETIAA

SEQ ID NO: 47991 - protein, 189 aa, Oryza sativa
GATRFDLSESCPGRIRCAPICGFPTGLSPGLLSPGVFVENILFLEDLGSPQDDLLVIMRKLPNFLALSEKKIRRAVEFLKRDVGLEGRYIVQRPVLLSYSLERRLLPRHCLLKVLRTKGLLNSELDYYSTAALSEKKFVNKFVHPYEDHIAGLADAYASGCSEEGNGVASLLSLQTEMDGVQVYAGKSG

SEQ ID NO: 47992 - protein, 448 aa, Lactobacillus plantarum WCFS1
MSQATDYVQHVYQVIEHRDPNQTEFLEAINDVFKTITPVLEQHPEYIEANILERLTEPERIIQFRVPWLDDAGHARVNRGFRVQFNSAIGPYKGGLRLHPSVNLSIVKFLGFEQIFKNALTGLPIGGGKGGSDFDPKGKSDNEIMRFCQSFMTELSKYIGLDTDVPAGDIGVGGREIGFLYGQYKRLRGADRGVLTGKGLNYGGSLARTEATGYGLAYYTNEMLKANQLSFPGQRVAISGAGNVAIYAIQKVEELGGKVITCSDSNGYVIDENGIDFKIVKQIKEVERGRIKDYADRVASASYYEGSVWDAQVAYDIALPCATQNEISGDQAKNLIANGAKVVAEGANMPSSPEAIATYQAASLLYGPAKAANAGGVAVSALEMSQNSMRLSWTFEEVDNRLKQIMQDIFAHSVAAADEYHVSGDYLSGANIAGFTKVADAMLAQGLV

SEQ ID NO: 47993 - protein, 752 aa, Ustilago maydis 521
MAAEQSNGVAAAVVEVSIDGKPASIGYDHEFLFVVRGHHSQADAMLSKAYVRVPLTLVLNASFVSDSDGGSLLVRILSPPVQAQGSQAPGPFSFFKKDRSRPKCMESLSQQAYQELTPAERIERLREQLEGPCSSLRLVKIEARVVAVKDGTAIEAKTQSWVDRVMSAAYQHVKPYKRIKVLINPAGGPGKGRQLFDSRARPILEAAGCKLDVTVTTHRMHGFEIARELRIADYDAVGVVSGDGLLHELLNGFATRSDARQALALPLAPIPSGSGNAMSINLLGAQQGFSLALACLNIIKGRPMKLDLLRVTQPASAFPPGVPVPGRSLSGSLGKRGGKTAGEPTLNGNPSASARGSEDVARLIDAPSKPFVQYYSFLSQAIGILADLDLGTEHLRSLGDTRFLIGYASSVLRNAKCDVDVDIKLGARGSKNRAEMRQRVIDFYQARSRSTADQNADGATEGGDLDEGQNSLTQNAQDSSVSASSPCDLVHGDVTQPLTTSSNPPPPFDMRDPSWPHSLLSKTSSVRQVEAALQASQGDEQALQSGWMRIQEPIASLYGGKLPFVSRDMMQFPFALPNDGTIDVAMILHAGGRAAKLPEDGYAENGQIVYQKAMTYLKVEAIRVTPKRKEGDKKLKMGGLISIDGEKVPYAAFQVEVARGLQYSVLSLYGRFCVPVVEPPAMALCLTSALGSHAIRKEETFDTRLNASDPINAVCPWMYVCEIVLQHGNMLRGWVREKADEEKVLADGASVT

SEQ ID NO: 47994 - protein, 318 aa, Brassica napus
MATKRNVGTLKEADLKGKSVFVRVDLNVPLDDNSNITDDTRIRAAVPTIKYLMGNGSRVVLCSHLGRPKGVTPKFSLKPLVPRLSELLGIEVVMANDSIGEEVQKLVAALPEGGVLLLENVRFYKEEEKNDPEFAKKLAALADLYVNDAFGTAHRAHASTEGVAKYLKPSVAGFLMQKELDYLVGAVANPKKPFAAIVGGSKVSTKIGVIESLLSTVDILLLGGGMIYTFYKAQGHAVGSSLLEEDKLDLARSLMEKAQDKGVSLLLPTDVVIADKFAPDANSKIVPATAIPDGWMGLDIGPDSIKTFSEALDTTKTI

SEQ ID NO: 47995 - protein, 429 aa, Zea mays
MAPLHAALPPPSSAAAHHHAAAPPVFLARSPYHPRRAAASCPLAVAAAPSSRKAFLSCPLLGHWTTAAPPRAIPSSSSSSTPALIASVQDLYDFICCGPLVDRIGYTSEKITESIDRWLLAGARVARLFRLNELQLSDAEKARIYHFYIPVFLWCEDEVMVHRARYNDGDDIPPLVIGVSAPQGSGKTTLVFALDYLFRVAGRNSATLSIDDFYLTAKEQNELRDRNPANALLEFRGNAGSHDLQLSVETLESLIKLTKEGMKMKVPRYDKSAFGGRGDRADPSVWPEVEGPLEVVLFEGWMLGFKPLPNEVVKEVDPQLEVVNKNLEAYSDAWDRFIQSWIVIKIREPGSVYQWRLQAEVAMRADGKPGMSDEEVMDFVSRYLPAYHAYLPTLYKEGPNGSNPDHLLVIDIDENRNPICGGSWDISCL

SEQ ID NO: 47996 - protein, 362 aa, Glycine max
MTDNEEPMIVPGSMSELAFNKYKRWQWWCLVTLSIAFLIVGQSAAVILGRFYYDQGGNSKWMATLVQTAAFPILFIPLFTIPSPPEASTSASPPIKIILLIYFGLGVLIAADNMMYSTGLLYLSASTYSLICASQLAFNAVFSYFINSQKFTALIINSTVVLTLSAALLAVNEDTDEPSGFSKGKYIIGFLCTLGASAVYSLLLSLMQLTFEKVLKKETFSVVLEMQIYTSFVASGASVIGLFASGEWRTLHGEMEGFQKGYVAYVMTLVWTSIAWQVCSVGVVGLIFLVSSLYSNVISTVSLAVTPIAAVIVFHDKMNGVKIISMLLALWGFASYIYQNYLDDSKTRHAQAATKSQNDSSC

SEQ ID NO: 47997 - protein, 274 aa, Triticum aestivum
MSIHGIESMEAKRRRGEKSATSEGAIPLEVLDCAFCFDPLTPPVFQCRVGHVICSSCHHKLRKKDNCHVCAITGGYNRCIAFDHILESIKVSCSNSIYGCTVKTHYYQQEEHEKSCPHAPCFCPEPGCGFAGSTTQLQRHLTADHMLSATAFAYGYSFTLHMQEGMRVLHRKEEGGPLFLAKFTLVPPFGNAVSILCIDPHDVTENHRFECDVDFYSRTMGWHQHSNFQIISTNLSNGFPGEEASYTFVVPNISSDPHTTTTRLLIRPPKIACP

SEQ ID NO: 47998 - protein, 251 aa, Ricinus communis
MPIRNIAVGHPHEATQPDALKAALAEFISTLIFVFAGEGSGMAFNKLTNNGVATPSGLVAAAIAHAFALFVAVSVGANISGGHVNPAVTFGAFVGGNITLLRGILYWFAQLLGSTVACLLLKFSTGGLTTSAFALSSGVGVWNAFVFEIVMTFGLVYTVYATAVDPKKGSLGTIAPIAIGFIVGANILAGGAFDGASMNPAVSFGPALVSWSWENHWVYWAGPLVGGGLAGLVYEFFFIHSTHEQLPTTDY

SEQ ID NO: 47999 - protein, 250 aa, Oceanospirillum sp. MED92
MRTAFVAGNWKMNGNTDSINELMDGLVNSINSSSVEVLVCPPSVYISQVKSLTESSKISVGAQNVSENANGAFTGEVSLSMLNDLGCEYVILGHSERRSLYAETDQLVAAKFIAAVESGVKPILCVGETLDERENGETLKVVSRQLNAVIDAAGIEKFADAVVAYEPVWAIGTGKTATPEQAQEVHAAIRAEIAKSDAATAEKTRILYGGSVNAANAAELFANADVDGGLVGGASLKVNDFIAICQAADA

SEQ ID NO: 48000 - protein, 442 aa, Zea mays
MASRNHNAAAPQLHHHNRAGVPALGKAKAVPARADALNRRPPLGDIGNLVSVRPATGNPQEQVNRPITRSFGAQLVKKAQAKAAIKNAAILPARHAPRQERKAPVKQQPPPEDIIVLSSDSEQSRAQSESSASSVRSRRKAINTLSSVLSARSKAACGIAGKPRQVVDDIDKLDVNNELAVVEYIEDIYTFYKIAQHERRPCDYIDAQLEINSKMRAILADWIIEVHHKFELMPETLYLTMYIIDQYLSLQPVLRKELQLVGVSSMLIACKYEEIWAPEVNDFILISDSAYSREQILSMEKGILNRLEWNLTVPTVYMFLVRFLKAATLGGKVEKEMENMVFFFAELALMQYDLVTRLPSLVAASAVYAARLTLKRAPLWTDTLKHHTGFRESEAELIECTKMLVIAHSTAPESKLRVVYKKYSSEQFGGVALRPPAEEICK

SEQ ID NO: 48001 - protein, 265 aa, Platanus x acerifolia
MATMLLLFGLLMASLDTTGAQTGVCYGRLGNNLPTPQEVVNLYKSKNIQRMRIYGPDEAVLRALRGSNIELMVGVPNDQLQGIASNPSTANDWVQKYIRAYSPGVKFKYIAVGNEVNPNGNLVSFVLPAMRNINSALASAGLQNQIKVSTAVDTTILGNSFPPSKGTFNDNVRSFLNPIITFLVNNRAPLLANVYPYFSYIGNTRDISLPYALFTAPSVVVQDGQLGYRSLFDAIVDGLYSALEKAGGSSVEIVISETGWPSAGG

SEQ ID NO: 48002 - protein, 311 aa, Triticum aestivum
  misc_feature (138)..(138): Xaa can be any naturally occurring amino acid
MAGGSLDLPVVDLASPDLKSAVDAVRKACVESGFFYVTNHGIQDGLLEALFAESKRFFELPLEEKMLLQRNSSHRGYTPPYAEKLDESSEFQGDLKESFYIGAVRDVDMPNDPNQWPPKERFPSWKDTMKLYHEAALXAGKRILSLIALSLDLEAEFFQNIGAVDCSSEVIRLLHYPGEVNESDNGNYGASAHSDYGMITLLATDGTPGLQICREKDRHPQLWEDVRHVDGTLIVNIGDLLERWTNCVFRSTLHRVVAVGKERYSAAYFLDPRPDLVVQCLESCCCEAYPPRFPPITAGDYLKERLSATYK

SEQ ID NO: 48003 - protein, 474 aa, Bacillus anthracis str. A2012
  misc_feature (470)..(470): Xaa can be any naturally occurring amino acid
MLPRNNTNNELKRTMKSRHLFMIALGGVIGTELFNGSGFIISQAGPGGSVLAFMAGGLLMYFVMLCLGELAVAMPVSGSFQEYATKFINPATGFTIGWLYWLSWANTTGLEFTTAGITMQRWFPDIPVWVWCLIFGVTIFMINALSARSYAETEFWFSSIKVSAIIAFIILGGAAMFGLIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNISIPYAADIMNFVILTAVLSVANSGLYAATRMLWSLSKNEMAPAFLKKLSSRGIPLNALILTISISAFSLLTSVVAAETVYLWLISISGVITIIVWMSICVSQFFFRKHYVADGGRLEDLKFKTPLYPLVPILGFGLYGIILVSLIFIPDQRLGIYCTVPFIIFCYTYYHFKVKKRISTNTSSENKXSETI

SEQ ID NO: 48004 - protein, 445 aa, Pseudomonas aeruginosa PAO1
MTQSVDAFLERLKRRDPDQPEFHQAVEEVLRSLWPFLEANPHYLEAGIIERIVEPERAILFRVPWVDDQGRVRVNRGYRVQMSSAIGPYKGGLRFHPSVNLGVLKFLAFEQVFKNSLTTLPMGGGKGGSDFDPKGKSDAEVMRFCQSFMSELYRHVGADLDVPAGDIGVGAREIGYLFGQYKRLSNQFTSVLTGKGLSYGGSLIRPEATGFGCVYFAQEMLKDRGRGFDGQRVAISGSGNVAQYAARKVMEMGGKVISLSDSEGTLYAEAGLSDEQWEYLMELKNVRRGRIREMAEQFSLQFLEGRRPWGLACDIALPCATQNELDAEDARRLLANGCVCVAEGANMPSTLEAVDLFLEAGILYAPGKASNAGGVAVSGLEMSQNAMRLRWSEGEVDTKLHGIMQSIHHACLLYGEEQGRVNYVKGANIAGFVKVADAMLAQGVV

SEQ ID NO: 48005 - protein, 179 aa, Cenarchaeum symbiosum
MLLLLDNGSIFTRQIADLLHAAGAIFRRVSPAELGPDDAARFDSYILSGRRRNDAAVNAFNSRIIRHALSRGKPLLGICYGAEIMALTLGGTIRRTGARRGYGSVRVHGDNPLCGGEVTVFESHSFEIARLAGPVVGLASSSACEHEMIHARGSKMYGTQFHPEMSDDGRGMIRRFLSV

SEQ ID NO: 48006 - protein, 487 aa, Porphyra yezoensis
MPTLPPPLFLPLPQLAFRLSTPPTAIMSGLSAKLQPVFDSIKARNPNEPEFLQAAEEILHSLGPVVEAEGGDKFIPVTKALFEPERVIQFRVAWYDDAGELQVNRGFRVQMNSAIGPYKGGLRLHPTVNLSILKFLATEQVLKNAVTTLPLGGGKGGSDFNPKGRSEAEVRRFCQSFMGALARHIGPDTDVPAGDIGVSGREIGYLFGAYKRVTNRFEGILTGKGPTFGGSLIRPESTGYGVVMFVREMLKVKGDTLEGKVVVISGSGNVAQYATQKVNALGGKVIALSDSKGVLVDEEGITDKKLAEVMDIKNVRRTSLKAFTEKFSTAKWTDFSEQYTDEDEKSNPLWEIKCDVALPCATQNELNADGARALVDNGVSIVAEGANMPSTPGAIEVLRSAKVAFAPGKASNAGGVATSGLEMSQNSQRMAWSAEKVEEELDGIMTRIHADCVETAKAYDRAGDYVFGANVTGFLKVAEAMLAQGLA

SEQ ID NO: 48007 - protein, 395 aa, Phytophthora infestans
MKTLMEPERLIQFRVPWIDDEGSSRVNRGFRVQFSSALGPYMGGLRFHPETTHGTAKFLGFETIFRNALAGPYGGAHGGSDFNPMDKSESEIMRFCQSYMTELVNYIGPHTDVPTAGVGVGPQEIGYMFGQYKRMRQLHPGGTEGILSGGAYHYPQVTGYGVAHFANRILETRGETLKGKRCLISGSGTVALNVARKLLDFGAIPIGMSDNFGYVIEDQGFSSKSLEELKRIKEERNARLGAYIMSSTTANYHPSEEGRLWETPCDYAFPCAIQNDVDADAVRLLVKNGCKGIFEGANFPCTDEAISLIKQHGLAFGPNKASNGGSFALITKNLGSSTQMLDDEVDVIVKEYMDKLHDRVAASAEEFNAGGDLHVGANITAFMSVAAAMFRQGVV

SEQ ID NO: 48008 - protein, 394 aa, Synechococcus sp. RS9917
MTQLETRTEPMVVNFGPHHPSMHGVLRLVVTLDGEDVVDCEPVIGYLHRGMEKIAENRTNVMFVPYVSRMDYAAGMFYEAIVVNAPERLADIPVPKRASYIRVLMLELNRIANHLLWLGPFLADVGAQTPFFYIFREREMIYDLWEAATGQRLINNNYFRIGGVAADLPFGWLEKCRDFCDWFGPKIDEYEKLITNNPIFRRRIEGLGTIGREEAINWSLSGPMLRASGVPWDLRKVDHYECYDDFDWDVAWENEGDCFARYRVRIEEMRQSLKILRQACDMIPGGPTENLEARRMAEGKSSDFAGFDYQYVAKKVAPTFKIPNGELYTRLESGKGEIGVFIQGNNDVTPWRFKIRAADSNNLQILPHILKGHKVADIMAILGSIDVIMGSVDR

SEQ ID NO: 48009 - protein, 440 aa, Methylococcus capsulatus str. Bath
MQRKRNEQPLPRILIIGGGAGGLELATKLGRTLGKKGKAQVTLIDAHPTHIWKPLLHEVAAGTMDVNDDELDYLAQANACHFRFVLGRMSGLDRVAKQVKLAPMTNAAGEEVIPACSYPYDILVIAVGSVCNDFGVPGVAQNCIFLDTTEEAQQFHRRLLEAYMRAHAMGGAKQPGQLDVAIVGGGATGIELSAQLHQATRLLAAYGLDNVKPSDIKIHLIEAAPRLLPELPPRLSESTVKQLLALDVQLHLGERVVEARPDGVLTHTGKFIPATLKVWAAGVKAPDFLAQTDLETNRLNQVVVRQTLQTTRDDHIFAIGDCSACPWPERNTTVPPRAQSAHQQASTAYENILRLLAGKAPVDYRYRDYGSLVSLGKYSTVGNLMGNLLGSVMIEGVIARLVYLSLYKMHQYALFGPLRVGLIMIAHFFSQKLRPKIKLH

SEQ ID NO: 48010 - protein, 518 aa, Zea mays
MAPPRISFLELCLSFLCFVVFYYFHMRSKRKNPFVPLDWPLVGMLPALLGNLHHLHDWITSLLVASQLSFLFTGPPRSGMQFFVTADPANVRHVFTSNFANYPKGPEFEEIFDVLGGGIFNADGESWRRQRAKAQLLMSSAPFRALVSRYSRAKVDTALLPLLSHMAATGEAFDLQDVFLRLTFDTTTTLVFGVDPGCLSVGLPEVPFARAMDDAMGVLLLRHVVPMTWWKLARRLRIGHERKMAEAWRTIDQFVADTIAKRRAEKARHGNGQVSADLLSSYINDDEDEEGGVDAFLRDTTINLMLAGRDTTGSALSWFFYLLTRNPRVVGKIRQELECVKSKSSGSGGGMASFDPDELSRLTYLHAALCESLRLYPPVPQELKEAAAADVLPCGHEVRAGDKILVSLYAMGRMEEVWGSDCREFRPERWIPELEDGRRVVQVRYVPSYKFMSFNSGPRTCLGKDMAFVQLKAAAAAVVSNFDVEAVPGHVVEPMLSIILHMKNGFMATVKRRRQTFA

SEQ ID NO: 48011 - protein, 637 aa, Neurospora crassa
MSDHDPDHGPASPNEYDDESNPASPGSVDESSEASTPMDPPSSGSDAMPGFTPEGDLPRRVPSLRTISDPQHTNSMSPSSSVPGTLNAARRPAASAANLPTDLMAKARALHQQRMGMAPRPSMSPQNSGLGMGPMGSGMGGMGSMGGMGHSMNLNMNHGGPAPGGLPGGLRLPPGIARPPPQGFPKSAPAIAGLGAKKAPSLSERRAMKLGGLPGGPGSPVTATPKLSDMGAEDAKAPAINGEGRGSKLSDFKNYIDAEKGWITFADAATITRTGVNFANGQTFRISLDEVEVMDELGKGNYGTVYKVRHSKVMAMKEIRLELDESKFSTILKELVILHECASPYIIDFYGAFYQEGAVYMCIEYMDGGSIDKLYAGGIPENVLRKITYATIMGLKCLKEDHNIIHRDVKPTNILVNTNGQVKICDFGVSGNLVASIAKTNIGCQSYMAPERISGGGMSAAGGAAAGTYSVQSDIWSLGLTIIECAMGRYPYPPEVSSTIFSQLSAIVEGDPPGLPSEGYSGTAQDFVKSCLNKIPAKRHTYPMLLMHPWIKSLGRPETITEEVEAEEKAADDQLADATGSLDINSNGPINDQGDREVAEWVTNVLDRKLKGLLSDKAEKPALHAAPLDQVSPGIAA

SEQ ID NO: 48012 - protein, 1069 aa, Oceanospirillum sp. MED92
MPKRSDLQSILILGAGPIVIGQACEFDYSGAQACKALREEGYRVILVNSNPATIMTDPAMADSTYIEPINWKTVEKIIAKEKPDALLPTMGGQTALNCALDLEREGVLEKHGVEMIGANADTIDKAEDRDRFDKAMKNIGLECPRAAIAHSMEEALQVQAQLGFPCIIRPSFTMGGTGGGIAYNKEEFIEICERGLDLSPTTELLIDESLIGWKEYEMEVVRDKNDNCIIVCAIENFDAMGVHTGDSITVAPAQTLTDKEYQIMRNASLAVLREIGVETGGSNVQFGVNPKDGRMVVIEMNPRVSRSSALASKATGFPIAKVAAKLAIGYTLDELQNDITGGATPASFEPSIDYVVTKIPRFTFEKFPQANDRLTTQMKSVGEVMAIGRTQQESLQKALRGLEVGATGFDPIIDITSEDARSTIVREMKEPGAERIWYLGDAFRMGMSVDELYEISGIDPWFLVQVEDIIKDEQRVSEMAMSDLDKDAVFRLKRKGFSDERLATLLGVSEKQFRKHRHNLDVRPVYKRVDTCAAEFSSDTAYMYSSYEEECEANPSDRDKIMVIGGGPNRIGQGIEFDYCCVHAALAARDDGFETIMVNCNPETVSTDYDTSDRLFFEPITLEDVLEIVHVEKPKGVIVQYGGQTPLKLAVALEQAGVPIIGTSPEAIDRAEDREQFQQMLKRLGLKQPENATVRSLEEAIIEADKLGYPLVVRPSYVLGGRAMEIVYKEEELRRYMTTAVQVSNDAPVLLDHFLNAAVEVDIDAVCDGKDVVIGAIMQHIEQAGVHSGDSACSFPPYSLAADVQDEMREMVRKMALELGVVGLMNTQLAYQDGEIYVIEVNPRASRTVPFVSKCIGVSLAKIGAQVMTGKSLAELGFTKEIVPALYNVKEAVFPFNKFQGVDPILSPEMKSTGEVMGVGATFGEAFMKAHIGAGETLPESGKAFVSVREADKSAVAAMAKDLVALGFKLVATKGTAQLLQESGIEAEVVNKVMEGRPNIIDMIKNDEIAYIVNTTEGRKAIEDSADIRRSALQHKVPYTTTLAGAEAITMALQFGEEKEVRRVQDLGA

SEQ ID NO: 48013 - protein, 489 aa, Cryptococcus neoformans var. neoformans JEC21
MGKRTADAADLPVSKAAATGQATAREPAADDEMGEFEDRWEDEIESEEEVVEHDADGEADGKSCSEDAEPPAAPTQTYLPGTAIAEDEQLVPDNSVYLALHSLSYAWPCLSFDVLRDSLGTDRATYPHTSWIVTGTQAGEVPGEGKAKDEVVIMRLGNLSKTQHDDDDDSDDGKDDDDDEADDEDATLDFLTIPHVGSVNRVRAAPAPVGGAVPDPYHVATFSETGKVHIFDVRPYIDTLAGPSRPRQKLPVHTISNHGRAEGFAVEWGATGLLTGDIDRKIYLTTLTPSGFTTSPNPYLSHTSSVEDLQWSPTEPTVFASASADRTVRVWDVRAKGRRSVVSVEAHSEDVNVISWNKTVDYLLVSGGDEGGLKVWDLRMFKDTPSPVAQFQWHTAPITSVEWHPTDSSVFAASGSDDQLTLWDLSVEPDEDEAPIGPADGNITAVPPQLLFVHQGQKDVKELHWHPQIPGMVISTASDSFNVFKTISC

SEQ ID NO: 48014 - protein, 272 aa, Salmonella typhimurium LT2
METYAVFGNPIAHSKSPFIHQQFAQQLDIVHPYGRVLAPINNFINTLDAFFAAGGKGANITVPFKEEAFARSDELTERASLAGAVNTLKRLEDGRLLGDNTDGIGLLGDLERLNFIRPGLRILLIGAGGASRGVLLPLLSLDCAVTITNRTASRAEALAKIFAHTGSVHATDMDKLDGCEFDLIINATSSGIRGEIPAIPASLIHPSLCCYDMFYQKGNTPFLSWCVQQGAKRYADGLGMLVGQAAHAVLLWHGVLPQVEPVIEQLQQELLA

SEQ ID NO: 48015 - protein, 795 aa, Zea mays
  misc_feature (61)..(61): Xaa can be any naturally occurring amino acid
  misc_feature (87)..(87): Xaa can be any naturally occurring amino acid
  misc_feature (102)..(102): Xaa can be any naturally occurring amino acid
  misc_feature (122)..(122): Xaa can be any naturally occurring amino acid
  misc_feature (153)..(153): Xaa can be any naturally occurring amino acid
MATPSHLLLVVFTALLALLPGTTQLQPSQVWTLIKIQQLLNAPPMLSHWRRSTDFCGGGGXAPMGPAGSAAVLCYGDTVTQLHIAGXRARRPLPRNFSIGAXVTTLSRLPDLKVLTLSGLGXLWGPLPGKLGRLASLEIVNMSGNYLFGEVPXGVSRLAGLQTLVLDDNMLGGEVPAWIGALPSLAVLSLRNNTFQGAVPESLGSAPSLRSLVLASNNLSGNLPDMSRQANLQVLDVGGNSLGPAFPKLGRKVVTVVLGRNRFGGGLPAELSSFYLLERLDVSWNRFVGPFAPALLSLPSIRYLNIAGNRFTGTLSDKAPCGDNLRFVDLSLNLLMGSVPTCLRSPGRKPDTVVLVSTNCLDDSDGSQHPSPFCQNQALAVGIVPGKERKSVAGQAGFVAGVVVAILVAISAVGLIAFFAVRKAAMKRWEARAPTVSEEESSSTGYPSKMLADARYISQTLKLGALGIPSYRAFSLVELEAATNNFENSHLLGQDSHGEMYRGRLGNGTPVTIRTLKMKRSQTAQSFNRHIETISRLRHQNLVSALGHCFEYNLDESTVTQLYIVFEYVQNGNLRSRISQGTEGCRLTWSQRISAAIGVAKGIQFLHGGIIPGLVGNDLRITNVLVDQNHVAKIGSYNIPILAEAMRSEQGGAGNKFQADSRVKSDKTDIFDFGVILLEVVSGKTITSMYEVEILKELLAWAIADEDRVRRRSFADPAVSKGCSDESLRTVMEICQRCLAKEASQRPSVEDVLWNLQFAAQVQDDWETDAWSSGGGSPVSSSSRATRPSRLHLSR

SEQ ID NO: 48016 - protein, 180 aa, Triticum aestivum
MAAHVEPLVVGRVIGDVVDMFVPTMPVTVRFGTKDLTNGCEIKPSIADAAPSIQITGRAGDLFTLVMTDPDAPSPSEPTMKEWLHWLVVNIPGGSDPSQGEEVVPYMGPKPPLGIHRYVLVLFQQKARVLAPAPGGDTAASAMRARFSTRAFAERHDLGLPVAAMYFNAQKEPANRRRRY

SEQ ID NO: 48017 - protein, 429 aa, Salmonella typhimurium LT2
MKKQNNLRSLAAQAVEQVVEQGQSLSNVLPPLQQKVADKDKALLQELCFGVLRTLSQLEWLINKLMSRPMTGKQRTVHYLIMVGFYQLLYTRVPPHAALAETVEGAVSIKRPQLKGLINGVLRQFQRQQETLLNEFATSDARFLHPGWLVKRLQNAYPTQWQHIIEANNQRPPMWLRVNRTHHTRDGWLGLLEDAGMKGYPHPDYPDAVRLETPAPVHALPGFAEGWVTVQDASAQGCAVFLAPQNGEHILDLCAAPGGKTTHILEVAPEADVLAVDIDEQRLSRVYDNLKRLGMKATVKQGDGRYPSQWCGEQQFDRILLDAPCSATGVIRRHPDIKWLRRDRDIAELAQLQAEILDAVWPRLKPGGTLVYATCSVLPEENRDQIKTFLQRTPDAALSETGTPDQPGQQNLPGGEEGDGFFYAKLIKK

SEQ ID NO: 48018 - protein, 180 aa, Triticum aestivum
  misc_feature (91)..(91): Xaa can be any naturally occurring amino acid
  misc_feature (150)..(150): Xaa can be any naturally occurring amino acid
  misc_feature (163)..(163): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLRXSSKVGFIFREHNASPWGTTMAGTGTMWKLPNVSGWHRRQRKVINEVEEVKKEYPDAYVXRIIRFDNMRQVQXASSFIASNQPGCKIRQG

SEQ ID NO: 48019 - protein, 208 aa, Platanus x acerifolia
PKQPVYLWTLPMFHANGWSFPWGMAAVGGTNICLRKFDAATIYGAIRKHGVTHMCGAPVVLNMLANAPDGASLSHPVQILTAGAPPPAAVLFRTEALGFVVSHGYGLTETAGLVVSCAWKPQWNRFPATERAKLKARQGVRLAGMAEVDVVDPDSGVSVKRDGSSLGEIVLRGGCIMLGYLKDPAATSKSMKNGWFYTGDVGVIHPDG

SEQ ID NO: 48020 - protein, 235 aa, Oryza sativa (japonica cultivar-group)
MGATLLLLCADFSAVAGGRRRPSLPSEPRLAAPAAGSRAPPSRASVRPSAAAAPLAARGLPHHASVAGQNSGIYTVGDFMTKREELHVVKSTTSVDEALEMLVEHRITGFPVIDDEWNLVGVVSDYDLLALDSISGNGLAEVDIFPEVDSTWKTFNEIQKLLSKTNGKVIGDVMTSAPLVVRETTNLEDAARLLLETKYRRLPVVDSSGKLVGIITRGNVVRAALKIKKKFEGEL

SEQ ID NO: 48021 - protein, 116 aa, Glycine max
MASSMISSPAATTDNRAGAAMGASFTGLKPMAGYPTRKTSSDITYIASNGGRVHCLLVWPPGGLKKYVTLSYLPDLDDAQLAKAVEYLITMGRIPCSAFEMERCFQHREHTREPGY

SEQ ID NO: 48022 - protein, 385 aa, Desulfovibrio desulfuricans G20
MKETGRTAGIKPFYAMDVLERAQELERQGADVIHLALGEPDFDVPEPVRQALVQAVEGGHTHYTGSMGMLELRQAIAKDYRRRYGVDVSPERIAVTSGTSPAMFMLFGALLQQGDEVIISDPHYACYPSFISFAGGVPVKVRVYEEDGFQYRLDAIKAKLTGRTRAIFINSPSNPTGNQLPADRMRRIASLGIPVISDEIYHGLEYGEKEHTILEFTDNAFVFNGFSKLYAMTGLRLGYVIAPDAWVPVLRKLCQNFFISPNSVSQHAGVAALTQCDADVARMRIIYDERRKFMIRRLREMGFGITVEPTGAFYVLANARFLSADSYALAFEILEQAHVGVTPGIDFGEGAEGYLRFSYASSLEKIHEAMNRLEQFVRSRTGCAC

SEQ ID NO: 48023 - protein, 469 aa, Methylococcus capsulatus str. Bath
MTPKDVLQIIKEKEVRYVDLRFADTRGKEQHVTVPASTIDEAAFEEGKMFDGSSIAGWKGINESDMILMPDASTAVMDPFFDDPTLILRCDIVEPATMQGYERDPRSIAKRAEAYMKSTGIADTALFGPENEFFIFDDVRWGANMSGSFYKVDSEEAGWNSEKVYEDGNIGHRPGVKGGYFPVPPVDSFQDLRSAMCNTLEDMGMVVEVHHHEVATAGQCEIGVRCNTLVKKADEVLLLKYAVQNVAHAYGKTATFMPKPLVGDNGNGMHVHQSLAKDGKNLFSGDLYGGLSETALHYIGGIIKHAKALNAFCNASTNSYKRLVPGFEAPVMLAYSARNRSASIRIPYVMNPKARRIEVRFPDSTANPYLAFAAMLMAGLDGIQNKIHPGDAMDKDLYDLPPEEEKAIPQVCYSFDQALEALDKDREFLTRGGVFTDDMIDAYLDLKGQEVTRLRMSTHPVEFDMYYSL

SEQ ID NO: 48024 - protein, 274 aa, Porphyra yezoensis
REFLSNKTVATAAGLPTPWSIPASTFAIQGLGNVGYWAAHFIAKNGGRITTVGERDGTVSDPAGVDVEALKLHLTNNGGSVVGFANGGSPSLSVVADPAAVLSADVDVLIPAALEGAITTANAKAVRAKVVAEAANGPVTAGADVVLAAAGVVVLPDLVMNAGGVTVSYFEVAKNLAGLRFGRLTQRAEEAAMANLLATLQSHGVTITDRDRRRLIIGADERAHVYSGLEDSMCAACGETVKVAAELGVSLRIAAYFTAIRRVAETFESRGLWP

SEQ ID NO: 48025 - protein, 302 aa, Oryza sativa
  misc_feature (55)..(55): Xaa can be any naturally occurring amino acid
MLGRAIRSMEVMVHSSTFLLPKLHQPANSPAKKYALVVLNQNLPRFVPRLWTHGXAKLRICADGGANRIFDEMFQMTNDPDYESTRKRLYSLLEISISSGVPFDMLCDLNAQLVPKTVTKINSTYGHIQAKIPLQRTGMSIVCWKGSKISDKSHNQETTDLHKCISRIHRCTPDHEKTNLCVLVTGALGGRFDHEAANINILYLFSDMRIVLLSDDCLIRLLPKTHKHEIYIESSVEGPHCGLFPVGAPSGSTTTTGLKWNLSEAKMRFGSMISTSNIVHAEKVTVQSDADLLWTISLRNLT

SEQ ID NO: 48026 - protein, 211 aa, Novosphingobium aromaticivorans DSM 12444
MTQSSSESCAGRLLAAPGMMRVPSPRLEMFVVRDFLSQAECNGLIARIERDRRPSTIADANGDHYFRTSETCDLPMDDPEIVALDEKLCALSGIGRPFGEPIQGQRYESGQEFKAHTDYFDPHGADFQRFCSVAGQRTWTFMVYLNDVEAGGATRFKVIDKTIQPERGKLVCWNNRRPDGTVNPCTLHHAMKVRKGLKYVITKWYREKPWG

SEQ ID NO: 48027 - protein, 258 aa, Ralstonia mannitolilytica
SVKNAAVNVPYGGAKGGIRVDPRKLSSGELERLTRRYTSEIGIIIGPNKDIPAPDVNTNAQIMAWMMDTYSMNEGATATGVVTGKPIALGGSLGRREATGRGVFVVGSEAARNLGIDVKGARVVVQGFGNVGSVAAKLFHDAGAKVIAVQDHKGIVFNGSGLDVDALIKHVDHNGSVAGFAAETVSADDFWALDCEFLIPAALEGQITAKNAPHIKAKIVVEGANGPTTPEADDILRERNILVCPDVIANAGGVTVSY

SEQ ID NO: 48028 - protein, 283 aa, Bdellovibrio bacteriovorus HD100
MYKRSEGFFKGYQDINLFFQIWDNPEARGTVIITHGHGEHSESYHRLIKAFENDKWSFYGWDLRGHGRSDGRRGYVAEFDDYCKDYKIFLDMVMKEEKVKKGPVILYCHSMGGLIQLKTLLQNSDIDCTAMVISAPLLGLTVPVPAFKAKGAGILNKLLPQITMGNELSNDMLTRDPDVIREYEQDALRHTRVSPGAFLGFLDSFEFVNPRANQLKKPALVIVSDADPVISTSAAKALYEHLGTTQKELYVYPGGKHELINDTIRQTVYADIKKFLDGFLESK

SEQ ID NO: 48029 - protein, 401 aa, Rickettsia sibirica 246
MSIISTRLSSIKPSPTLAIVKKTLELKQAGVDIITLGAGEPDFDTPDNIKEAAIKAIKDGFTKYTNVEGMPLLKQAIKDKFKRENNIDYELDEIIVSTGGKQVIYNLFMASLDQGDEVIIPAPYWVSYPDMVALSTGTPVFVNCGIENNFKLSAEALERSITDKTKWLIINSPSNPTGASYNFEELENIAKVLRKYSHVNIMSDDIYEHITFDDFKFYTLAQIAPDLKKRIFTVNGVSKAYSMTGWRIGYGAGSKTLIKAMTIIQSQSTSNPCSISQMAAIEALNGPQDYIKPNALNCQKKRDLALSILKRVKYFECYKPEGAFYLFVKCDKIFGHKTKSGTIIANSNDFAEYLLEEAKVAVVPGIAFGLEGYFRISYATSMEELEKACIRIERTIDVIPA

SEQ ID NO: 48030 - protein, 661 aa, Streptococcus agalactiae 2603V/R
MTFDTIDQLAVNTVRTLSIDAIQAANSGHPGLPMGAAPMAYVLWNKFLNVNPKTSRNWTNRDRFVLSAGHGSALLYSLLHLAGYDLSIDDLKQFRQWGSKTPGHPEVNHTDGVEATTGPLGQGIANAVGMAMAEAHLAAKFNKPGFDLVDHYTYTLHGDGCLMEGVSQEAASLAGHLKLGKLVLLYDSNDISLDGPTSQSFTEDVKGRFESYGWQHILVKDGNDLEAIAAAIEAAKAETDKPTIIEVKTIIGFGAEKQGTSSVHGAPLGAEGITFAKKAYVWEYPDFTVPAEVADRFASDLQARGAKAEEAWNDLFAKYEVEYPELATEYKEAFAGQAETVELKAHDLGSSVASRVSSQQAIQQLSTQLPNLWGGSADLSASNNTMVAAETDFQASNYAGRNIWFGVREFAMAAAMNGIALHGGTRVYGGTFFVFSNYLLPAVRMAALQNLPTVYVMTHDSIAVGEDGPTHEPIEQLASVRSMPNLNVIRPADGNETNAAWQRAVSETDRPTMLVLTRQNLPVLEGTSELAQEGVNKGAYILSEAKGELDGIIIATGSEVKLALDTQDKLESEGIHVRVVSMPAQNIFDEQEASYQEQVLPSAVTKRLAIEAGSSFGWGKYVGLNGLTLTIDTWGASAPGNRIFEEYGFTVENAVSLYKEL

SEQ ID NO: 48031 - protein, 575 aa, Hevea brasiliensis
MDTTGRLHHRKHATPVEDRSPTTPKASDALPLPLYLTNAVFFTLFFSVAYYLLHRWRDKIRNSTPLHIVTLSEIVAIVSLIASFIYLLGFFGIDFVQSFIARASHDVWDLEDTDPNYLIDEDHRLVTCPPANISTKTTIIAAPTKLPTSEPLIAPLVSEEDEMIVNSVVDGKIPSYSLESKLGDCKRAAAIRREALQRMTRRSLEGLPVEGFDYESILGQCCEMPVGYVQIPVGIAGPLLLNGREYSVPMATTEGCLVASTNRGCKAIYLSGGATSVLLKDGMTRAPVVRFASATRAAELKFFLEDPDNFDTLAVVFNKSSRFARLQGIKCSIAGKNLYIRFSCSTGDAMGMNMVSKGVQNVLEFLQSDFSDMDVIGISGNFCSDKKPAAVNWIEGRGKSVVCEAIIKEEVVKKVLKTNVASLVELNMLKNLAGSAVAGALGGFNAHAGNIVSAIFIATGQDPAQNVESSHCITMMEAVNDGKDLHISVTMPSIEVGTVGGGTQLASQSACLNLLGVKGANKESPGSNSRLLAAIVAGSVLAGELSLMSAIAAGQLVKSHMKYNRSSKDMSKAAS

SEQ ID NO: 48032 - protein, 310 aa, Bacillus sp. NK13
MPLDPHIQIFLNQYNEMPRPSLEDVTPPQLREMEKMSLTPSKEAVKKVYNKDIELNERTLTIRVYEPEGTGPFPALVYYHGGGWVLGSLDTHDSICRSYANGANCIVVSVDYRLAPEDKFPAAVNDAYEALDWISAHASQLNIDSNKIAVGGDSAGGNLAAVVSILAKERQGPSIVHQLLIYPSLGFKNQHPASMKENAEGYFLSKDLMDWFRLQYLNNKEEEQHPYNAPVLLEDLSSLPSATIITAQYDPLRDSGKDYADALKNHGVPVTYENYETMIHGFLGFHEFVPLAQQAINKSAAQLRQVFDSI

SEQ ID NO: 48033 - protein, 448 aa, Chlamydomonas reinhardtii
MEARTVSVLAGLAHRVASAAWRSASGLRTCTTTTPTYGRTSVYVKEALDLLDFDPQVEKAILNPDREVTVNLVVPMDNGEVNMFPAYRVQHNNALGPFKGGIIYHPGVTLENMRNLASLNTWKFSLLNVQFGGAKGGVGVDPRSLSERETEKLTRKYVQALQEVIGPHTDIPAPDINTDEHHMAWIFDQYSRLRGFAPAAVTGKPTWLHGIVGRDKAGGRGAAIATREFLTRSLRRKVAGTSFLIQGFGKLGSWTAQILQQEMGAKIVGVSCSETAVYNEEGLDIPALRAHVAAGGLLKDFPGGTGVLNDDSFLDLPADVFIPCAVDGTIHAGNVHRCVNFKAVVEAANGALTPEADAALRKAGVPVLPDLIANGGAVVVSFFEWVQNNQNMQWEEDDVKRELDRYLTDAFEALLREQSLHAGCSLRTAGYLVALRRLQQADSVRGHS

SEQ ID NO: 48034 - protein, 352 aa, Amycolatopsis methanolica
MTSTTFRRSDQMRVGVLTGGGDCPGLNAVIRAVVRKGIEAHGWEIVGFRSGWRGPLTGDSRPLGLDDVEEILIRGGTILGSSRTNPYKEEGGVEKIRAVLADQGVDALIAIGGEDTLGVAKKLTDDGIGVVGVPKTIDNDLAATDYTFGFDTAVHIATEAIDRLRTTAESHYRAMVVEVMGRHAGWIALHAGLAGGANVILVPERPFSVEQVVEWVERRFEKMYAPIIVVAEGAVPEGGAEVLRTGEKDAFGHVQLGGVGTWLADEIAERTGKESRAVVLGHTQRGGTPTAYDRVLATRFGLHAVDAVADGDFGTMVALRGTDIVRVKLAEATAELKTVPPERYEEAEVFFG

SEQ ID NO: 48035 - protein, 396 aa, Synechococcus sp. RS9917
MGVAQNEEIRHEKTGIVFRPGLEGVPATQSAICDIDGQLGRLSYRGYPLEDLAVHSTFLETTYLLIWGELPSPQQLRDFEEEVQMHRRVSFRVRDMMKCFPASGHPMDALQSSAASLGLFYSRRAIDDPQYIYDAVVRLIAKIPTMVAAFQLIRKGQDPIQPRDDLAYSANFLYMLTEREPDPLAARIFDRCLMLHAEHSLNASTFSARVTASTLTDPYAVVASAVGTLAGPLHGGANEDVLAMLEEIGTPANAAAYLDEAMASKRKVMGFGHREYRVKDPRAVILQSLAEEMFARFGHDALYDVARALEEAADTRLGPKGIYPNVDFYSGLVYRKLGIPRDLFTPVFAIARVAGWLAHWREQLGANRIFRPSQIYTGHPLRSWVARESRVPAAGA

SEQ ID NO: 48036 - protein, 665 aa, Mannheimia succiniciproducens MBEL55E
MTDHKKLANAIRFLSMDAVQKAKSGHPGAPMGMADIAEVLWRGFMKHNPTNPKWADRDRFVLSNGHGSMLIYSLLHLTGYDLSIEDLKNFRQLHSKTPGHPEYGYAPGVETTTGPLGQGITNAVGMAIAEKTLAAQFNREGHDIVDHHTYVFLGDGCLMEGISHEACSLAGTLGLGKLIAFYDDNNISIDGHVDGWFSDNTKGRFEAYGWQVIDNIDGHNPEQIAAAVKLARAETEKPSIIICKTIIGYGSPNKSASHDCHGAPLGDEEIALTRKALNWEYAPFEIPADIYAAWDAKSAGQSAEAVWNEKFAAYEKAYPELAKEFKRRVNGELPANWAAESQAFIEKLQANPASIASRKASQNAIEAYAHILPEFLGGSADLASSNLTLWSGSKPIRAKQNVDGNYINYGVREFGMSAIMNGIALHGGFIPYGATFLMFYEYAHNAVRMAALMKQRSLFVYTHDSIGLGEDGPTHQPVEQTASLRLIPNLETWRPADQVESAIAWKAAVERKDGPSALIFTRQNLAQQDRTSEQLANVARGGYILKDCAGTPELILIATGSEVELAVKAAEALTAEGKAVRVVSMPSTNVFDKQDEAYRESVLPSSVTKRVAIEAQIADFWYKYVGLEGRIVGMNRFGESAPADQLFKLFGFTVENVVAKAKEIL

SEQ ID NO: 48037 - protein, 218 aa, Synechococcus sp. RS9917
MFGFLKQVGDYTRDAVDAARNLTQGLAVTFDHMKRRPVTVQYPYEKLIPSERYRGRIHYELDKCIACEVCVRVCPINLPVVDWVMNKETKKKDLRNYSIDFGVCIFCGNCVEYCPTNCLSMTEEYELAAFDRHSLNYDNVALGRLPTSVTTDPSVQPLRELGYLPAGVIDPHDVPADQPRAGQLPEQVLATLAPLAGADAADGGESSATAPAKEESAE

SEQ ID NO: 48038 - protein, 480 aa, Oceanospirillum sp. MED92
MSDKFDVIVIGAGPGGYVAAIRAAQLGLKTACVEKWVDEKGGAVLGGTCLNVGCIPSKALLESTHQFHNAQHADVHGIQVSGDVTMDVKAMVARKDKIVGNLTMGVAGLFKANGVTLLQGMGKLHGGKKVEVTAADGSSATYEAENVILASGSVPVEIPPAPLTEGLILDNEGALNIDETPKRLGVIGAGVIGLEMGSVWARLGTEVTVLEAMDDFLAAADKDVAKEAAKLFKKQNLDIKLGARCTGTEVIGGKEVKVKYTDANGDQEIVVDKLIVAVGRKPQTQGLLADDSGVNLDERGFIFVNEQCQTGVPGVYAIGDSVRGPMLAHKASEEGIMVADIIAGHHAQMNYDVIPNIIYTHPELAWVGKTEQELKAEGAKIKVGKFPFAANGRAMAANETDGFVKMIACEETDRVLGVHIVSGIASELIGQAAIAMEFCSSAEDLQMTVFAHPTVSEAIHEAALAVDGHAIHMANRKKRK

SEQ ID NO: 48039 - protein, 174 aa, Coprinopsis cinerea okayama7#130
MSLLRAAQAVARPGAGLRTTVGARFNSSKSDPTPATSTKDSAVVPTPPPTEEILAADTISGAPTELRQRVVRIYQPTRNTMQSGSGKTERWRIDFDILPGGSRWENPLMGWASSADYMQGTRLTFRSKEDAAHFAEKQGWDYYVQPPEVKRIPPKNYAENFVYKPHKLRIMRTK

SEQ ID NO: 48040 - protein, 326 aa, Nocardia farcinica IFM 10152
MTRAPAEPGRRGFRRVPARRPPLWHGGLYESVADMKTILITGATSGIGSAAAEQLGARGEHLILVGRNPEKLAATEQRVRAAGAGAVDTLRCDVGSQAAIRELAEQVRQRYDRLDVLANNAGGHFPDRALTEDGVETTFAVNYLGPFLLTELLLDLLLDSAPARVVFTSSVLHFGARLDLDDLPFEHGYTGEKAYSRSKLALILYTRELARRLDGTGVTVNAFHPGAVATGIWDTMPWYGKPLAAIAKRIFMISPEQGAEALTYLATDPEVADTTGCYFQRNRPKQPGRRATDDELGARLVEVSARLCGLPTPLKAGDARGGTPPA

SEQ ID NO: 48041 - protein, 411 aa, Glycine max
MNALAATNRNFRRAAHILGLDTKLENSLLIPFREIKVECTIPKDDGTLVSYVGFRIQHDNARGPMKGGIRYHPEVDPDEVNALAQLMTWKTAVADIPYGGAKGGIGCNPRDLSVSELERLTRVFTQKIHDLIGIQRDVPAPDMGTNSQTMAWILDEYSKFHGHSPAVVTGKPIDLGGSLGREAATGLGVIFATEALFAEYGKSISDMTFVIQGFGNVGTWAAKSIYERGGKVIAVSDISGAIRNPNGIDIPALLKHKEGNGNLKEFSGADIMDPDELLVHECDVLIPCALGGVLNKENAADVKAKFIIEAANHPTDPDADEILSKKGVIILPDIYANAGGVTVSYFEWVQNIQGFMWDEEKVNRELKKYMTKAFRNIKAMCQIHNCDLRMGAFSLGVNRVARATLLRGWEA

SEQ ID NO: 48042 - protein, 258 aa, Ralstonia solanacearum
SVKNAAVNVPYGGAKGGVRVDPRKLSSGELERLTRRYTSEIGIIIGPNKDIPAPDVNTNAQIMAWMMDTYSMNEGATATGVVTGKPIALGGSLGRREATGRGVFVVGSEAARNLGIDVKGARIVVQGFGNVGSVAAKLFQDAGAKVIAVQDHKGIVFNGAGLDVDALIQHVDHNGSVDGFKAETLSADDFWALECEFLIPAALEGQITGKNAPQIKAKIVVEGANGPTTPEADDILRDRGILVCPDVIANAGGVTVSY

SEQ ID NO: 48043 - protein, 449 aa, Coprinopsis cinerea okayama7#130
MAADELIDGHVSVKQCQKAIEALHSYETKRQQKLEEEELIPGKEPNIWLNITVKKIPPGHRIKPVKVPVVHPLVDPRTSPICLITKDPQREYKDLLESHNIKFISRVVGIEKLKGKFRPYEARRALLKENGMFLADERVVPLLPKLLGKKWFEAKKQPIPVCLTRKDLKGELERSISSTYMNQNQGTCTSVKVANLSHKPAHVLANLQKALPTIVANIKDGWENIQSLHIKTNYSVSLPIWTCSLDASGEGRWHDLEAEAVSENEGPDDSNDSEVENAGAVKTKNGRKRESSSDDQSEDGPRKRVKKTKDTPSRTAKSTNAETAVTQSAKAMSKPSTKKAKTGAADSGEKSKQKTASSSKSTKDGPQPTESAAPSTKKTKTPASAKPAPTVKASVKSAKPSQPPTTTQPEDLKSKREVKSIEKKKEKIIKQKGGKTAKSSLLGKKAAQN

SEQ ID NO: 48044 - protein, 431 aa, Mycobacterium avium subsp. paratuberculosis K-10
MADTDDIATLKYPGGETDLEIVSATEGADGIALGSLLSKTGYTTFDNGFVNTASCKSAITYIDGDAGILRYRGYPIEQLAEKSTFLEVSYLLIYGELPDKDQLAEFTKRIQLHTMLHEDLKRFFDGFPRNAHPMPVLSSAVNALSAYYPDSLDPMDTEDVELSTIRLLAKLPTIAAYAYKKSVGQPFLYPDNKLSLVENFLRMTFGLPAEPYQADPEVVRALDMLLILHADHEQNCSTSTVRLVGSSQANLFTSISGGINALWGPLHGGANQAVLEMLEKIRQSDDDVSEFVRKVKNREAGVKLMGFGHRVYKNYDPRARIVKEQADKILAKLGGDDDLLDIAKQLEEAALTDEYFIERKLYPNVDFYTGLIYRALGFPTRMFTVLFALGRLPGWIAHWREMHDEGDSKIGRPRQIYTGYTERDYVTIDAR

SEQ ID NO: 48045 - protein, 258 aa, Ralstonia solanacearum
SVKNAAVNVPYGGAKGGIRVDPRKLSSGELERLTRRYTSEIGIIIGPNKDIPAPDVNTNAQIMAWMMDTYSMNEGATATGVVTGKPIALGGSLGRREATGRGVFVVGSEAARNLGIDVKGARIVVQGFGNVGSVAAKLFHDAGAKVIAVQDHKGIVFNGAGLDVDALIQHVDHNGSVAGFKAETVSADDFWGLECEFLIPAALEGQITGKNAPQIKAKIVVEGANGPTTPEADDILRDRGILVCPDVIANAGGVTVSY

SEQ ID NO: 48046 - protein, 483 aa, Bacillus cereus E33L
MDKKATFVNVEKKAMYINGEWITLQEQIEVNNPATKEIFATVPKGGVTEAKQAVDAAHEAFKSWSKLTAADRAAKLKKWFTLIDENKEEIAAIMTKEQGKPFAEALGEVNYANSFVEWYAEEGKRVYGEMIPASHPNKRILVMKQPVGVMAAITPWNFPAAMITRKVAPALAAGCTAVVKPASQTPLTALKLAELAHEADIPKGVINIVTGSAKAIADTWMEDGRVRKVSFTGSTEIGKELMASAAQTMKKVSLELGGHAPFIVMNDADLDKAVEAVIGSKFRNAGQTCICTNRVFVQEEVYEAFVEKFQKAVGQLKVGDGFGDGTTVGPLIDENAVSKVQEHIEDAIQKGGTVLYGGQKVAELDGHFMQPTVIGLANDTMLCMNEETFGPVAPVAKFKTVDEVIERANHTPYGLAAYIFTKDISQAFQISEALEYGIIGLNDGLPSVAQAPFGGFKESGIGREGGHFGIEEYLEIKYISLGL

SEQ ID NO: 48047 - protein, 592 aa, Arabidopsis thaliana
MDLRRRPPKPPVTNNNNSNGSFRSYQPRTSDDDHRRRATTIAPPPKASDALPLPLYLTNAVFFTLFFSVAYYLLHRWRDKIRYNTPLHVVTITELGAIIALIASFIYLLGFFGIDFVQSFISRASGDAWDLADTIDDDDHRLVTCSPPTPIVSVAKLPNPEPIVTESLPEEDEEIVKSVIDGVIPSYSLESRLGDCKRAASIRREALQRVTGRSIEGLPLDGFDYESILGQCCEMPVGYIQIPVGIAGPLLLDGYEYSVPMATTEGCLVASTNRGCKAMFISGGATSTVLKDGMTRAPVVRFASARRASELKFFLENPENFDTLAVVFNRSSRFARLQSVKCTIAGKNAYVRFCCSTGDAMGMNMVSKGVQNVLEYLTDDFPDMDVIGISGNFCSDKKPAAVNWIEGRGKSVVCEAVIRGEIVNKVLKTSVAALVELNMLKNLAGSAVAGSLGGFNAHASNIVSAVFIATGQDPAQNVESSQCITMMEAINDGKDIHISVTMPSIEVGTVGGGTQLASQSACLNLLGVKGASTESPGMNARRLATIVAGAVLAGELSLMSAIAAGQLVRSHMKYNRSSRDISGATTTTTTTT

SEQ ID NO: 48048 - protein, 454 aa, Bacillus cereus E33L
MNTKKFAKVNEQIPGPKAASLLERRQNIVPKGVSNGIPTFVQSANGALVTDVDGNQYIDFAGAIGTINVGHCHPAVKEALHKQVDQYIHTGFNVMMYEPYIELAEKLAALAPGSFDKQVLFLNSGAEAVENAVKIARKYTKRPGIIAFSKGFHGRTLMTMTMTSKVKPYKFGFGPFAPEVYKAPFPYEYRRPEGLTEEQYDDFIIEEFKNFFISEVAPETIAAVVMEPVQGEGGFIVPSKKFVQEVRNICSEHGILFVADEIQTGFSRTGKYFAIDHYDVVPDLITVSKSLGAGVPISGVIGRKEIMNESAPGELGGTYAGSPLGCAAALAVLDVIEKENLNDRAIELGKVVMNRFEEMKNKYNCIGDVRGLGAMCAFELVQDRKTKTPDKTLTANLCAEANKRGLLLLSAGTYGNVIRVLMPLVITDEQLEEGLTIIEESLQICYEKANTARV

SEQ ID NO: 48049 - protein, 146 aa, Arabidopsis thaliana
  misc_feature (15)..(15): Xaa can be any naturally occurring amino acid
  misc_feature (27)..(27): Xaa can be any naturally occurring amino acid
  misc_feature (64)..(64): Xaa can be any naturally occurring amino acid
  misc_feature (102)..(102): Xaa can be any naturally occurring amino acid
  misc_feature (115)..(115): Xaa can be any naturally occurring amino acid
  misc_feature (129)..(129): Xaa can be any naturally occurring amino acid
MAASMLSCAVEVTSXDEAPMVAPFTGXKIFAAYPVPRMTNQDITSIARNGGRVSCMKVWPTHRXKKFETVSYIADLRDVELTKDVDYLVRNKWIPCVEHESXHCSAYCEHGNTQXYYDGLDWTMWKLAXTGCTCSAQVLKEAEECT

SEQ ID NO: 48050 - protein, 351 aa, Cenarchaeum symbiosum
MSAKRDYYEVLGLGRDAELAEIKSQYRKLALKFHPDRNKSADAPEHFKEISEAYGVLSDPEKRGVYDQHGHGGVGERYSTEDIFRGSGGFEDAFGGGGFGSIFDTIFGGGGPGRRRGSDILYKTDVTLEEVLRGKKAVIDLDTNVACDVCRASGCQPGTSKASCKACGGHGQIKQVRQTGFGSFMTMSACHRCRGQGTVIEKPCSTCSGRGTRRGRKHLEFEIPPGIDNGDYTVRGEGELVPGGENGDLIVRITVRPHAIFKRDGRDIFYDEEVTMVDAALGKKVTVPTLDDTREIKIDPGTQPNTIIKLRGRGVPHQGSGRGDQYVRIVVTIPKKLTKDQKKILGEFYKP

SEQ ID NO: 48051 - protein, 537 aa, Thermoplasma volcanium GSS1
MVVVRRLRQSLVDEYGKEIYSLLKSFADVIGYSFEDEEEIKIEFNPDRPDLFSIPTLVGAAKIFYYNEPIVRSLFQASEIEVAISEGVSFIRPYFAGFVAEGPSIGSKLDDLIDYQEIIHQTVGKERKKVSIGIHDLDKTEPPFRYTTISKLERMKTYDSFEGTIEDVLQKHPKGMAYSSLLPDSRRVPAILDKNGGILSVPPIVNGIMTKIEPETRKFFVDITGMDSNSVKYAFYLLANFFQSSKYRISLPKIKGSYGPSKKEILDFNFRPYRLNLKYVSRYLGDKVSEENVILNLRKMGYVAEPGYPEVMVYVPGFRVDVMGLVDIIEDFIKSYGIENVREQYVSPGTIGSPNIFNEIKEKIRDVVVGLGFQEVMTFVLTGKYYQEDFQGEVRIENPKSEDYSVIRDRLYLNLLDLLARNKKHPLPQRIFEIGDVIVHGKQETHLCVMVEDNRSGVSTSKSILTSFLKRFSDHESKISGKKIYGCIEGRSGEIFLSGKSIGVIGEVHPSTLENFGLVNPISFFEINIQELIDQHQ

SEQ ID NO: 48052 - protein, 292 aa, Mannheimia succiniciproducens MBEL55E
MFKPQGIIAPVLTALDDNEKFNPEVYKNYINYLIKAGIHGIFPLGTNGEFYGFNEAEKLEIIKTAIEAADGCVPVYAGTGCVTTKETVEFSKKVVDLGVDVLSIVSPYYIAVTQDDLYRHYATIAENVTAPILMYNIPARTGNNIDYKTIKKLAQYENIIGVKDSSGNFDNTLKYIENTDSRLSIMAGSDSLILWTLLAGGTGAISGCSNVFPELMVSIYEYWKQGDFEKANEAQKKIRDFRNVMQMGNPNSVVKRAAQLRGLGTGPAKEPSNCANNPVIDKALQDVFKLYD

SEQ ID NO: 48053 - protein, 151 aa, Populus tremula x Populus alba
PNPFFDMTVGGQPVGRIVMELFADVVPRTAENFRALCTGEKGVGRLGKPLHFKGSSFHRVIPNFMCQGGDFTAGNGTGGESIYGAKFADENFVRKHTGPGVLSMANAGPGTNGSQFFICTVKTEWLDGKHVVFGQVVEGMDVVKAIEKVGS

SEQ ID NO: 48054 - protein, 160 aa, Citrullus lanatus
IIAKGHYTERAAASLLRTIVQIVHTCHSMGVIHRDLKPENFLLLSKDEDSPLKATDFGLSVFYKQGEVFKDIVGSAYYIAPEVLKRRYGPEVDIWSVGVMLYILLCGVPPFWAESEHGIFNAILRGHIDFTSDPWPTISPAAKDLVRKMLNSDPKQRLTA

SEQ ID NO: 48055 - protein, 113 aa, Rhodococcus sp. RHA1
MNTLDFLDKKSLRDDIPEFRPGDTLNVHVKVIEGSKERVQVFKGVVIRRQGGGVRETFTVRKVSFGVGVERTFPVHSPNLAQIEVVTRGDVRRAKLYYLRDLRGKAAKIKEKR

SEQ ID NO: 48056 - protein, 120 aa, Citrullus lanatus
SHCGWNSTLESLWHGVPMVAWPMYAEQQLNAFQMVVGLGLAVEITLDYRKDYRLERSKIVTAEEIESGIRKLMDDGDQIRKKVKAKSEEIRKAVMEGGSSFISLVHFINDALANSSQGKH

SEQ ID NO: 48057 - protein, 130 aa, Triticum aestivum
MVRVSVLGDCLKSINNAEKRGKRQVLVRPCSKVIVKFLQVMQRHGYIGEFEIIDDHRAGKIVIQLLGRINKCGVISPRYDMTIKELEPWLRNLLPSRQFGYVVITSSAGIMDHEEARRKHVGGKLLGFFY

SEQ ID NO: 48058 - protein, 258 aa, Ralstonia solanacearum
SVKNAAVNVPYGGAKGGIRVDPRKLSSGELERLTRRYTSEIGIIIGPNKDIPAPDVNTNAQIMAWMMDTYSMNEGATATGVVTGKPIALGGSLGRREATGRGVFVVGSEAARNLGIDIKGARIVVQGFGNVGSVAAKLFHDAGAKVIAVQDHKGIVFNGAGLDVDALIQHVEHNGSVAGFKAETVSADDFWGLECEFLIPAALEGQITGKNAPQIKAKIVVEGANGPTTPEADDILRDRGILVCPDVIANAGGVTVSY

SEQ ID NO: 48059 - protein, 122 aa, Novosphingobium aromaticivorans DSM 12444
MNLIQQLEAEAIAEFKAKKEIPDFRAGDTVRVGVRVVEGERTRVQAYEGVCIARSNRGLGSNFTVRKISFGEGVERVFPLYSPNIDSITVVRRGVVRRAKLYYLRGRTGKSARIAERKVTKA

SEQ ID NO: 48060 - protein, 342 aa, Glycine max
MGSLPVPAFPSKHCLDESSHIDEATLSALFKSQQSHLNFFFDHIDHSQTLAFTRALLNAAGTVFFTGVGKSGFVAHKISQTLVSLGVRSAFLSPVDALHGDIGILTNRDVLILLSKSGATEELLRLVPCARAKGALLIALTSVEGNALAAACDMSVHLPLQRELCPFNLAPVTSTAIQMVFGDTVAIALMEARNLTKEEYAANHPAGKIGKSLIFKVKDVMKKQDELPICRESDLIMDQLVELTTKGCGCLLVIGDGYRLIGTFTDGDLRRTLRASGEAIFKLTVGQMCNRNPRTIGPEAMAVDAMKKMEAPPSPVQFLPVINDESILIGIVTLHGLVSAGL

SEQ ID NO: 48061 - protein, 175 aa, Oryza sativa (indica cultivar-group)
MGPTVMASSATSVAPFQGLKSTAGLPVSRRSTNSGFGNVSNGGRIKCMQVWPIEGIKKFETLSYLPPLTVEDLLKQIEYLLRSKWVPCLEFSKVGFVYRENHRSPGYYDGRYWTMWKLPMFGCTDATQVLKELEDAKKAYPDAFVRIIGFDNVRQVQLISLIANKPPGRAEFGGN

SEQ ID NO: 48062 - protein, 784 aa, Geobacter metallireducens GS-15
MAEEQLETTGLRTLEDISTLILKSHDLPDTLDNIVHLVAKRIGTDVCSIYLLEDDGKTLRLAASKGLSKSSVGKITMQTSEGLAGLVIETKGLVTADNAPLHPRYKYFPETREERFNSFLGIPLMLRESPMGVIVIQTRESRTFQQEEVSTLTTIAYQISSIVINAKLLDSIRLKEAERERLERELEKFKAIGAPAGAEPSGDKRKREKRSLLLMGTPVSAGFSRGRAVIIDRRDEHDGMGVATVRSRPEERSRFQTALEKAKIETICMEKRVAELLSKEDAAIFHTHLMILEDRGFIAKVHDLIEEDYGAVRAVNEVVAHYVSAFSRMEDPYLKERSADMEDIRRRIIAFLDGSGHARLRLREKRILVAHEILPSDMATLDHEKLLGIVTEKGDLNSHAAIMAKSLGIPAVVGVEGILQKLGLRDEVIVDGNSGRIYINPSEKIKGEYERLEIDFGVRRRELEGLRDLPAVTRDGVDVALKANIGLLSDIRVALANGAEGVGLYRTEFPYMTRSAFPTRSELVGLYRKVLEGFAPHPVTIRTLDIGGDKTLPYFPMAAEDNPFMGWRSIRVSLEREDIFRVQLAGILLASLHGKARIMFPMVSSIAEIWQIKKILGEVREELAHEGQTFDPDISFGIMVELPAAVQTAHILVNEVDFFSIGTNDLIQYTMAADRNNPKVRRYYDSCQPAVLHSIKRVVDVALATGKPVSVCGEMAADPVMAILLVGMGIRELSLSAPSIPVVKQAIRSVDLRTAREMADRVLSLVSSGAVRTYLAETQNALGL

SEQ ID NO: 48063 - protein, 529 aa, Plantago major
MTADHQKSSVASFAVSSGDAGKLGLSSTLDTLPKKPLKRNKYALAISILASMTSVLLGYDCGVMSGATQFIQEDLIITDVQVELLVGTINIYSLVGSAVAGRTSDWVGRRYTIVFASTIFFLGAILMGFATNYAFLMVGRFVAGIGVGYALMIAPVYAAEVAPASCRGFLTSFPEVFINFGVLLGYVSNFAFAKLPLTLGWRMMLGVGAVPSVLLGVGVLYMPESPRWLVLQGRLGDAKKVLDKTSDSLEESKLRLADIKEAAGVPLDCHDEIVQVQKRSQGQGVWKELLLHPTKPVLHILICGVGIHFFQQGIGIDSVVLYSPRIYEKAGIKNTSDKLLATIAVGVSKTFFILITTFFVDRFGRRPLLLTSCAGVALSMFALGTSLTIIDRNPDGNIKGLLIFAVILTMAIVGFFSMGLGPIAWVYSSEIFPLKLRAQGCSMGVAMNRFMSGVILMSFISLYKAITIGGAFFLFGGITTVAFIFFYTLFPETQGRTLEEMEELFGTFFSWRTRMKELDAKKKTGSEAT

SEQ ID NO: 48064 - protein, 272 aa, Xanthomonas campestris pv. vesicatoria str. 85-10
MLAVSSHNLWIALAVTLAAGLATGLGSLMVVFAKKPNPRLLAFGLAFAGGAMVYVSLTEILNKSIAAFSQAYNDKLGFTFGTLTFLGGMLLIMVIDRLVPNPHQSLSSDDPQFREDNRAYIRRVGLMTAVAITAHNFPEGLATFFATLESPAVGMPLAFAIAIHNIPEGIAIAVPVYFATRNKFYAVGASLLSGLAEPVGAGIGYLALSSVLSDAVFGTVFGLISGVMVFLALDELLPAAKRYAQGHETVYGLVSGMGTLAISLVLFRFATP

SEQ ID NO: 48065 - protein, 530 aa, Plantago major
MNSEHHNSGGLASFSVDAGKSQKPDAASVLDTLPKKPVTRNKYALAISILASMTSVLLGYDTGVMSGATLYIKDDLKISDVQVELLVGTINIYSLVGSAVAGRTSDWVGRRYTTVFASVVFFVGAILMGIATNYVFLMAGRFVAGIGVGYALMIAPVYAAEVAPASCRGFLTSFPEVFINFGVLLGFVSNYAFAKFPLKLGWRMMLGVGAIPAVFLAIGVIYMPESPRWLVLQGRLGDARRVLDKTSDSLEESKLRLADIKEAAGIPEDCNDDFVQVQKHSQGQGVWRELLLHPTKPVLHILICGVGIHFFQQGIGIDSVVLYSPRIYDRAGITDTSDKLLATIAVGISKTFFILITTFYVDRFGRRFLLLVSCAGVALSMFALGTVLTIIDRNPDAKQTGVLVLVVLLTMVIVGFFSMGLGPIAWVYSSEIFPLKLRAQGCGLGVAMNRFMSGVILMSFISLYKEITIGGSFFLFGGITTLGWIFFFTLFPETRGRTLEEMEGLFGTFFKWRTTMKELDAKKRSGTDGA

SEQ ID NO: 48066 - protein, 968 aa, Oryza sativa
MSFLFHVRYVHSYCRKSLAYMSATKTQLIDGKEIAKNIRDKCRLMVEEIRNQQKDFKPGFAVVQVGNREDSNVYIRHKLKAAEEIGIDARLVRLDSSTTEPQLIQQIEQLNNDPAIHGIIVQLPFDSVQTIDANRIANTVSPDKDIDGLSDLNAGLLSHGNLDKCFVPCTPNGCIELIRATGTQIEGARAVVVGRSKIVGTPMFELLKHYNATVTICHSKTRNIQDIIKDADIVVACLGKPKFIPGSWIKENAVVIDCGITPVQELDLSKLSEKEKGENGKTKLYGDVDLDSCQGVASWITPVPGGVGPMTVALLMRNTITAAQRYLETYSPTQWKSMTYLPLTLETPVPSDLNIAKKQIPKDIKQLAKEIHIHNSELELYGTKKAKVKLNVLERLRNAPNGKYVVVSGITPTPLGEGKSTTTIGLCQALGAHLNKNVIGCLRQPSQGPTFGIKGGAAGGGYSQVIPMEEFNLHLTGDIHAITAANNLLAAQIDARMFHENTQTDQQLFNRLVPTIDGKRTFSDIQRKRLDKLKIHKTDPSTFTEEEIKAFVRLDIDPTTITWQRVIDTNDRFLRKITIGQSPTEKNFTRETNFDITVASEIMAVLALTTSLGDLRERLGRMVVAASRDGVPITADDLGVGGALAVLMRDAIKPTLMQTLEGTPVLVHAGPFANIAHGNSSILADQIGLKLVGPDGYVVTEAGFGFDIGCEKFMDIKCRYSGLVPNCVVIVATMRALKLHGGGPKVEAGSPIPPEYAQENLPLLERGTQNLVKQIENARHFGVPVVIAINRFKTDTQAEIDLVKRIAIENGAFDAVMADHWAKGGSGATDLARAVEQACLQKPDFKFLYDLQLPIEEKIRIIARKIYGADDIKLSEMAEKRIQLFTKQGFNDLPICMAKTHLSLSHDPSLKGCPKGFILPIRDIRASIGAGFLYPLVGEMSTIPGLPTRPCFYDIDIDPITEEIYGLF

SEQ ID NO: 48067 - protein, 212 aa, Brassica napus
  misc_feature (165)..(165): Xaa can be any naturally occurring amino acid
SENFDTLAVVFNRSSRFARLQSVKCTLAGKNAYVRFSCSTGDAMGMNMVSKGVQNVLEFLTDDFPDMDVIGISGNFCSDKKPAAVNWIEGRGKSVVCEAVIKGEIVNKVLKTSVAALVELNMLKNLTGSAVAGSLGGFNAHASNIVSAVFIATGQDPAQNVESSXSACLNLLGVKGASTESPGMNSRELATIVAGAVLAGELSLMSAIAAGQ

SEQ ID NO: 48068 - protein, 729 aa, Magnaporthe grisea 70-15
MAADDTPQNGTAKAAAAPTGNEQSSSGHRGNRGGRGGGQRNQRGGRGGRGGRRGGWEDNKGKDGWNRNPSDTTATRRRHRDRDDRPNFPSKRSKNNEDPSSFMNIQFSAEEIAAEERKPKKKVAVLIGYAGTGYKGMQINHFEKTIEGDLFRAFVDAGAISKANASDPKKVSLMRCARTDKGVHAASNVISLKLIVPLEEKELAGNGNAEKPAATADGTTAGEVEAASEAAPGAAPEAEPKAVTEDATEKVESNEPAAEKPSTESLESNAATVAAEEPSVESKPDQKASEEPAETMADLVARINSHLPDQIRVWDILRTNNSFSCYQACDSRWYEYLMPTHALIPPHPDSYLGKKVISAVNEKGEYDDWKLKFADLNNFWENVEEKEIKPLLESLDPEVRKEVKSRMHMVEEGDYKKPSTLGTEEVSKPSAEETEAEPSTEAASEKTEVTPVPPADDVVMADAEAPAPAAAESSEKPKEEEHVYTPAELAIRDIKATYVAAKRRYRVSQERIGKLQAALDKYVGTHNFHNYTILKKFTDSSAKRHIKSFKVNPEPIQIGETEWVSLKVHGQSFMMHQIRKMVAMAVLTVRCGVPLDRITQSYEAKRISIPKAPGLGLLLERPVFENYSYRAVQTLGKEPLNFDKYEDEIEAFKRAHIYQRMWDVEEQENIFHTFFNQIDNFHTDHFLWVTAHGFDAAYERKERERIQLPRGLEAGLGDDDDENPEDGDG

SEQ ID NO: 48069 - protein, 337 aa, Triticum aestivum
  misc_feature (181)..(181): Xaa can be any naturally occurring amino acid
MMNPKSRVQEWVADHIELIPGMPDDVAVDCLARVPHGSYRSMRRVCRGWRSAAAAPEFALARAEAGANEDLVFLMQFGNPVAGDDGAPENTPAYGVAVYNVTTGEWHRESSAPPVPMFAQCAAVGTRVAVMGGWDPKTFEPVADVNVLDAATGVWRRGAPMRVRAAFFACAEAGGKIYVAXGGHDRLKNALKTGEAYDAGADGWDPLPDMSEDPDECDGLATFAGTFPGGPKSGADRCTGGCPVRCAHALAVCCRQFVGGTPIAPGCLGVAFTRLLKPARRRAVGGRRSACVTGAMESGGSAAGKALWVDVKPKNWTVVRPPPQFAGFVFSLASVRV

SEQ ID NO: 48070 - protein, 164 aa, Zea mays
GIKGPFGKGGAFGKKFGVLGGGQSLETCFLKKPRGKNGGIKAGVPGCCPGPVLSFPGGPQNLIKSGLTFGAFFYLFGKVKKQQPGGGVPPGKGVRDPKGGKRVFSPLKLPPLEARGEFCKFQNFLSSKFWGKGVIPGEGRPVIYFGKGPWKRAKGQTGFFFPCF

SEQ ID NO: 48071 - protein, 258 aa, Ralstonia solanacearum
SVKNAAVNVPYGGAKGGVRVDPRKLSSGELERLTRRYTSEIGIIIGPNKDIPAPDVNTNAQIMAWMMDTYSMNEGATATGVVTGKPIALGGSLGRREATGRGVFVVGSEAARNLGIDVKGARIVVQGFGNVGSVAAKLFQDAGAKVIAVQDHKGIVFNGAGLDVDALIQHVDHNGSVDSFKAETLSADDFWALECEFLIPAALEGQITGKNAPHIRAKIVVEGANGPTTPEADDILRDRGILVCPDVIANAGGVTVSY

SEQ ID NO: 48072 - protein, 511 aa, Nepeta racemosa
ILIALLCTLPFLFFLKKWRRSYSGKTPPPSPPKLPVLGNLHQLGTFPHRSLQSLSRRYGPVMQLHFGSVPVLVASSPEAAREIMKNQDLNFSNRPNLSIPRRLLYDNHDVAFAPYGEYWRQIRSICVLQLLSNKRVQSFRRVREEETSIMVEKIMQLQKTTPTAAVNLTDLLTCLTNDVFCRIALGKKYGGTTTGDGEYHVRSLKKNLAEFYVLLGISPLWEYIPWLEWTRRFDGVDRRIEEVSRTFDEFLGKVIQEHRVRDKREDTTVVGDTVGLDFVDLLLQFQRENERSSSPVDDLTIKAVILDMFLAGTDTTVTALEWALSELIKNPRAMKILQKEVRGVAGSKGEIEESDLEKMPYLKAVMKESLRLHAPVPLLVPRESTRDTKVLGYDVASGTRVLINCWAIGRDSSVWEESETFLPERFLETSIDYRGMHFELIPFGSGRRGCPGATFAAAIDELALATLVHKFDFKLPNGVRVEDLDMSEGSGFTIHKKFPLLVVPTPHACTS

SEQ ID NO: 48073 - protein, 287 aa, Arabidopsis thaliana
MENPAKRVLMTSNGDEVSRNIAFHLAKHGCKLVMMGNEGSLRSIVDKIRDSIEGAFPADVIALDMESDSEVAFHAAVQKAWELSGHFDAFLNSYTYQGLICFLFFTTLPLMLLCVDHSFIQQSFFLAGKVQDILQVSQDEFHRITKINLTAPWFLLKAVATRMKDHGSGGSIVFMATIASGERALYPGADAYASTSAAIHQLVRASAMSLGKHKIRVNMISRGLHLDDEYTASVGRDRAQKLVKDAAPLGQWLNPDTDLYSTVIYLISDGSRFMTGTTVLVDGAQSL

SEQ ID NO: 48074 - protein, 502 aa, Mentha x piperita
MYSIAFMLVLRKMDEIISHTLAFQALVSLILLISITKWLSNSPKNKNSSPPSPRKLPILGNLLQLGSLPHHNLRSMARKHGPIMLLHLGSVRPVSSRRRPRGNHENSRSRLRRPRGSRSAALQLQGRVGGYGEYWRQLKTICVVQLLSNKRVQSFRSVREEETELLMKKIGDSSGNVNLSHMFTQLTNDVVCRSAIGRKYGAGDENGEKFLEILREFLELLGAISIGDFVPSLWWINRINGFDRRVDRIAKEMDEFLEKVIHERLENPAAKAEENFVDILLEIYRNNSAGVSIDRDSIKAIILDVFAAGTDTTAVVLEWAMTELLRHPEIMKKLQSEVRQVVKDKHNITDDDIEKMHYLKAVMKETMRFHTPIPLLVPRVARNDVEVMGYDVPVGTMVMINAWAIGRDPTSWDEPEKFRPERFLNSSVDFKGLDFELIPFGAGRRGCPGTTFPMATLEFTLANLMQKFDWELPHECRELDMSERPGVAIRRVIPLLAIGTKM

SEQ ID NO: 48075 - protein, 485 aa, Ostreococcus tauri
MMMRCASYKEKNERTGKANPVGKTARPSSVLGRETPDVNDLFEFHDELGRGQFGTTFLVTEKATGRKCACKAISKRQLQNAEDIEEVRNEVRILHHLSGDNRVVELVGAYEGNKHVYIVMELLSGGELFDRIVEKGKYSEKDASETLRTIVETVEYCHELSVMHRDLKPENFVLKTKDRDSPVCAIDFGLSTFFRDNQVFVDLVGSPYYVAPEVLRRRYGREADIWSCGVILYILLSGVPPFWAQTEQGIFDAILQGSLDLDSDPWPKISSEAKELISGMLQSDPSKRMTAAQVLKHPWVADPNVAPKTKLDNTVFKRFKNFAGMTKFKKMGLMAMAKTMTSDEVAGLKELFKSFDTDGSGTISIDELRQGLKLKSAGPAMEELRAIMKTIDIDGSGELDYEEFIAATLATSKQQSNDAVRRAFDYFDKDGDGSITVQEFEEAFKKMTDVERANLGDIGSLIKSADTDGDGCIDFNEFIAMMSSK

SEQ ID NO: 48076 - protein, 258 aa, Ralstonia solanacearum
SVKNAAVNVPYGGAKGGIRVDPRKLSSGELERLTRRYTSEIGIIIGPNKDIPAPDVNTNAQIMAWMMDTYSMNEGSTATGVVTGKPIALGGSLGRREATGRGVFVVGSEAARNLGIDIKGARIVVQGFGNVGSVAAKLFHDAGAKVIAVQDHKGIVFNGAGLDVDALIQHVDHNGSVAGFKAETLSADDFWALECEFLIPAALEGQITGKNAPNIGAKIVVEGANGPTTPEADDILRERGILVCPDVIANAGGVTVSY

SEQ ID NO: 48077 - protein, 394 aa, Geobacillus kaustophilus HTA426
MKKAKRMNAFSASIFAELTAYRQKQRHLHDEWIDLSVGSPDLPPAPFVREAIARYANEPNAYGYTLKGIREFHEAVADYYRTAHGVVLDPETEVTYVIGSQDGLVHLPMVFADPGDVILLPDPGYPAYAAGVAMAEAMPYFLPLREENSFLPDLRAIPEDIAKRAAIMFLNFPGNPVPAVATESFYREVVEFAKRYDILVVSDFAYGELYYDGNKPVSFLSVPGAKDVGVEINSLSKSYNMAGCRVGYLCGNAEVIRAFAEFKSNLDYGIFWPLQKAAAEVLRHGAGFCAQSRMMYQARRDVLVDGLADIGWTVDRPQAGMFVWAKIPDGWTSLSFAKALIDQAGVVVTPGHAFGPSGEGYVRIALVQPEEVLRRAVAKLKATGLFASPAADRR

SEQ ID NO: 48078 - protein, 516 aa, Gentiana triflora
MSPIYTTLTLHLATALFLFFHVQKLVHYLHGKATGHRCRRLPPGPTGWPILGALPLLGNMPHVTFANMAKKYGSVMYLKVGSHGLAIASTPDAAKAFLKTLDLNFSNRPPNAGATHLAYNAQDMVFAHYGPKWKLLRKLSNLHMLGGKALENWADVRKTELGYMLKAMFESSQNNEPVMISEMLTYAMANMLSQVILSRRVFNKKGAKSNEFKDMVVELMTSAGYFNIGDFIPSIGWMDLQGIEGGMKRLHKKFDVLLTRLLDDHKRTSQERKQKPDFLDFVIANGDNSDGERLNTDNIKALLLNLFTAGTDTSSSIIEWALAELLKNRTLLTRAQDEMDRVIGRDRRLLESDIPNLPYLQAICKETFRKHPSTPLNLPRNCIRGHVDVNGYYIPKGTRLNVNIWAIGRDPSVWGDNPNEFDPERFLYGRNAKIDPRGNHFELIPFGAGRRICAGTRMGILLVEYILGTLVHSFDWKLGFSEDELNMDETFGLALQKAVPLAAMVIPRLPLHVYAP

SEQ ID NO: 48079 - protein, 510 aa, Eustoma grandiflorum
MAVGNGVLLHIARSLMLFFHVQKLVQYLWMNSRRHRLPPGPIGWPVLGALPLLGTMPHVALANMAKKYGPVMYLKVGSCGLAVASTPEAAKAFLKTLDMNFSNRPPNAGATHLAYNAQDMVFADYGPRWKLLRKLSNIHILGGKALQGWEEVRKKELGYMLYAMAESGRHGQPVVVSEMLTYAMANMLGQVMLSKRVFGSQGSESNEFKDMVVELMTVAGYFNIGDFIPSIAWMDLQGIQGGMKRLHKKFDALLTRLLEEHTASAHERKGSPDFLDFVVANRDNSEGERLHTVNIKALLLNMFTAGTDTSSSVIEWALAELLKNPIILKRAQEEMDGVIGRDRRFLEADISKLPYLQAICKEAFRKHPSTPLNLPRIASQACEVNGHYIPKGTRLSVNIWAIGRDPSLWENPNEFNPDRFLERKNAKIDPRGNDFELIPFGAGRRICAGTRLGILLVEYILGTLVHSFDWELPSSVIELNMDEPFGLALQKAVPLAAMVTPRLPLHIYCP

SEQ ID NO: 48080 - protein, 258 aa, Ralstonia solanacearum
SVKNAAVNVPYGGAKGGIRVDPRKLSSGELERLTRRYTSEIGIIIGPNKDIPAPDVNTNAQIMAWMMDTYSMNEGATATGVVTGKPIALGGSLGRREATGRGVFVVGSEAARNLGIDIKGARIVVQGFGNVGSVAAKLFHDAGAKVIAVQDHKGIVFNGAGLDVDALIQHVDHNGSVAGFKAETVSADDFWGLECEFLIPAALEGQITGKNAPQIKAKIVVEGANGPTTPEADDILRDRGILVCPDVIANAGGVTVSY

SEQ ID NO: 48081 - protein, 132 aa, Rickettsia sibirica 246
MIKPDAIKRNKIGQVNTYLENAGLKIVAQKMKFLTKYEAACFYDEHRARPFFNSLVEYITSGAVVLQVLKGEDAITLNRTVMGATNPAEAEAGTIRKDLGESIEANSIHGSDSENSAKREIEFFFNKSEIIE

SEQ ID NO: 48082 - protein, 523 aa, Campanula medium
MSIDISTLFYELVAAISLYLATYSFIRFLFKPSHHHHLPPGPTGWPIIGALPLLGTMPHVSLADMAVKYGPIMYLKLGSKGTVVASNPKAARAFLKTHDANFSNRPIDGGPTYLAYNAQDMVFAEYGPKWKLLRKLCSLHMLGPKALEDWAHVKVSEVGHMLKEMYEQSSKSVPVPVVVPEMLTYAMANMIGRIILSRRPFVITSKLDSSASASASVSEFQYMVMELMRMAGLFNIGDFIPYIAWMDLQGIQRDMKVIQKKFDVLLNKMIKEHTESAHDRKDNPDFLDILMAATQENTEGIQLNLVNVKALLLDLFTAGTDTSSSVIEWALAEMLNHRQILNRAHEEMDQVIGRNRRLEQSDIPNLPYFQAICKETFRKHPSTPLNLPRISTEACEVDGFHIPKNTRLIVNIWAIGRDPKVWENPLDFTPERFLSEKHAKIDPRGNHFELIPFGAGRRICAGARMGAASVEYILGTLVHSFDWKLPDGVVEVNMEESFGIALQKKVPLSAIVTPRLPPSSYTV

SEQ ID NO: 48083 - protein, 431 aa, Rickettsia sibirica 246
MTNTRSKIKTPRSPYVKKYNSWRVRILYSIIIGYATFYFCRQNFNIATPAIREYFGVTKTQIGWILTASSIMYGVSKACNGFISDKVNARIFMVLGLLFVGIITMLIGFSDSLWFIGILWIASNWFQSMGWPPATKMLTHWFASKELGTKWAMGATSNQIGGALAMISCGYLIDKFDWRAAFFVPGVVACVVSLFLYNRLRNSPKEVGLSTVEEYKEYPLEAIGDYEKLLTPQLLKMVFCNKLIWYVCLANMFVYIIRSGVIYWAPTFLKDLRNISLANAGLQIGLYEMIGIPGALIAGVLSDKLFQGRRGPVASICMVLLSLLLVLFWKLPIHSELLSIVILSLIGFFVSGPQLLVGIAAADFSTRQAVGTANGLSGLFGYLGAAIAGVGVGWISDNYGWNGVFIFFSISALLGGGLFALIWNRSAKKYI

SEQ ID NO: 48084 - protein, 319 aa, Staphylococcus aureus subsp. aureus MRSA252
MAKLNMNNEIKKVEQRLEKAIKSKDSVLEQASLHLLSSGGKRVRPAFVILSSQFGKDEQTSEQTYQVAVALELIHMATLVHDDVIDKSDKRRGKLTISKKWDQTTAILTGNFLLALGLEHLMAVKDNRVHQLISESIVDVCRGELFQFQDQFNSQQTIINYLRRINRKTALLIQLSTEVGAITSQSDKETVRKLKMIGHYIGMSFQIIDDVLDFTSTEKKLGKPVGSDLLNGHITLPILLEMRKNPDFKLKIEQLRRDSERKEFEECIQIIRKSDSIDEAKEVSSKYLSKALNLISELPDGHPKSLLLSLTKKMGSRNT

SEQ ID NO: 48085 - protein, 450 aa, Methylococcus capsulatus str. Bath
MSRYEFPERFLWGAATSAYQVEGSPLADGAGPSNWHRFCRQPGRILNGDTGDTACDHYRRFREDVALMKALGLSAYRFSIAWSRIFPEGKGRINWRGIAHYQALVETLLEHGIRPMATLHHWDLPAALEDLGGWANRDSAGWFADYAHTVIRALGNEIDLWATLNEPWVIMDAGYVSGVHPPGHRSLKDAPWVTHNLLRAHALAVQAFRADGRGQIGLVVNLEPKYALTDSRDDRAAAERAHAYMNRQYLDPVLHGAYPDELAEISALHWPSFESEDLRVIQEPIDYLGINYYTRAVVRHDPSGGPLEVTAVPQRGVEHTEMGWEVYPQGLKDVLAWVKARYGDIPLYITENGAAFADPEGENGRIDDTRRIAYYRSHLRALHEAIAQGVDVRGYFAWSLLDNFEWTYGYARRFGLVQVDPLTQRRIPKASAGFYAEVAQTNGAVLDRDY

SEQ ID NO: 48086 - protein, 646 aa, Oryza sativa (japonica cultivar-group)
MAIAAPLFRLAAAAAVVMGVVSPAVKAAGGGNSSTACPLDLGYVRSFPWDTAPCMPPVANQTACCTTLLSVLGVGLAARLRATGHFRLPSANASAACLGAFSDELASPPLSLQDTLVPACWPVSSQLAISPSYCAGVTTAKQYVATVGNAAVLGSLNSSCGSDLADLSLCSSCLAAAIDASGRLVAAAAKGTNPQNCFYLTVLYAAGVSSSAGPTSPGTANCALGLALSTPSSSSSPASSSNHTNMAVATAIPVASALLVSVIAALLVWRRRQDSIRSKSRRLSGERRLSRPRPNVGSVLFSLGELAKATCGFAERNLIGRGGFGVVYRGVLDDGSVVAVKKMLDPDMEGGDEEFTNEVEIISHLRHRNLVPLRGCCISDDDADEGKQMFLVYDYMPNGSLDHYIFKDGGDGGRRPPPLSWAQRRGVVLDVARGLEYLHHGVKPGIYHRDIKATNILLGTDMRARVADFGLARRSREGQSHVTTRVAGTHGYLSPEYALYGQLTEKSDVYSFGVLVLEVMSGRRALDLSDPSGVVLITDWAWALVRAGRAAEVVAAALREREGPAGVHAMERFVLVGILCAHVTVACRPTMPEALRMLEGDMDVPDLPERPQPYGQRIAFDEGEANFSASSVLSGPPFMDFGDMLR

SEQ ID NO: 48087 - protein, 171 aa, Arabidopsis thaliana
MALLRLPGISLQILGHKSNQKNPNPNVAFTNHSLSLSTPSLCRLHRHATFPDSIPAKSRNLTSYFSTTTQEPVLESSSSSSSAPEVVEEEISKTRLIAQNVPWTSTPEDIRSLFEKYGSVIDIEMSMHKKERNRGLVFIEMASPEEAATALKSLESCEYEGRRLKVDYAKT

SEQ ID NO: 48088 - protein, 358 aa, Brassica napus
MVEVERVENLAKSGIKSIPKEYIRPKEELESINDVFQEEKKEDGPQVPTIDLQNIESEDETLREQCIEELKKAAMDWGVMHLINHGVPVDLMERVKKAGEEFFGLPVEEKEKYANDQATGKIQGYGSKLANNASGQLEWEDYFFHLVYPEDKRDLSLWPKTPSDYIEATSEYAKCLRLLATKVFKALSIGLGLEPDRLENEVGGLEELLLQMKINYYPKCPQPELALGVEAHTDVSALTFILHNMVPGLQLFYEGKWVIAKCVPDSIVMHIGDTLEILSNGKFKSILHRGLVNKEKVRISWAVFCEPPKDKIVLKPLPEMVSAETPAKFPPRTFSQHIEHKLFRKNEQEELVPEKKDD

SEQ ID NO: 48089 - protein, 339 aa, Oryza sativa (japonica cultivar-group)
MALVQSARRAAGPAASRLFSTASVAAAGRSPVAGLPKALPRPAISSLWMVGAAAPPRRFAGTAAVGGVDVTAPTATPPPAKKEESEKEAASYWGVAPTRLVKEDGTVWKWSCFRPWDTYEADVAIDLTKHHNPATLGDKVARWTVKSLRWPVDLFFQRRYGCRAMMLETVAAVPGMVAGAVLHLRSLRRFEHSGGWIRALLEEAENERMHLMTFMEVSQPRWYERALVVAVQGAFFNAYLASYLLSPRFAHRIVGYLEEEAVHSYTEFLRDLDAGKIDDVPAPAIAIDYWRLPADATLRDVVMVVRADEAHHRDVNHYASDIHYQGHALREVAAPLGYH

SEQ ID NO: 48090 - protein, 353 aa, Oceanobacillus iheyensis HTE831
MKNFKIANIPGDGIGKEVVPAAANVLKAIAAIHGGLRFEFTEFPWSCEYYMEHGKMMPEDGLEIIKDYNAIFLGAVGNIELVPDHISLWGLLIKFRREFEQVINYRPAKVLPGVKSKIVNPKDFDLIVVRENSEGEYSEVGGRIFRGEDEIAIQNSIFSRRGTERVMRFAFELAAKRKKHVTSATKSNGIFHSMPFWDEVFKDVSRDYSTIETDSQHIDALAAFFVTNPERFDVIVASNLFGDVLSDLGAAIMGSVGVAPAANINVNGKYPSMFEPVHGSAPDIIGKNIANPIGQIWTAKLMLDHFGEEELGSLLLDVIENTTNKGILTPDIGGKHTTSEVTEEIIEGLKARF

SEQ ID NO: 48091 - protein, 510 aa, Eustoma grandiflorum
MAVGNGVLLHIAASLMLFFHVQKLVQYLWMNSRRHRLPPGPIGWPVLGALRLLGTMPHVALANMAKKYGPVMYLKVGSCGLAVASTPEAAKAFLKTLDMNFSNRPPNAGATHLAYNAQDMVFADYGPRWKLLRKLSNIHILGGKALQGWEEVRKKELGYMLYAMAESGRHGQPVVVSEMLTYAMANMLGQVMLSKRVFGSQGSESNEFKDMVVELMTVAGYFNIGDFIPSIAWMDLQGIQGGMKRLHKKFDALLTRLLEEHTASAHERKGSPDFLDFVVANGDNSEGERLQTVNIKALLLNMFTAGTDTSSSVIEWALAELLKNPIILRRAQEEMDGVIGRDRRFLEADISKLPYLQAICKEAFRKHPSTPLNLPRIASQACEVNGHYIPKGTRLSVNIWAIGRDPSVWENPNEFNPDRFLERKNAKIDPRGNDFELIPFGAGRRICAGTRLGILLVEYILGTLVHSFVWELPSSVIELNMDESFGLALQKAVPLAAMVTPRLPLHIYSP

SEQ ID NO: 48092 - protein, 633 aa, Bacillus anthracis str. Ames
MCGFVGCLCENPREFSETEKHQFENMNTMIFHRGPDDEGYFRDEHVQFGFRRLSIIDLEAGHQPLTYENDRYVIIFNGEIYNYVELREMLLEKGATFATQSDTEVIIALYAHMKEKCVDYLRGMFAFMIWDREEKKLFGARDHFGIKPLYIAQQGDTTFFASEKKSIMHVMEDKGVNPTSLQHYFTYQYGPEPETLTIDVNKIEPGHYFVKEIGKEMEIHRYWKPYFNASSATKEEHIQAIRDVLYDSVKVHMRSDVPVGSFLSGGIDSSIIASIAREMNPNLLTFSVGFEQRGFSEVDVAKETAEKLGVKNHNVFISAKEFMDEFPKIIWHMDDPLADPAAVPLYFVAKEARKHVTVVLSGEGADELFGGYNIYREPNSLKMFSYIPSPGKSVLKALSGALKEGFKGKSFLERGCTPIEERYYGNAKIFREEEKAELMKYYNESVNYMDITKPLYNEIKDYDDVSKMQYIDMFTWLRGDILLKADKMTMANSLELRVPFLDKEVFDVASKIPTEFKIANGTTKAILREAARGIVPDHVLDRKKLGFPVPIRHWLKDEMHDWAINIINESKTEHLIDKQYVLNLLEAHCADKGDYSRKIWTVLAFMVWHQIYVEHKYDTNKFHEETKRAYSLV

SEQ ID NO: 48093 - protein, 227 aa, Capsella rubella
RGKIEIKRIENTTNRQVTFCKRRNGLLKKAYELSVLCDAEVALIVFSSRGRLYEYSNNSVKGTIERYKKAISDNSNTGSVAEINAQYYQQESAKLRQQIISIQNSNRQLMGETIGSMSPKELRNLEGRLERSITRIRSKKNELLFSEIDYMQKREVDLHNDNQILRAKIAENERNNPSISLMPGGSNYEQLMPPPQTQPQPFDSRNYFQVAALQPNNHHYSSAGGRQ

SEQ ID NO: 48094 - protein, 226 aa, Capsella bursa-pastoris
RGKIEIKRIENTTNRQVTFCKRRNGLLKKAYELSVLCDAEVALIVFSSRGRLYEYSNNSVKGTIERYKKAISDNSNTGSVAEINAQYYQQESAKLRQQIISIQNSNRQLMGETIGSMSPKELRNLEGRLERSITRIRSKKNELLFSEIDYMQKREVDLHNDNQILRAKIAENEKNNPSISLMPGGSNYEQIMPPPQTQPQPFDSRNYFQVAALQPNNHHYSSAGRQ

SEQ ID NO: 48095 - protein, 152 aa, Triticum aestivum
  misc_feature (14)..(14): Xaa can be any naturally occurring amino acid
LIALLQADYYDRIXGRWYYEHAAKGGGMVGVFQPSHEERQIMGQRPHNQKALAEIYLLSFSDVLLTTGASTFGYMSSSLAGLRPTMLMIPEDGKVPEPPCVRAVSMEPCFHMTPDVECRGKAVNKEELSRHVKECEDVGKGIKWIKGIKLFD

SEQ ID NO: 48096 - protein, 226 aa, Capsella bursa-pastoris
RGKTEIKRIENTTNRQVTFCKRRNGLLKKAYELSVLCDAEVALIVFSSRGRLYEYSNNSVKGTIERYKKAISDNSNTGSVAEINAQYYQQESAKLRQQIISIQNSNRQLMGETIGSMSPKELRNLEGRLERSITRIRSKKNELLFSEIDYMQKREVDLHNDNQILRAKIAENERNNPSISLMPGGSNYEQIMPPPQTQPQQFDSRNYFQVAALQPNNHHYSSAGRQ

SEQ ID NO: 48097 - protein, 302 aa, Arabidopsis thaliana
MANKCRNCDFGGGGNVTEAAIGRVNNGRVHEETEEEDEEGVTAAAEEEVREKSVNVEDDDDFDPFAGLFDDEQKSIVEIKEKLEDPDLSEESLVELLQNLEDMDITFQALQETDIGRHVNRVRKHPSNNVRRLAKQLVKKWKETVDEWVKFNQPGDLEPPSLIADEDSPVQKALHNGSRQQVPDFGYSPVPQNGYSSSSKNSNITEPERKPRPVAPQPRRESPSPAKPSRPSPSQQTIPRDKEHKEVDFDTARKRLQQNYRQAENAKKQRTIQVMDIHDIPKPKKGGFFPRKGGSSQGGRHW

SEQ ID NO: 48098 - protein, 594 aa, Prunus persica
MSNCTLPETQEKLTLPDAWDFKGRPAERSKTGGWTAAAMILGGEACERLTTLGIAVNLVTYLTGTMHLGNATSANTVTNFLGTSFMLCLLGGFVADTFLGRYLTIAIFATFQAMGVTILTISTTIPSLRPPKCTSDTSTPCIPASGKQLMVLYIALYLTALGTGGLKSSVSGFGSDQFDESDKQERRQMTNFFNWFFFFISIGSLAAVTVLVYIQDNLGRQWGYGICVCAIVLGLIVFLSGTRRYRFKKLVGSPLTQISGVCVAAWRKRNMELPSDMSFLYNVDDIDDGLKKKKKQKLPHSKQFRFLDKAAIKEPKTTSGTAMIINKWSLSTLTDVEEVKLIIRMLPIWATTIMFWTVYAQMTTFSVSQATSMDRHIGKSFQIPPASLTAFFVGSILLTVPVYDRLIVPMARKALENPQGLTPLQRMGVGLVFSIFAMVAAALTEVKRLNIARSHGLTDNPTAEIPLSVFWLVPQFFFVGSGEAFTYIGQLDFFLRECPKGMKTMSTGLFLSTLSLGFFFSSLLVTIVHKTTGHNKPWLADNLNQGKLYDFYWLLALLSALNLVIYLFCANWYVYKDKRLAEEGIELEEPEICA

SEQ ID NO: 48099 - protein, 535 aa, Gibberella zeae PH-1
MGWNTHASGTNDPPEVRNWRIHLIATVASMSALAIGYDTSVIGGTMALTSFMRDFGLDLVEKTQRDTIQGNIVSTFQAGCFFGALCTFPIAEKWGRRKTIMAAACIFLLGGALMTAANGNLNMIYAGRAVAGLGLGASSLTVPVYISETAPPSIRGRLIGIFEIASQGGGMLGFWINYATDRTIDVNTKTQWIVPLGLQLLPGAGLALGMLWCPESPRWLARGDRFEEAEKILSQIRGMTPDHEYIRREMGDIRAQVEERSTNKMSKKQMFMKLFQKGVRNRMGIGMALMFLQSFTGVNIITYYAPRIFESLGIPGTSLKLFSTGFYGISKTLGMVLFTFWVVEKVGRRKGLIWGAALGCIPMLYIGGYVMKADPAAAAAAGVVNRDGWGYLAIVCVYINAIIICATWQGITWTYASEIFPLDIRMLCVAITTADTWLGSFIIARSTPYMISDLGYGAYFFFGSILVLMGIWSLFFVPETKGITLEDMDALFAKPVYKTVWAQMRGKPVLEGNAANRSDSPFDEDDEKARELRIP

SEQ ID NO: 48100 - protein, 512 aa, Ostreococcus tauri
MALHELMTRAENRSCADCGGANPDWASVNHGAFLCLSCSGIHRSLGVHVSFVRSATMDSWSVDQLNSMRAGGNVEMNAFMERYGTDARTPARAKYESDAARAWRERVKCVANGGEWKRPKWLKSSGGKTGGGGARGKSASGSSMELFQFEAQPGDGESSGRDKASAKANVSKTGYDLSTGQGSLVSKRYEPDDDGWVPPPPPLPKGAKPGEFLSGMTPYQWVDFLKRSLQDDRTYHLKNMTDEERAQVVAAMSGLPIPPRSGKKHVPKASSNVAVNSAASDLKTLNPFEDASSSTGGTDEFFNESVEKSKKEKKEKKEKKEKKEKKEKKMNENETDLERRMREAGEAAKALARERMLSNPDASASVYAVPEKKKPSYSPQQSYFHGSSNLGRSGSSKYEGFGNTSSLPPPPQDWQSKMKSATESAKGWLSGTLKGLAAKLDNTSLAHGGASGSSRVGVASYQQMSHQTSRPPEVQSYRPPEVKPYDLPPRPVGKAKPESFYSSESGSDSDSD

SEQ ID NO: 48101 - protein, 595 aa, Solanum tuberosum
MDVRRRSEKPVYPSKVFAADEKPLKPHKNQQQEDNNTLLIDASDALPLPLYLTNGLFFTMFFSVMYFLLSRWREKIRNSTPLHVVTLSELGAIVSLIASVIYLLGFFGIGFVQTFVSRGNNDSWDENDEEFLLKEDSRCGPATTLGCAIPAPPARQISPMAPPQPAMSMVEKPSPLITPASSEEDEEIIKSVVQGKIPSYSLESKLGDCKRAASIRKEVMQRITGKSLEGLPLEGFNYESILGQCCEMPIGYVQIPVGIAGPLLLNGKEFSVPMATTEGCLVASTNRGCKAIYASGGATCILLRDGMTRAPCVRFGTAKRAAELKFFVEDPIKFETLANVFNQSSRFARLQRIQCAIAGKNLYMRFVCSTGDAMGMNMVSKGVQNVLDYLQNEYPDMDVIGISGNFCSDKKPAAVNWIEGRGKSVVCEAIITEEVVKKVLKTEVAALVELNMLKNLTGSAMAGALGGFNAHASNIVSAVFIATGQDPAQNIESSHCITMMEAVNDGKDLHISVTMPSIEVGTVGGGTQLASQSACLNLLGVKGANREAPGSNARLLATVVAGSVLAGELSLMSAISAGQLVNSHMKYNRSTKASS

SEQ ID NO: 48102 - protein, 456 aa, Arabidopsis thaliana
MDEDGEKRVRTKRLCSPESSDKKSGYEVDWVRDLPESLICHVLLNLSTKDVIKNCVLSTKWRYLWRYVPGLDLDCSDFTEYNTFVSFVDRFLSTNTESYLNKFKLGFDCDLVGDEETGNAQMARWINDVVKRKVQHLDLEWGALEIPPIVYVCKSLVSLKLCGVILPIPEFVCLPSVKVIVLDWVKFANDLALEMLISGCLVLKSLTLCRSNNDNVKVLRVRSQSLLSFNYNGPNTMGPEYEELIVEIDTPKLQDLTLSHRMTASFIIKNRSSLVGAHINIEFNFCFGEKFDPKNLPKREMIRNFLVGISGVKNMAIAACTLEVIYDYSRCEPLPLFRNLCLLSVEFYEDRWEMLPFFLESCPNLKSLVVGSNRYRMERTSIISGHRCLLSSLEYVEIETPLTGEVFEMKLVSYLLENSPILKKLTIHLHDNSRKKAECEILTIPRRSSSCQVILL

SEQ ID NO: 48103 - protein, 420 aa, Thermoplasma volcanium GSS1
MSSKELFELAAKLFPMGVNSPVRYFKDYPFYVKEGKGSTILDVDGNKYIDYCLGYGPLILGHSDPDVTRAVIEQAEKGLLFGEPSENEIKLAEMIKETSKNIEMMRFTNSGTEATMHAIRLARAITGRKLIVKMEGGFHGAHDYSLIKSGSGTLTFGSPSSPGIPDEVAQTVIVGKYNDENNIKEIFQKYGDKIAAVITEPIMGNAGVILPKQGFLEFLRDITQKHGSLLIFDEVITGYRFAFSPFQDIMRIDPDITTMGKIIGGGLPIGLFGGSEEIMKNISPSGNVYEAGTFSGNPMSMAAGYAAMEKLSKQDYSILKKRTQKLVSGIDDILDRKHITHTIKYYGTMFQVFFADHVNNYDDALKARKEVYFKLFKALSKNGVYLPPSQYETNFVSFAHSDSDIDATLAAFEKAVAEMD

SEQ ID NO: 48104 - protein, 176 aa, Camellia sinensis
MAASIISSAVVAPAQASMAAPFTGLKSTSAFPVTRKLDTDITSLASNGGRVQCMKVWPPLGLKKFETLSYLPPLTQAQLGKEVDYLIRLGWIPCLEFSVQGGFVYREHNKSPGYYDGRYWTMWKLPMFGCTDSSQVLKEVEECKKEYPQSFIRIIGFDNKRQVQCISFICYKPPGF

SEQ ID NO: 48105 - protein, 359 aa, Capsicum annuum
MGTAIILLGLLAANIDIAGGQSIGVCYGMLGNNLPPASQVVQLYKSRNIRRMRLYDPNQAALQALRGSNIEVMLGVPNSIFKTLLPPFNAILGSKECQNSGHCLNYRVHCCEMKSALLTGTSSLTRFLLPAMRNIRNAISSAGLGNNIKVSTSIDMTLIGNSFPPSQGSFRNDVRSFIDPIIVFLRGINSPLLVNIYPYFSYAGNPRDISLSYALFTAPNVVVQDGSLGYRNLSDERLDSVTAALSQARGGSVEIVVSESGWPSAGAFATTTNDAAAYYKNLIQHVKRGSPRRPNKVIETYLFAMFDENNKNPELEKHFGGFSPNKQPKFPLNFGFSDRFLDIFAENNNATSTFFKSDI

SEQ ID NO: 48106 - protein, 446 aa, Oryza sativa
MACSFHFVPLLLLLTLLLLISSASSTAALPSMRSSSEDTASNATAATRLRPGKELLKYKRIRALLKKLNKPSLKTIQSPDGDLIDCVPSHLQPAFDHPKLKGQKLLDPPERPKNYNLTIAVSSSSSSRVGEVVVQAWHAAGEECPEGTVAIRRTTEKDLLRASSLRRYGRKPARRNIRRDSTSNGHEHAVGYVNNDNYYGAKASVNVWSPRIGDPSEFSLSQIWVISGSFGNDLNTIEAGWQVSPELYGDSNPRFFTYWTVEFEVICTYNFQTDAYQETGCYNHNCRGFVQTTNKIAIGAAITPESVYNGRQFDITLMLWKDPKHGHWWLELGPGMVVGYWPSYLFTHLAHHGNMVQFGGEVVNTRPSGSHTATQMGSGHFPGEGFDRAAYFRNLQVVDWDNSLIPAANLKLLADHPACYDIQGGSNSYWGSYFYYGGPGRNVKCP

SEQ ID NO: 48107 - protein, 507 aa, Cenarchaeum symbiosum
MDKIAVLDFGSQYSHLICRRIRDFEVHAVLLPHDISADKLRKEAPSGVVLSGGPSSVYKEGAPRPGAGVLEIGLPILGICYGHQVIVDGFGGKVRRANREYGSSLLSVDDDGDLLGGLGGSFRAWMSHGDEAEQVPPGFEIMGHTGGSSAAVIADRSRSIYGIQFHPEVAHTEQGSEILRNFVLKICGAKQEWTMDAFIDDAVDKMSGLEGNILCGVSGGIDSTVTALLIHKAVGDRLKCVFVDNGLLRHNEEAEVERIFKEEFGMRFTALYAAERFLEKLKGITDPEEKRKVVGGEFADVFSEYAEKNGPFRWLAQGTLYPDVVESGATGGPAAVIKSHHNVGGLPDRLGLEILEPLRELYKDEVRKIAARLGVPPGLVSRHPFPGPGLAVRIMGEVTPRKLGIAKAASKIVEEELEAAGLYDTVWQAYAAVGDDRAVGVVGDERRHGSIVTIRVVESLDAMTADWSRLPHGLLEKMSNRITNEIEEVTWVTYAISSKPPATIEPQ

SEQ ID NO: 48108 - protein, 527 aa, Oceanobacillus iheyensis HTE831
MDRPWIRHVPKGNPTNVEIPEISLQALFFKSVETYADKVAMTFFDQTYTYQQLEKMIYSVANSLYNLGIEKGDRIALMLPNCPQYPISYFATLLCGGIIVQINPMYKANELLHVLNDSEAKVIICLDSLLPIVGEVKDKTDLMNIIPVSFESDSKFNELLIDKGHKLPEITIEPAEDIAVLQYTGGTTGRSKGVMLTHYNLVANTIQSYGTSQININTGEEKVLTISPLFHVYGMTSCMNFTFFIGGNLILVPRFEVEQTVNIIEKMKPSLFMGVPTMFIALLNYYHEEKQFDLSCLRTCSSGSAPLPVEIIHQFNNVSGSNVAEGFGLSEASPVTHRNPVEGLQKPGSIGIPIPNTDSKIVDLATGEETLPNGEVGELIIKGPQVMKGYWRMEDETNQVLRNGWLYTGDLAKMDDDGFFYITGRKKDLIIASGYNVYPVEIEDVIYKHPGVLEVAIIGVPDKYRGETVKAFVVLKNNASLTEEDLIQYCRDRLASFKVPRSVEFLQELPKTAVGKILKRKLKEQYS

SEQ ID NO: 48109 - protein, 226 aa, Capsella bursa-pastoris
RGKIEIKRIENTTNRQVTFCKRRNGLLKKAYELSVLCDAEVALIVFSSRGRLYEYSNNSVKGTIERYKKAISDNSNTGSVAEINAQYYQQESAKLRQQIISIQNSNRQLMGETIGSMSPKELRNLEGRLERSITRIRSKKNELLFSEIDYMQKREVDLHNDNQILRAKIAENERNNPSISLMPGGSNYEQIMPPPQTQPQQFDSRNYFQVAALQPNNHHYSSAGRQ

SEQ ID NO: 48110 - protein, 116 aa, Citrullus lanatus
GDRPRDDCPETLPKVTTPLRPWGPKEHAKLSEFQVELIQLASQLNGDHVLNSYPNIGKYMTVGEANRYAEDAVKRFLEAGRVALMAGANESAIVTMRPSLTSRTAAVDSGRFVETV

SEQ ID NO: 48111 - protein, 94 aa, Glycine max
LRGRLRLVAVVLIDHLGDVLLERDLAAVPRDLEEIDKEIEDKKTELEPKVVEAYEASPPEVKALFKDKKPVKVIKKNSAAVTKFLDELAKIGRT

SEQ ID NO: 48112 - protein, 631 aa, Pseudomonas fluorescens Pf-5
MLHPMCTRSGFRPTDRTLRAADKPIRQRDRLFYPVFSTSRAALKPSVEERRIGPGLVSTRALGRLYRPARSQYPSALRAIARVDGWGNSEWKTVYNPMDSCLGCCIQCAHNKNREPHTMNTPQVSQQRPEDENLGVGANMAYGLQHVLTMYGGIVAVPLIVGQAAGLSPSEIGLLIAASLFAGGLATLLQTLGVPFFGCKLPLVQGVSFAGVSTMVAIVTSGGEGGFQSILGAVIVASLIGLLITPVFSRITKFFPPLVTGIVITTIGLTLMPVAARWAMGGNSRAPDFGSMSNIGLAAVTLVLVLLLSKIGSAAISRLSILLAMIIGTVIALFLGMADFSGVTQGPMFGLPTPFHFGMPTFHVAAILSMCIVVMVTLVETSADILAVGEIIHTKVDSKRLGNGLRADMLSSMIAPIFGSFTQSAFAQNVGLVAVTGIKSRFVVATGGLFLVILGLLPFMGRVIAAVPTSVLGGAGIVLFGTVAASGIRTLSRVDYRNNMNLIIVATSIGFGMIPIAAPSFYDHFPSWFATIFHSGISSSAIMAILLNLAFNHFTAGNSDQQSVFVAGTERSLRFQDVAVLREGDYFSGGKLHDAEGNEVPLVGEEPGHSPNQAGDGSQPSHARGSVEATH

SEQ ID NO: 48113 - protein, 642 aa, Burkholderia vietnamiensis G4
MSTGAQSKAVVAGQHADGPRLLADVGGTNARFALETGPGEITQIRVYPGADYPTLTDAIRKYLKDVKIARVNHAAIAIANPVDGDQVTMTNHDWSFSIEATRRALGFDTLLVVNDFTALAMALPGLTDAQRVQIGGGTRRQNSVIGLLGPGTGLGVSGLIPADDRWIALGSEGGHASFAPQDEREDLVLQYARKKFPHVSFERVCAGPGIEIIYRALAARDKKRVAASVDTADIVERAHAGEALALETVECFCGILGSFAGSVALTLGALGGVYIGGGVALKLGELFTRSSFRARFEAKGRFAHYLQNIPTYLITAEYPAFLGVSAILAEQLSNRSGGASSAVFERIRQMRDALTPAERRVADLALNHPRSIINDPIVDIARKADVSQPTVIRFCRSLGCQGLSDFKLKLATGLTGTIPMSHSQVHLGDTATDFGAKVLDNTVSAILQLREHLNFEHVENAIEILNGARRIEFYGLGNSNIVAQDAHYKFFRFGIPTIAYGDLYMQAASAALLGKGDVIVAVSKSGRAPELLRVLDVAMQAGAKVIAITSSNTPLAKRATVALETDHIEMRESQLSMISRILHLVMIDILAVGVAIRRASTAGELPEAVAQARARASDDETADVLDWLSHGASPAAKDVARD

SEQ ID NO: 48114 - protein, 224 aa, Camelina sativa
RGKIEIKRIENTTNRQVTFCKRRNGLLKKAYELSVLCDAEVALIVFSSRGRLYEYSNNSVKGTIERYKKAISDNSNTGSVAEINAQYYQQESAKLRQQIISIQNSNRQLMGETLGSMSPKELRNLEGRLERSITRIRSKKNELLFSEIDYVQKRESDLHNDNQLLRAKIAENERNHPSISLMPGGSNYEQLMPPPQTQPFDSRNYFQVAALQPNNHHYSSAGRQ

SEQ ID NO: 48115 - protein, 228 aa, Lepidium squamatum
RGKIEIKRIENTTNRQVTFCKRRNGLLKKAYELSVLCDAEVALVVFSSRGRLYEYSNNSVKGTIERYKKAISDNTNTGSVAEINAQYYQQESAKLRQQIVSIQNSNRQLMGETIGSMSPKELRNLEGRLERSITRIRSKKNELLFAEIDYMQKREVDLHNDNQLLRAKIAENERNNPSISLMPGGSNYEQIMPPPQTQPQPQQFDSRNYFQVAALQPNNHHYSSAGRQ

SEQ ID NO: 48116 - protein, 427 aa, Burkholderia vietnamiensis G4
MSNNQILFERAQKTIPGGVNSPVRAFRSVGGTPRFVARAQGPYFWDADGKQYIDYIGSWGPMIVGHVHPEVLAAVQRVLADGFSFGAPTEAEIEIAEEICKLVPSIEQVRMVSSGTEATMSALRLARGFTGRSRIVKFEGCYHGHADSLLVKAGSGLLTFGNPTSAGVPADIAKHTTVLEYNNVAALEEAFGAFGDEIAAVIVEPVAGNMNLVRGTPEFLNALRALCTKHGAVLIFDEVMCGFRVALGGAQQHYGIAADLTCLGKVIGGGMPAAAFGGRRDIMAHLAPLGGVYQAGTLSGNPIAVAAGLKTLQLIQAPGFYDALTAQTKRLADGLAAEARAAGVPFAADSIGAMFGLYFAERVPASFAEVTKSDVERFNRFFHLMLDEGVYFAPSAYEAGFVSSTHDDAVIDATLAAARRAFAALAA

SEQ ID NO: 48117 - protein, 230 aa, Lepidium squamatum
RGKIEIKRIENTTNRQVTFCKRRNGLLKKAYELSVLCDAEVALVVFSSRGRLYEYSNNSVKGTIERYKKAISDNTNTGSVAEINAQYYQQESAKLRQQIVSIQNSNRQLMGETIGSMSPKELRNLEGRLERSITRIRSKKNELLFAEIDYMQKREVDLHNDNQLLRAKIAENERNNPSISLMPGGSNYEQIMPPPQTQPQPQSQSFDSRNYFQVAALQPNNHHYSSADRQ

SEQ ID NO: 48118 - protein, 425 aa, Mycobacterium avium subsp. paratuberculosis K-10
MFDYPHFLIRLWESRSTLAQRTQGSLKGNWYLLGPAFVAAIAYVDPGNVAANVSAGSQYGYLLLWVIVAANVLAGLVQYLSAKLGLVTGRSLPATIGKRMSRPARLVYWVQAELVAIATDAAEVVGGAIALHILFGLPLLAGGLITGVVALLLLGIQDRRGQILFERVITGLLLVIAIGFAASFFVKTAPPEAVLSGLLPRFRGTESVLLAAAILGATVMPHAVYMHSGLVLDRHGHPDEGPHRRLLLRVTRWDVVLAMAVAGTVNAAMLLIAATNLQHRDVSASIEGAYAAIHNTLGATIAVMFAVGLLASGLASSSVGAYAGAMIMQGLLHRSIPMVVRRLITLCPALLILAVGYDTTRALVLSQVVLSFGIPFAVLPLIKLTSDRELMGSDANHRITTILGWGVGILISLLNMVLIWLTVTG

SEQ ID NO: 48119 - protein, 429 aa, Novosphingobium aromaticivorans DSM 12444
MRAMQTHTEIAPMPIPGHVDPVPVPREVTPREDGRIDLIGLPRKQIAELFAQAGLDAKAAKLRAKQVFHWLYHRGVTDFDAMTDIAKTMRPWLAERFVIGRPEIVEAQVSTDGTRKWLLRTADKHDFEMVFIPDADRGTLCVSSQVGCTLNCRFCHTGTMRLVRNLTPGEIVGQVMLARDALGEWPKGANDSRVATMAGLDFDDEDEGSYTSDGRLLTNIVMMGMGEPLYNFDNVRDALKLVMDGDGLALSKRRITLSTSGVVPMMERCGEEIGVNLAVSLHAVTKDVRDEIVPINRKYGIEELLQACADYPGASNARRITFEYVMLKDKNDSDDHARELVRLIRQYKLPAKVNLIPFNPWPGAPYECSSPDRIKSFANIVFEAGISAPVRTPRGRDIDAACGQLKTASERKSRAELDRLAEEKLAALG

SEQ ID NO: 48120 - protein, 217 aa, Brassica napus
MQSYHHHRSSSSSRRRSIVQRSRFILPCFSSSPLSLFAVLAAAVPFPIYFSGLLSSLSGRNNKAASTMRVNSNIASTNITCTTFNVLAPIYKRVDQQNQSIRESQFRALWLTRNQKILDLLLNQRSSVISLQEVWVGNEELVNMYHDRLASAGYTTFQLARTNARGDGLLTAIHKDYFKLVNYRELLFNDFGDRVAQLLHVKSIVPFPLNENQMFSK

SEQ ID NO: 48121 - protein, 226 aa, Lepidium phlebopetalum
RGKIEIKRIENTTNRQVTFCKRRNGLLKKAYELSVLCDAEVALIVFSSRGRLYEYSNNSVKGTIERYKKTKSDNSNTGSVAEINAQYYQQESVKLRQHIVSIQNSNRQLMGETIGSMSAKELKNLEGRLERSIARIRSKKNELLFAEIDYMQKREVDLHNDNQLLRAKIAENERNNPSISLMPGGSNYEQIMPPPQTQTQPFDSRNYFQVAALQPNNHHYSSAGRQ

SEQ ID NO: 48122 - protein, 501 aa, Solanum chacoense
MQLISIFLFICFLFLLRKWKKYSKNSQTKKLPPGPWKLPFIGSMHHLAGGRPHRVLRDLAKKYGPLMHLQLGEVSAVVVTSPDMAKEVLKTHDIAFASRPKLLAMDIICYDRCDIAFSPYGEYWKQMRKICVTEVLSAKSVRSFSSIRCDEVVRLIDSIQSSSSSGELVNFKERVIWFTSSMTCRSAFGQLPKEQDMFIKLIREVIRLAEGFDVADIFPSYKFLHVFGRAKRKLLNVHRKVDAIVEDVINEHKKNFATRKNDDHALGGENLIDVLLKLMNDKSLQFPINNDNIKAIIIDMFAAGTETSSTTTVWAMVEMLKNPRVLAKAQAEVREAFRNKVTFDENDVEDLKYLKLVIKETMRLHAPIPLLVPRECRKETEINGYTIPVKTKVMVNVWALGRDPKYWDDVECFKPERFEQCSIDFIGNNFEYLPFGGGRRICPGTSFGLANDYLPLAQLLCHFDWKLPTGMEPKDLDLTELAGMSAASKDDLYLIATPYQP

SEQ ID NO: 48123 - protein, 500 aa, Solanum chacoense
MQLVSIFLFISFLFLLRKWKKYLNNSQTKKLPPGPWKLPFIGGMHHLAGGLPHRVLRDLAEKYGPLMHLQLGEVSAVVVTSPEMAKQVLKTHDIAFASRPKLLAMDIICYNRRDIAFSPYGDYWRQMRKICIMEVLSAKSVRSFSSIRHDEVVRLIDSIQPCFTSGELVNFTERIIWFTSSMTCRSAFGQVLKEQEVFIKLIREVISLAEGFDVADIFPSYKFLHGFGGAKQKLLNAHRKVDSIVEDVIKEHKKNLATRKSDDAIGGEDLVDALVRLMNDKSLQFPINNDNIKAVIIDLFAAGTETSSTTTVWAMAEMLKNPSVFAKAQAKVREAFRDKVTFDENDVEELKYLKLVIKETMRLHAPVPLLVPRECREETEINGYTIPVKTKVMVNVWALGRDPKYWDDAESFKPERFEQCSIDFIGNNFEYLPFGGGRRICPGISFGLANVYLPLAQLLYHFDWKLPTGMEPKDLDLTESAGITAARKGDLYLIATPHQP

SEQ ID NO: 48124 - protein, 579 aa, Gibberella zeae PH-1
MTSKEEKVDIGTHTPPSHEVAPGHQKDVFTGDIEGVREDFREDDFMTRNGLNLKSFQRRDYGTGVVELDRSMKKRHLHMIAIGGSIGAGFFVGSGGAFTKGGPGAVLICFMIAGVMIFNVVHALGELAVMYPVSGGFYTYSTRFIDPSWGFAMGWNYVFQWVIVLPLELTVASFTVQYWNPNINEGIWITVFWLFIIFINVFGTLGYAEEEFWSSCFKLAAIIIFMIVAVVLICGGGPSRGNFSTYQGAKLWYDPGAFQNGSRGFCAVFVTAAFSFAGTELVGLAAAESRNPAKALPGAIKQVFWRITLFYIVGLTLVGMLVSSTDDRLLNSANPYKDGVSPFVLAALDAGLNGYDDFMNLVICVSVVSIGVSCVYGGSRTLTALAEQDYAPKCFTYIDRSGRPLMSVIFNLAWGALAYIVLASSGGLVFDWLLAVSALAALFTWGSICACHIRFRSAWKRQGRTLDQIPFHAAGGVYGSWLGLTLCFVILGCQLYVAVCPPFKEGYGNAEDFFMACLAIPVVLVFWIIGYIWKRPQWLTIDKIDLDTGLREHDWDEINAYRAKVASWPAWRRALNKFM

SEQ ID NO: 48125 - protein, 338 aa, Neurospora crassa
MVVKVGINGFGRIGRIVFRNAIEHDDIHIVAVNDPFIEPKYAAYMLRYDTTHGNFKGTIEVDGADLVVNGKKVKFYTERDPAAIPWSETGADYIVESTGVFTTTEKASAHLKGGAKKVIISAPSADAPMYVMGVNNETYDGSADVISNASCTTNCLAPLAKVIHDNFTIVEGLMTTVHSYTATQKTVDGPSAKDWRGGRTAAQNIIPSSTGSAKAVGKVIPDLNGKLTGMAMRVPTANVSVVDLTARIEKGATYDEIKEVIKKASEGPLAGILAYTEDEVVSSDMNGNPASSIFDAKAGISLNKNFVKLVSWYDNEWGYSRRVLDLISYISKVDAKKA

SEQ ID NO: 48126 - protein, 384 aa, Solanum demissum
MASDSIIPLLLLPDELITEILLRLPIKSLSKFMCVSKSWLQLISSPAFVKNHIKLTANGKGYIYHRLIFRNTNDDFKFCPLPSLFTKQQLIEELFDIVSPIERTTLSTHIVGSVNGLICAAHVRQREAYIWNPTITKSKELPKSRSNLCSDGIKCGFGYDESHDDYKVVFINYPSHHNHRSVVNIYSLRTNSWTTLHDQLQGIFLLNLHCRFVKEKLYWTSSTCINNYKVCNITSFDLADGTWESLELPSCGKDNSYINVGVVGSDLSLLYTCQRGAANSDVWIMKHSGVNVSWTKLFTIKYPQNIKIHRCVVPAFTFSIHIRHGEILLVLDSAIMIYDGSTRQLKHTFHVNQCEEIYVESLVNPLKISDQGRRNHESPQSSHS

SEQ ID NO: 48127 - protein, 280 aa, Marinobacter sp. ELB17
MHPNGDIHWEHLDKLVDFHIENGTHGIVAVGTTGESATLDPEEHCKTIGHIIKRVNGRIPVIAGTGGNSTREAIALTSAAHKLGADACLLVVPYYNKPTQEGLYQHFRTIAEAVPMMKQMLYNVPGRTACDMLNETVVRLADIPNIIAIKDATGNIPRGAELIQAVKGRLDVYSGDDATAMELMLAGAKGNVSVTANVAPRAMADLCTAAVAGNREEAERLNELLMLLNRKLFLEANPIPVKWALQRMGLIGDGLRLPLTVLSEPFHGEVEDALKASGVL

SEQ ID NO: 48128 - protein, 204 aa, Triticum aestivum
  misc_feature (115)..(115): Xaa can be any naturally occurring amino acid
MACLHDHECGDHNCAADWSLYNHIDIPKVVALNESVAGSVKSVFKSWDQRLETSGGFLESNEGDPELLVFIPFTSDVKIKSIAVVGGADGTSPSRMRVFINREGIDFSDAQNMQXCQEWELAENLQGVLEYQTRYSRFQGVANLTLHFPDNFGGDTTKIYYIGLRGEATQNKRDVVATIVYEVMPNPSDHKTKSETGGGFSHVE

SEQ ID NO: 48129 - protein, 275 aa, Candida albicans SC5314
MKELDHENIVTLYDVIHTENKLTLVFEYMDKDLKKYMEVHGQQSALDLKVVKSFMFQLLKGIMFCHDNRVLHRDLKPQNLLINNKGELKLGDFGLARAFGIPFNTFSNEVVTLWYRAPDVLLGSRAYTTSIDIWSAGCIFAEMCTGKPLFPGTANEDQLIKIFRLMGTPNERTWPGISQYTNYKNNWQIFVPQDLRLIVPNLDSMGLNLLQSLLQMRPESRITARQALQHPWFHEITMPNAVPQHLSDPYQQQQQQQQQQQQQQHPHQPIIDQQY

SEQ ID NO: 48130 - protein, 567 aa, Saccharomyces cerevisiae
MSGVNNTSANDLSTTESNSNSVANAPSVKTEHNDSKNSLNLDATEPPIDLPQKPLSAYTTVAILCLMIAFGGFIFGWDTGTISGFVNLSDFIRRFGQKNDKGTYYLSKVRMGLIVSIFNIGCAIGGIVLSKVGDIYGRRIGLITVTAIYVVGILIQITSINKWYQYFIGRIISGLGVGGIAVLSPMLISEVAPKQIRGTLVQLYQLMCTMGIFLGYCTNYGTKNYHNATQWRVGLGLCFAWTTFMVSGMMFVPESPRYLIEVGKDEEAKRSLSKSNKVSVDDPALLAEYDTIKAGIELEKLAGNASWSELLSTKTKVFQRVLMGVMIQSLQQLTGDNYFFYYGTTIFKSVGLKDSFQTSIIIGVVNFFSSFIAVYTIERFGRRTCLLWGAASMLCCFAVFASVGVTKLWPQGSSHQDITSQGAGNCMIVFTMFFIFSFATTWAGGCYVIVSETFPLRVKSRGMAIATAANWMWGFLISFFTPFITGAINFYYGYVFLGCLVFAYFYVFFFVPETKGLTLEEVNTMWLEGVPAWKSASWVPPERRTADYDADAIDHDDRPIYKRFFSS

SEQ ID NO: 48131 - protein, 153 aa, Brassica napus
  misc_feature (127)..(127): Xaa can be any naturally occurring amino acid
  misc_feature (129)..(130): Xaa can be any naturally occurring amino acid
  misc_feature (133)..(133): Xaa can be any naturally occurring amino acid
  misc_feature (136)..(136): Xaa can be any naturally occurring amino acid
  misc_feature (148)..(149): Xaa can be any naturally occurring amino acid
  misc_feature (151)..(151): Xaa can be any naturally occurring amino acid
TVLFLSFVLALYACEGFGKQLQLPWWGLLLACSVAFTFTLPIGVIQATTNQQMGLNVIAELIIGYLYPGKPLANVAFKTYGYVSMSQALSFVGDFKLGHYMKIPPRSMFLVQLVATMVSTTVCFGTXWXXLLXLVXNICAQEKLPIGXXWXCP

SEQ ID NO: 48132 - protein, 216 aa, Enterococcus faecalis V583
MTIGFIFDLDGVITDTAKFHYQAWKALADSLGIPIDETFNETLKGISRMDSLDRILVHGHRENAFTPAEKEALAQQKNDHYVQLLEQLTTEDVLPGVVPLLQQAQARHIPCAVASASKNAPLILEKLGVRAYFATIVDPDSLSKGKPDPEIFLAAADSIGVLPQNAIGFEDAQSGIDGLKAAGIYAVGLSASQPLIGADMQVSEMTELSVDALLNR

SEQ ID NO: 48133 - protein, 569 aa, Saccharomyces cerevisiae; identical to SEQ ID NO: 1106

SEQ ID NO: 48134 - protein, 572 aa, Aspergillus nidulans FGSC A4
MPTKKHPNDSTHLPTKIKNFFRINSSSSTSSHQSSNHVNSSDRDTGSSTPVKHEPKSTFRQSRFLPMIGRNRSATVASEGNPLDEAISPTATANPYFVHQGQPALQHRNDGSIPSSPPDTPELQVDGVSAAEQATTANKEELARKLRRVASAPNAQGLFTATDSDGRPQTAELGKEPLVHSGAAGSPVGLVEVSSNTDQDGNLTVPQPGSGKLPAVTQVRTSSGGFRRTYSSNSIKVRNVEVGPASFDKIKLIGKGDVGKVYLVREKKSTRLYAMKVLSKKEMIKRNKIKRALAEQEILATSNHPFIVTLYHSFQSEDYLYLCMEYCSGGEFFRALQTRPGKCISEDAARFYAAEVTAALEYLHLMGFIYRDLKPENILLHQSGHIMLSDFDLSKQSGPGGAPTMIPARSGNSNTSLPTIDTKSCIADFRTNSFVGTEEYIAPEVIKGCGHTSAVDWWTLGILIYEMLYGTTPFKGKNRNATFGNILRDEVPFPEQGGAQQISKYVITEFCRGNETVNFRNVKESASVDIGEKNPSKMKGVPLNSGLATPNGEIADPFEEFNSVTLHHDGDF

SEQ ID NO: 48135 - protein, 799 aa, Saccharomyces cerevisiae
MSTIYRESDSLESEPSPTPTTIPIQINMEEEKKDAFVKNIDEDVNNLTATTDEEDRDPESQKFDRHSIQEEGLVWKGDPTYLPNSPYPEVRSAVSIEDDPTIRLNHWRTWFLTTVFVVVFAGVNQFFSLRYPSLEINFLVAQVVCYPIGRILALLPDWKCSKVPFFDLNPGPFTKKEHAVVTIAVALTSSTAYAMYILNAQGSFYNMKLNVGYQFLLVWTSQMIGYGAAGLTRRWVVNPASSIWPQTLISVSLFDSLHSRKVEKTVANGWTMPRYRFFLIVLIGSFIWYWVPGFLFTGLSYFNVILWGSKTRHNFIANTIFGTQSGLGALPITFDYTQVSQAMSGSVFATPFYVSANTYASVLIFFVIVLPCLYFTNTWYAKYMPVISGSTYDNTQNKYNVTKILNEDYSINLEKYKEYSPVFVPFSYLLSYALNFAAVIAVFVHCILYHGKDIVAKFKDRKNGGTDIHMRIYSKNYKDCPDWWYLLLQIVMIGLGFVAVCCFDTKFPAWAFVIAILISLVNFIPQGILEAMTNQHVGLNIITELICGYMLPLRPMANLLFKLYGFIVMRQGLNLSRDLKLAMYMKVSPRLIFAVQIYATIISGMVNVGVQEWMMHNIDGLCTTDQPNGFTCANGRTVFNASIIWSLPKYLFSSGRIYNPLMWFFLIGLLFPLAVYAVQWKFPKFKFAKHIHTPVFFTGPGNIPPSTPYNYSLFFAMSFCLNLIRKRWRAWFNKYNFVMGAGVEAGVAISVVIIFLCVQYPGGKLSWWGNNVWKRTYDNDYKKFYTLKKGETFGYDKWW

SEQ ID NO: 48136 - protein, 414 aa, Shewanella sp. MR-4
MDHFLYQDNTLYAEGCRVNDLAQQYGTPLYIYSRATLERHWHAFNNAVADHPHLVCYAVKANSNLAVLNVLARLGSGFDIVSGGELARVIEAGGDPAKVVFSGVGKTVAEMEQALNLGIYCFNVESSAELEQLNQVAGRLGKIAPVSLRVNPDVDAGTHPYISTGLKENKFGIAMDEAEVVFARAHALPHLQVKGVDCHIGSQLTEIQPFLDAMDRMLALIDRLAEQGIVIEHFDVGGGLGVTYDDETPPHPDVYAAALLARLGDRKLKLIFEPGRAIAANAGIFVTQVLYLKENSDKRFAIVDGAMNDLIRPALYSAWQNIIPVNPRDEQAQVFDIVGPVCETGDFLGKDRALAIAAGDLLVVRSSGAYGFAMASNYNTRPRAAEVMVDGDKAYLVREREKLAQLWQGEQLLP

SEQ ID NO: 48137 - protein, 137 aa, Oceanospirillum sp. MED92
MKNSFYYDLESGKIGQQTDLGQALDNLRYNEDGLIPAIAQQHDTGEVLMMAWMNKASIEETLKTGQVCYWSRSRQTYWRKGESSGHVQKLVEMRIDCDGDTLLCLVNQNGPACHTERPNCFYHKVTGDKIEIITEPN

SEQ ID NO: 48138 - protein, 128 aa, Euphorbia esula
MATTAASFSPARISAASVVTIGHKSQKKESKIVYIRGLNSYGGLKAHNTVASLGMPVSTEQGFANVISSLKTSSSNGKGKSGGALGSKCSKIGEIVQIAATLNGLTLLGVAVGFVLLRIEAFVEESAE

SEQ ID NO: 48139 - protein, 228 aa, Eruca sativa
RGKIEIKRIENTTNRQVTFCKRRNGLLKKAYELSVLCDAEVALIVFSSRGRLYEYSNNSVKGTIERYKKAISDNSNTGSVAEINAQYYQQESAKLRQQIISIQNSNRQLMGETIGSMSPKELRNLEGRLDRSVNRIRSKKNELLFAEIDYMQKREVDLHNDNQLLRAKIAENERNNPGMISLMPGGSSNYEQIMPPPQTQPQTFDSRNYFQVAALQPNNHHYSSAGRE

SEQ ID NO: 48140 - protein, 398 aa, Burkholderia vietnamiensis G4
MNTTADSLVTLAARVDAIQPFYVMELMKEAQRLESSGRDVIHMGIGEPDFTAPEPVVEAAAAALRRGVTQYTSALGIAPLREAIAAHYARAYGLTISPERIVVTAGASAALLLACLALVGRDDEVLMPDPSYPCNRHFVAAAEGRPVLVPSGPEACFQLTADDVRTRWGNRTRGVLLASPSNPTGTSLEPDELKRIVEAVRARGGFTIVDEIYQGLSYDAAPVSALSYGDDVVTVNSFSKYFSMTGWRLGWLVVPPALVGTFEKLSQNLFICPSALAQHAALACFEPATLDIYEARRLEFKRRRDFIAPALERLGFKVPVMPDGAFYVYAHCGGVAHPAAGDSAALTHAMLHDAGVVLVPGMDFGVHAPRDYIRLSYATAYSRLEEAVERLAKLFGHH

SEQ ID NO: 48141 - protein, 322 aa, Clostridium difficile 630
MYMSISKETLLEMYKRMNQARKFEEKVSWFFARGMVHGTTHLSVGQEASSVAAVMALEKGDLVSLTHRGHSQFIGMGIDLNKMMAELMGKETGFCKGKGGSMHIADIESGNLGANGVVGGGLTIAPGAALTQQYKKTGKIVLCSFGDGASNEGTFHEGINLSSIWKLPIIFYCENNLYGMSTSIKRHMNIESIATRAASYGIEGISIDGYNPIEVYETVQKAAEKCRRGEGPVLIESRTYRWLGHSKSDANVYRTKEEIESWKAKDPIEFLKNYLIENNLSNEDELDKIQEFAKQSIEDAVEFAQNSPNPKIESLLEDVYAD

SEQ ID NO: 48142 - protein, 231 aa, Eruca sativa
RGKIEIKRIENTTNRQVTFCKRRNGLLKKAYELSVLCDAEVALIVFSSRGRLYEYSNNSVKGTIERYKKAISDNSNTGSVAEINAQYYQQESAKLRQQIISIQNSNRQLMGETIGSMSPKELRNLEGRLDRSVNRIRSKKNELLFAEIDYMQKRSLQEVDLHNDNQLLRAKIAENERNNPGMINLMPGGSSNYEQIMPPPQTQPQTFDSRNYFQVAALQPNNHHYSSAGRE

SEQ ID NO: 48143 - protein, 490 aa, Lotus japonicus
VALMILRKNLKKPDSIPNIPPGPWKLPIIGSIPHLVGSPPHRKLRDLAKKYGPLMHLQLGEVIFIIVSSAEYAKEVMKTHDVTFASRPRSLFTDIVFYGSTDIGFSPYGDYWRQVRKICNVELLSMKRVQSLWPIREEEVKNLIQRIASEEGSVVNLSQAIDSLIFTITSRSAFGKRYMEQEEFISCVREVMKLAGGFNIADLFPSAKWLENLTRMRSKFEYLHQKMDRILETIIDDHKANSRTKEGQVEGGEEDLIDVLLKYENSSTDQDFHLTIRNIKAILFDIFIAGSETSATTINWTMAEMMKDPILLKKAQDEVREIFQRRGKVDETCIYELKYLKAFINEVLRLHPPGPLVFRECRQACEINGYHIPAKSTVLVNTFAIGTDSKYWAEPERFCPERFIDSSIDYKGTNFEHLPFGAGRRICPGINYGMANVELVLALLLYHFDWTLPKGIKNEDLDLTEEFGVTVSKKEDLCLIPSISHPLPST

SEQ ID NO: 48144 - protein, 296 aa, Novosphingobium aromaticivorans DSM 12444
MFSGSIPALVTPFRDGAFDEKAFRRLVDWQIENGSSALVPCGTTGEASTLSNAEHHRVIEVCVEQAAGRVPVIAGCGSNDTMNALLHMNFSKKCGAQAALCVAPYYNRPSQAGIIAHFSYLAEHNDLPIVLYNVPGRTVTDILPETVCELAKRYPDKIIGIKDASGDLSRVTDHRMGIGKHFCQLSGDDELALPANAAGAVGCISVTANVAPRLCADFQAACAANDLEKARELNDKLYPLHYAMFEDASPGPVKYALSRVFADINEDLRLPMVPCNEAARKAVDAALVHAGLLELA

SEQ ID NO: 48145 - protein, 561 aa, Cryptococcus neoformans var. neoformans JEC21
MPDPSIPVVGHKTQRKLVGHNLLYSVSVFLSIGVWLFGYDQGVMSGIITGPYFKAYFNQPTSTQIGNMVAVLEIGAFITSLAAAHIADNYGRRMTLRTGAIVFTIGGAIQTFCVGYNSMVLGRIVSGFGVGMLSMVVPIYQSEISPADHRGLLGSVEFTGNIIGYASSVWIDYACSFFQSDWSWRLPLSVQCIGGSVLFIGSFVTPESPRYLVDTDQEVEGLAVIADFQGKALDDISVQAEYKEIRDAVLADRAVGDRSYRALWRRYKGRVLIAMSSQLFAQLNGINVISYYAPLVFEQAGWIGRDAILMTGINALFYVASSLPPWYLMDRAGRRPILLSGAVAMAIALTATGWWIYIDQAITPNAVVICVVIYNSAFGMSWGPVPWLYPPEIMPLSFRAKGVSLSTATNWISNWWVGVSTPLFQELIGWRLYPMHAFFCALSFILVYFLYPETRGVPLEEMDKLFGDESDEDEVDSDFDEVEEAESEISSLVSNPRHRRRSASSSLGPSLPTSRKPSPIPSREASSSRGLFGRITDSVNGLIGSTKQQSRSVGYTAVNEE

SEQ ID NO: 48146 - protein, 506 aa, Vibrio cholerae O1 biovar eltor str. N16961
MIYAQPGSDNAVITFKSHYDNFIGGQWVKPVSGEYFGNISPVNGQVYCQVARSTQADIDLALDAAHQVREAWAKTSVTERSNLLLKIADRIEANIEQLAVAECWENGKPVRETLAADLPLVVDHFRYFAGCIRAQEGSAAELDSHTASYHFPEPIGVVGQIIPWNFPMLMAAWKLAPALAAGCCVVLKPAEQTPTSILVLIEKIADLIPAGVLNVVNGFGSEAGQALATSQRIAKLAFTGSTQVGQHILKCAAQSLIPSTVELGGKSPNIYFPDIFDHEDTYLEKCIEGTLLGFFNQGEVCTCPSRVLVHESIYDRFVAKVAERAKGIKQGNPLDTATQVGAQASQEQFDKILSYLDIGRQEGAKVLFGGGVAKQEGELGQGYYIQPTLLQGHNKMRVFQEEIFGPVIAITSFKDEAEALALANDTEYGLGAGIWTRDQNLAYRMGRNIQAGRIWINCYHAYPAHAAFGGYKKSGIGRETHKMMLNHYQNTKNLLISYDVNPLGFF

SEQ ID NO: 48147 - protein, 302 aa, Mycobacterium avium subsp. paratuberculosis K-10
MTRGLVIGESLIDIVEDAEYVGGSPLNVAVGLGRLGRDVDFLTYLADDDHGRRIAAYLKDAGVQLVSESRAAERTATARSTIAADGSADYEFDLDWRLSGTPPVAPPLFVHTGSIAAVRDPGCLAVAALIDTYRVSATVTFDPNVRPSLIADRELAVSRIEHLVERSDIVKVSAEDLHWIDPDRSPEQLAQTWLGLGPAIVAVTMADRGAVGYCAAGTARVPTRAVRVVDTVGAGDSFMAGLLDALWEAGLLGGDRRGALRDIGIDTLTSALDAASLSSALTIARAGADLPDRAAVQAALRR

SEQ ID NO: 48148 - protein, 348 aa, Clostridium difficile 630
MVANKIKATPAARSQARKDNIKLDRLIGSGENGRIHLVDVLNYLKDNKANTTPLARRIAEDLNIDLETIVGTGYNGKIRKCDVEKLTAKETIVSTNTSKSSEKKELKIENENSSMFNTVEGIFEKPNPMRATVAKRMSESYFSAPVFTFNIEVDATELKVLRAKLIDTVKESTGVKLTMTDLIVMAVSKILPNHQALNSAWTDEGIFRYKDVNIAIAVGLDEGLYVPVVKNANKKSLKEIAKESKELAEKVKTGKLMPADQEGNTFTISNVGMYGITTFTPIINMPSSAILGVGATQDKFVPVNGEAKIKPIMNLSLTSDHRVIDGTVAAKFLKDLKELLENPLSMLV

SEQ ID NO: 48149 - protein, 531 aa, Sorghum bicolor
MATTATPQLLGGSVPQQWQTCLLVLLPVLLVSYYLLTSRSRNRSRSGKLGGAPRLPPGPAQLPILGNLHLLGPLPHKNLRELARRYGPVMQLRLGTVPTVVVSSAEAAREVLKVHDVDCCSRPASPGPKRLSYDLKNVGFAPYGEYWREMRKLFALELLSMRRVKAACYAREQEMDRLVADLDRAAASKASIVLNDHVFALTDGIIGTVAFGNIYASKQFAHKERFQHVLDDAMDMMASFSAEDFFPNAAGRLADRLSGFLARRERIFNELDVFFEKVIDQHMDPARPVPDNGGDLVDVLINLCKEHDGTLRFTRDHVKAIVLDTFIGAIDTSSVTILWAMSELMRKPQVLRKAQAEVRAAVGDDKPRVNSEDAAKIPYLKMVVKETLRLHPPATLLVPRETMRDTTICGYDVPANTRVFVNAWAIGRDPASWPAPDEFNPDRFVGSDVDYYGSHFELIPFGAGRRICPGLTMGETNVTFTLANLLYCYDWALPGAMKPEDVSMEETGALTFHRKTPLVVVPTKYKNRRAA

SEQ ID NO: 48150 - protein, 226 aa, Guillenia flavescens
RGKIEIKRIENTTNRQVTFCKRRNGLLKKAYELSVLCDAEVALIVFSSRGRLYEYSNNSVKGTIERYKKAISDNSNTGSVAEINAQYYQQESAKLRQNIISIQNSNRQLMGETIGSMSAKELRNLEGRLDRSINRIRSKKNELLFAEIDYMQKREVDLHNDNQLLRAKIAENERNHPSMSLMPGGSNYEQIMPPPQTQSQPFDSRNYFQVAALQPNNHHYSSAGRQ

SEQ ID NO: 48151 - protein, 397 aa, Rickettsia sibirica 246
MLSKLNKPALFALIFYPIFIISLVVKYSFDYGIGLTEVIFIIASYYINNITVGIGLHRLWSHNAYKINKYAEFVLIMLSAGTLQGPALSWASNHYKHHRYTDQDQDPHTPLKFDNKFLGFMWSHIGWMLVGSGSYKSIDRITWAKHGKNNLLKWQLKYYWQIAAFMNIVVPLFIGYLVGGTMQSAYAGFLFMGLGRFLQQQATFCVNSLCHFAGSKKYYKGTAGDIWWMALFLLGENWHNYHHAFPSDYRNGAKWYHFDVHKWIIFLMSKIGLASELERTTKVRIQAKMQETLSYLSEKQKQKLTLMQTKIDHLLENLCLKIKELEESSITIKEQFKKSFVEIQESLKNLAEQVSAATQITEKSSEKLLKIINKKIIDAEQSIYKLYNKLNTLKVSN

SEQ ID NO: 48152 - protein, 499 aa, Glycyrrhiza echinata
MEILSLLSYSVFYLALFFIFNIVIRARKFKNLPPGPPSLPIIGNLHHLKRPLHRTFKGLSEKYGHVFSLWFGSRLVVVVSSASEFQQCFTKNDVVLANRPRFLSGKYIFYNYTTLGSTSYGEHWRNLRRITALDVLSNHRINSFSGIRRDETQRLITRLADDSSTNFAEMELSSRLYDMTFNNIMRMISGKRYYGEDCDTSDLQEASQFRDMVSELLQLSGANNKTDFMPLLRFLDFENLEKRLKDISGKTDAFLRGLIEEHRTKKERANTMIDHLLNLQDSQPEYYTDQIIKGLALAMLLAGTDSSAVTLEWSMSNLLNHPEVLKKVKDELDTHVGQDRLVDESDLPKLTYLKNVINETLRLYTPAPLLLPHSTSDECNIGGYKVPQDTIVLINAWAIHRDPELWTEATTFKPERFEKKGELEKLIAFGMGRRACPGEGLAIRAISMTLALLIQCFDWKLINGDKIDLAERDGFTLTKLVPLKAMCKSRPVINKVFKQ

SEQ ID NO: 48153 - protein, 226 aa, Thlaspi arvense
RGKIEIKRIENTTNRQVTFCKRRNGLLKKAYELSVLCDAEVALIVFSSRGRLYEYSNNSVKGTIERYKKAISDNSNTGSVAEINAQYYQQESAKLRQQIISIQNSNRQLMGETIGSMSPKELRNLEGRLDRSITRIRSKKNELLFSEIDYMQKREVDLHNDNQLLRAKIAENERSNPSMNLMPGGSNYEQLMPPPQTQSQPFDSRNYFQVAALQPNNHHYSSAGRQ

SEQ ID NO: 48154 - protein, 254 aa, Brassica napus
MARKFFVGGNWKCNGTAEEVKKIVNTLNEAQVPSQDVVEVVVSPPYVFLPLVKSILRPDFYVAAQNCWVKKGGAFTGEVSAEMLVNLDIPWVILGLSERRALLNETNEFVGDKVAYALAQGLKVIACVGETLEQRESGSTMDVVAAQTKAIADRVSNWSNVVIAYEPVWAIGTGKVASPAQAQEVHDELRKWLAKNVSADVAATTRIIYGGSVNGGNCKELGGQADVDGFLVGGASLKPEFIDIIKAAEVKKSA

SEQ ID NO: 48155 - protein, 369 aa, Rhodococcus sp. RHA1
MAVSLPLVFTAPRRGMPPKHLADLDSAERREAVKELGLPGFRADQLARQYYARLEADPEKMTDLPAAVREQVGAALFPTLLTPVKHLACDGGDTRKTLWKANDGTLLESVLMRYPDRATLCISSQAGCGMACPFCATGQGGLQRNLSTAEIVDQVRAAAAALRDGDVHGGPGRLSNVVFMGMGEPLANYKRVVAAVRRITSPAPDGLGLSQRSVTVSTVGLAPAIRKLADEDLSVTLAVSLHTPDDELRDTLVPVNNRWSVAEVLDAARYYADKSGRRVSIEYALIRDVNDQPWRADLLGKKLRKALGPLVHVNLIPLNPTPGSEWDASPKPVEKEFVRRVLAQGVSCTVRDTRGQEIAAACGQLAAEN

SEQ ID NO: 48156 - protein, 226 aa, Thlaspi arvense
RGKIEIKRIGNTTNRQVTFCKRRNGLLKKAYELSVLCDAEVALIVFSSRGRLYEYSNNSVKGTIERYKKAISDNSNTGSVAEINAQYYQQESAKLRQQIISIQNSNRQLMGETIGSMSPKELRNLEGRLDRSITRIRSKKNELLFSEIDYMQKREVDLHNDNQLLRAKIAENERSNPSMNLMPGGPNYEQLMPPPQTQSQPFDSRNYFQVAALQPNNHHYSSAGRQ

SEQ ID NO: 48157 - protein, 487 aa, Eschscholzia californica
GTSTVALIAVIISSILYLLFGGSGHKNLPPGPKPWPIVGNLLQLGEKPHAQFAELAQTYGDIFTLKMGTETVVVASTSSAASEILKTHDRILSARYVFQSFRVKGHVENSIVWSDCTETWKNLRKVCRTELFTQKMIESQAHVREKKCEEMVEYLMKKQGEEVKIVEVIFGTLVNIFGNLIFSQNIFELGDPNSGSSEFKEYLWRMLELGNSTNPADYFPMLGKFDLFGQRKEVAECLKGIYAIWGAMLQERKLAKKVDGYKSKNDFVDVCLDSGLNDYQINALLMELFGAGTETSASTIEWAMTELTKNPKITAKIRSEIQTVVGERSVKESDFPNLPYLEATVKETLRLHPPTPLLLPRRALETCTILNYTIPKDCQIMVNAWGIGRDPKTWTDPLTFSPERFLNSSVDFRGNDFSLIPFGAGRRICPGLPIANQFIALLVATFVQNLDWCLPNGMSVDHLIVEEKFGLTLQKEPPLFIVPKSRV

SEQ ID NO: 48158 - protein, 261 aa, Triticum aestivum
  misc_feature (200)..(200): Xaa can be any naturally occurring amino acid
MAAERGSREGRWTLAAARALITGGSKGIGYAIVEELAGFGARVHACSRNAAELEECRRRWEEKGLHVTVSACDVSVRADRERLMDTVRQTFNGKLDILVNNAGQLLVKPTAECTAEEYSKVMATNLESSFHLCQLARPLLVHAGGGSIINMSSMGGSIGFVGSAIYAITKSAMNQLTRSLAAEWAPNNIRVNGVAPGFIXTTDMIKDMDTESLEREHSKTPLLRSGKPVEIASAVAFLCMPAASFITGQVICVDGGRTISA

SEQ ID NO: 48159 - protein, 515 aa, Thermoplasma volcanium GSS1
MPFENENTYLRMSEAGKEAEFHRLYEESLKEIEAYFNKEYPNIIDGDVIESKKIKDISPIDGKEIATFQLASDSSVDKAVDMLYKSYKAWYSLGYMKRALIFLKAADMLSEQKFKFAAILTYENGKNRYEAIGDVDEAIDFMRYYAMNLIENQGFIRFTGKAYRNEESISIMKPYGVFGVISPFNFFSIGVGMSSAPLVTGNAVILKPSSDIPLSLYLWVRLMHEAGVPKNVLAFVSGSGGLVGRHIVENKKVAGIVFTGSRDVGLDIQRKSIDNGPKVVITEMGGKDAIIVSNKADMDKAVEGVVRAAFGFAGQKCSACSLLYVHKDIYDEFMKRLKARTEAIKPDDPRKKDTFLNPIINKEAYDKFIKLKPEFNKGKILTGGHELNKPGFYVEPTIVTDLPKDAYIARNEIFLPVLSVFKCNSIEEAVDDINSMDYGLTGGIFTEDPKEIQYYFDNIEVGVIYANRKSGGSTGSMVGSQPFVGWKLSGVSGKGTGSFYYLQQFLREQSQTIAH

SEQ ID NO: 48160 - protein, 172 aa, Glycine max
  misc_feature (27)..(27): Xaa can be any naturally occurring amino acid
  misc_feature (56)..(56): Xaa can be any naturally occurring amino acid
FKPPSPPVKSQNFRRGALGTKFGSQSXVFFLGGLGPPPGPGGFFGLKGPFPYNPFXRKFFGTFFAPFPKRGLFPQVFFLGGGSPPAFFRAPPPGGLFPPQKGPPPPPKFGPRGQILFFLVQSPPHWGPGLFFFPRVAKRGRMLAGQPTKKRLPSRLIWGPWLGFPLNQALFW

SEQ ID NO: 48161 - protein, 189 aa, Arabidopsis thaliana
MSAKNDVTGKVIVIMGVSGAGKSTIGKMLGKALSCDFLDADDFHSLSNRDKMRQGIALSDEDRMPWLEKIQESLRKRLLDVETVVLACSSLRKQYREILRGSDPDYKPGSYTSCKVTFVLLEGNAEVIAARLQKRASEEEHFMPLTLLQSQFDLLQADECEKIFKISVVLSPEVIVNTILEMVANSLNP

SEQ ID NO: 48162 - protein, 584 aa, Saccharomyces cerevisiae
MGIHIPYLTSKTSQSNVGDAVGNADSVEFNSEHDSPSKRGKIHIESHEIQRAPASDDEDRIQIKPVNDEDDTSVMITFNQSLSPFIITLTFVASISGFMFGYDTGYISSALISIGTDLDHKVLTYGEKEIVTAATSLGALITSIFAGTAADIFGRKRCLMGSNLMFVIGAILQVSAHTFWQMAVGRLIMGFGVGIGSLIAPLFISEIAPKMIRGRLTVINSLWLTGGQLVAYGCGAGLNYVNNGWRILVGLSLIPTAVQFTCLCFLPDTPRYYVMKGDLARATEVLKRSYTDTSEEIIERKVEELVTLNQSIPGKNVPEKVWNTIKELHTVPSNLRALIIGCGLQAIQQFTGWNSLMYFSGTIFETVGFKNSSAVSIIVSGTNFIFTLVAFFSIDKIGRRTILLIGLPGMTMALVVCSIAFHFLGIKFDGAVAVVVSSGFSSWGIVIIVFIIVFAAFYALGIGTVPWQQSELFPQNVRGIGTSYATATNWAGSLVIASTFLTMLQNITPAGTFAFFAGLSCLSTIFCYFCYPELSGLELEEVQTILKDGFNIKASKALAKKRKQQVARVHELKYEPTQEIIEDI

SEQ ID NO: 48163 - protein, 612 aa, Saccharomyces cerevisiae
MAEMKNSTAASSRWTKSRLSHFFPSYTNSSGMGAASTDQSSTQGEELHHRKHCEEDNDGQKPKKSPVSTSTMQIKSRQDEDEDDGRIVIKPVNDEDDTSVIITFNQSISPFIITLTFVASISGFMFGYDTGYISSALISINRDLDNKVLTYGEKELITAATSLGALITSVGAGTAADVFGRRPCLMFSNLMFLIGAILQITAHKFWQMAAGRLIMGFGVGIGSLISPLFISEIAPKMIRGRLTVINSLWLTGGQLIAYGCGAGLNHVKNGWRILVGLSLIPTVLQFSFFCFLPDTPRYYVMKGDLKRAKMVLKRSYVNTEDEIIDQKVEELSSLNQSIPGKNPITKFWNMVKELHTVPSNFRALIIGCGLQAIQQFTGWNSLMYFSGTIFETVGFKNSSAVSIIVSGTNFVFTLIAFFCIDKIGRRYILLIGLPGMTVALVICAIAFHFLGIKFNGADAVVASDGFSSWGIVIIVFIIVYAAFYALGIGTVPWQQSELFPQNVRGVGTSYATATNWAGSLVIASTFLTMLQNITPTGTFSFFAGVACLSTIFCYFCYPELSGLELEEVQTILKDGFNIKASKALAKKRKQQVAEGAAHHKLKFEPTQEIVES

SEQ ID NO: 48164 - protein, 301 aa, Arabidopsis thaliana
MGKQFDKKITWTIKNFASLLSDLIYSDHFVVGGCKWHLRAYPKGYNNANSLSLFLGVAVPTSLPSGWRRHTKFRLTLVNQLSDKLSQSKLNELEQWFDEKTTNWGLSSMCPLNEIHAKDSGFLLNGELKIVVEIKVLETIGKLDVTEETSTITETVDVNGFQLLPSQAKSVSRMFAKHPELASDLRPKNPNLRTGYMSLLLSLIETLSQLPQQMSKDDLLDAYDALGSMRDAGFKLDWLEKKLYEVSEKKENEEASETGLQEMEEELKDMKQKCLEMEALVEKEKAKVSTAKAPISFDDIV

SEQ ID NO: 48165 - protein, 225 aa, Eruca sativa
GRGKIEIKRIENTTNRQVTFCKRRNGLLKKAYELSVLCDAEVALVVFSSRGRLYEYSNNSVKGTIERYKKAISDNTNTGTVAEINAQYYQQESAKLRQQIISIQNSNRQLMGETIGSMSPKELRNLEGRLDRSINRIRSKKNELLFAEIDYMHKREVDLHSDNQLLRTKIAENERNNPSMNLTPGGYEQIMQPSQTQSQPFDSRNYFQVAALQPNNHHYSSAGRQ

SEQ ID NO: 48166 - protein, 360 aa, Pseudomonas fluorescens Pf-5
MSKQILILPGDGIGPEIMAEAVKVLELANDKYSLGFELSHDVIGGAAIDKHGVPLADETLDRARAADAVLLGAVGGPKWDKIERDIRPERGLLKIRAQLGLFGNLRPAILYPQLADASSLKPEIVSGLDILIVRELTGGIYFGAPRGTRELENGERQSYDTLPYSESEIRRIARVGFDMARVRGKKLCSVDKANVLASSQLWREVVEQVAKDYPDVELSHMYVDNAAMQLVRAPKQFDVIVTDNMFGDILSDEASMLTGSIGMLPSASLDANNKGMYEPCHGSAPDIAGQGIANPLATILSVSMMLRYSFNLTEAADAIEQAVSRVLDQGLRTGDIWSAGCTKVGTQEMGDAVVAALRNL

SEQ ID NO: 48167 - protein, 229 aa, Guillenia flavescens
RGKIEIKRIDNTTNRQVTFRKRRNGLLKKAYELSVLCDAEVALIVFSSRGRLYEYSNNSVKGTIERYKKAISDNSNTGSVAEINAQYYQQESAKLRQQIVSIQNSNRQLMGETIGSMIPKDLKTLESKLDKSITRIRSKKNELLFAEIDYMQKRSLQEVDLHNDNQLLRAKIAENERNNPSMNLMPGGSNYEQIMPLPQTQSQPFDSRNYFQVAALQPNNHHYSSAGRH

SEQ ID NO: 48168 - protein, 488 aa, Eschscholzia californica
  misc_feature (192)..(192): Xaa can be any naturally occurring amino acid
MEVVTVALIAVIISSILYLLFGSSGHKNLPPGPKPWPIVGNLLQLGEKPHAQFAELAQTYGDIFTLKMGTETVVVASTSSAASEILKTHDRILSARYVFQSFRVKGHVENSIVWSDCTETWKNLRKVCRTELFTQKMIESQAHVREKKCEEMVEYLMKKQGEEVKIVEVIFGTLVNIFGNLIFSQNIFELGXPNSGSSEFKEYLWRMLELGNSTNPADYFPMLGKFDLFGQRKEVAECLKGIYAIWGAMLQERKLAKKVDGYQSKNDFVDVCLDSGLNDYQINALLMELFGAGTETSASTIEWAMTELTKNPKITAKLRSELQTVVGERSVKESDFPNLPYLEATVKETLRLHPPTPLLLPRRALETCTILNYTIPKDCQIMVNAWGIGRDPKTWIDPLTFSPERFLNSSVDFRGNDFSLIPFGAGRRICPGLPIANQFIALLVATFVQNLDWCLPNGMSVDHLIVEEKFGLTLQKEPPLFIVPKSRV

SEQ ID NO: 48169 - protein, 226 aa, Guillenia flavescens
RGKIEIKRIENTTNRQVTFCKRRNGLLKKAYELSVLCDAEVALIVFSSRGRLYEYSNNSVKGTIERYKKAISDNSNTGSVAEINAQYYQQESAKLRQQIVSIQNSNRQLMGETIGSMIPKDLKTLESKLDKSITRIRSKKNELLFAEIDYMQKREVDLHNDNQLLRAKIAENERNNPSMNLMPGGSNYEQIMPLPQTQSQPFDSRNYFQVAALQPNNHHYSSAGRH

SEQ ID NO: 48170 - protein, 474 aa, Bacillus anthracis str. Ames
MKKHLYINGDWKSVNTYKPLYAPYSEETLAEIAQGTEEDVKEAVAAAKNAMKEMNTLSAYDRATILEKVAQKMDERREEFAEIIAKEAAKPIRAARGEVDRTVQTYKFAAEEAKRIYGETLPLDAAPGADGRIAYTIRKPIGVIGAITPFNFPLNLVAHKVGPAIAAGNTVVLKPADQTPLSSYALIELFEEAGLPKGALNIISGPGSTVGEAIVTNDDVASITFTGSPKVGIGIKAKAGLKRVTLELGSNAAVIIDEDVELTDELIERVKWGAFVNNGQVCISVQRVFVHEERRDDFLSKLRKAMETVVVGDPLIEETDVSALISKKDVERIDNWVQEAVKEGANVLYGGNKRDERVFEPTVLTNVPEHVSVQCQEVFGPLMTVNTFKEFDEAIEQVNNSRYGLQAGVFTNNLFKAMRAIDELEVGGVMINDIPTFRVDHMPYGGVKESGTGREGIKYAIEEMTEMKLVCIKK

SEQ ID NO: 48171 - protein, 554 aa, Mycobacterium avium subsp. paratuberculosis K-10
MTSVHTLPDITATPAWDALRKHHDRIGDTHLRQFFEEDPDRGRELTVTVGDLYIDYSKHRVTRETLRLLVDLARTAKLEERRDQMFAGVHINTSEDRAVLHTALRLPRDAELIVDGRNVVADVHEVLDAMGEFTDRLRSGEWTGATGKRISTVVNIGIGGSDLGPVMVYQALRHYADAGISARFVSNVDPADLIATLADLDPATTLFIVASKTFSTLETLTNATAARRWITDALGDAAVAHHFVAVSTNKRLVDDFGINTDNMFGFWDWVGGRYSVDSAIGLSVMAVIGREAFADFLSGFHIVDRHFQTAPLESNAPVLLGLIGLWYSNFMGAQSRAVLPYSNDLARFAAYLQQLTMESNGKSTRADGSPVTTDTGEIFWGEPGTNGQHAFYQLLHQGTRLVPADFIGFSQPIDDLPTAEGSGSMHDLLMSNFFAQTQVLAFGKTAEEIAAEGTPADIVPHKVMPGNRPSTSILANRLTPSVLGQLIALYEHQVFTEGVIWGIDSFDQWGVELGKTQAKALLPVITANNSPAPQSDSSTDALVRRYRSERGRTS

SEQ ID NO: 48172 - protein, 552 aa, Pisum sativum
MVAAPISTVKLTDANLHTRFHSSSSSTPSTLSLPLSLHFHFSSHSKRFSSIRCQSVNGEKRKQSSRNVFDNASNLLTSLLSGANLGSMPIAEGAVTDLFDRPLFFSLYDWFLEHGSVYKLAFGPKAFVVVSDPIVARHILRENAFSYDKGVLADILEPIMGKGLIPADLETWKQRRRVIAPGFHTSYLEAMVQLFTSCSERTVLKVNELLEGEGRDGQKSVELDLEAEFSNLALEIIGLGVFNYDFGSVTNESPVIKAVYGTLFEAEHRSTFYIPYWKFPLARWIVPRQRKFQDDLKVINTCLDGLIRNAKESRQETDVEKLQQRDYSNLKDASLLRFLVDMRGVDVDDRQLRDDLMTMLIAGHETTAAVLTWAVFLLAQNPDKMKKAQAEVDLVLGMGKPTFELLKKLEYIRLIVVETLRLYPQPPLLIRRSLKPDVLPGGHKGDKDGYTIPAGTDVFISVYNLHRSPYFWDRPNDFEPERFLVQNNNEEVEGWAGFDPSRSPGALYPNEIISDFAFLPFGGGPRKCVGDQFALMESTVALVCCYRISMWN

SEQ ID NO: 48173 - protein, 512 aa, Sorghum bicolor
MDASLLLSVALAVVLIPLSLALLNRLRLGRLPPGPRPWPVLGNLRQIKPIRCRCFQEWAERYGPVISVWFGSGLTVVVSTSELAKEVLKENDQQLADRPRNRSTQRFSRNGQDLIWADYGPHYIKVRKLCNLELFTPKRLEALRPIREDEVTAMVESVYRAATAPGNEGKPMVVRNHLSMVAFNNITRLAFGKRFMNANGDIDEQGREFKTIVNNGIKIGASLSVAEFIWYLRWLCPLNEELYKTHNERRDRLTMKIIEEHAKSLKESGAKQHFVDALFTLKQQYDLSEDTVIGLLWDMITAGMDTTVISVEWAMAELVRNPRVQKKLQEELDRVVGRDRVMLETDFQNLPYLQAVVKESLRLHPPTPLMLPHKASTNVKIGGYDIPKGANVMVNVWAVARDPKVWSNPLEYRPERFLEENIDIKGSDFRVLPFGAGRRVCPGAQLGINLVASMIGHLLHHFEWSLPEGTRPEDVNMMESPGLVTFMGTPLQAVAKPRLEKEELYNRVPVEM

SEQ ID NO: 48174 - protein, 1231 aa, Oryza sativa (japonica cultivar-group)
MELRFKAPDYATWKKEAAACDKNNGNDKDGSIPVRNKYPRHPPPRFELAEGLDYKKIDKFMDERAISIAKTIANDIIIPDPAPEWMCHTFLDKHDELEPIFVKDSPRCFLRYFKNCGCYGMSWNLTITAQTLTCMVSFNALRCAKVVLEGRAPELFGMHANPNCVTKYGYFPLHEAAERFSVEMIKLLLRFGASANVRTVGDDVIEDLLPLHIAIENTCLHKYLEDNLSPSQNHLDYIYKLIHLLCLPEMKIFLDTIRLLAGKTNNLLEELWYYIEDGKLIQSAILLLAAQEQIRGGCSSKINGSSKKDGFGIISKRILRLSFALRWEKGSNGMAQKLREEKRALIDCTGLLVDVISQAGEPLSAYVQAHSEAPHVEVLEHVSTILKEYGFYPTAEVIDTMNLQPYDCEMERESCSKGWEKGSRRRMGSHVYKEKFFPILEISFTNPVSCEVGRIPPFANNHQSKRSFSTCATGAFRLLKLLKSSVTDLAWGLRYPCPLDLEAQQLGKYIVKYSLLFCQFQNVMVTIYWCSRQKVAWSATGCTLLISLLFFFSGSPHRILLNKKPLNFKTAPSRLLREISISSSRVQRVNNSSAEFVANLNDRNVEIVQHMEDNDHNIINATANVTSDWSIVKEEFTFPAGSAPFNSCHASTIVETEKDSFLVAYFGGSKEGAPDVKIWLQRYSPFLVEDGRLLCGSSVESWNSWGAWLEVTKDAGRTWRKYGPIYIEGETLGVIQPVPYMTANGTIRVLLRSFETIGRVCMADSADGGVTWSYVHETDLPNPNSGIDGVKMKDGRVLLAYNTFSRGTLKVAVSMDDGDSWNDVMTLEDTEGMEFSYPAVIQTMDDLIHITYTYNRTQIKFDLPTLSSQGSKDHGLILHIQEKCDKMTNKWSVLREEFTFSEGNVPFKTCHASTIVEVQKNMFLVAYFGGTQEGADDVKIWLQRYYNGSWHSPEVVDEVPNVPLWNPVLFQLPSGEILLFYKVGKTVESWSGCMKCSSDGGVIWSKREQLPPGILGPIKNKVTKDHGKTWKKYGPIYVRGKTMGVIQPVLYQTSSGTIRMLLRPSDEVGRICVAESKDSGVNWSYAQPTELPNPNSGIDGVKLKDGRVVLVYNSTSRGVLKVAVSQDDGDKWEDVLTLEETHGVEFSYPAVIQTSDGLVHVTYTYKRTQIKVVLPMLFGLLMVITSFIIFHVKNEFLLVTALCSMSFYNQARFDAVSNQTCGFVSGVKFEL

SEQ ID NO: 48175 - protein, 348 aa, Neisseria meningitidis FAM18
MKMQAVVVNKNVAGDVEIVEREVRPLEYGEALVEVEYCGVCHTDLHVAAGDYGEKPGRVLGHEGIGLVKEVADGVKNLKVGDRVSIAWLFQSCGSCEYCNTGRETLCRSVLNAGYTADGGMATHCIVSADYAVKVPEGLDPAQASSITCAGVTTYKAIKVSSVRPGQWIAIYGAGGLGNLGVQYAKKVFGAHVVAIDINDEKLAFAKESGADLVINAAKEDAAKVIQEKTGGAHVAIVTAVSAAAFNSAVNCVRAGGRVVAIGLPPESMDLSIPRLVLDGIEVVGSLVGTRKDLEEAFQFGAESLVVPKVQLRALDEAPAIFQEMREGKITGRMVIDMKKECGCGHHH

SEQ ID NO: 48176 - protein, 393 aa, Desulfovibrio vulgaris subsp. vulgaris str. Hildenborough
MAVIKMTDLDLKGKRVLLREDLNVPLKEGRITSDKRIRAALPSIRMAMEAGARVLIVSHLGRPVEGEFDEAFSLAPVAAHLSRELGRDVRLVKDYIDGVDVAEGDCVLCENVRFLKGEKKNTEELGRRLAALCDIFVMDAFGAAHRAQASTHAVARFAPVACAGPLLAAELDALERALDAPKHPLVGIIGGSKVSTKLTLLDNLSHRVDRLIVGGGIANNFIKAAGYEVGKSLYEPELVEEAARLMAAARAAGGEIPVPLDVVVGPELADGAPATVRKVSEVGPDEMILDIGPATATRYREILLAAGTIVWNGPVGAFEWEQFGAGTRALCEAVADSPAFSIAGGGDTVAAVEKYGVASRVGYISTGGGAFLEFLEGKELPAVAILQERAAQS

SEQ ID NO: 48177 - protein, 251 aa, Oryza sativa (indica cultivar-group)
MSGTGYTVEVTNLSSRASESDLHEFFSFSGAIEHIELIRSGEYGSTAYVTFKEPYSLETPVLLSGATIVDQPVCIARWGQPNEPYNFWDTPNWYTEEEIEYRTYQTCQFNSTPQEALTIAQDVVKTMLARGYVLSKDALARARAFDESHQVTATAAAKAAELSKRIGLTDRVSGLTDRVSAGVGAIRSVDETYHVSETTKTVATATGRTAVKVVNGIMTSSYFSAGAMMLSDALHRAAQAAADLAAHGRHN

SEQ ID NO: 48178 - protein, 664 aa, Desulfovibrio vulgaris subsp. vulgaris str. Hildenborough
MPSRKDFANAIRVLSMDAVEKAKSGHPGAPMGMANIAEALWRGPLRHNPANPHWPDRDRFVLSNGHGSMLIYALLHLTGYAVSMDDIRDFRQMGSRTPGHPEYGITPGVETTTGPLGQGIATAVGMAMAERMLATGFNRDGFPVVDHHTYVFLGDGCMMEGISHEACSLAGTLGLGKLIAFYDDNGISIDGEVKGWFADDTPARFEAYGWHVVRDVDGHDAAALDAALAAARAQTGKPSLICCKTCIGSGAPNKCGSHDCHGSPLGEAEIAAAREAMNWPHPPFEIPADIYAAWDCRDKGAKDEAAWREMFEGYRKAYPDLAAAFERRMSGELPANWEAEVEACIAATDSAAEKLATRVASRNALNGIAPLLPELVGGSADLTGSVGTWHKGSVRLTPDNWDANYISYGVREFAMGAIMNGLTLHGGFIPYAGTFLIFSDYAKNAIRLSALMGIRVVWVLTHDSIGVGEDGPTHQPVEQLGGLRLIPNVSVWRPCDTVETVAAWKSAIECATGPTCISLTRQGVPHIARTAEQRAAIGRGGYILRDCAGKPEAIIMATGSEVQLAVEAAAELEKRGRRVRVVSMPSSSVFDRQDAAYRESVLPSDVRVRVAVEAAASDAWWKYVGLDGKVVGMTGFGESAPGGVLFKHFGFTVDNVVDTVTSLL

SEQ ID NO: 48179 - protein, 322 aa, Geobacter metallireducens GS-15
MHSALALVGDDLKNVEAQFKKDLESDVYLIRKVGEYVLASGGKRIRPTLLLLAAKLCGYTGDRHVPLASVIEFIHTATLLHDDVVDNATLRRGNASANEVWGNEASVLVGDFLFSKSFSLMVQAGDLRVLKVISDATTIIAEGEVLQLLCTSDLDMTLERYIEVVKSKTAVLLSAACEAGAILGKATPEQELALRDFGMDLGIAFQLMDDTLDYTASEEQFGKEIGHDLEEGKITLPLIHTLRKCTDEERETIAAVVEKEVMEPGDFEAVFALVHKYGGIQYTTEVAGEYIARCKEHLQAFPASTEKQAALDLADYVVSRNR

SEQ ID NO: 48180 - protein, 224 aa, Geobacter metallireducens GS-15
MTRPKLVAIAVIGLAVALFFMSGLDRHLTLQSLKANRELLVSYSEQHRLAAVSLFIGIYVVQTALSLPGAAILSLAAGAIFGAVQGTVYAVIGATLGATLAFLVTRYLFHDAVQEKFGHRLTTINRELETAGLNYLLFLRLVPLFPFFLINLAAGLTHLPLRTFIIGTLVGIIPGGFVYVNAGASLATISNPADAASPRVLGSFALLGLFALIPVIYRKFTRRA

SEQ ID NO: 48181 - protein, 555 aa, Marinobacter sp. ELB17
MYQYNQIDQTLVDERVEQFRDQTRRYLTGELPEDEFSALRLMNGLYIQRQAPMLRVAVPYGLLSSTQMRKLAHVARTYDRGYGHFTTRTNIQFNWPELAAVPDILAELAQVQMHAIQTSGNCIRNTTTDPYAGVAESELEDPRPYCEIIRQWSTLHPEFAYLPRKFKIAVTGATEDRAASQVHDIGLQMVQNADGEIGFEVLVGGGLGRTPIIGKSIRKFLPKQHLLSYLDAILRVYNLKGRRDNKYKARIKILVEALGPDEFRRLVEEEWAHIRDGELTLTDAEIARAKSFFTLPDYDANAASADAHASLSDSLATDIEFNAWYRHNTLAHRVDGYRIAIVSLKPYLEAPGDITDSQMDAVADLADRYSFGETRATHHQNLVLTDVRKGDLYAVWQALAANNLARSNIGTLTDMIVCPGFDFCSLANARTLNISDQINEHFDDMDHLYDLGEIRLNMSGCINACAHHHVADIGILGVDKKGEDWYQISLGGSSKEDARLGKILGRSVPASDVAITVEKILAVYVDQRGEDESFAQVVQRVGIKPFKERVYATAH

SEQ ID NO: 48182 - protein, 437 aa, Saccharomyces cerevisiae
MLEHQLTQEDLEFDKKHIWHPYTSITTPLKVYPITKAEGSYLYLDNGTKVVDGMASWWCVQQGYNNHRLNAAAISQINKMSHVMFGGITHKAGIDFCKKLLALLPDTLECALLADSGSISVDIAMKMALRYHHSLGNTTKKRFLTIKKGYHGDAFGAVSVCDPVNSRHNTYNGFLAENIFCKAPEVRFDCREKDVEKLVEELDVKPFAEIIDKHHSEISGVVMESIVQGAGGLRMYHPYFLKRVRALCNDFNILLILDEVAVGLGRTGMLFGFEHAGIVPDIVCLGKTLTAGYLTLSATVTTREIGDQISSGPEGCFMHGQTYMANPLACAVASENLSILMEGKWKSQVRQIEVQLKKELVPLLEHPIVADVRILGAIGVVEVTKRVNVEVLQEKFIKAGAWIRPFGNIIYILPPYIITSEELTVLTEAIRSVLDFI

SEQ ID NO: 48183 - protein, 106 aa, Glycine max
  misc_feature (43)..(43): Xaa can be any naturally occurring amino acid
LLLFCPSLDGSRYCVDTVYGNGDITETRKCRLYVRVGLTQMLXGGVIIDILHAEQVRIMDEAYACWVIVLERVPSDIRDESRMHRLSDSMVINDIDASRYYHSNGE

SEQ ID NO: 48184 - protein, 506 aa, Saccharomyces cerevisiae
MASMFRPPESNRSHQKTPKLTLPVNLVQNAKSTNDGQHLNRSPYSSVNESPYSNNSTSATSTTSSMASNSTLLYNRSSTTTIKNRPVPPPLPPLVLTQKKDGIEYRVAGDSQLSERFSNLHVDITYKELLSSAPISTKLSNIDTTFIKKDLDTPEGEDSYPSTLLSAYDFSSSGSNSAPLSANNIISCSNLIQGKDVDQLEEEAWRFGHLKDEITTLGILGEGAGGSVAKCRLKNGKKVFALKTINTMNTDSEYQKQIFRELQFNKSFKSDYIVQYYGMFTDEQSSSIYIAMEYMGGKSLEATYKNLLKRGGRISERVIGKIAESVLRGLSYLHERKVIHRDIKPQNILLNEKGEIKLCDFGVSGEAVNSLAMTFTGTSFYMAPERIQGQPYSVTCDVWSLGLTLLEVAGGRFPFESDKITQNVAPIELLTMILTFSPQLKDEPELDISWSKTFRSFIDYCLKKDARERPSPRQMLKHPWIVGQMKKKVNMERFVKKCWEKEKDGI

SEQ ID NO: 48185 - protein, 437 aa, Saccharomyces cerevisiae
MCEHQLTQEDLEFDKKHIWHPYTSITTPLKVYPVTKAEGSYLYLDNGTKVVDGMASWWCVQQGYNNHRLNAAAISQINKMSHVMFGGITHKAGIDFCKKLLALLPDTLECALLADSGSISVDIAMKMALRYHHSLGNTTKKRFLTIKKGYHGDAFGAVSVCDPVNSRHNTYNGFLAENIFCKAPEVRFDCREKDVEKLVEELDVKPFAEIIDKHHSEISGVVMESIVQGAGGLRMYHPYFLKRVRALCNDFNILLILDEVAVGLGRTGMLFGFEHAGIVPDIVCLGKTLTAGYLTLSATVTTREIGDQISSGPEGCFMHGQTYMANPLACAVASENLSILMEGKWKSQVRQIEVQLKKELVPLLEHPIVADVRILGAIGVVEVTKRVNVEVLQEQFIKAGAWIRPFGNIIYILPPYIITSEELTVLTEAIRSVLDFI

SEQ ID NO: 48186 - protein, 354 aa, Arabidopsis thaliana
MKIEEDLGFINILKRATKLLCGNINLVLFLFLCSLPLFCFLIFFELSLQTTVSLASQYLVRQLTNWDYYYVPQDASVLGNLIPLLIQAFLLYLFPYGLIDLFTTTTIVSASWTVHTSEEEPLRFGQLVRRTVEICQNRLEGCLITSLYVLLLSTPVFFGFLFVATNYFHIISLTGSGENSYYYSINIEEDAEGYYRSSSVNSPVKMLFDAVLAMFHGAIFLGLLAMFSKWSAGWNMGLVVSVLEEEENGQSIYGTDALTLSSNYGKGHEKRGLQVMLVFLVFAIAMRMPCFCFKCTESSNGNRVLYTSFYVGLICVGNMIKWVACVVFYEDCRTSVLEKKGDVEIGSKGMTFVA

SEQ ID NO: 48187 - protein, 453 aa, Mannheimia succiniciproducens MBEL55E
MQLKSSLIVNQHLRLEQITEDDAEPVFRLICRQRDYLSRWLPGVGLTSNVSSTLKFIRSLKPLEQVFTIRRDDEIIGLVSFNKADYSNLKLEIGYWLSQSEQKQGIMTQCVQTMIDYAFNQLYFNRIQIKCAIGNTASKGIPQRLGFQLEGIERQGLLLLSGEFADFEIYSMLAQDWKNKQDKQIMDTYAVWGNPIAQSKSPAIHKIFAEQTGQNMKYIAMLGDEQHFERQLQEFFAQGAKGCNITAPFKERAYRLADEYSERALTAGACNTLKKLENGKLYADNTDGAGLVSDLQRLGWLKPNQQILILGAGGATKGVLLPLLQAQQKILIANRTLAKAEELAEKFSPYGEIRAVELKTIPPYRYDVVINATSLGLTGKTADIQPEILQQAGAVYDMQYAKETDTPFIALAKSLGVNNVSDGFGMLVGQAAHSFRLWRGIMPDIEVLLNRGI

SEQ ID NO: 48188 - protein, 359 aa, Zea mays
MQSKHRVFAEDLLLAAAAEGEDHFDRVPDSLVLLIFNKLADARSLGRCSAVSRRFSALVPLVDDACLRIDRVIPADAADAGAPRPRAALSHLLKSVLLAVLKPFAHCDAKSASPQKHAQQQQQQHHSPAQVLRNFSSIRSLRMELPVSDVGTDDGVVLRWKAVFGSTLQSCVILGGTRVDRAGPPHAPSSGSAPPAGDDDGGSIPESLYTNGGLKLRVVWTISSLIAAATRHYLLREIVKEHPTLERVALTDAGGQGTLSMGRDQLREFRDRPLAAAPAAAANRTQVPACNMKLRYAPLLELSDGTRIHGATLVVIKPVGDAGGKDLDELGAGAFDGPLREAVAALGKRRAYLLEMNGF

SEQ ID NO: 48189 - protein, 523 aa, Glycyrrhiza echinata
MEPQLVAVSVLVSALICYFFFRPYFHRYGKNLPPSPFFRLPIIGHMHMLGPLLHQSFHNLSHRYGPLFSLNFGSVLCVVASTPHFAKQLLQTNELAFNCRIESTAVKKLTYESSLAFAPYGDYWRFIKKLSMNELLGSRSINNFQHLRAQETHQLLRLLSNRARAFEAVNITEELLKLTNNVISIMMVGEAEEARDVVRDVTEIFGEFNVSDFIWLFKKMDLQGFGKRIEDLFQRFDTLVERIISKREQTRKDRRRNGKKGEQGSGDGIRDFLDILLDCTEDENSEIKIQRVHIKALIMDFFTAGTDTTAISTEWALVELVKKPSVLQKVREEIDNVVGKDRLVEESDCPNLPYLQAILKETFRLHPPVPMVTRRCVAECTVENYVIPEDSLLFVNVWSIGRNPKFWDNPLEFRPERFLKLEGDSSGVVDVRGSHFQLLPFGSGRRMCPGVSLAMQEVPALLGAIIQCFDFHVVGPKGEILKGDDIVINVDERPGLTAPRAHNLVCVPVDRTSGGGPLKIIEC

SEQ ID NO: 48190 - protein, 571 aa, Staphylococcus xylosus
MSNHINGIAASDGVAIAKAYLLVEPDLSLDNEKVTDTDAEIAKFNHAIETSKVELTKIRNNAEENLGADKAAIFDAHLLVLDDPELIQPIEDKIKNEQVNAPTALSDVTGQFITIFESMDNEYMKERAADIRDVSKRVLAHILGVELPNPSMIDESVVIIGNDLTPSDTAQLNKEFVRGFVTNIGGRTSHSAIMSRSLEIAAVVGTKSITKEVKQGDMIIVDGLTGEVIIDPTEDEVIAYQNKRERFFEDKQALQQLRDEPSTTADGTHVELAANIGTPDDLKGVIENGAEGIGLYRTEFLYMGRDEMPTEDKQFEAYKKVLETMEDKRVVVRTLDIGGDKELPYLNLPEEMNPFLGYRAIRLCLDQPDIFRPQLRALLRASTYGKLNIMFPMVATIKEFRDAKALLLEEKENLTNEGIEVSDDIELGIMVEIPSTAALADVFAKEVDFFSIGTNDLIQYTMAADRMSERVSYLYQPYNPSILRLVKQVIKASHNEGKWTGMCGEMAGDETAIPLLLGLGLDEFSMSATSILKARRQIKGLSQNEMEELADRAINCATSEEVQELVEQYAK

SEQ ID NO: 48191 - protein, 130 aa, Saccharomyces cerevisiae
MTRSSVLADALNAINNAEKTGKRQVLIRPSSKVIIKFLQVMQKHGYIGEFEYIDDHRSGKIVVQLNGRLNKCGVISPRFNVKIGDIEKWTANLLPARQFGYVILTTSAGIMDHEEARRKHVSGKILGFVY

SEQ ID NO: 48192 - protein, 290 aa, Glycine max
MAKPRYSRLPPRKSSSSSTLILTLFLVFTFLVLILLALGILSIPSSSRGNLPKPNDLASIARNTIHTSDDDDVRGEQWVEVVSWEPRAFVYHNFLTKEECEYLIDIAKPNMHKSSVVDSETGKSKDSRVRTSSGTFLARGRDKIVRDIEKRIAHYSFIPVEHGEGLQVLHYEVGQKYEPHYDYFLDDFNTKNGGQRIATVLMYLTDVEEGGETVFPAAKGNFSSVPWWNELSECGKKGLSIKPKRGDALLFWSMKPDATLDPSSLHGGCPVIKGNKWSSTKWMRVSEYKA

SEQ ID NO: 48193 - protein, 338 aa, Xylella fastidiosa Dixon
MSVALSIDLSKKKTILCFGEALIDMLAQPPVKKGMPRAFLQCAGGAPANVAVAVARLGGAVQFVGMLGSDMFGDFLFDSFAEAGVVTDGIVRTSTAKTALAFVALDAHGERSFSFYRPPAADLLFRAEHFQDASFSDALIFHACSNSMTDADIAEVTFEGMRRAQAAGAIVSFDLNFRPMLWPNGENPASRLWKGLSLADVVKLSSEELDYLANTLAADANAVIQQLWQGRAQLLLVTDAAGPVHWYTRTAGGQVPTFRVQVQDSNAAGDAFVGGMLYTFAQQFDDAAALIDFCHDPESIVSTLRFAAAVGALAVTRQGAFTAMPMLSEVLSLIQEQS

SEQ ID NO: 48194 - protein, 328 aa, Oryza sativa (japonica cultivar-group)
MMGPNVSSEKKALAAAKRRAYVTFLAGDGDYWKGVVGLAKGLRRVRSAYPLVVAVLPDVPGEHRRKLVEQGCVVREIQPVYPPESQTQFAMAYYVINYSKLRIWEFVEYERMVYLDADIQVFDNIDHLFDLDKGAFYAVKDCFCEKTWSHTPQYDIGYCQQRPDEVAWPERELGPPPPLYFNAGMFVHEPGLGTAKDLLDALVVTPPTPFAEQDFLNMFFREQYKPIPNVYNLVLAMLWRHPENVDLDQVKVVHYCAAGSKPWRFTGKEENMNREDIKMLVKRWWDIYNDESLDYKEEEDNADEASQPMRTALAEAGAVKYFPAPSAA

SEQ ID NO: 48195 - protein, 125 aa, Sulfolobus tokodaii str. 7
METVFTEKAPKPVGPYSQAIKVGNTLYVSGQIPIDPRTNEIVKGDIKVQTRQVLDNIKEIVKAAGFSLSDVAMAFVFLKDMNMFNDFNSVYAEYFKDKPPARVTVEVSRLPKDALIEIAVICSKG

SEQ ID NO: 48196 - protein, 230 aa, Arabidopsis thaliana
MAVSNSLTISPRKLRSDLYSYSYQNNSKTPLVISVLSSLIDRTLTRNERISRRALPSSGAGGKTQIFDCREIPDMTIQSYLGRIFRYTKAGPSVYVVAYVYIDRFCQTNPGFRISLTNVHRLLITTIMIASKYVEDLNYRNSYFAKVGGLETEDLNKLELEFLFLMGFKLHVNVSVFESYCCHLEREVSFGGGYQIEKALRCAEEIKSRQMIIQDPKHHHHHHQLARILL

SEQ ID NO: 48197 - protein, 542 aa, Oryza sativa (indica cultivar-group)
MEAATVVAAPIPAADAAAKALQKKLLDLELPPFPAPAKKAAAKVVAAAPKKKLAGGAGGYVLEDVPHLTDYLPNLPSFPNPLQNHPAYSVVKQYFVNADDTVAKKIVVHKGSARGTHFRRAGPRQRVFFQPDEVSAAIVTCGGLCPGLNTVIRELVCGLHDMYGVTSVVGIEGGYRGFYARNTVELTPRSVNGIHKRGGTVLGTSRGGQDTGKIVDSIQDRGINQVYIIGGDGTQKGAATIHAEVQRRGLKCAVVGVPKTIDNDIAVIDRSFGFDTAVEEAQRAINAAHVEAESAENGVGVVKLMGRNSGFIAMYATLASRDVDLCLIPESPFYLEGKGGLLEFAEKRLRENGHMVIVVAEGAGQDVIARSMRLADAHDASGNKVLLDVGLWLCAKIKDHFKKKANFPITLKYIDPTYMIRAVPSNASDNVYCSLLAHSAIHGAMAGYTGFTVAPVNGRHAYIPFYRITEKQNKVVITDRMWARVLCSTNQPCFLSTEDVEKAGQDDEEPIVPLVEGENSLVKAPPLLANAGDGAALCNGAA

SEQ ID NO: 48198 - protein, 1114 aa, Streptococcus pyogenes M49 591
LARDEAQQGDGNAKSGDGFQSSSKEAKPVLDSSSANPASIAEHHLRMHFKTLPAGESLGSLGLWVWGDVDQPSKDWPNGAITMTKAKKDDYGYYLDVPLAAKHRQQVSYLINNKAGENLSKDQHIPLLTPKMNEVWIDENYHAHAYRPLKKGYLRINYHNQSGHYDNLAVWTFKDVKTPTTDWPNGLDLSHKGPYGAYVDVPLKEGANEIGFLILDKSKTGDAIKVQPKDYLFKELDNHTQVFVKDTDPKVYNNPYYIDQVSLKGAEQTTPNEIKAIFTTLDGLDEDAVKQNIKITDKAGKTVAIDELTLDKDKSVMTLKGDFKAQGAVYTVTFGEVSQVARQSWQLKDKLYAYDGELGATLAKDGSVDLALWSPSADSVKVVVYDKQDQTKVVGQADLTKSDKGVWRAHLTSDSVKGISDYTGYYYLYEITRGQEKVMVLDPYAKSLAAWNDATATDDIKTAKAAFIDPSKLGPTGLDFAKINNFKKREDAIIYEAHVRDFTSDKALEGKLTHPFGTFSAFVEQLDYLKDLGVTHVQLLPVLSYFYANELDKTRSTAYTSSDNNYNWGYDPQHYFALSGMYSANPNDPALRIAELKNLVNEIHKRGMGVIFDVVYNHTARTYLFEDLEPNYYHFMNADGTARESFGGGRLGTTHAMSRRILVDSITYLTREFKVDGFRFDMMGDHDAAAIEQAFKAAKAINPNTIMIGEGWRTYQGDEGKKEIAADQDWMKATNTVGVFSDDIRNTLKSGFPNEGTAAFITGGAKNLEGLFKTIKAQPSNFEADAPGDVVQYIAAHDNLTLHDVIAKSINKDPKVAEEEIHKRIRLGNTMILTAQGTAFIHSGQEYGRTKQLLNPDYKTKVSDDKVPNKATLIDAVAQYPYFIHDSYDSSDAVNHFDWAKATDSIAHPISNQTKAYTQGLIALRRSTDAFTKATKAEVDRDVTLITQAGQDGIQQEDLIMGYQTVASNGDRYAVFVNADNKTRKVVLPQAYRYLLGAQVLADAEQAGVTAIAKPKGVQFTKEGLTIDGLTALVLKVSSKTANPSQQKSQTDNHQTKTPDGSKDLDKSLMTRPKRAKTNQKLPKTGEAPSKGLLAAGVALLLLAISLLMKRQKD

SEQ ID NO: 48199 - protein, 262 aa, Clostridium difficile 630
MEKLQGKIAVVTAATKGIGLASAEILAKNGATVYLAARSEELAHEVINKISAEGGCAKFVYFNAREEETFTSMIEEVVKKEGKIDILVNNFGSTNPSLDKDLVTGDTDNFFDTVNTNLKSVYLPCKAAIPHMIKNGKGSIVNISSIGSVLPDLSRIAYCVSKAAINSLTQNIATQYAKDNVRCNAVLPGLIATKAALDNMSPEFIKEFLKHVPLNRIGEPDDIAKAVLFYASDDSSFITGDLLEVAGGFGLPTPQFADNILG

SEQ ID NO: 48200 - protein, 533 aa, Ostreococcus tauri
MNILSPPHSPPPMSRARAPDAVTLNETREDAARAVGALFAAAATRTRGASIKARTLAPHVRHKRATHAVTCETIKHARTIKSVFADACEDLRALVDEDAGESEGKETFRRRGEAYVYAYETLFGNGRGLERWEGGEGCAIARENEEAMREALKREMTLRGVSSAKALSELVVEASEGASVRYSRTARVNTLKMTVKDALEVFRGDGFECDVDALIDTLLVFPAGTDLHAHRLVKSGGVVLQGRASCLPAAALAPERGWACIDGCAAPGNKTTQLAAMVGREGGVYAFDADAKRLKRLKENATTTGSHAIIRAKCQDFLTVDPANQQYASVRALLLDPSCSGSGTEVNRGDIMLREALCDDNDDENEVDAADHDRVEKLAAFQKKALTHAFNFPEVQRVSYSTCSVYEKENEEVVRDVMGAANERGFKLVHALPAWHRRGIAIDGLSESQARCLIRADPTEDDMEGFFVAVFERDVERTRSKGCELPPSNPNAAAAKAESERDKKKRSMKHATIAQPVYAKKKSKGGKPAPLFR

SEQ ID NO: 48201 - protein, 227 aa, Ostreococcus tauri
  misc_feature (227)..(227): Xaa can be any naturally occurring amino acid
MGGEGAVGARAVTISGATTAPVGALIVIPGLTDGPESLAYGASEGSALSRACEERRWALVRFELSSSYDRYGTCTLDDDARDIDAVIAHVMSTRPSAREIALLGHSTGCQSICHFIARGYETSKAVKRVVLQAGVSDRDWYEKDAGREAMAQAIERAEAMAPDELMPKETPGTYGVATTARRFLSLAKPGGDDDWFSLDLFDGTREDASKIPRLTGCAHVDVRLVVX

SEQ ID NO: 48202 - protein, 215 aa, Burkholderia vietnamiensis G4
MNAPASSPARRTKKLPPLRVGIGGPVGSGKTTLLEMLCKAMRDTYDLVAITNDIYTKEDQRLLTVAGALPEERIMGVETGGCPHTAIREDASINLEAVDRMLSRFPDADIVFIESGGDNLAATFSPELSDLTIYVIDVAGGEKIPRKGGPGITKSDLLVINKTDLAPLVGANLDVMASDTKKMRGERPYVMTNLKALDGVADVIAFIEKKGLLTV

SEQ ID NO: 48203 - protein, 156 aa, Pisum sativum
GPFGGLKFMTGFPVKKVNTDITSITSNGGRVKCMQVWPPIGKKKFETLSYLPPLTRDQLLKEVEYLLRKGWVPCLEFELEKGFVYREHNKSPRYYDGRYWTMWKLPMFGTTDASQVLKELDEVVAAYPQAFVRIIGFDNVRQVQCISFIAHTPESY

SEQ ID NO: 48204 - protein, 429 aa, Zea mays
  misc_feature (192)..(192): Xaa can be any naturally occurring amino acid
MLLSAPMQITHYLYSGAPSLSSSPIDPRDWDLQRAIGLMEVGDARNGSAAAALTKGGADDAARKPLPPCCVKAKARVPETEANCHDTVVSGWFTEPRSRFGKTSKVQYFNNPMWPGEAHSLKVEKILFQGKSPYQEILVFESSTYGNVLVLDGIVQLTDKDECAYQEMVTHLPLCSIPAPKNVLVVGGGDGXGFYLREIARHDSVETIDICEIDQLVIDVSKEFFPNLSIGFKDPRVRLHVGDAVDFLRNSPEGKYDAIIVDSSDPIGPAQALVEKPFIQTIARALKPGGVLCNLAESMWLHTHLIQDMLAICRQTFKGAVHYAWTSVPTYPSGVIGFLLCAKEGRAVNFLTPANPIEKIEGAAKAGRELRFYNSEIHRAAFVLPTFVRRELEAYTTPISSAENEKPKESVSEPQKIKILSNNAILTAS

SEQ ID NO: 48205 - protein, 419 aa, Sulfolobus tokodaii str. 7
MAWKLEDIKVIIPIGGEATRLRPLTVETSKAAVRLLNRPLIEYTILELARQGIKEFIFGVKGYVNYRSLFDLYKEGIGFSARYHIKPRVHFKYIPRAETVGNAHAVKIAVEYYDVKEPFLVVQGDNLFKLDVKKVLEYHEEKKAFMTIVLKKVESVEEFGVAELDNDMKIKRFVEKPKRREEAPSDLANTGIYVISPEIRDVFKSEEVEEMLKLGKMDFGKDIIPYLIKKGYPVYGYVTENLWFDVGTPDRYLEAMLTLLKTLSDEDMQGLRIDANRRIFVQGTSPDSRKRRVIIKRMYKKGDLKLEGDILIGRHCQIGSGTYIEESAIDNFTIIGKSVKIVRSSIMDRVYIGDNAVIENSIIGRHVEIRSTSSKPTKIINSVIADDAVIGEGSEITNSKIYPHKLINSESKIYDTILT

SEQ ID NO: 48206 - protein, 197 aa, Aspergillus nidulans FGSC A4
MAEHDDELIASKTEGFKVGEKKTIAEYNELDKNDESLNRWKASLGLNTGEPTGDPNDPRTCIIKTLALEVQGRPDVVIDVSAPGALEKLKDKPFTIKEGAHFRIKVTFEVHHDVLSGLKYLQVVKRKGIRVSKDQEMLGSYAPCTTGKPIYEKKFQEEEAPSGMMARGHYNAESKFIDDDDKVHLHFHWSFDIAKDW

SEQ ID NO: 48207 - protein, 888 aa, Shewanella sp. MR-4
MSEDMLQDLDPLETQEWVDALQAVLEQEGPERAHFLLEKLIDKARRNGTHLPYTATTAYLNTIPAGQEPHMPGNQEMERRIRAIIRWNALAMVLRGSKKDLELGGHISSFASSATIYDVCFNHFFRAPNEKDGGDLVYFQGHIAPGIYARSFLEGRLTEDQLANFRQEVDGKGLSSYPHPKLMPDYWQFPTVSMGLGPIQAIYQARFLKYLTDRGLKDCSDQTVYCFLGDGECDEPEALGAIGLAAREELDNLVFIINCNLQRLDGPVRGNGKIIQELEGEFRGAGWEVVKVIWGRYWDPLLARDTSGKLLQLMEETVDGEYQNCKAKGGAYTREHFFGKYPETAEMVANMSDDDIWRLNRGGHDPVKVYAALDHARKTKGRPTVILAKTVKGYGLGDAGEGKNIAHNVKKMGIESIRYFRDRFNIPIPDDQLEDLPFYHPGPDSEEVKYMMSRRAELHGSVPQRREKFSEELEIPSLKIFDSILQGSNGREISSTMAFVRVLTALLKDKKIGKNIVPIIPDEARTFGMEGLFRQVGIYAHEGQKYVPQDSDQVAYYREDKSGQVLQEGINELGAMSSWVSAATSYSVNDVPMIPFYIYYSMFGFQRIGDMAWAAGDMRARGFLVGGTSGRTTLNGEGLQHQDGHSHVLANTIPNCITYDPTYGYEIAVVVQDGIRRMYGENQEDIFYYLTTMNENYEQPAMPEGAEVGIVKGIYKLETVAGSGKGKVQLMSCGTILEQTRKAAQALAKDFGITADVFSVTSFNELTRDGQAVERWNMLHPTETPKQAYISQVISSDAPAIAATDYMKIYGEQLRAYMPTDYKVLGTDGFGRSDSRDNLRHHFEVDAKFIVIAALKSLVDRKELPVDVLANAIKEYGIDADKINPQYA

SEQ ID NO: 48208 - protein, 475 aa, Shewanella sp. MR-4
MSNEIKTQVVVLGAGPAGYSAAFRAADLGLETVIVERFSTLGGVCLNVGCIPSKALLHVAKVIEEAKAVAAHGVVFGEPTIDLDKLRSFKQKVISQLTGGLGGMSKMRKVNVVNGFGKFTGPNSLEVTAQDGTVTVVKFDQAIIAAGSRPIKLPFIPHEDPRIWDSTDALELKEVPGKLLVMGGGIIGLEMGTVYSSLGSEIDVVEMFDQVIPAADKDVVRVFTKQIKKKFNLILETKVTAVEAREDGIYVSMEGKSAPAEPVRYDAVLVAIGRTPNGKLIDAEKAGVKIDERGFINVDKQLRTNVPHIYAIGDIVGQPMLAHKGVHEGHVAAEVIAGMKHYFDPKVIPSIAYTDPEVAWVGLTEKEAKEQGIAYETATFPWAASGRAIASDCSEGMTKLIFDKDTHRVIGGAIVGVNGGELLGEIGLAIEMGCDAEDLALTIHAHPTLHESVGLAAEIYEGSITDLPNPKAKKK

SEQ ID NO: 48209 - protein, 444 aa, Saccharomyces cerevisiae
MQSMNVQPRVLAVGGEQFFSQRQASEQHQQQNMGPQVYSPKVNRARMFPQGMPVNTINGSVNQEMNNAYLLKQKNEPLLTQQQQQQQQQQQQQQQQQQQQQQQQQQQPFNIGTPVSVASLPPGLNVLQQQQQQQQQQGVGLNRPLASQLPKHLTNQSMPPIFLPPPNYLFVRDVWKSNLYSEFAVIRQLVSQYNHVSISTEFVGTLARPIGTFRSKVDYHYQTMRANVDFLNPIQLGLSLSDANGNKPDNGPSTWQFNFEFDPKKEIMSTESLELLRKSGINFEKHENSGIDVFEFSQLLMDSGLMMDDSVTWITYHAAYDLGFLINILMNDSMPNNKEDFEWWVHQYMPNFYDLNLVYKIIQEFKNPQLQQSSQQQQQQQYSLTTLADELGLPRFSIFTTTGGQSLLMLLSFCQLSKLSMHKFPNGTDFAKYQGVIYGIDGDQ

SEQ ID NO: 48210 - protein, 433 aa, Saccharomyces cerevisiae
MQSMNVQPRVLAVGGEQFFSQRQASEQHQQQNMGPQVYSPKVNRARMFPQGMPVNTINGSVNQEMNNAYLLKQKNEPLLTQQQQQQQQQQQPFNIGTPVSVASLPPGLNVLQQQQQQQQQQQQQQQGVGLNRPLASQLPKHLTNQSMPPIFLPPPNYLFVRDVWKSNLYSEFAVIRQLVSQYNHVSISTEFVGTLARPIGTFRSKVDYHYQTMRANVDFLNPIQLGLSLSDANGNKPDNGPSTWQFNFEFDPKKEIMSTESLELLRKSGINFEKHENLGIDVFEFSQLLMDSGLMMDDSVTWITYHAAYDLGFLINILMNDSMPNNKEDFEWWVHQYMPNFYDLNLVYKIIQEFKNPQLQQSSQQQQQQQYSLTTLADELGLPRFSIFTTTGGQSLLMLLSFCQLSKLSMHMFPNGTDFAKYQGVIYGIDGDQ

SEQ ID NO: 48211 - protein, 511 aa, Oceanobacillus iheyensis HTE831
MENNELVLVLDFGSQYNQLITRRIREFGVYSELHSHKLTAEEIKEMNPKGIILSGGPHSVYDENSFRCDEGIFELGIPVLGICYGMQLMSLHYDGKVERSKNREYGKALIELDGEPVLFKDTPKGQTVWMSHGDKVTAAPPSFNIDATSPSTPIAAISNVEKNLYGVQFHPEVRHTEYGNDLLNRFVFDVCGCTGDWSIENFIDMEVEKIQETVGDRKVLCALSGGVDSSVVAALIHKAIGDQLTCIFVDHGLLRKNEGDDVMKVFAEDFQMNIIKVDAKDRFLFKLEGVSDPELKRKIIGNEFIYVFDDEASKLKDIDFLAQGTLYTDVIESGTDTAQTIKSHHNVGGLPEDMQFTLIEPLNTLFKDEVRELGSQLGVPDRIVWRQPFPGPGLAIRILGEVTEEHLEIVRESDAILREEIAKAGLDRDIWQYFTVLPNIKSVGVMGDARTYAHTIGIRAVTSIDGMTSDWARIPWDVLERISTRLVNDVDNINRVVYDVTSKPPATIEWE

SEQ ID NO: 48212 - protein, 655 aa, Mycobacterium sp. MCS
MCGLLAFLKDPSAQSSPALVGAVSGAAELMRHRGPDEPGTWADDTDDPGIVLGFNRLSIIDIAHSHQPLRWGPPEAPLRYVLVFNGEIYNYLELREALRTEHGAEFATDGDGEAIVAAYHHWGPAALSRLRGMFAFALWDTVTGELFCARDPFGIKPLYIATGPGGTAVGSEKKCLMAVADQLGIDTGLDERAVQHYTVLQYVPEPETLHRGVRRLESGSYLRMRPGQAPVVTRYFTPRFDAVPFRAASAPGSAGGVDQARYDEITAVLEDSVAKHMRADVTVGAFLSGGIDSTAIAALAMRHNPRLITFTTGFEREGFSEVDVAVASAEAIGARHVTKVVSQAEFVEALPAIVWYLDEPVADPALVPLYFIAREARKHVKVVLSGEGADELFGGYTIYREPLSLRAFDYLPRPVRRSLRRASAPLPEGMRGKSLLHRGSQTLEERYYGNARSFSDEHLRAVLRRFSPDWTHTDVTAALYRESDGWDPVARMQHIDLFTWLRGDILVKADKMTMANSLELRVPFLDPEVFAVASRLPLEQKITRATTKFALRRALEPVVPAHVLNRPKLGFPVPIRHWLRAGELLEWAYETVAASQTGDLIDAEAVRTMLDEHRTGVSDHSRRLWTVLIFMLWHAIFVEGSVTPRIEEPHYPVQL

SEQ ID NO: 48213 - protein, 305 aa, Pseudomonas fluorescens Pf-5
MSAKVVVVGSLNMDLVTRAERLPRGGETLIGKSFATVSGGKGANQAVAAARLGAQVSMVGCVGDDAYGEQLRGALLAEQIDCQTVSVVEGSSGVALIVVDDSSQNAIVIVAGGNGQLTPEKVAGFDGVLQDGQVIICQLEVPLATVGYTLKRGRELGKTVILNPAPASGPLPAQWYGAIDYLIPNESEASALSGVAVDSLESAEVAASRLIAAGAGKVIITLGAQGSLFADGQRFEHFPAPRVKAIDTTAAGDTFVGGFAAALAAGKSEAEAIRFGQVAAALSVTRAGAQPSIPTLSDVQAFIPS

SEQ ID NO: 48214 - protein, 877 aa, Oryza sativa (indica cultivar-group)
MSGQSNSPDMIFQVYTPRKRKFLNSVHYSESNRAVSHGSGLVTSAKDSHQGEESFLNGPAGLSSILSNSQGFAPQDILSGTTELSGIRYSTDQSQTAVAHKLLFSCEKGDQSIVAMVHPSQSSLEKIQQKQGISSYEAKHDVQGSTKADDSSSILSPHSLDDEIMSVVGLLSPSAYESLCDAEKKNHDITWPKIIEIKGRVKLDAFEKFVQELRRCQTRSLMVISLCWKFGTSKAGLLGMKEVAENFEASQKVGFADVCDGSNLYVCPRSDAVITILAKCGFFKGMSAADTNQDSLIGCIVWRRNPLSKIVDHSRWTSGNTCSNNPGMDSRTNTGNIQNDIDQMQEIQSNSVKTHPVATGLLSQCGHAKSTGERDPTEKVVPHSLFKLASKLTPQPPFKAPSLIGCQLSQVSPFELASHEVPEIQQHVQSIIDSHSGSFGVWHPTSHSQGLSLKSLHVQQRTTHYDLAAQKNHMAEAFSGSITQEYASNAVESSKQQETNPFLLQPDTYGAHRANDIDDLPKVDFANLHRVELKFDVHPINRETTITSDVLICPRLSDKKSNSPFQQSSQPSFQVEGIKNHEKVEVKENVTDMISREITNQVSHRKAEIENFKSKDDIDAEDMPECHFQGLDNEKLHQSGSSKHTSPSLKNSTGSKAPSQVFPPITQKSYTPLEVEDISSGHDPNMPSGCLNIPRDQVSFPRHPPPAQGDQRLAARHPPVLADQGYVPRLPPPVLEDQGLAPRCPPPALAGQGFVPRHPPPVLPNQGFFPRRCPPFAGQDLYPWRPPFHANQGPFPRHAPPHPCPPFTPGHVRPPSNFAPPGPWRPVLHPGQEHHHHHYGHPGRSNGPSGSGNKPGYHNPSYGNGPGGCRPPHQAQG

SEQ ID NO: 48215 - protein, 372 aa, Candidatus Kuenenia stuttgartiensis
MGRDYYQILGVSRNAGSDEIKKAYRQLAMKYHPDRNPGNKESEQMFKEAAEAYGVLSDAEKKKLYDQYGEEGLKATGTRGYSSYEDIFDAFGDIFGGGSIFDEFFGKGRGGGEAGKRGASLKCDIEMGFKEVATGVEKKIELMRREICDACRGTGAKEGTSPVTCPYCGGKGQVQQSQGFFTLRTTCPKCRGTGKIIESPCRKCGGTKRYPRRATISVKIPAGVEDGTRLRLVGQGEPGENGAPSGDLYCDVHVTPHPIFQRHGNDVLCEVPISFAQAALGCKIDVPTLSGNIIQVKVPKGIQNNEIIPIKGEGFPNIHRHGKGNLLVQVVVETPTKISSRQEELLKEFAELEKNNISSRQKKFIEKMKQVS

SEQ ID NO: 48216 - protein, 259 aa, Triticum aestivum
  misc_feature (67)..(67): Xaa can be any naturally occurring amino acid
SGKTKTKWGTEIKGKGSLEPWSHAYTWEEDFTASDDDEDEGEYGQIEERKPEKKKKEDKPKKIKGGXTQKKKKPARTCVQIEEIPEDNTAGCDAIRKAFAMGNGKGKAKELSPQDAALLIQMNYRAHLAHRSQVLRCLRDLAVAKAKLKELRSLFYNLSYRRRLSHDHEERQRFSEKIIVLLLTVDALEGPDFMVRTAKKSMLEELESMLEIVDPQPPGKQRSFSRRKFDLPEGGAIPNEKTAGVNNAVRVINTGKGKQ

SEQ ID NO: 48217 - protein, 542 aa, Desulfovibrio vulgaris subsp. vulgaris str. Hildenborough
MSTSPFNSRVAPMPHDDATAPVLHYAHDAAGAHDAADAAGAHDAADAAGTPPCAASRTARLRSLDAAHVWHPFTQMRDWMGSEPCIIDAADGNHLIDTDGNRYLDGVSSLWTNVHGHRHPHIDEAIRRQLDRVAHSTLLGLGGTPSIELAARLTAIAPAGLTRVFYSDSGSTAVEAALKIAFQYHRQAPEGDARRTRVMAFSNAYHGDTIGSVSLGGMSLFHGIYGPLLFDPVRAPAPHCYRCPADLRPETCGMACLGEVERLMRHHGHELCAVVVEPLVQGAAGMLVQPRGWLRGLRDLCDRHGVFMVADEVAVGFGKTGTMFACEQEGVVPDMLCLAKGITGGYLPLAATLVTEHIHDGFLGGYADFRTFFHGHTYTGNALACAAALASLDVFEEERTLETLRPRIERLATLLAPLNDLPHVGDIRRVGVMTGIELVADRETRTPYRPEERIGHRVTLEARRRGVIVRPLGDVMVLMPPLSITETELETLVHTVRGAIIAVTEHGADGGLWTKRPDGPDNPDKANTPDTPDGARTGETVV

SEQ ID NO: 48218 - protein, 733 aa, Saccharomyces cerevisiae
MSKNQSVSASEDEKEILNNNAEGHKPQRLFDQEPDLTEEALTKFENLDDCIYANKRIGTFKNNDFMECDCYEEFSDGVNHACDEDSDCINRLTLIECVNDLCSSCGNDCQNQRFQKKQYAPIAIFKTKHKGYGVRAEQDIEANQFIYEYKGEVIEEMEFRDRLIDYDQRHFKHFYFMMLQNGEFIDATIKGSLARFCNHSCSPNAYVNKWVVKDKLRMGIFAQRKILKGEEITFDYNVDRYGAQAQKCYCEEPNCIGFLGGKTQTDAASLLPQNIADALGVTVSMEKKWLKLKKLSGEPIIKNENENINIEFLQSLEVQPIDSPVDVTKIMSVLLQQDNKIIASKLLKRLFTIDDDSLRHQAIKLHGYTCFSKMLKLFITEQPQVDGKGNETEEDDIKFIKGILDFLLELPKTTRNGIESSQIDNVVKTLPAKFPFLKPNCDELLEKWSKFETYKRITKKDINVAASKMIDLRRVRLPPGWEIIHENGRPLYYNAEQKTKLHYPPSGSSKVFSSRSNTQVNSPSSSGIPKTPGALDSKKHKLSDEEYERKKQKRLEYERIALERAKQEELESLKQKLKLENERKSVLEDIIAEFNKQKELQKEESKKLVEAKEAKRLKRKTVSQSQRLEHNWNKFFASFVPNLIKKNPQSKQFDHENIKQCAKDIVKILTTKELKKDSSRAPPDDLTKGKRHKVKEFINSYMDKIILKKKQKKALGLSSASTRMSSPPPSTSS

SEQ ID NO: 48219 - protein, 1367 aa, Oryza sativa (japonica cultivar-group)
MELSNQGQTPMSTNMGSQPLPSSNIQPNQAEYPSMFYPSLPADWGAQPMFSMGASVPISSYFIVPMSQQSVQIGASRPETPRSSGAHSLSRVSLRPPQQVLSIRTSLPTMVGSQHSPAGKKLQPTIASPKVQILKSTQSQSSNKRSAQKETPSKVQTQQLESVRSKFRESLSAALRTDSDQSKNQSSDVQPDGSADQKKEMDVDADQVATTSQGMSAAKSEVLTSVGAERRAEDEKLNSDLVSNIATPLNADIQQQPENASLQDEMLGQYTVVADELLQGHGLCWVSDFDAGVPEPATQPNLKRSRASDIDPVVADTLSESESKRMKSANDEEAIDKDSIIQKADDLAVRVEEELFKLFGGVNKKYKEKGRSLLFNLKDKSNPELRERVLSGDITPDRLCSMTAEELASKELSEWRLAKAEELAQMVVLPSTEVDVRRLVRKTHKGEFQVEVEETDGISVEVELGGNLLTQVPSKAPEDQTKSDDKESTDDKTGIQDNDKAPDGTSQDEDNGAGKNDPQDDLEYVDNEKSDLMQELMVDDLKDTENLPPIPSLDEFMQGLDSEPPFENLSAGTPEEDSDDRDEADTTAESAELPEEEVKVSAAEKIVSEADLPSSQDKSESKLESPKDEVGSNLGPVEQREGKLIKSSPDSVEVKQTTTENVLNRDSTVHNMATTLPMIRESIWEGAIQLTMSSLTNVVAIFKSGEKPPVKEWRSFVEIKGRVKLSAFQEFVEQLPKSRSRAIMVTELCWKEGSHESGRQHLLQTIDSYISDERVGLAEPADGIELYLCPSQGKTVEILSRHLPKEHLESLAVSASSIIGVIVWRRPNVPRMPAHPRHDGSRRPSILKKPQVTGSTPGPRPSLPMSSHGAPPGFPVQRHRHEEDVTDDVPPGFGPGVARDEDDLPEFNFVNSSNPAANVTTTQGLQGAGSMYPLPLLARLVLGMMMTTMIYQNGTPTSLSPNNSQQGSSQFHPHHSNRLPPPPPPPSLQQLHHPYQHQQQQQQQLYHHQNALQPQIPSNSIPQAYLRTQQPLQQLPLMQQQLQPAQAWQQTNAWWPAQGGAAAAAAQASMVQQSQYGVIPNSNNSAQSYGSGSESGSEDDDLDVGIGDVPSELEVKNSGLIPAQSKETERQLSKKEWKKKELAELDTVLAELGISGHAERKPDKQNGGDKNGAPQGPWRGGGYKSEEEITAVYMKEKMKKIASAKKKSGRGGWGCKACCKMEDAARSAKLAGAKKKEKTNSLSIDRLLPSPSSEFRMSTGLICSTCYYEVEVPGVGFAPRIDLKLCFASWLFLKSALRIGSTVTLKLMNKEYAAKESLKKFLRFFVGVPKRHFCLSLESKPAALSSHPLWQYPFTRNRRFAYSYYKL

SEQ ID NO: 48220 - protein, 556 aa, Xanthomonas oryzae pv. oryzae KACC10331
MRQSHTLEVAEQRVPANQVETQLQRLHAAIESARGEMQQLRDRLHGALAREVGEFLELHALLLDDPELLQGLDELIRTHRYSADYALRVQRDRLAAVFDGMEDAYLKSRMDDLDHVIGRIHAFLHKRAPDLKGVAGEILVCDNVAPSELAQLQAQGVVGIVTTAGSALSHSAILARSLHLPLVVGVSEAVQRIEDGDVLIVDASSGQVIVDPKPEHLRDYRERLRALAKEQRELGRLRSKPTRTRDNVDITLLANAESLEDVAKAHALGASGLGLYRTEFLFLQRNELPDEDEQFHAYRDTVLGMSGRPVTIRTLDLGADKADRTGLTLVDEDNPALGLRGVRLSLARPAVAQTQLRAILRASGYGPVRILVPMVSGREEILLLRKQLKKLTAQLREEGHEIAEHIPLGAMIEVPAAALALDCFIDDIDFLSIGTNDLVQYLLAVDRNNEALGELYSPLHPAVLRLIAQVIATGRTHGKPVAVCGEIAGDPCFVPMLLALGLTEFSLHPATLLEVRRAVRDIHLGELGVHGEKLLSARDRKGIEKWLAGHAQGLLR

SEQ ID NO: 48221 - protein, 110 aa, Aspergillus nidulans FGSC A4
MGASEHVPPITSKAEFQEKVLNAKGFVVVDCFATWCGPCKAIAPTVEKFAQTYTDASFYQIDVDELSEVAAELGIRAMPTFLLFKDGQKVSDVVGANPGALEAGIKALLA

SEQ ID NO: 48222 - protein, 267 aa, Shewanella sp. MR-4
MDGLTGKVVIITGASEGIGRALAIAMARVGCQLVLSARNETRLASLALEIANYGPTPFVFAADVSSASQCEALIQATIVHYGRLDILVNNAGMTMWSRFDELNQLSVLEDIMRVNYLGPAYLTHAALPYLKSSQGQVVVVASVAGLTGVPTRSGYAASKHAVIGFFDSLRIELTDDNVAVTVICPDFVVSQIHKRALDGEGKPLGTSPMQEAKIITAEQCANMMLPVIATRGRLLITSLRGRLGRWLKLIAPGLIDKIARKAIASGR

SEQ ID NO: 48223 - protein, 368 aa, Mycobacterium sp. MCS
MTDGPLEFTVHRNAEPATDEVRAEILANPGFGRFHTDHMVSIDYTADAGWHNAQVLPYGPIELDPSAVVLHYAQEIFEGLKAYRWADGSVVSFRPESNAARLRSSARRLAIPELPEELFLESLRQLIAIDEQWVPPAGGEESLYLRPFVIATEPGLGVRPANEYRYLVIGSPAGAYFPRGIKPVSVWLSHEYVRASPGGTGAAKFGGNYAASLLAQAQATEHGCDQVVWLDAIERRYVEEMGGMNLFFVFGSGGSARLVTPELSGSLLPGITRDSLLQLATDAGFAVEERKIDVDEWQKKAAAGEISEVFACGTAAVITPVSHVKHHDGEFTIADGEPGEVTMALRDTLTGIQRGKFADTHGWMVKLN

SEQ ID NO: 48224 - protein, 230 aa, Saccharomyces cerevisiae
MKRTNKLPDYHLKIVVVGDGAVGKTCLLISYVQGTFPTDYIPTIFENYVTNIEGPNGQIIELALWDTAGQEEYSRLRPLSYTNADVLMVCYSVGSKTSLKNVEDLWFPEVKHFCPSTPIMLVGLKSDLYEADNLSDLVEPSSAESLAKRLGAFAHIQCSARLKENIDEVFETAIHTLLSDSLYAPREPTHTIKNPFKRNTTRSDIDSSTGDTSVSISGTKRLRKNKCIIM

SEQ ID NO: 48225 - protein, 629 aa, Mycobacterium sp. MCS
MGVTFDPIRLSRSRESQHMAVSVQMPALGESVTEGTVTRWLKQEGDTVEQDEPLLEVSTDKVDTEIPSPASGVLQKIVAQEDDTVEVGGELAVIGEGGEDSGDSSDDSSSDEDEDEEPAEEAESETTSEESDSSEETDSSEETESEPEPEPEPKKESKPKPKSSGSATPVTMPELGESVTEGTVTRWLKKVGDSVEVDEPLLEVSTDKVDTEIPSPVAGTLLEIIAEEDDTVEVGGELAKIGDADQAEAEEPEPEPEPEPEPEPEPEPEPEPKQESKPEPKPEPKQESKQEAKPEPKKEPEPQQDAEPSDGSGPYVTPLVRKLAAEHDVDLAAVKGTGVGGRIRKQDVLAAAEADKKAKSGPEDAAEAPGKAPAAATASANASDAPLAHLRGTKQKANRIRQLTAKKTRESLQATAQLTQTHEVDMTKIVALRAKAKNDFAEREGVNLTYLPFIARAVIDALKQHPNVNASYNEDTKEITYYDAEHLGFAVDTDQGLLSPVIKNAGDLSLAGLARAIADIAARARSGDLKPDELSGGTFTITNIGSQGALFDTPILVPPQAAMLGTGAIVKRPRVIVDEFGNESIGVRSICYLPLTYDHRLIDGADAGRFLTTIKRRLEEGSFEADLGL

SEQ ID NO: 48226 - protein, 245 aa, Zea mays
MDSRLAIAALLLLASASSAAADGGKVAVALYYESLCPYSARFVVNHLAKVFADGLREVVDLTLVPYGNARIHPGGEISCQHGPYECLLNTVEACAIDAWPDLDVHFSFIYCVEDLVVKRQYKDWESCFEKLGLDAKPVTECYKSEHGHKLELKYANQTDALEPPHRYVPWVVVDGQPLLEDYENFEAYICKAYKGTPPKACEGLERLQMALETAAEARNGVSYNSGVSKLATAEDEGGEHKVGEY

SEQ ID NO: 48227 - protein, 244 aa, Nostoc sp. PCC 7120
MSTDENKVIAITGASSGIGEATARLLARQGLRVMLGARRTDRLEAIAAEIRSKGGEAEYRTLDVTNLEDMQAFVEFAQDKFGRLDVVVNNAGLMPLSRLEVLKIDEWNRMIDVNIRGVLHGIAAALPLFKQQRSGQFVNLSSIGGHNVYPTAAVYCATKFAVWAISEGLRQESTDIRVTVISPGVTETELASTITDAEAAEWVEGFREAVIPADAIARAIAFAIEQPVEVDVNEIIVRPIGQMS

SEQ ID NO: 48228 - protein, 470 aa, Geobacillus kaustophilus HTA426
MEQRSKQPITYRFPAGFWWGSATSATQIEGAANEGGKGKNIWDHWYEQEPHRFFQGVGPEVASDFYHRYKEDIALMKEIGHNSFRFSISWSRLIPDGVGEVNPEAVRFYNAVIDELLANGIEPFVNLYHFDMPLAMQTIGGWENREVVDAYARYASLCFQLFGDRVKTWFTHNEPIVPVEGGYLYDFHYPNVVDFRRAVQVAYHTMIAHAKAVAAFRRAAIPDGKIGIILNLTPSYPRSQHPADVKAAHIADLLFNRSFLDPAVKGEYPQDLIELLDEYGFLPVTKANDRELIKENTIDLLGINYYQPRRVKAKENMPNPDAPFLPERFFDYYAMPGRKMNPYRGWEIYEKGIYDILINIKENYGNIECFISENGMGVEGEERFRDESGMIHDDYRIEFIREHLKWVHRAIEEGVNVKGYHLWTFMDNWSWTNAYKNRYGLVAVDLENGLKRTIKKSGYWFKSLAENNGF

SEQ ID NO: 48229 - protein, 309 aa, Triticum aestivum
MFYAGYGYHASNFEQTYRCYPASFFDKPHLEGGDKVIMPPSALDRLASLHIEYPMLFELHNGVTDRISHCGVLEFVAEEGMIIMPYWMMQNMLLQEGDIVRVKNATLPKGTYVKLQPHTTDFLDISNPKAILEKTLRNFSCLTTGDSIMVAYNNKQYYIDIVEAKPASAVSIIETDCEVDFAPPLDYKEPEKPQRPIVPAGKAPAEDQEAIVEDEPKFKPFTGSGKRLDGKGPKQPAPGASSATAAARSAPSDSNKRANQQTASPSGASTSTRKKEAEAQKEPAKGSEPPKKEEPKFNAVTGKSYSLNR

SEQ ID NO: 48230 - protein, 365 aa, Oryza sativa (japonica cultivar-group)
MTNLASTLLLVRAVNLRGWFPLLGPAFAANELVLPTNCLFCRGVDSHAPGGLLKFLRKTTPRTEQHVCNGSSSQPINVGDDCNVGDCVRTEKRLPWTKEEDLRLVSAWLNNSNDPIQSNYKKNDQYWNGVAAVYNNTTPKNRARQVKQVKDRFGRIKKRVAWFCASWKEANALWASGESEVNLMDRTVKSYEEDHKKDGPFMFKHCWDVLSKEPKWDAYLERLEGLEPDKRKFNVEEGVGHHFSLDDARDERPIGGKQAKEQQKRKRKDQAIIDLEEEFHKLVDAQNTANEGHKEMLETQRRVSSENVEARKLKYLAEKEHKESTILETYKSLMMQDTTGMPEDVRSERMLALRCFREKLFGKTD

SEQ ID NO: 48231 - protein, 250 aa, Triticum aestivum
  misc_feature (207)..(207): Xaa can be any naturally occurring amino acid
MSAAGDRDLRELAPVEAILFDIDGTLCDSDPFHFLAFRELLQEVGFNNGVPVTDDFYSANISGWHNDALAGALFPELEHAKGMESMDRKEALCKKLAAGELKGLEGLQELCTWIEGRNLNRAAVTNAPRANAELVLSLLGLTSFFPVLVIGSECERAKPSPEPYLKALELIGASPDRTCIFEDSESGIRAGVIVGVAEVGLTTGKPXKVMRDAGASLRIEDSGSQTLMGMLQELDPAPADREAGVPGHRC

SEQ ID NO: 48232 - protein, 576 aa, Xanthomonas campestris pv. campestris str. 8004
MSLRLRGHAASRGNALGRARVRQSHTPEVAEQRVPANQVETQLQRLHAAIAAARTEMQQLRDRLHGALAREVGEFLELHALLLDDPELLQGLDDLIRTHRYSADYALRVQRDRLAAVFDGMEDAYLRSRMDDLDHVIGRIHAFLHKRAPDLKGVAGEILVCDNVAPSELAQLQAQGVVGIVTTAGSALSHSAILARSLHLPLVVGVADAVQRVNDGDVLIVDAGSGQVIVDPTPEHLRDYRERLRTLAKEQRELGRLRSKPTRTRDNVDITLLANAESLEDVAKAHALGASGLGLYRTEFLFLQRNELPDEDEQFHTYRDTVLGMSGRPVTIRTLDLGADKADRTGLTLSDEDNPALGLRGVRLSLARPAVAQAQLRAILRASGYGPVRILVPMVSGREEILLVRKQLKKLTAQLRDEGHEIAEHIPLGAMIEVPAAALALDCFIDDIDFLSIGTNDLVQYLLAVDRNNEALGELYSPLHPAVLRLIAQVIATGRAHNKPVAVCGEIAGDPRFVAMLLALGLTEFSLHPATLLEVRRAVRDLHLGQLRVHGEKLLRARDRKSIEKWLASVAQGLLH

SEQ ID NO: 48233 - protein, 421 aa, Desulfovibrio vulgaris subsp. vulgaris str. Hildenborough
MPNVRSTYTDAVGFFGLTSPTELVETYGSPLYVYSEAILRQRCREMKALSSHPGFRVNYSAKANSNLALLHIIREEGLVVDAMSPGELFMNLRAGFSPDKILYVCNNVSAEELGNAVSHGLLVSVDSLSQLDLYGEVNPGGRVMVRFNPGIGAGHHKKVVTAGKETKFGVDPASIDEVRTILARHNLTLAGINQHIGSLFLEPESYVEAARFLLTLAERFDDVEVIDFGGGFGIPYHKYDNQPRLDLTAMGAQFDDLISGWAQRRGYRGRFLVEPGRYVVAECGLLLGSVHSVKSNGANRYVGTDLGFNVLARPVMYDAHHDIEVYREDGAPSDLLLPQTVVGNICESGDIIARNRPLPPVEEGDILGVLDAGAYGYVMSSSYNQRMRPAEVLIDLEGRPRLVRRRETLDDLVAMYEGLGL

SEQ ID NO: 48234 - protein, 431 aa, Marinobacter sp. ELB17
MTTIANIKAREVLDSRGNPTVEADVILKDGTLGRACAPSGASTGSREALELRDGDASRYLGKGVLKAVDAINGKIRDALMGKDAADQRGLDNTMLELDGTENKANLGANAILAVSLAAAKAAAASLGKPLYEHIADINGTSGKYSMPVPMMNILNGGEHADNNVDIQEFMVQPVAAKSFADALRIGAEIFHSLKKVLQAQGLNTAVGDEGGFAPNLPSNEAALAMIQEAVEKAGYKLGTDITLALDCAASEFYKNGQYLLAGEGKSFDSAGFADYLAGLAERYPIVSIEDGMDESDWDGWKILTDKIGDKVQLVGDDLFVTNTKILKRGIDTGVANSILIKFNQIGSLSETLDAIKMAQDAGFTAVISHRSGETEDTTIADLAVATCAGQIKTGSLCRSDRVAKYNQLLRIEEALGGKAAYNGLREIKGQG

SEQ ID NO: 48235 - protein, 567 aa, Aspergillus nidulans FGSC A4
MSQKIYRSPFPNLEIESVDLVSKVFSNPFDTPLSRPMYIDALSGEQYTYGDVIQRTRSLANGLQQLFGLREHDVVALFSPNTIDYPIACHAIIGSLAVVAPTSAALTAQELHAQLKTSRARFIIAHSSLLSTARAAAKGTSIEKVIVLDGQSSAPGHLTCQQLASTYAPTALRQIPAHEAGSRIAFICFSSGTSGPAKGVITTHRNITSNLQQWRAQLLDSGSAAQRVDRTAAIAFLPFSHIYGLNLYMCQCLTWGTPVVILPRFDLDTYLSCVEKYKPQELALVPPIALMLVKDDRIRNYNLRSVRRILSAAAPLTIELSSALETRFKDIFGTEVFCTQSWGLTETSPIATGIPNDRMDKRGAGVGCIVPNMEFRFVDPETMLDADVGKDGASQPGEIWCRGPNVTPGYYNNLEATRGAFHVDDDGVSWFRTGDIGVIDAEGYITIQDRIKEMIKYKGLQVIPSELEGKLVDHPDVVDVAVIGVWVDARATELPTAFVTLRQGIDERGVGKVIEDIHLWFNARVANHKRLRGGIYVVENIPKSPSGKILRRVLKQQLKESAAKARL

SEQ ID NO: 48236 - protein, 417 aa, Oceanobacillus iheyensis HTE831
MEDPNLEANRQDKKSFIQKVKSVGPGAIIAASFIGPGTVTTSTQAGASFGYALIWAVLFSILATIVLQEMSARLGIISKKGLAEAARDQFNHPAIKYPIIGFIIMAIYVGCTAYMSGDLRGTSLGLEALTGVSINIIGPIVGILILLLGLSGSYKLIEKLMVFFVVLMSIIFITTMFIAQPDIGGVLSGMFVPSIPVGSIITIIALIGTTVVPYNLFIHSSSVQERWSRPEQLKDSRRDIYFSIGVGGLITIAIVITSGTLMRGVEVGSVIDLAIQLEPLLGGFAESFLAIGIFSAGFSSATASALGAAITVSSMLKWENGMKNWKFKAVFSSVIIIGILSFVFRFEPLDVLLFAQALNGILLPSIAILLIVIMNNKKLLGSYANSTIINIIGIVVVVICTGLGIYSLVTAIQGFIG

SEQ ID NO: 48237 - protein, 478 aa, Mycobacterium sp. MCS
MADKTADDIIKLIKDESVEYVDIRFCDLPGVVQHFSIPASAFDESVFEDGLAFDGSSVRGFQSIHESDMMLLPDPETARIDPFRHAKTLNMNFFVHDPFTREAYSRDPRNVARKAENYLISTGIADTCYFGAEAEFYIFDSVTFDSKINGTSYEVDSESGWWNTGEPFEADGSANRGYKVRPKGGYFPVAPYDHYVDLRDKMATNLINAGFVLERGHHEVGTAGQAEINYKFNTLLHAADDVLLFKYIIKNTAWQEGKTVTFMPKPLFGDNGSGMHAHQSLWKDGQPLFHDESGYAGLSDTARHYIGGILHHAPSLLAFTNPTVNSYKRLVPGYEAPINLVYSQRNRSACVRIPITGNNPKAKRLEFRCPDSSGNPYLAFAAMLMAGIDGIKRKIEPQAPVDKDLYELPPDEAASIPQAPTSLSAVIDRLEEDHEYLTEGGVFTEDLIETWISYKRENEIMPIQIRPHPYEVALYFDV

SEQ ID NO: 48238 - protein, 232 aa, Oryza sativa (indica cultivar-group)
MARRLWHVVLAVCHMLRRGLCRKRLMVDLHVLLGRGKLAGRALRGLLAHHAAAGHGHHLAASSSSSAALASFYGRRPREVEFSCTTTPSSYPHYGLFPFKSRGGGGGRRGGGGGGEYGGLDAAAVARAFEMMSAEVEGTPSSSAAAVQGGGGGGWATATPSPMVAWILGRSPAGVRPLRVTDSPFPAVPENGGGEQRVDDAEFEDFINKFYEQLRMQPSAATPDCQLRRRGR

SEQ ID NO: 48239 - protein, 155 aa, Zea mays
ISEPPKDGADVVAPDLNLVKGRGGALLREKMVEAASDKFIVIVDETKLVDGLGGSGLAMPVEVVQFCWKYNLVRLQELFKEEGVEAKLRFEGDKPYVTDNSNYIVDLYFKTPIKDALAAGQEIAALEGVVDHGLFLNMASSVIIAGTDGVSVKTK

SEQ ID NO: 48240 - protein, 413 aa, Parvularcula bermudensis HTCC2503
MTGQQHIVVIGAGQAAAQFISAYRQRGGESKITLVGDELDLPYQRPPLSKAYLKGEFDADRLSFKPQSFYDDSMAVCLLGEPAASINREQKVVTMTSGKTLPYDVLVLATGSRPRPLPSLPTSYDNVFSLRTRAESNELGAALSTAKHLTVIGGGFIGLEVAAISRSRDIPVTLLERADRLLARVTSPLVSDFFTRLHRRHGVNVHLSAEISEVRTDGNRVTHLALGDGQVIDTDIILVGIGGIANDELAKGAGVNCQDGIVVDDLGATNDPAIFAAGDCTRRPVPSGDLLRIESVYNAKEQADQIACHLTGSPSPVVDTPWFWSDQYDVKLQTAGLFNGYDEALPRGETDDAPFSVLYFKDERLIAADCLNDGPMFMTAKQILKTGAVIPKADLIDPAVPLKEIMAKAKAAG

SEQ ID NO: 48241 - protein, 167 aa, Oryza sativa (japonica cultivar-group)
MAFASASNGAVRFTEEQEALVLKSWAIMKDDSANIGHRFFLKIFEVAPSARHLFSFLRNSDVPLEKNPNLKKHAMAVFVMTCEAAAQLRKTGRVTVRDTTIKRLGSTHFKNGVSDTHFEVARFALLETIKDGIPASMWSPEMKNAWGEAYEHLVAAIKEGMKPVALL

SEQ ID NO: 48242 - protein, 372 aa, Oryza sativa (japonica cultivar-group)
MALFKPLHLPPLFAAAAAAAGPRPLSLSARPLYRQQDPLFLASRVASPAPPPPSATADGARPVEAAPAGAAPEEAARRAKIGVYFATWWALNVIFNIYNKKVLNAFPYPWLTSTLSLAAGSAIMLASWATRIAEAPATDLDFWKALSPVAIAHTIGHVAATVSMAKVAVSFTHIIKSGEPAFSVLVSRFFLGEHFPAPVYFSLLPIIGGCALAAITELNFNMIGFMGAMISNLAFVFRNIFSKKGMKGKSVSGMNYYACLSMLSLVILLPFAFAMEGPKVWAAGWQKAVAEIGPNFVWWVAAQSVFYHLYNQVSYMSLDEISPLTFSIGNTMKRISVIVASIIIFHTPVQPINALGAAIAILGTFIYSQAKQ

SEQ ID NO: 48243 - protein, 188 aa, Triticum aestivum
HGTKVEYRVWNPFRSKLAAAVLGGVDNIWIAPGARVLYLGAASGTTVSHVSDIVGPTGLVYAVEFSHRSGRDLVNMAKKRTNVIPIIEDARHPAKYRMLVGMVDVIFSDVAQPDQARILALNASYFLKNGGHFVISIKANCIDSTQAPEAVFAAEVEKLKLEQFKPSEQVTLEPFERDHACVVGGYRM

SEQ ID NO: 48244 - protein, 135 aa, Triticum aestivum
MIRILQISILCFFLVAGISISSSEEEEETIYKILQDNGLPSGIFPKGVTEFTFDGETGRFSVYLNQSCDAKYETELRYDTNITGTLSSANVTDLSGISAQDLFLWFPVKGIRVDVPSSGLIYFDVGVVRKQYSLS

SEQ ID NO: 48245 - protein, 1478 aa, Saccharomyces cerevisiae
MPFLRKIAGTAHTHSRSDSNSSVKFGHQPTSSVASTKSSSKSPRATSRKSIYDDIRSQFPNLTPNSTSSQFYESTPVIVQSFNWTTDDHISAGTLENPTSFTNSSYKNDNGPSSLSDSRKSSGGNSVNSLSFDKLILSWDPTDPDEWTMHRVTSWFKFHDFPESWILFFKKHQLFGHRFIKLLAYDNFAVYEKYLPQTKTASYTRFQQLLKKTMTKNVTNSHIRQKSASKLKSSRSSSESIKSKLKNSKSQEDISNSRSTSESALSPTKSGPSKTDEKNFLHSTSTHQKTKSASSLYRRSFISLRGSSSSNASSAKSPSNIKLSIPARPHSIIESNSTLTKSASPPASPSYPSIFRRHHKSSSSESSLLNSLFGSGIGEEAPTKPNPQGHSLSSENLAKGKSKHYETNVSSPLKQSSLPTSDDKGNLWNKFKRKSQIGVPSPNTVAYVTSQETPSLKSNSSTATLTVQTADVNIPSPSSSPPPIPKTANRSLEVISTEDTPKISSTTASFKETYPDCINPDKTVPVPVNNQKYSVKNFLLDQKFYPLKKTGLNDSENKYILVTKDNVSFVPLNLKSVAKLSSFKESALTKLGINHKNVTFHMTDFDCDIGAAIPDDTLEFLKKSLFLNTSGKIYIKDQMKLQQKPKPAPLTSENNVPLKSVKSKSSMRSGTSSLIASTDDVSIVTSSSDITSFDEHASGSGRRYPQTPSYYYDRVSNTNPTEELNYWNIKEVLSHEENAPKMVFKTSPKLELNLPDKGSKLNIPTPITENESKSSFQVLRKDEGTEIDFNHRRESPYTKPELAPKREAPKPPANTSPQRTLSTSKQNKPIRLVRASTKISRSKRSKPLPPQLLSSPIEASSSSPDSLTSSYTPASTHVLIPQPYKGANDVMRRLKTDQDSTSTSPSLKMKQKVNRSNSTVSTSNSIFYSPSPLLKRGNSKRVVSSTSAADIFEENDITFADAPPMFDSDDSDDDSSSSDDIIWSKKKTAPETNNENKKDEKSDNSSTHSDEIFYDSQTQDKMERKMTFRPSPEVVYQNLEKFFPRANLDKPITEGIASPTSPKSLDSLLSPKNVASSRTEPSTPSRPVPPDSSYEFIQDGLNGKNKPLNQAKTPKRTKTIRTIAHEASLARKNSVKLKRQNTKMWGTRMVEVTENHMVSINKAKNSKGEYKEFAWMKGEMIGKGSFGAVYLCLNVTTGEMMAVKQVEVPKYSSQNEAILSTVEALRSEVSTLKDLDHLNIVQYLGFENKNNIYSLFLEYVAGGSVGSLIRMYGRFDEPLIKHLTTQVLKGLAYLHSKGILHRDMKADNLLLDQDGICKISDFGISRKSKDIYSNSDMTMRGTVFWMAPEMVDTKQGYSAKVDIWSLGCIVLEMFAGKRPWSNLEVVAAMFKIGKSKSAPPIPEDTLPLISQIGRNFLDACFEINPEKRPTANELLSHPFSEVNETFNFKSTRLAKFIKSNDKLNSSKLRITSQENKTE

SEQ ID NO: 48246 - protein, 218 aa, Prochlorococcus marinus
AGTGSNSTSEAIHATAKAAEAGADGALVVVPYYNKPPQAGLESHFRAVAQAAPDLPLMLYNIPGRTGCSISPITVQRLMNCSNIVSFKAASGTTNEVTDLRIRCGSRLAIYSGDDGLPLPMLSVGAVGVVSVASHIVGMRLKAMIEAYFAGENSLALSHHEQLQPLFKALFATTNPIPVKAALELIGWPVGAPRSPLLPLENQMKNELMKTISALLQT

SEQ ID NO: 48247 - protein, 354 aa, Neisseria meningitidis FAM18
MKAARFYDKGDIRIEDIPEPTVAPGTVGINVAWCGICGTDLHEFMEGPIFIPPCGHPHPISGESAPVTMGHEFSGVVYAVGEGVDDIKVGQHVVVEPYIIRDDVPTGEGSNYHLSKDMNFIGLGGCGGGLSEKIAVKRRWVHPISDKIPLDQAALIEPLSVGHHAYVRSGAKAGDVALVGGAGPIGLLLAAVLKAKGIKVIITELSKARKDKARESGVADYILDPSEVDVVEEVKKLTNGEGVDVAFECTSVNKVLDTLVEACKPAANLVIVSIWSHPATVNVHSVVMKELDVRGTIAYCNDHAETIKLVEEGKINLEPFITQRIKLDELVSEGFERLIHNNESAVKIIVSPNL

SEQ ID NO: 48248 - protein, 295 aa, Zea mays
MQMSTDPNHYGVFPHSFCNQHVVSFQTSSVTSVSGAIPVCLDTSSGMNGNMAMLNTTTSTIVSTGSPNMSAESSCPNLKYTAPLAVEWSYPELQLLNDGLNKYANEPGIMKYIKIAATLPDKTVRDVAMRCQWMAARKEATRRRKPEEHYLGKKIKDRKDKMAEPSSWGTNPPVQTEMRSSSSMPPNAKDNGFLSADSQIDHGMLNVLEENAKLLNQIEVNILTSQAHNNIELFHHARRNINGLLQSMSQIPGIMSKMPPLPISVDERLASYILPRAPTAQVLGSSHLKEERRVW

SEQ ID NO: 48249 - protein, 425 aa, Sulfolobus tokodaii str. 7
MEEKKLSLSQALALGLGNIIGAGIFVMAGVSITAAGPAALLAFLITAVYAMSVGLNNAELASVFPKVEGGVYSFALLSLGETIGFLVGWFRVIGYAISGGATALGFSGYLITTFSLPSFLYFLLAILLIIVLIIIDYLGLKLAAEIESILVVLNILGLVIFSITALVISGIRLQNFSPFLPHGITGVLTASNIAFFAYSGFNTIATLTPSVKEGERTVPKAIVLSLLISAFLYMLVTFSMVDAIGYKNFKTNSAPLQLVLSTIHAPFYVYFFVNLTAILATITVTLSTIIATERTMVQMELDNLLPKVKGGKLSILLIIGLVMIASLGLGNVEVIALVSNFGIVFSYMLSGIEVAVVRHRGLRGVFKSPGFPFVQIISVILSGVFIYSLGFQSLLIGFVTLLIGLVIHSIHKEIMKKEGIFSRKK

SEQ ID NO: 48250 - protein, 446 aa, Mycobacterium sp. MCS
MDRQKEFVLRTLEERDIRFVRLWFTDVLGYLKSVAIAPAELEGAFEEGIGFDGSSIEGFARVSEADMVARPDPSTFQVLPWADGSGKHHSARMFCDITMPDGSPSWADSRHVLRRQLGKASDLGFSCYVHPEIEFFLLKPGPNDGTPPVPADNGGYFDQAVHDSAPNFRRHAIDALEQMGISVEFSHHEGAPGQQEIDLRYADALSMADNVMTFRYVVKEVALGDGVRASFMPKPFAEYPGSAMHTHMSLFEGDTNAFHSPDDPLQLSDVAKSFIAGILEHACEISAVTNQWVNSYKRLVHGGEAPTAASWGAANRSALVRVPMYTPRKASSRRIEVRSPDSACNPYLTFAVLLAAGLRGVEKGYVLAPQAEDNVWSLTPEERRAMGYRELPTSLGVALGEMENSELVAEALGEHVFDYFLRNKRAEWETYRSHVTPYELQAYLSL

SEQ ID NO: 48251 - protein, 279 aa, Triticum aestivum
  misc_feature (94)..(94): Xaa can be any naturally occurring amino acid
PGNFCIPTARRLGPRGPSTWPEGVRNSFLPADLFVSRICDPSPIPAAIPRGGGRDRSQPWTLLPRRPRRLLRRRRHPDFDYLFKLLLIGDSGVXGKSSLLLRFTSDSFEDLSPTIGVDFKVKMVNIAGKKLKLAVWDTAGQERFRTLTSSYYRGAQGIIMVYDVTRRETFTNLSDIWAKEIDLYSTNQDCIKMLVGNKVDKESERAVTKKEGIDFAREYGCLFLECSAKTKVNVALCFEELVLKILDTPSLLADASSGAKKNIFKQKAPEADAAASGCC

SEQ ID NO: 48252 - protein, 371 aa, Zea mays
MLRLQHHFLSSIRASSHRHCSLLSIATTATSPDRFVAEEYLVTTCGLTPAQAGRASKGLTHLKSPVKPDAVVAFLVGVGLAKDDITAGIARYPRLLCSKVDKTLTPRFAQLMSLGLSPSQISRLITIVPNIFVAPKKISHLQFYLSFMGCFDRVHSAIRINPMLLSRNLEDVVKPNIAFLLQCGLTVSNVLEFPLLIGMRPESVRERVACAEKLGVPRNTGMFKSALWAVYCVGPNSIGAKLDVIKATLGCSEAELTLVVRKSPPILRMSEGKLSRALKFLKVDVGLKLQYILLRPAILAFSMQRRLMPRHYFIKILKAKGLVKENVDFYNALCLTEKRFAQKFIDPYNQSIAGLADAYAAACAGKMPHED

SEQ ID NO: 48253 - protein, 434 aa, Vibrio cholerae O1 biovar eltor str. N16961
MRIVVVTRIIVVGGGAGGLELVTKLGRTLGRKGRANVTLVDRNSSHLWKPLLHEVATGSLDEGVDALSYRAHAKNHSFDFQLGSLASIDRESKTITLSELKDEHGELLMPKRDLEYDILVLAIGSTSNDFNTPGVKEHCIFLDSPEQANRFRTEMNNEFLKLHAKNGQGSVDIAIVGAGATGVELSAELHNAVKELRTYGFGDLDSSKLNVNLIEAGERILPALPPRISAAAHQELTKLGVNVRTMTMVTKAEKDGLTTKDGEKISAHIMVWAAGIKAPDFMKDIAGLETNRINQLVVKGTLQTTRDDDIFVIGDLAQCTQADGKFVPPRAQAAHQMASLAFRNIVAKMYGRELKAYVYKDHGSLVSLSRFSTVGSLMGNLTRGSMMVEGRIARVVYISLYRMHQMALHGMIKTGLMMLVGRINRVLRPNLKLH

SEQ ID NO: 48254 - protein, 515 aa, Shigella flexneri 2a str. 301
MTDHTMKKNPVSIPHTVWYADDIRRGEREAADVLGLTLYELMLRAGEAAFQVCRSAYPDARHWLVLCGHGNNGGDGYVVARLAKAVGIEVTLLAQESDKPLPEEAALAREAWLNAGGEIHASNIVWPESVDLIVDALLGTGLQQAPRESISQLIDHANSHPAPIVAVDIPSGLLAETGATPGAVINADHTITFIALKLGLLTGKARDVTGQLHFDSLGLDSWLAGQETKIQRFSAEQLSHWLKPRRPTSHKGDHGRLVIIGGDHGTAGAIRMTGEAALRAGAGLVRVLTRSENIAPLLTARPELMVHELTMDSLTESLEWADVVVIGPGLGQQEWGKKALQKVENFRKPMLWDADALNLLAINPDKRHNRVITPHPSEAARLLGCSVAEIESDRLHCAKRLVQRYGGVAVLKGAGTVVAAHPDALGIIDAGNAGMASGGMGDVLSGIIGALLGQKLSPYDAACAGCVAHGAAADVLAARFGTRGMLATDLFSTLQRIVNPEVTDKNHDESSNSAP

SEQ ID NO: 48255 - protein, 116 aa, Vibrio cholerae O1 biovar eltor str. N16961
MAEETIFSKIVRREIPADILYQDELVTAFRDIHPRAPSHILIIPNKLIPTVNDVEVEDELALGRLFTVAKKIAEQEGIAENGYRLIMNCNSHGGQEVYHIHMHLVGGRPLGPLLMG

SEQ ID NO: 48256 - protein, 174 aa, Magnetospirillum magnetotacticum MS-1
MNIKDHIRGVPDFPKPGILFYDISTLLAHPDAWQVAMGRMAREIIKFQPDVLAGIESRGFLVAAPLALKLGCGFVMLRKNGKLPGETIRHDYELEYGTDTIEIQKNAIAEGSRVVILDDLLATGGTMAAGVQLLRKIGAHVTGAGTIIDLAFLPGKQRLKELDVPFTCLASYDD

SEQ ID NO: 48257 - protein, 147 aa, Debaryomyces hansenii CBS767
MIATILVVLFVAYLLRNVFSGIEISNPNKGETAETIVEGKFTPVSLAKYNGSDDPKIFIAVRNRVFNVTMGAAFYGPGGPYENFAGRDASRGLSKNSFELECLTPVDQPIDPLDNLTSDEIESLDSWEEHFENKYPVVGTLHENDTV

SEQ ID NO: 48258 - protein, 107 aa, Oryza sativa
  misc_feature (20)..(20): Xaa can be any naturally occurring amino acid
LDPFGAGKGSDPEWNETFMXSAFTHNATELIIKLRDSDSAPDDDFVGEATISLEAIYTEGSIPPTVYNVVKEEEYRGEIKVGLTFTPEDDRDRGLSEEDIGGWKQSS

SEQ ID NO: 48259 - protein, 222 aa, Guillardia theta
MYLFINCSNYFKKVLTKKCNSEKKKSYLNLNQSLIEKFCSYIEGDWNNYDQNQKFPSLWSHIRVCFRTIPEENVGPNCFYVESAYDYMLDKPYKTVVVRIIEKDGFIEMENFKLKSPEDFWFGSRDSSLLLNLKVDDLIKFNDDCNSIFYYKENEDIFYGITKPGKKCIIIRNGVKTYLDSRITLSKSKYTSWDIGRSYESELQLWGSTSGPFCFEKQDFKF

SEQ ID NO: 48260 - protein, 302 aa, Nicotiana tabacum
MSTTTTATPPQHHHTFWCHECDMSVFLLHLPSTDPPRCPHCHSDFLEQMDSFTPTLLPQFPNQPDSNPNLEDLISTDLNTATNFTPSDDNFLLDSPYLHRLIHHLTTANDAPIPNRQHSPASKAAMEALEGIKISSLMLENDPVIPCPVCKDNFLLDMEVKMLPCKHMYHSDCILPWLEVNNSCPVCRFKLPTEEEDDEECIRRRERFLGAMRLGEILAEEEDLFGFRRTLRRVARRHQLDGGESTIGQAGQGVGVVARANSVETVSSWPSWPVENGSDGDEVGGSDNRLGGGQGDTTVVRS

SEQ ID NO: 48261 - protein, 446 aa, Xylella fastidiosa Dixon
MNFETLGLLPSLLRALSEQGYEIPTPIQQQAIPLALAGHDLLAAAQTGTGKTAAFGLPVLQRLMAASSNVGAGKPRALVLTPTRELATQVHDSLRGYAKYQRVSSAVIYGGVGMGNQLDVLRRGVDLLIACPGRLIDHIERRSVDLSGVGILVLDEADRMLDMGFLHSIKRILGKLPRQNRQTLLFSATFAEPIKQLALEFMCRPREVMVASHNTVAETITHRVHPVDVSRKRELLLYLLAQDSREQTLVFVRTKHGSDKLATFLEKYGIKTAAIHGNKTQGQRLRALNSFKAGRVTVLVATDIAARGIDIDQLPKVINYDLPMVAEDYVHRIGRTGRNGVQGEAISLVTQEDAKLLRQIVRLLDRDMDIRDVPDFEPQVPIRWGNSAPGKSKQPAGQHPPRKSQHRRAFGKASVHTTPALTKQSGVQHSNGSRNRDGMLPVHQRG

SEQ ID NO: 48262 - protein, 86 aa, Glycine max
  misc_feature (33)..(33): Xaa can be any naturally occurring amino acid
  misc_feature (39)..(39): Xaa can be any naturally occurring amino acid
ATETNVVVLGGMTEMTGAASSVEINNLASFAVXEQNKRXNSALDFVMVISAQHQMASGVNYYITLEAKDGGMKNDYYAKGWDREYQ

SEQ ID NO: 48263 - protein, 412 aa, Rhodococcus globerulus
MTAAIAVIGNGVAGVSAAQTLRLEGFDGRLFLIGEEEHEPYDRTALSKAVLAGETAEPPPLMTSEQLEALDVESITGRTVVGVDSAAGTLRFADGGTLASDRLLLVTGARARVPRVPGVALSGVHTLRTSGDVKALRQAWRPGAHVVIVGGGLIGCEVATTARKVGLEVTLLEAGSELLTRVLGRQVGAWCRQRLEGLGVEVRLNTAVAEFVGRDYVSAVMTSDGNRFDVDSVLVCVGAEPNTVLAQSLGLKCDRGIVVDAAGSTDHPTIFAAGDAASWPLRSGGRRSLETYLNSQKQASAVVAAMLDRSIPAPQVPLSWTEVAGHHLQMIGDIEGPGEFVARGRIDDGPGSVFRLLGGEVVAAVAIDSPRDFAVVTRLVESRAVVSAHALGDGSSHLRDLLKGRSSPRAHI

SEQ ID NO: 48264 - protein, 653 aa, Aegilops tauschii
MRRWLLRPLALLTTTTALLLNTSTSTSSSISTAHDLPALLSFKSLITKDPLGALSSWTINSSSNGSTHGFCSWTGVKCSRTHPGHVMALRLQGIGLSGTISPFLGNLSRLRVLDLSNNKLEGQIPPSLGNCFALRRLNLSFNSLSSAIPPAMGNLSKLVVLSIRKNNISGTIPPSFADLATVTVFSIASNYVHGQIPPWLGNLTALKDLNVEDNMMSGHVPPALSKLTNLRFLFLGTNNLQGLIPPVLFNMSSLERFDFESNQLSGSLPQDIGSTLPNLKEFSLFYNKFKGQIPSSLSNISSLERIVLHGNRFHGRIPSNIGQNGCLTVFVLGKNELQATESRDWDFLTSLANCSSLSTVDLQLNNLSGILPNSISNLSQKLETLQVGGNQIAGHIPTGIGRYYKLTVLEFADNLFTGTIPSDIGKLSNLRNLFLFQNRYHGEIPLSLGNMSQLNKLILSNNNLEGSIPATFGNLTELISLDLSSNLLSGQIPEEVMSISSLAVFLNLSNNLLDGPITPHVGQLVNLAIMDLSSNKLSSAIPNTLGSCIELQFLYLQGNLLHGQIPKEFMALRGLEELDLSNNNLSGPVPEFLESFQLLKNLNLSFNQLSGPVPDTGIFSNASIVSLTSNGMLCGGPVFFHFPACPYLAPDKL

SEQ ID NO: 48265 - protein, 407 aa, Zygosaccharomyces rouxii
MATHEEFIRTQVFGTVFEITNRYTDLNPVGMGAFGLVCSATDTLAGQPVAIKKIMKPFSTAVLAKRTYRELKLLKHLRHENLICLQDIFLSPLEDIYFVTELQGTDLHRLLQTRPLEKQFVQYFLYQILRGLKYVHSAGVIHRDLKPSNILINENCDLKICDFGLARIQDPQMTGYVSTRYYRAPEIMLTWQKYDVEVDIWSAGCIFSEMIEGKPLFPGKVHVHQFSIITDLLGSPPRDVIITICSEDTLKFVTSLPHRDPVPFQERFKAVEPDAVDLLGRMLVFDPKKRITAADALVHPYLAPYHDPTDEPIAEAQFDWDFNDADLPVDTWRVMMYSEILDFHKIGGSDGQIDTNAAFDDQVAAATAGPMLPLWLNSNININNSHPVNIQVQLLRHQQPRITVVYQ

SEQ ID NO: 48266 - protein, 383 aa, Lactuca sativa
MAIDCMIKTPSCMSSLKEELKEDQQRSLVFDASVLQHETNIPQQFIWPDNEKPNSKKSKDLEVPLIDLGGFLSGRSSSTKEASKLVGNACQKHGFFLVVNHGVDANLISDAQTYMDLFFELPLSEKQRAQRKAGESCGYASSFTGRFSSKLPWKETLSFRFSAEKNSADIVKDYFENTMGEEFVRLGKVYQEYCNAMSRLSLGIMELLGLSLGVNRSHFKEFFEENNSIMRLNYYPRCQKPELTLGTGPHCDPTSLTILHQDNVGGLEVFVDNEWRSITPNSNAFVVNIGDTFMALSNGRYKSCLHRAVVNNKTPRKSLAFFLCPKKDKVVSPPKELVDENNPRVYPDFTWATFLEFTQKHYRADMNTLQAFSNWVEQKTSTT

SEQ ID NO: 48267 - protein, 478 aa, Mycobacterium avium 104
MREYLKFYIDGQWVDPVRPNTFDVENPATEQVCGKISLGSAADVDVAVGAARRAFGRWSQSSREDRLDLLQAILAEYQKRADDLAAAVTEEIGAPPSLAAGPQVFLGIGHLTTAIEVLKNFAFTEQRGATLIAREPIGVCGLITPWNWPINQVAVKVYPALATGCTVVLKPSEVAPFSSYIFAEILAAAGVPAGVFNLVNGDGPGVGAALASHPDIDLVSFTGSTRAGVEVARNAAPTVKRVTQELGGKSPNIVLDDGGFADAVRAGVANMMPNSGQSCNAPSRMLVPASRMAEAISIAREVAEQVQVGDPDDATAIGPVASRAQFEKVQRLIQQGIDEGATVVAGGPGRPAGLDQGYYVKPTVFADVTNDMTIAREEIFGPVLCILGYDDLDHAVRLANDTDYGLAGYVSGADLDTAREVAGKIRAGWVTINHAFDLNAPFGGYKRSGNGREWSDFGFHEYLEVKSILGYAPAQADR

SEQ ID NO: 48268 - protein, 369 aa, Lactuca sativa
MPSLHKEHINAQPKPLVFDSLILQHETNIPEQFIWPDHEKPNSQKAKELAVPLVDLRGFLSGRASSAKEASVVVGEACKKHGFFLVTNHGVDASLIVDAHRYMDLFFELPFLDKQRVQRKIGESCGYASSFTGRFSSKLPWKETLSFQFSGEKKSSKIVEEYFEKTMGKEFARLGKVYQEYCNAMSRLSLGIMELLGMSLGVEQSHFKEFFKENDSIMRLNYYPPCQKPDLTLGTGPHCDPTSLTILHQDTVGGLEVFIDNEWRSIAPNLNTFVVNIGDTFMALSNGQYRSCLHRAVVNNKIHRKSLAFFLCPKKDKVVSPPDELVDEKNPRIYPDFTWSTFLEFTQKHYRADMNTLQAFTNWIQQKNS

SEQ ID NO: 48269 - protein, 301 aa, Vigna unguiculata
TGYGLGGSSMALFGRVGGGIYTKAADVGADLVGKVERNIPEDDPRNPAVIADNVGDNVGDIAGMGSDLFGSYAESSCAALVVASISSFGLNHEFTAMLYPLIVSSVGILVCLLTTLFATDFFEIKAVKEIEPALKKQLVISTVLMTIGVAVVSFVALPTSFTIFNFGVQKDVKSWQLFLCVAVGLWAGLIIGFVTEYYTSNAYSPVQDVADSCRTGAATNVIFGLALGYKSVIIPIFAIAISIFVSFTFAAMYGIAVAALGMLSTIATGLAIDAYGPISDNAGGIAEMAGMSHRIRERTDA

SEQ ID NO: 48270 - protein, 363 aa, Lactuca sativa
MHTRVADAFKAHPMVNQKHLDLKSMKELPESHAWLSQDGSPSYGSSSSEQVPVINLKDPNAMKLVGHACKTWGVFQVTNHGVPTNLLEEMEAAGRKLFALPIQQKLKAARAPDGVSGYGVARISSFFPKLMWSEGFTIIGSPYEHARKLWPNRYSRFCDVIEGYKHEMNNLAQRLMWLMLGSLGVTTEDVKWDGSQGSCPALQLNSYPACPDPDRAMGLAAHTDSTLLTILYQNNTSGLQAHREGAGWVTVPPIPGALVVNVGDLLHILSNGLYPSVLHRAMVNRTQHRLSVAYLYGPPSNVQISPLSKLTDHVHPPLYRPVTWSEYLGTKAKHFNKALSSVRLCVPLNGFVDANDHSGVPVG

SEQ ID NO: 48271 - protein, 511 aa, Glycine max
MGCCQSSMLLRVGERETHPEKEKEREKEKEQAYGNHQRQSEGGEGDGEKEVVDFSFSEFSLAELKAATNNFSSEYIVSESGEKAPNLVYKGRLQNQSRWIAVKKFSKSAWPDPKQFVEEASGVGKLRHPRLANLIGYCCDGDERLLVAEYMPNDTLAKHLFHWETQTIEWAMRLRVALYIAQALHYCSSEGRPLYHDLNAYRVLFDQEGDPRLSCFGFMKNSRDGKSYSTNLAYTPPEYLRNGRVTPESVIYSFGTVLLDLLSGKHIPPSQALDMIQGKNNMLLMDSHLEGKFSTEEATVVVNLASKCLQYEPRERPDTKDLVTTLAPLHTKPDVRSHIMLGIPKHEEAPSTPQRPLSAMGEACSRMDLTAIHQILVATHYRDDEGTNELSFQEWTQQMRDMLEARKRGDHAFRDKDFRTAIDNYSQFIDVGTMVSPTVFARRSLCYLLCDQPDPALRDAMQAQCVYPDWPTAFYMQSVALAKLDMHKDAADMLNEAAALEEKRQRGARGS

SEQ ID NO: 48272 - protein, 442 aa, Parvularcula bermudensis HTCC2503
MSGSYRDPDYFPPLGVSILLGVQHILAMFVSNVTPAVIVAGAAGIGFGAADQTPLIVMIQASMVFAGVATLLQTISLGPIGARLPIVQGTSFAFLPIMIPLVSGGGVSSLSALYGGALCGGIFHLLLAPLVPRIRFALPPLVTGLVVLMIGLSLIRVGIQYSAGGVPSQGTAAFGRGESWALALVVMMATLGFKFFGRGLLSTASVLLGILTGYAVAAVFGRIDTVAVSDAAWFLLPEPLPFGVSFSAAAIVSFCLIVLVSGIETIGDVSAITQSGAGRRATDRELTGATFADGAGTLIAALFGGLPNSSFSQNVGLVAMTGVMSRHVVTLGAVFLVLCGLVPKIGAAIVTIPIEVLGGSVVIMFGMVAAAGLSMLSEVTWSQRNLLIFATSLSVGLGLQLVPDALQHLPSLAQILLASGVLPAAFLAIVMSLALPPLEDKE

SEQ ID NO: 48273 - protein, 301 aa, Oryza sativa (japonica cultivar-group)
MGALSYVTVTILEISQGLPDSVGGVLSGPVSNVATRWGLSDLHCKGMVPIDEDETHEGIKTIRIQKACEFTTSSVLCVCIITWNMNGKMSVEDVTKLVSSNRKFDLLVFGLQEVPKCDVAQVLQETMAETHILLCQKTMQSLQMFLFGAKSSEKYIRELKVDKHAVGGCGDITVWLGDLNYRLQGISSIPARKLIEENRQSKLRGKDQLLQEAEKGEVFNGYCEGTLLFKPTYKYNIGSSNYDTSYKIRVPSWTDRILFKVDHTSGLDAVLNSYEALDCIRSSDHKPVRAHLCLKVHGDSA

SEQ ID NO: 48274 - protein, 356 aa, Triticum aestivum
  misc_feature (316)..(316): Xaa can be any naturally occurring amino acid
  misc_feature (334)..(334): Xaa can be any naturally occurring amino acid
MVRTTVQELAAAVEEPPRQYVVAHEQDQDLLAADEMPEPILLIDLSRLTTADAADEADKLRAALQTWGLFLVTNHGIEESLMDAMMSASREFFRQPSGEKQKCSNLIDDGGKHSEVEGYGNDKVVNQDESLSWNDRLHLRVEPEDERNFTKWPTHPESFRDVLLEYASRTKRIRDVVFRTIAKLLDLDEDYFLNQMSNKDPGFARFNYYPPCPRPDLVLGMRPHSDAGLLTILFVDRDVGGLQVERDGKWYNVPAKPYSLVINLADCMEIMCNGIFRSPVHRVVTNAEKERLSLAVFYAVDGETVLEPAPGLLDDXRPPRYGKFKAKDFGLSFXEHNISAQGKRFIETLKIQARRS

SEQ ID NO: 48275 - protein, 485 aa, Xylella fastidiosa Dixon
MHHNVHQSEILADPCDLQRAERWRQRDLRVLWHPCTQMREHPDTLPLVPIVRGEGAWLVGHDGRRYLDAVSSWWTNLFGHADPRISAAIAAQARTLEHVMLAGFSHEPAVRLAEALLRLAPRQDGREPLSKVFYADNGSAGVEVALKMAFHYFRNRGEEQRTRFIALHNGYHGETIGALAVGDIPLYRRVYAPLLTEVLFAPSPDAYLAEPGQSAAEYALQAAEALEALFKRYSGQICALILEPLLQCAGGMRMHHPVYLHRVRELCDAHGALLICDEIATGFGRTGTLFACEQACPAISTDTDDKELGIMPDLLCLSKGLTGGFLPLAAVLTTQQLYEEFLDDSRERAFLHSHSYTGNPLACIAALTTLDIFENDCIIERNQVTAARMTQLAASLSGHPHVADVRQTGMVVAFELTRDGNKRTPFPPQARLGLHVYRAALARGVILRPLGDVVYWMPPYCVDEEQLHLLAETTRVAIDEAIACV

SEQ ID NO: 48276 - protein, 429 aa, Anabaena variabilis ATCC 29413
MKKVLAIILGGGAGTRLYPLTKLRAKPAVPVAGKYRLIDIPVSNCINSEIFKIYVLTQFNSASLNRHIARTYNFSGFSEGFVEVLAAQQTPENPNWFQGTADAVRQYLWMLQEWDVDEFLILSGDHLYRMDYRLFIQRHRETNADITLSVIPIDDRRASDFGLMKIDNSGRVIDFSEKPKGEALTKMRVDTTVLGLTPEQAASQPYIASMGIYVFKKDVLIKLLKESLERTDFGKEIIPDASKDHNVQAYLFDDYWEDIGTIEAFYNANLALTQQPMPPFSFYDEEAPIYTRARYLPPTKLLDCHVTESIIGEGCILKNCRIQHSVLGVRSRIETGCVIEESLLMGADFYQASVERQCSIDKGDIPVGIGPDTIIRRAIIDKNARIGHDVKIINKDNVQEADRESQGFYIRSGIVVVLKNAVITDGTII

SEQ ID NO: 48277 - protein, 550 aa, Hebeloma cylindrosporum
MENEKTEHEKRESSSNLEKGDHVVAQTNPQFHFDVHDLDRVQRRLKQRHVQMIAIAGTIGTGLFLGSGGALEAAGPLGALIAYALVGTVAYSSLCAVGEMSTWAPISGTFPHFAARWVDPALGFATGWNYFYTNAISTPVEITAAVILLTFWDHNSKHISLYTAILCVLVCMINIFGVRYFGESEFIFAIIKLTLIIGLLLVGLIVDLGGGPQGDRIGFRYWKNPGAIAGSGLDRNIFGLDRFLAILSVIVQAAFSFQGMELVVIAASETESPRRNIAKAVRRVFYRILVFYILGILMIGMLVAYNDKDLLFLQGNNTAAKSPFVIAINRAGIKVLPHIVNGAIFTSAFSAGNSFLFCSSRVLYGLALRGQAPKVLTYCTKKGLPLYAVLVASAFSFLSFMSVSSGSNRVFGWFVNLSTTGGFTSWFVMNVTYIFFRRGLLAQGYDPTTNSYHNRFQPYIAYWGAGWTLFFILINGFSVFWKFTAAGFLTAYINIPIFLVLYFGYKIVFRTKFWKPLEMDFVTGIPTLEETETPEKPPKNLGERIANIIF

SEQ ID NO: 48278 - protein, 527 aa, Emericella nidulans
MADAVIAGQRVEAPVTWKAYLMCVFAAFGGIFFGYDSGYINGVMGMDYFIQEFTGKVKSETPAAQFVISSSNKSLITSILSAGTFFGAIIAGDLAEWYGRRITIINGCGVFMAGVAFQIASTTVPMLVVGRLIAGVGVGFVSAIIILYMSEISPRRFRGAIVSGYQFCITIGLMLASCVNYGTENRNDSGSYRIPIALQLLWAIILGIGLFVLPESPRYYVRKNNLAEAAKTLARVRGQPPESEYITQELAEIVANNEYEMQVIPQGGYFATWLNCFRGGLRSPNSNLRRVILGTSLQMMQQWTGVNFVFYFGTTFFQNLGTIDDPFLISMITTIVNVFSTPISFYTMEKLGRRPLLLWGALGMVVCQFIVAIAGTVDGDNSKTVSAQISFICIYIFFFASTWGPGAWVVIGEIFPLPIRSRGVALSTASNWLWNCIIAVITPYMVDIDKGNLKSRVFFIWGSLCACAFVYVYFLIPETKGLTLEQVDKMMEETTPRTSAKWKPHSTFATEMGMTEKNASTTVESAA

SEQ ID NO: 48279 - protein, 629 aa, Mycobacterium avium 104
MPFRNVAIVAHVDHGKTTLVDAMLRQSGALHHRGDDTQERILDSGDLEKEKGITILAKNTAVHRHHPDGSVTVINVIDTPGHADFGGEVERGLSMVDGVLLLVDASEGPLPQTRFVLRKALAAHLPVILVVNKTDRPDARIAEVVEASHDLLLDVASDLDDEAAKAAEHALGLPTLYASGRAGVASTEQPADGEVPAGENLDPLFDVLLEHIPAPSGDPEAPLQALVTNLDASTFLGRLALIRIYNGKLCKGQQVAWMREVDGLPVITSAKITELLATEGVERSPTDEAIAGDIVAVAGLPEIMIGDTLADPDHAHALPRITVDEPAISVTIGTNTSPLAGKVPGHKLTARLVRNRLDQELVGNVSIRVVDIGRPDAWEVQGRGELALAVLVEQMRREGFELTVGKPQVVTRTIDGQLHEPFEAMTIDCPEEFVGAITQLMAARKGRMEEMTNHAAGWVRMDFIVPSRGLIGFRTDFLTITRGTGIANAVFDGYRPWAGEIRARHTGSLVSDRAGTITPFAMIQLADRGQFFVEPGQDTYEGMVVGINPRAEDLDINVTREKKLTNMRSSTADVIETLAKPLELDLEQAMEFCAADECVEVTPEIVRVRKVELDATSRARSRARAKARG

SEQ ID NO: 48280 - protein, 121 aa, Propionibacterium acnes KPA171202
MSKPEVTLPDSAPDDLVVEDITIGDGPEASAGNLVEVHYVGVALSNGREFDSSWNRGEPLTFQLGAGQVIPGWDEGVQGMKVGGRRKLVIPHHLAYGPQGISGVIAGGETLVFVCDLVNVI

SEQ ID NO: 48281 - protein, 391 aa, Zea mays
  misc_feature (322)..(322): Xaa can be any naturally occurring amino acid
MGNSSLPDSASGFSLSLYNYHYLLLPHAPCSNLTKVGSADCFLCFFGVSRSSLDAGKIKIGINGFGRIGRLVARVALQSEDVELVAVNDPFITTDYMTYMFKYDTVHGHWKHSDITLKDSKTLLFGDKPVTVFGIRNPEEIPWGEAGAEYVVESTGVFTDKDKAAAHLKGGAKKVVISAPSKDAPMFVVGVNEDKYTSDVNIVSNASCTTNCLAPLAKVIHDNFGIVEGLMTTVHAITATQKTVDGPSAKDWRGGRAASFNIIPSSTGAAKAVGKVLPDLNGKLTGMSFRVPTVDVSVVDLTVRIEKGASYEDIKKAIKAAXEGPLKGIMGYVEEDLVSTDFLGDSRSSIFDAKAGIALNDHFVKLVSWYDNEWGYSNRVVDLIRHMFKTQ

SEQ ID NO: 48282 - protein, 330 aa, Pyrus communis
DVDFWDAKGQTPLFPRIFGHEASGIVESVGEGVEGLEVGDHVLPVFTGECGDCAHCKFEESNMCDLLRINTDRGVMLSDGKTRFSINGTPINHFLGTSTFSEYTVIHSGCLAKTNPLAPLDIVCILSCGISTGLGATLNVAKPKKGSSVAIFGLGAVGLAAAEGARICGASRIIGVDRNPKRFEEAKKFGVNEFVNPKDHDKPVQEVIAEMTNGGADRSIECTGYINAMISAFECVHDGWGVAVLVGVPNKDAVFMTKPINVLNERTLKGTFFGNYKPRTDLPLVVEMYMSKKLEVEKFITHRVPFSEINKAFDYMTKGEGLRCIVSMEE

SEQ ID NO: 48283 - protein, 274 aa, Zea mays
MAVHGGDYLRRFVAETEWYNEVVLSAVAPGDWRRGLPHPVQSWMRNCVGGYLLYFISGFLWCFVIYYWKRHAYIPKDAIPTNEAMKKQIAVASKAMPFYCALPTLSEYMIESGWTRCYFNISEMGFSAYLCYMAMYLIFVEFGIYWMHRELHDIKPLYKHLHATHHIYNKENTLSPFAGLAFHPLDGILQAMPHVLALFLFPTHFRTHIALVFLEGVWTTNIHDCIHGKLWPVMGAGYHTIHHTTYRHNYGHYTVWMDWMFGTLREPDDILKKA

SEQ ID NO: 48284 - protein, 261 aa, Passiflora edulis
VLNHGIPNEFMDTVERMTKAHYNKCMEQRFNELVASKALEGVQVELKDMDWESTFYIRHLPESNIAEIPDLDDEYRKVMKDFAAKLEKLAEELLDLFCENLGLEKGYLKKALYGSRGPTFGSKVSNYPPCPKPELVKGLRPHTDAGGIVLLFQDGKVGGLQLLKDGQWVDVPPIPHAIVINIGDQLEVITNGKYKSVDHRVVAQTDGARMSLASFFNPGSDAVIYPAPALVEKEAEEKKQLYPKFVFEDYMKIYAGLKFHA

SEQ ID NO: 48285 - protein, 244 aa, Propionibacterium acnes KPA171202
MTGEQLAHWIEESTSTVFFGGAGMSTESGIPDFRSAGGLYTTQHDLPFPAEYMLSHSCLVEHPAEFFDFYRTYLVHPQARPNAGHRALAALERAGQVSTIITQNIDGLHQEAGSRQVIELHGSVHRNRCLACGRAHPLSVIMDAPGVPRCSCGGMVRPEVVLYEESLRSQDLDNATTAISTADLLIVGGTSLNVYPAAALLRFFRGRHLVFINREATGYDRAADLVIHDGLGKTLSAVQRAVMP

SEQ ID NO: 48286 - protein, 330 aa, Pyrus communis
DVYFWEAKGQNPLFPRIYGHEAGGIVESIGEGVTDLKAGDHVLPVFTGECKDCAHCKSEESNMCDLLRINTDRGVMLSDGKSRFSIKDKPIYHFVGTSTFSEYTVVHVGCLAKINPLAPLDKVCLLSCGISTGLGATLNVAKPKKGSTVAVFGLGAVGLAAAEGARFSGASRIIGVDLHSGRFEEAKKFGVTEFVNPKEHKKPVQEVIAELTNGGVDRSIECTGSVEFMISAFECVHDGWGVAVLVGVPHKEAVFKTHPLNFLNERTLKGTFFGNYKPRTDIPSVVEKYMNKELQLEKFITHKVPFSEINKAFEYMLKGEGLRCIIHMED

SEQ ID NO: 48287 - protein, 231 aa, Triticum aestivum
  misc_feature (165)..(165): Xaa can be any naturally occurring amino acid
  misc_feature (180)..(180): Xaa can be any naturally occurring amino acid
  misc_feature (188)..(188): Xaa can be any naturally occurring amino acid
  misc_feature (210)..(210): Xaa can be any naturally occurring amino acid
GPFRPIFQKTRLDRSEFPGFCGTPVPRLERGPLHGLKDLKKPECLSLARFIPPLSSPCPPRVGLLATSVALFRGLKSTAGLPVNRRSKGGSLGRVSNGGRIRCMQVWPIEGIKKFETLSYLPPLSTEALLKQVDYLIRSKWVPCLEFSKVGFIFREHNASPWYYXRYWTMWKLPMFGCTXATQVINEXEEVQEGYPDAYVRIIGLDNMRXQVQCVSFIAFKPPGCEESGKA

SEQ ID NO: 48288 - protein, 295 aa, Oceanobacter sp. RED65
MSDKGLVFCKIIFHDELPCLQIEHPKFQALICLQGAQLLSFVPTGKQNLLWLSPLAEYKTEQSPRGGIPICWPWFGNAEKNPPEIFDAVTNPEQAHGFARNQLFDIDEVNETAHKVQLSLMLSDNSATREIWPHAFELKASFTLSDHIEMTLSTKNIGNIPFSFTEALHSYLPANIKTTQITGAEQQTYVDALDKWVNKLELNRIGIQKEVDRIVRHGGPYRIIDSDKKEHLLIESDGKDSIIWNPWIDKSKRLSQFPDHAYQSMLCIESANILDNVVTLAPGQTHSLDLSIKSV

SEQ ID NO: 48289 - protein, 905 aa, Hordeum vulgare subsp. vulgare
MAVGETGASVSAAEAEAEATQAFMPDARAYWVTSDLIAWNVGELEAQSVCLYASRAAAMSLSPSNGGIQGYDSKVELQPESAGLPETVTQKFPFISSYRAFKVPSSVDVASLVKCQLVVASFGADGKHVDVTGLQLPGVLDDMFAYTGPLGAVFSEDSVSLHLWAPTAQGVSVCFFDGPAGPALETVQLKESNGVWSVTGPREWENRYYLYEVDVYHPTKAQVLKCLAGDPYTRSLSANGARTWLVDINNETLKPASWDELADEKPKLDSFSDITIYELHIRDFSAHDGTVDSDSRGGFRAFAYQASAGMEHLRKLSDAGLTHVHLLPSFHFAGVDDIKSNWKFVDECELATFPPGSDMQQAAVVAIQEEDPYNWGYNPVLWGVPKGSYASDPDGPSRIIEYRQMVQALNRIGLCVVMDVVYNHLDSSGPCGISSVLDKIVPGYYVRRDTNGQIENSAAMNNTASEHFMVDRLIVDDLLNWAVNYKVDGFRFDLMGHIMKRTMMRAKSALQSLTTDAHGVDGSKIYLYGEGWDFAEVARNQRGINGSQLNMSGTGIGSFNDRIRDAINGGNPFGNPLQQGFNTGLFLEPNGFYQGNEADTRRSLATYADQIQIGLAGNLRDYVLISHTGEAKKGSEIHTFDGLPVGYTASPIETINYVSAHDNETLFDVISVKTPMILSVDERCRINHLASSMMALSQGIPFFHAGDEILRSKSIDRDSYNSGDWFNKLDFTYETNNWGVGLPPSEKNEDNWPLMKPRLENPSFKPAKGHILAALDSFVDILKIRYSSPLFRLSTANDIKQRVRFHNTGPSLVPGVIVMGIEDARGESPEMAQLDTNFSYVVTVFNVCPHEVSMDIPALASMGFELHPVQVNSSDTLVRKSAYEAATGRFTVPGRTVSVFVEPRC

SEQ ID NO: 48290 - protein, 129 aa, Panax ginseng
MGSNKAFLLLGLSLAIVLLISSEVAARELAEAQTTTTNKNTEAATVDGRSGYNGYGGGGYHGGGGYHGGGGYHGGGGYHGGGGYHGGGGYHGGGGHGGGGCSHGYCRYRCRNYAGEVVDAETTGVKPQN

SEQ ID NO: 48291 - protein, 505 aa, Arabidopsis thaliana
MAIEGEKEKPSKRTTNPGVRVVGGRIYDSSNGKTCHQCRQKTMDFVASCKAMKKDKQCTINFCHKCLINRYGENAEEVAKLDDWICPQCRGICNCSFCRKKRGLNPTGILAHKAKASGLASVSMLLEVEGHDNFAYQKKPKLVLKTITQILIFVNLALNVLLCLLDQYDVAKDKKKVVGKSKKANATHKLKEEIQFEAQLPQGISLISVSGVVIPTEEAGNVFQLFEFCSAFGKALELKEGQAETVVRELFSCGRNTRRQQYCSIIQLMIQLSLSLSVSDNWFTALGEILLQSEVLSDEFPPETFETGVAEYEKMDASRRLKLLNFVCDESLSTWAMRNCIKSQSTECKANNNEAKRKAAAAKEKEKQLKQKLQGDLAKAIMKKNGAPLSIEEHNEILSQIRAEAKEAHDGMMEAKGITSGMTRICDARRTEPIMVEDNGLVLWKLNCYDEEPKFLLQDLGTFDGLCSHEKWLAFKPEQKPDIENYISYKRRKVMQTLKNTNVVA

SEQ ID NO: 48292 - protein, 579 aa, Ligularia fischeri
MDDRRRRVIPHYASVHICSSEPLRRYNQDCSVIAPFSLPLPMYLTDAVFFTLLFSVMYYLLHRWRDKISTSTPLHVVNYSEIAAIVAFVASVIYLLRFYGIGLVQSDPDGIGNDSWERRDESPERSIDRTTALSPVRRNIPMRSVRVAAYPAQIITASLPEEDEVVIESVVSGRIPSYSLESKFADCTRAASNHKDALERVTAKSLQGLPLDAFDYESTLGQCCEMPIGYVQIPVGIAGPMLLDGNEFSVPMATTEGCLVASTNRGFKAIYLSGGATSVLLKDGMTRAPVVRFGTAKRASDLKFFLEEPLNFETLASVFNKSSRFGRLQRIQCAIAGKNLYIRFTCSTGDAMGMNMISKGVQNVLDYLQVDFPDMDVIGISGNYCSDKKPAAVNWIEGRGKSVVCEAIISDEVVKKVLKTTVASLVELNMLKNLTGSAIAGALGGFNAHASNIVSAVYLATGQDPAQNIESSHCITMMEAVNDGKDLHVSVTMPSIEVGTVGGGAQLASQSACLNLLGVKGANKELAGSNARQLAKIVASSVLAGELSLMSAIAAGQLVKSHMKYNRSSKDVSTMAKTA

SEQ ID NO: 48293 - protein, 420 aa, Arabidopsis thaliana
  misc_feature (378)..(378): Xaa can be any naturally occurring amino acid
  misc_feature (389)..(389): Xaa can be any naturally occurring amino acid
MSSSGQTQFRYTQTPSKVVHLRNLPWECVEEELIDLCKRFGKIVNTKSNVGANRNQAFVEFADLNQAISMVSYYASSSEPAQIRGKTVYIQYSNRHEIVNNQSPGDVPGNVLLVTFEGVESHEVSIDVIHLVFSAFGFVHKIATFEKAAGFQALVQFTDVETASAARSALDGRSIPRYLLSAHVGSCSLRMSYSAHTDLNIKFQSHRSRDYTNPYLPVNQTAMDGSMQPALGADGKKVESQSNVLLGLIENMQYAVTVDVLHTVFSAYGTVQKIAIFEKNGSTQALIQYSDIPTAAMAKEALEGHCIYDGGYCKLRLSYSRHTDLNVKAFSDKSRDYTLPDLSLLVAQKGPAVSGSAPPAGWQNPQAQSQYSGYGGSXHICTHHLIPTXGFTLRSTSLLWMRYCLLKISDFAATGEYFHV

SEQ ID NO: 48294 - protein, 1049 aa, Bacillus clausii KSM-K16
MRKPHIKTVLVIGSGPIVIGQAAEFDYSGTQGCLALKEEGIRVVLLNPNPATVMTDDSCADTVYFEPLSVETVVNIFEREKPDGLLATLGGQTGLNLALKLHEQGLLAAYGVELLGTPIESIQKGEDREQFRALMHQLNEPVPDSEIVHSASEALRFAEQAGYPIIVRPAYTLGGAGGGIADCEKELKAIIENGLAQSPISQCLIEKSIAGFKEIEYEVMRDENDTCITVCNMENIDPVGIHTGDSIVVAPSQTLTDKDYQMLRAASLKIIRALGIIGGCNIQFALDPNSDRYYLIEVNPRVSRSSALASKATGYPIARMAAKLSIGYYLHELKNPVTGYTYASFEPSLDYCIVKFPRWPFDKFFTANRKLGTQMKATGEVMAIERSFEAAVQKAIRSLEIDVAGLEMPVLSGSGEKELWQHVLQADDARLFALFELLRRGETCANLHEKTNIDMFFLKKFEKLVHLEKETKQLSLESLSKEALHRLKIAGFSDETIACYLGAPKEKVTAKRIDWGIKPAYKMVDTCAAEFEAATPYFYSSYYGENEAMPSTQKKVLIIGSGPIRIGQGIEFDYCSVHGAKAVRKQGYEAIIMNNNPETVSTDYATADRLYFEPLSFEDVYAVCALEQPEGIIVTLGGQTGIKLVQELEEAGLPVLGVSADTIDMLEDRQRFYAFMNNIGVPHIPGETANDLEDACCRAKATGYPVLLRPSYVIGGQGMALVSSENELTSYLQNHEYSGLFPLLIDHFIEGIEIDVDVLTDGKSIRIAGMFEHVEKAGVHSGDSTAVTPPHTLSASMLAQLEEAAKKIATGIHFRGLFNIQFVVAGDRYYVIEVNPRASRTVPLLAKIYGEPFVEQAVKLMLGCSINELAPPKKQGDFVAVKAPVFSYSKLAGLDPLLGAEMKSTGELLMIGKSVEEAFAKVFAPFEEPISLYKPREEKSVFVDLADEHKHDFSEILQKLEQVGCTLVEDDFANWLESPHACALISVPPLGKRDGANMRMAALAKQLTVISAKETATAMLAYFEQSKKSCKPIQEWHRLRKTEMAGETN

SEQ ID NO: 48295 - protein, 150 aa, Zea mays
LHFSIFFNVSGKGLVMMKGIKGSFADAASSAKIFAVLAGVQSLVACSLRKLRGKDDGINAGVAGCCTGLALSFPGAPQTLIQSCLTFGTFSYIIEKLNKQQPALALLPATGVMDPKAGQSVLPPFTLPPLDTMDEFSKFQNFLSSKFRGN

SEQ ID NO: 48296 - protein, 341 aa, Solanum melongena
MADLLSNYSSKLEAVPPSHCLPLHERPVDPVEIVNTIPVIDLGKAKGDERPAVVQQLMKAFEEYGFFQIINHGVPEKLMEEAMKVYKEFFSLPAEEKERYAKDAANNTATGAAKMYSSSAKHYDSEEHRYWRDVLEHSANLDGKDRETWPDKPSRYREVIGEYSDELRRVSKVILGMVAEGLGLEPGFFDKGLGQRMLVNHYPACPDPSLTLGVGGHCDPNLITIIQQEVYGLQILKDDKWIGVEPKPNAFVVNSGLPITVISNGKLASVAHRVVTNTTHSRTSIGTFICPENIVEPAKALVGPGNPPQFKSFNWGIDFMPHYLSKKSVYHAALEPFKIDA

SEQ ID NO: 48297 - protein, 167 aa, Xanthomonas oryzae pv. oryzae KACC10331
MLASLASGPPTNLEQSPCGDCRSNITRHAVPTMSKLNKTILADFEAAQIQRKLPEFNQGDTVVVNVKVKEGNRERVQAYEGVVIGTKNAGLNSAFTVRKISHGFGVERVFQTHSAIIDSVEVKRRGKVRAGKLYYLRGLEGKAARIKEDLAAAAQAKAARQAAAKAE

SEQ ID NO: 48298 - protein, 407 aa, Alkalilimnicola ehrlichei MLHE-1
MNLSDEFPRIKRLPPYVFNIVNELKAAARARGEDIVDFGMGNPDQPTPQHIVDKLTEVAQRGDTHRYSMSRGIPRLRRAICNWYRDRYDVDLDRETEAIVTIGSKEGLAHLALATLAPGDAVLVPNPAYPIHPYGVVIAGADIRHVPMLPDGDFFAEMEKAIRDSYPKPKMLILNFPSNPTSACVDLEFFEKVVAVARQHNIWVVHDLAYADIVFDGYRAPSILEVPGAKEVAVESFSLSKSYNMPGWRVGFMCGNRHLIAALARMKSYLDYGTFTPIQVAAIAALEGPQECVQEICEMYRRRRDVLCEGLNAAGWEVEKPKATMFVWARIPERYRDMGSLEFAKKLLRDAKVAVSPGIGFGDYGDEYVRFGLIENEHRTRQAIRCIKQMFRRDGQHDQQQEGEVSS

SEQ ID NO: 48299 - protein, 92 aa, Oryza sativa
MAPSVMAWSATTVAPFHGLKSTAGMPGARRSGNSSLGNVTNGGRIRCMQVWPIEGMKKLKTLSYLTPLTVEDLMKQIEYLLRSKWVPCLEFS

SEQ ID NO: 48300 - protein, 232 aa, Glycine max
MLTAGEYSNHSRPLQPETSLAELNLPRVLCVLSSMLEKLVARNEKLVDILSQQLDGLNCGSVRLGNSLNTFHGVRAPSISIPKYLERIYKYTNCSPSCFVVGYVYIDRLTHRHPDSLVTSLNVHRLLVTSVMVASKMLDDEHYNNAVYARVGGVSNTELNKLELELLFLLDFRVMVSSRVFESYCFHLEKEMVINGTGMKIERALTPKAMDDLETEISVEDKQSPSPPQIVD

SEQ ID NO: 48301 - protein, 174 aa, Aspergillus niger
MSGNTKAFFDIQYAPVGSSAPKTGRVVFNLFEKDVPKTAKNFRELCKLPQGQGYKGSTFHRVIPQFMLQGGDFTRHNGTGGRSIYGEKFADENFIYKHNKPGLLSMANAGPNTNGSQFFITTVVTSWLDGKHVVFGEVADAESMQVVKEIEALGSSSGSVRSAVKPTIVDCGEL

SEQ ID NO: 48302 - protein, 448 aa, Paenibacillus polymyxa
MTIFQFPQDFMWGTATAAYQIEGAYQEDGRGLSIWDTFAHTPGKVFNGDNGNVACDSYHRYEEDIRLMKELGIRTYRFSVSWPRIFPNGDGEVNQEGLDYYHRVVDLLNDNGIEPFCTLYHWDLPQALQDAGGWGNRRTIQAFVQFAETMFREFHGKIQHWLTFNEPWCIAFLSNMLGVHAPGLTNLQTAIDVGHHLLVAHGLSVRRFRELGTSGQIGIAPNVSWAVPYSTSEEDKAACARTISLHSDWFLQPIYQGSYPQFLVDWFAEQGATVPIQDGDMDIIGEPIDMIGINYYSMSVNRFNPEAGFLQSEEINMGLPVTDIGWPVESRGLYEVLHYLQKYGNIDIYITENGACINDEVVNGKVQDDRRISYMQQHLVQVHRTIHDGLHVKGYMAWSLLDNFEWAEGYNMRFGMIHVDFRTQVRTPKESYYWYRNVVSNNWLETRR

SEQ ID NO: 48303 - protein, 448 aa, Clostridium thermocellum
MSKITFPKDFIWGSATAAYQIEGAYNEDGKGESIWDRFSHTPGNIADGHTGDVACDHYHRYEEDIKIMKEIGIKSYRFSISWPRIFPEGTGKLNQKGLDFYKRLTNLLLENGIMPAITLYHWDLPQKLQDKGGWKNRDTTDYFTEYSEVIFKNLGDIVPIWFTHNEPGVVSLLGHFLGIHAPGIKDLRTSLEVSHNLLLSHGKAVKLFREMNIDAQIGIALNLSYHYPASEKAEDIEAAELSFSLAGRWYLDPVLKGRYPENALKLYKKKGIELSFPEDDLKLISQPIDFIAFNNYSSEFIKYDPSSESGFSPANSILEKFEKTDMGWIIYPEGLYDLLMLLDRDYGKPNIVISENGAAFKDEIGSNGKIEDTKRIQYLKDYLTQAHRAIQDGVNLKAYYLWSLLDNFEWAYGYNKRFGIVHVNFDTLERKIKDSGYWYKEVIKNNGF

SEQ ID NO: 48304 - protein, 426 aa, Arabidopsis thaliana
MTTTISHLPTELLDEIISRVPLKSTRAVRLTCKNWDSLFKNRSFMKEEAAAKEGESRMIVLMDKNLFAMSIFFNGIDIDPSAEQRGKLTCLYDDSEQVKISQVFHCEGLLLCVLEDDKCSLVVWNPYWGQTRWIEPRYFSRIQNCYGRYMYVYALGYNNKSRSHKILRFIDGAFDFPFWYEIYDFDSDLWTTLDVTPQWFINFPPRGCYNRGVTLKGNTYWCAIRRKSNTNWFVDLDHIICFDFTSERFGPLMPLPFVRYTSGSLVTLSCVREEKLAVLFCNNATVEVWITTKIETDKISWSKFLTVNMYVDLLEGSFFIDEVKKVAMIFDIPMNRETVYIVGEAGNVKELHLGQPVDVDKHFSPLFVCSYVPSLVQIKQPPGCQRKQESSLEKRRCDDENISRLIAHEETYVVYGRYVPSRKKPR

SEQ ID NO: 48305 - protein, 448 aa, Paenibacillus polymyxa
MSENTFIFPATFMWGTSTSSYQIEGGTDEGGRTPSIWDTFCQIPGKVIGGDCGDVACDHFHHFKEDVQLMKQLGFLHYRFSVAWPRIMPAAGIINEEGLLFYEHLLDEIELAGLIPMLTLYHWDLPQWIEDEGGWTQRETIQHFKTYASVIMDRFGERINWWNTINEPYCASILGYGTGEHAPGHENWREAFTAAHHILMCHGIASNLHKEKGLTGKIGITLNMEHVDAASERPEDVAAAIRRDGFINRWFAEPLFNGKYPEDMVEWYGTYLNGLDFVQPGDMELIQQPGDFLGINYYTRSIIRSTNDASLLQVEQVHMEEPVTDMGWEIHPESFYKLLTRIEKDFSKGLPILITENGAAMRDELVNGQIEDTGRHGYIEEHLKACHRFIEEGGQLKGYFVWSFLDNFEWAWGYSKRFGIVHINYETQERTPKQSALWFKQMMAKNGF

SEQ ID NO: 48306 - protein, 416 aa, Debaryomyces hansenii CBS767
MSLSNKLSVKDLDVSGKRVFIRVDFNVPLDGKTITNNQRIVAALPTIKYVLENKPKAVILASHLGRPNGEKVDKFSLAPVASELEKLLGKKVNFLDDCVGDNVEKAVNGGSDGEVFLLENLRFHIEEEGSQKKDGEKVKASGEDVKKFRQQLTNLADVYVNDAFGTAHRAHSSMVGLELPQKAAGFLMAKELEYFAKALENPVRPFLAILGGAKVSDKIQLIDNLLDKVDLLIVGGGMSFTFKKVLDNMPIGDSLFDEAGAKNVENLVAKAKKNNVKIVLPVDFITADKFDKDAKTSTATEDEGIPDNWMGLDAGPKSNELFAKTVAEAKTIVWNGPPGVFEFDNFAKGTKSLLDAAVKSAESGNTVIIGGGDTATVAKKYGVVDKLSHVSTGGGASLELLEGKELPGVVAISDKK

SEQ ID NO: 48307 - protein, 316 aa, Anaplasma phagocytophilum HZ
MKLLVASELQEMESLIVKQRHSEVQLIADIIQHLILSGGKRTRPVMLLAACGMLGCTDARRIVVAAAIEFLHSATLLHDDVVDKSDMRRGVETANSIWGNKASILVGDFLFATAFQWIVSCNSIQLLSVLSNTASIIVSGEMQQLVHSSSLDISRTKYLEIISSKTAVLFSAACESAAVLHDVGTLQRNALRDWGFNFGIVFQILDDILDYTANQNELGKRTYNDIVSGKVTLPLIIAYEGASEKDRIGLRGALSRERPDPDLAFSYIMAQNAIEKSVGLAKEYIAIAEKQLSHFPDSAYKQKLLNLLNSAVNRRF

SEQ ID NO: 48308 - protein, 604 aa, Oryza sativa (japonica cultivar-group)
MSLEHNKMMITLVRLLPLVLVVALAWPAAEAPAAASPPPDPVQCSSGSGTADCTVSSAYGVFPDRSTCRAAAAVYPSTEEELVRAVANATASGTKMKVATRYSHSIPQLACPGDGDGEGLVISTRRLNRVVAVDAGRMEVTVESGISLRELIAEAGKAGMALPYAPYWWGLTVGGMLGTGAHGSSLWGKGSAVHEYVVGMRIVTPAPAADGYAKVRVLTAADPELDAAKVSLGVLGVISQVTLALQPLFKRSVTFMERDDDDLADQVTKFGYQHEFADIAWYPGIGRAVYRVDDRLPMNASGEGVLDFIGFRATPRLLIRTNRLAEELFERAGNGNGKCVTSRVTHAALSSAGYGLMRRSGGLFTGYPVVGPQHLMQASGGCITGPEDALLTACPWDPRVRGSSFFHQTTFSLPVSRAGAFVEEVRRLRDMNPKALCGVELYDGILIRYVKASTAHLGKPAAGGGQSDDMVDFDMTYYRSRDPNRARLFEDVLEEIEQMGVFKYGGLPHWGKNRNLAFVGAARKYPRIGEFLRIKDAYDPDGLFSSDWSDMMLGIGGRAPTRDAPGCALEGMCVCSQDAHCAPEQGYVCRPGKVYKDARVCTKV

SEQ ID NO: 48309 - protein, 560 aa, Candida albicans SC5314
MSELSIKTIETKPFQDQKPGTSGLRKKVTVFQQPHYTENFIQSILDAIPEGSQGSTLVIGGDGRFYNDVVIQLIIKIAAANGVKKLILGQNGILSTPATSHVIRIKQATGGIILTASHNPGGPQNDLGIKYNLGNGGPAPESVTNKIYEISKQINQYKLIELPNVDLSKIGTIVEGPIEIEIIDSTKDYVDMLKSIFDFPLIKSFIDKATKEQDFKVLFDALNGVTGPYGYEIFVNELGLPESSIQNYKPLPDFGGLHPDPNLTYAHTLVERVDKENIAFGAASDGDGDRNMIYGAGTFVSPGDSVAIISEYADSIPYFQKQGVYGLARSMPTSGAIDLVAANKNLQCYEVPTGWKFFCSLFDAKKLSICGEESFGTGSNHIREKDGLWAIVAWLNVLAGYNKQNPQSKTSIEIVQNSFWEKYGRTFFTRYDYENVSSEGAQKLIDLLQSIVNEKSVGDELAPGYIIKQADNFSYTDLDGSVSSNQGLFIKFDNGLRFIVRLSGTGSSGATVRLYLEKHCDDKSKYHLKVDEYLTNEIQFVLELLKFTQFLNKEDPDVRT

SEQ ID NO: 48310 - protein, 1090 aa, uncultured archaeon GZfos27B6
PKKLNIRTPSYNYGNKTINKKMPKAEDIKRVLVIGSGPIIIGQACEFDYSGTQACKALKEEGYEVVLVNSNPATIMTDPGMADQTYIEPLTVENVEEIIAKERPDALLPNLGGQTGLNLSAELSKRGILAKYGVELIGVEADAIERGEDRIVFKETMTKLDISMPESSPAYSVEEAEEIAQELGYPVVIRPAYTMGGTGGGIVYNVEELKTIVTRGISASLIGQVLVEESVLGWEELELEVIRDKKGNKITVCFIENVDPMGVHTGDSFCVAPMLTIGEELQRKLQELSYRIVDAIGVLGGTNIQFAHNPEDGRVVVIEINPRTSRSSALASKATGFPIARISAKLAVGITLDELPYWKEGTLDKYTPGGDYVVVKFARWAFEKFPQTRDILGTQMKAVGEVMSIGKNFKEAFQKAIRSLEIKRYGVGGAKDFASLSLPELKAKLVNPSSERIFLIYEALRKGMSVEELYQLTKIGRWFISQMQELVRFEEELKKFRGKGKDLSDETLKKAKENGFSDRYLAQLLDKTEKDIRKQRLNAGKKEAYEAVPVSGADAAYYFSTYNAEDSVGVSSKRKVMILGGGPNRIGQGIEFDYTCVHAAFALREEGIESVMVNCNPETVSTDYDTSDKLYFEPLTVEDVLSIYEKEKPEGVIVQFGGQTPLNIARELHEAGVKILGTSPDSIHLAEDRELFREMMIKLSIPQPEGGTARSVEEALAVARKIGFPVMVRPSFVLGGRGMEIVYDEKMLLDYAKAAVDVSPEYPMLIDKFLEHAIETEVDAIADGSDVYIAAVMEHIELAGVHSGDSACVIPPRNISKGNLAKIEDYTKKIADALEVVGLMNIQYAIANGKVYILEANPRASRTVPLVSKVTGVPIAKIATKVMLSKKLKGMVNLDSSKKEIHYFGVKEAVFPFNMFPDVDPVLGPEMKSTGEVMGIAPSFGVAFYKAQEAAGMKLPTEGSVLISVAGKERQDILAIAAGLKKLGFKILATKGTKAFLDMNGIESDLALKLHEGRPDITDDIRNGRIQMVINTPTGRKGKYADSYIRKTAIQHKIPYITTAAAAMATVAGIETVKRGNVEVKSIQEYHGGQ

SEQ ID NO: 48311 - protein, 155 aa, Glycine max
MTVLSPSLSRPKLQSSFLCCPLKYSKPTNRNIQPKPTSYPRIRALDLDQNTVVAISVGVVSVAVGIGIPVFYETQIDNAAKRENTQPCFPCNGSGAQKCRFCLGNGNVTVELGGGEEEVSRCINCDGVGSLTCTTCQGSGIQPRYLDRREFKDDD

SEQ ID NO: 48312 - protein, 129 aa, Brassica napus
MASEKDAALAAVPNDNPTIFDKIIKKEIPSTVVYEDEKVLAFRDINPQAPTHIVIIPKVKDGLTGLSKAEERHVEILGCLLYAAKVIAKQEGLEDGYRIVINDGPSGCQSVYHIHVHLLGGRQMNWPPG

SEQ ID NO: 48313 - protein, 472 aa, Guillardia theta
MNKLFSIKIGPYYLGKTLGVGSFGKVKLGEHELCGQKVAVKILNRKKIKNLKMEEKVKREICILKLFMHPHIIRLYEVIETPTDIFVVTEYITGGELFDYIVERGRLNEDESRKFFQQMISGIEYCHNHMVVHRDLKPENILLDAHLNVKIADFGLSNIMKDGNFLKTSCGSPNYAAPEVINGKSYLGPEVDVWSCGVIMYALLCGSLPFDDENIPNLFKKIKSGIYILPGYLSDLSRDMIAKMLITNPLLRITINEIRDHPWFNSRLPKYLSFPTFKKNFVIQKKLNIDDNILELVSNKTFLSKKYIKLGIMKHERNSTAIIYHLIRESITPFDMITVDNSYIRDIIKKENVIKKSNEKEHNTSLHQAFLGIESPRENLKDILNEIQRAIKTFRSKTHNLNHFSVIIVINTNSLFETKYKKKKEIILRTTTILIQIFKRSMKYLIDLQKINGDSFFFLSTCNFIKQELNLK

SEQ ID NO: 48314 - protein, 440 aa, Photorhabdus luminescens subsp. laumondii TTO1
MNSTKTVSIQHVINNQKFSKVQWQVLILCFLIVVIDGFDTVLMGYIAPAVVNDFKVEGAILGPAMSAALVGLSLGSIFAGPLADRFGRKSVLTISVTVFGLLSLATAIADSIQTLTILRFLTGLGLGAAMSNAITLISEYAPENRRSLLINIVFCGFPLGAAVGGIISAWIIPHFGWQGVLILGGILPLFLSLFLFSLLPESLRYLVSKGGAEGNIRRILSKMTGNTLNDINKFTFDGEEIIHKSSIKTVLSNRFLIGTAMLWITYCMGALVFYVLTSWMPFLMNDVGFSVSMAATLTALFPLGGVISTVFSGWLMDRINPHKVVATNYALAGILVFFIGQEENVLLLSILIFLAGITMNGAQASMGSISAQFYPTHCRATGVAWMLGFGRFGGIFGTLFGAELIRLELSYSTIFAILSIPAIIAALSLTFKDVSYRRHK

SEQ ID NO: 48315 - protein, 536 aa, Photorhabdus luminescens subsp. laumondii TTO1
MTDSNFFLSEYDGVALSPISFLRRAILSNGDDIAVIDGECHWTWSQYASRCERLAIALKKMGVCKETVVSALLPNIHELLELHFAVPMAGGILNALSTRTDSNTLNFIFKKLNPKVLFIDRTFISLLDDVSLDKQVKIIVIDVDGAVISESISDREFIQYESLITTHKSGELSFSLRDEQEAISINVTSGTSGQPKLIVYSHRGVFLNSISNVLDWDIPKRPTFLWTLPMFHCNGWCFPWAITARGGTHICMRKFDAEEAILLMQKHKVTHYCGAPIVHCALGTIARKQGLHFKEKIHGLVAGAPPTEMMFSLLDSIGIAVTQVYGMTETYGPVVVCEEKSDWEKLSKSVRISKRMRQGIVSNLQGQVCVIEENTGLQVPFDGKTVGELVIRGNMVASYDPDRHVTLDAASQWLFTGDLAVVENDGYVRIVDRKRDIIISGGENISSLELENILSNYPGVLAAAVVAKPDSHWGEVPYAFIELEETSSVTEYELDNYICTVMARYKRPKGYTFLTLPRNASGKIIKGQLRQLIRNS

SEQ ID NO: 48316 - protein, 269 aa, Triticum aestivum
  misc_feature (246)..(246): Xaa can be any naturally occurring amino acid
  misc_feature (261)..(261): Xaa can be any naturally occurring amino acid
HLFDKFLINEALDMIETAGGSFHLVKCDVGQSIDDMSYSELEVGADDTTTLDKIIDSLTSIANAHRGDPNATEISLKIGRVSECGIDGSMDKVGPKVLILGAGRVCRPAAEFLTSYQNIDQVHVVVASLYQKDAEETVDGIKNATAAQLDVSDTESLSNLVSQVDVVVSLLPASFHAAIARVCIELKKHLVTASYVDDSMSKLEQAAQGAGVTILCEMGLDPGIDHMLSMKMIDEAHALNGKIKAXFTSFCGGLPSPAAAXNNPITYKF

SEQ ID NO: 48317 - protein, 507 aa, Arabidopsis thaliana
MGSSFETIDIGTSARRIGVDNRISLKFYFRIADNILKQANIFRAEKNVIDLYVMLLRFSSLALETIPSHRDYRTSLKSNKEYLRMRLLDVLTELEKLKPVVQQRIDELYPKLKPRYNVQAHPANGSLGWSSAVKPSFNSYDHAKVRNPPGHNSGYMGSRGQQFLNAAPLEERFRKMSVNFRPNEETLSKHSILGPGGLSAQWQPPKYDTKVQYPSNIDFSPVVIPSFQQLVDSKPMITNGSNDEPEKPIVEPSVASNEKIQKNYTEELSSMISFEEPESVNENNLIRQPSPPPVLAEVQDLVPALCPEVREPECMIENSLPDESLRSESPLELHIATSMMDTFMRLAKSNTKKNLETCGILAGSLKNRKFYITALIIPKQESTSDSCQATNEEEIFEVQDKQSLFPLGWIHTHPTQSCFMSSIDVHTHYSYQIMLPEAVAIVMAPQDSSRNHGIFRLTTPGGMTVIRNCDRRGFHAHSSPEDGGPIYNTCKEVYMNPNLKFDVIDLR

SEQ ID NO: 48318 - protein, 459 aa, Agrobacterium sp. ATCC 21400
MTDPNTLAARFPGDFLFGVATASFQIEGSTKADGRKPSIWDAFCNMPGHVFGRHNGDIACDHYNRWEEDLDLIKEMGVEAYRFSLAWPRIIPDGFGPINEKGLDFYDRLVDGCKARGIKTYATLYHWDLPLTLMGDGGWASRSTAHAFQRYAKTVMARLGDRLDAVATFNEPWCAVWLSHLYGVHAPGERNMEAALAAMHHINLAHGFGVEASRHVAPKVPVGLVLNAHSAIPASDGEADLKAAERAFQFHNGAFFDPVFKGEYPAEMMEALGDRMPVVEAEDLGIISQKLDWWGLNYYTPMRVADDATPGVEFPATMPAPAVSDVKTDIGWEVYAPALHTLVETLYERYDLPECYITENGACYNMGVENGQVNDQPRLDYYAEHLGIVADLIRDGYPMRGYFAWSLMDNFEWAEGYRMRFGLVHVDYQTQVRTVKNSGKWYSALASGFPKGNHGVAKG

SEQ ID NO: 48319 - protein, 230 aa, Arabidopsis thaliana
MNNTFVESSNISEYDIGEESDLFRAPDPILEEPILTVDPLSAALTMISCGEDTSQGLCELPDLGSLQSGQQLLDKAFYECEQDLMMKSAMESPFSDVLDIKNISVVTTINENQDMQKSVSSGNLSSMDWSHAQQETVMIQNFPDFDFGYGMRRAFSEGDIQKLGAGLVQSPLDRIIVSCTSEDRREKLSRYKNKKSRRNFGRKIKYACRKALADSQPRVRGRFAKTEERK

SEQ ID NO: 48320 - protein, 455 aa, Caldicellulosiruptor saccharolyticus
MDMSFPKGFLWGAATASYQIEGAWNEDGKGESIWDRFTHQKRNILYGHNGDVACDHYHRFEEDVSLMKELGLKAYRFSIAWTRIFPDGFGTVNQKGLEFYDRLINKLVENGIEPVVTLYHWDLPQKLQDIGGWANPEIVNYYFDYAMLVINRYKDKVKKWITFNEPYCIAFLGYFHGIHAPGIKDFKVAMDVVHSLMLSHFKVVKAVKENNIDVEVGITLNLTPVYLQTERLGYKVSEIEREMVSLSSQLDNQLFLDPVLKGSYPQKLLDYLVQKDLLDSQKALSMQQEVKENFIFPDFLGINYYTRAVRLYDENSSWIFPIRWEHPAGEYTEMGWEVFPQGLFDLLIWIKESYPQIPIYITENGAAYNDIVTEDGKVHDSKRIEYLKQHFEAARKAIENGVDLRGYFVWSLMDNFEWAMGYTKRFGIIYVDYETQKRIKKDSFYFYQQYIKENS

SEQ ID NO: 48321 - protein, 438 aa, Zea mays
  misc_feature (11)..(11): Xaa can be any naturally occurring amino acid
MATHAALAASXPASSRHGVQRLDFADFSGLRPGSCSVSAAAREASFSDVLGAQLVAKATGENAVRAPAEAKLKVAINGFGRIGRNFLRCWHGREDSPIDVVVVNDSGGVRNASHLLKYDSMLGTFKADVKIVDDTTISVDGKPITVVSSRDPLKLPWGELGIDIVIEGTGVFVDGPGAGKHIQAGAKKVIITAPAKGADIPTYVVGVNEGDYDHSVADIISNASCTTNCLAPFVKILDEEFGIVKGTMTTTHSYTGDQRLLDASHRDLRRARAAALNIVPTSTGAAKAVALVLPQLKGKLNGIALRVPTPNVSVVDLVINTVKTGITADDVNAAFRKAAAGPLQGILDVCDVPLVSVDFRCSDVSCTIDASLSMVMGDDMVKVVAWYDNEWGYSQRVVDLAHLVAAKWPGAAAAGSGDPLEDFCKDNPETDECKVYEA

SEQ ID NO: 48322 - protein, 308 aa, Salmonella typhimurium
TTKKADYIWFNGEMVRNEDAKVHVMSHALHYGTSVFEGIRCYDSHKGPVVFRHREHMQRLRDSAKIYRFPVSQSIDELMEACRDVIRKNNLTSAYIRPLVFVGDVGMGVNPPPGYTTDVIIAAFPWGAYLGAEALDQGIDAMVSSWNRAAPNTIPTAAKAGGNYLSSLLVGSEARRHGYQEGIALDVNGYISEGAGENLFEVKDGVLFTPPFTSSALPGITRDAIIKLAKELGIEVREQVLSRESLYLADEVFMSGTAAEITPVRSVDGIQVGEGRCGPVTKRIQQAFFGLFTGETEDKWGWLDPVNS

SEQ ID NO: 48323 - protein, 435 aa, Solibacter usitatus Ellin6076
MTNRRQLGLFDATMIVMGGIVGSGIFMNPSVVARQVHTPFLILGVWLAGGALAILGAFIWAELATRLPGAGGQYLYLREAYDPAVAFVYGWVLLLVTQTGGMAAVAVTFARYYREISGVAWSDSAIAAAVLLGLTAINCMGARAGSNVQSALMLMKTGAIAVLVIAGIALGGGTIHPLPLLDRPVSLGLLGALGAGMIPVAFAYGGWQTATFVAGEMRNPGRDLSRGLVAGVTGVVVLYLAVNVVCLKVLRPEGLAATRTPASAVMRAAMGDRGAWWIALGIAISTLGFLSQGMLTAPRVYNAMARDGLFFERVGRLSPRTGAPVTAIVLQGIASTVIAFSGKYEQILNYEVSVDFIAFALAGGALFLFRREGRGDQQGGIYRAPGHPYTTALFVAACVAIVASTVITDPLNSARGWGIMLTGVPVYLYWRRKAQ

SEQ ID NO: 48324 - protein, 337 aa, Microdochium nivale
MVVKVGINGFGRIGRIVFRNAIEHDDIEIVAVNDPFIETKYAEYMLKYDSTHGNFKGTIEVASDGLVVNGKKVQFFTERDPSAIPWGKAGADYVVESTGVFTTIDKAGAHLKGGAKKVIISAPSADAPMYVMGVNNETYDGKADVISNASCTTNCLAPLAKVIHDKFTIIEGLMTTVHSYTATQKTVDGPSAKDWRGGRTAAQNIIPSSTGAAKAVGKVIPDLNGKLTGMSMRVPTANVSVVDLTVRIEKGASYEQIKEAIKEAANGPLKGVLAYTEDEIVSSDMIGNPHSSIFDAKAGISLNDNFVKLVSWYDNEWGYSRRVLDLLAYIAKVDAGK

SEQ ID NO: 48325 - protein, 448 aa, Glycine max
MAATASNNDVAAAADGPVMSLINKRLRALRKKLNRILAMEEAVTQGKPLNKEQEEVLRSKPSVLALIDELEKLRQPLATALSEELQNNGTSSQNSRETETETENETLAESSGSVEPNTNSTTNDVVVEDLLNLLYFGSLFDVKSDFASTMLTRTHERGCCLTYDYVTDDATDLLGEKDLDSISALRGLLVSRPADSSFSHKNALQRCLEHARLWLTKSEQPIEPDTDVTYAALREKLNKIMSSEYFTTTPEMKAPVEVAAAAAGGNYVSFHVPVHGSVVPVEVEQPVFQSQEKDEGTANFQGHGSEEDLSDHEGELQKDEVEAEAENAGEVVSAQHEQANQQADVEYNERDVEAKDQQSYPRRGYQNHRGGRGGGGRRGYSNGRGGRSGGRGGYQNGRNQYYDQPGNYYPRNNYYNNRGRGGRGGGYYNNHGAGGQVNHVAGDVGVQS

SEQ ID NO: 48326 - protein, 341 aa, Oryza sativa (japonica cultivar-group)
MAKKKGFTSIFSRLLVVTGGGDDERGGGAAATTSPSPPPWPWPSCGNRPRTVSSRRDGGCSTSAAAAASAAAARRIAGEMYKTVNSVYFDYSAADGYSCFDDDDGRVVDDDDDGDSFSTTTASEEWSEAVIRSLGRTSTDRFFFDPGPPTNSILAAAAVPETKPVAAAAVFHDEEKEKLPEPPASLVEESVAVAVESEDPYSDFRSSMEEMVAAHGLRRWDALEELLVWYLRVNGKHNHALIVAAFVDLLVGLAAAATTTGTTPTTTTTTSSGRSTASTSTACDITTTTTITTSSATATMEPCPCGGGSSDDLEEEEEEARVMISLGASSCSLAPSTFANS

SEQ ID NO: 48327 - protein, 429 aa, Alkalilimnicola ehrlichei MLHE-1
MGTIKQIKAREILDSRGNPTVEADVILDSGVMGRAAVPSGASTGTREAVELRDGDAGRYLGKGVRKAVENVNTVIADALCGMDASGQRALDDRMRELDGTDNKGKLGANALLAVSLAAARATAAERGQSLFRYLNPEGPWSLPVPMMNILNGGEHADNSVDIQEFMVMPTGFDRFSEALRCGTEIFHALKKVLQDRGLNTGVGDEGGFAPDLPSNEAALEVILEAIDRAGYKAGENVWLALDAASSEFYQDGVYRLASEGREFSAEAFADYLADLCARYPILSIEDGMDESDWVGWKALTDKLGDRVQLVGDDLFVTNTRILKRGIDEGVGNSILIKFNQIGTLSETLDAIAMAHEAGFTSVVSHRSGETEDTTIADLAVATTATQIKTGSLSRSDRVAKYNQLLRIEEELGEQADYPGLAAFPQLRRG

SEQ ID NO: 48328 - protein, 426 aa, Xanthomonas oryzae pv. oryzae KACC10331
MAARRPPIRLHRAAQSHRPHHHGAAGGSMSLRIDTAAALAALPHVRDRCDGPICAYVYDLAALDAHAAWMRAQLPAQCELFYAAKANAEPPILQTLAAHVDGFEAASGGELAWLHAQQPQAPLLFGGPGKLDTELAQAAALPDCTVHVESLSELERLAAIAAHAGRCVPVFLRMNIAVPGAQSTRLTMGGHPSPFGLDPDDLDAAMQLLQASPSLRLEGFHFHLMSHQRDAAAQLHLIAAYLRTVQRWRHTYALGPLRVNAGGGFGVDYLAPESSFDWAGFCAGLPALLGEHGTDLRLRLEPGRYVSASCGWYLMEVLDLKRSHGAWFAIARGGTHHFRTPAAQAHDHPFRVLRGARTPVLRDTPVTLVGQLCTPKDVLARDQSVAALAPGDCLAFPLAGAYAWTISHQHFLMHPAPQMVFLPAKK

SEQ ID NO: 48329 - protein, 115 aa, Escherichia coli O157:H7 EDL933 [sequence omitted]

SEQ ID NO: 48330 - protein, 191 aa, Solibacter usitatus Ellin6076
MSSLKAEFVVSSGKPDTFPSDRLPEIAFLGRSNVGKSSLINALTGHKKLAFTSNTPGRTQTINFYRVDEKFYLVDLPGYGYARVPAGFAEQWKVLIEHYLEFRETLKFSCLILDTRRGWMEKDLDLKRWLDHHGRPYLVVATKTDKLNQSEQERGLRAIRQEGVEPLPFSALSGRGVREIWQAITTTLQAR

SEQ ID NO: 48331 - protein, 431 aa, Oceanobacter sp. RED65
MAKIIDVKAREVMDSRGNPTVEADVLLEGGFFGTACAPSGASTGSREALELRDGDKTRYMGKGVLNAVANVNGAIKNALVGMDATDQKALDHKMLELDGTDNKATLGANAILAVSLAAAKAAASAKGIELYEHIAELNGTAGQFSMPLPMMNILNGGEHADNNVDIQEFMVQPVGFTSFSEGLRAGAEIFHNLKKVLQGKGLNTAVGDEGGFAPNLASNADALAVIKEAVSAAGYQLGKDITLALDCASSEFYKDGKYDLSGEGKVFSAEEFSDYLAELCDQYPIVSIEDGQDESDWDGWKYQTEKLGSKVQLVGDDLFVTNTKILKEGIEKDIANSILIKFNQIGSLTETLEAIKMAKEAGYTAVISHRSGETEDTTIADLAVGTCAGQIKTGSLCRSDRVAKYNRLLRIQEQLGDKAVYNGLKEVKGQA

SEQ ID NO: 48332 - protein, 566 aa, Debaryomyces hansenii CBS767
MYEENKNDLIRDEVDNISDTSSNSTIFQAGLTDKEISESVDAIIEKNQSLIPHKELIYRGAVLANDGGNVLQEHQHHYTNTEVDQLVFESKHSIRAQSWTMFLVALSACLSAVNFGHDESAVSGAQLDYIKLFHITNANIQGTVNAAPYLAAGTLGIGFAILLDKYIGRKWIIFISCIFGVGGSLWQAFSQSMGSLLAARLFLGVGMGLNSSAVPLLIAEAAPAKSRGSFLMLWQTFVAFGVMLGSVFNRAFVDVEQIGWRLMIGASFVAPILTAALVVFIPESPRYLLSIHKDEQALISLVKLRNSELAGSRDFFVLYNSLKRSDEIEKIPITSQISLFFNNGRVKYAFLVSAFNMIMQQYCGVNILVGYTTTILVGSGVDPKTAIAGSIGIGGGCFVATFFSSQCIDRFGRRRMLLLTFPFLSGCLFWLGGSLYIFDDTSRLGSGLTAMYMFVIFFGLGIGPISWTYNAEVYPLNVRVLGVAIGMAINWILDFVLSMTWPKMAETMSASGGLFFYASFNLFAFFFTYFLIPETKELTLEELDNVFSQSPLKFAKTKALRFFKRN

SEQ ID NO: 48333 - protein, 398 aa, Oryza sativa (indica cultivar-group)
MATITAASPRPSAAPAAMEETSKAMPSESPAASGGNASPPARSRPSLLVIFSACLVLLGAGGPLLLRVYFVHGGTRLWLSATLQISGWPLLLPPLCVSLYRGRRHGIGNLLLPRRLVGAAAVLGGLYAVSCFVYALGSQALPLSTSSLLLATQLAFTAVFAFLFVGLRFTPFSANAVVLLTIGPAVLGVGPSSGKPAGESSRAYWTGFCEAIGAAALAGLVIPLVEVATARYGRRTGPAARVPPPYATVMQMQAVMGAAGTAVCVLGMAIKGDFQAVAREAAAFGLGAANYYLVLAWDAVSWQLLNLGIMGLITCASSLLAGIMIAVLLPLSQVLAVIFLHEKFDGTKGIALVLSLWGFASYLYGEKAQKKKEAQKMREREQEVALAQKTADVESAAP

SEQ ID NO: 48334 - protein, 483 aa, Anaplasma phagocytophilum HZ
MFSSISGLARLCKIGATLLRYGIIPNAGIFSNRKHKKNYGERVHLCLRSLGPTFIKFGQFLASRADIVGEEVAGNLLTLCDKLTPFPYSQVVSIIESQFHKKMDEIFLEFDEEPVAAASIAQVHRARTLDGELKAVKVLRPGIEASFRADIALMRKIADISSALGILSRFKLPQLVEMFSDICKLELDLRFEAASADELRENLRAESSDFYVPKVDWKHTSRRVLTLQWVEGTPIYRVDELQNKELLAKNLIIAFCNQVYRDGFFHADMHPGNLMVDANSRIIVVDFGIMGRLDEETCFYITEILVGFINRDYRRVAAAHFDAGYVPERFDQFVTACRSIWEPIADVDDTKNFSTASLLAQLFKITADFDMCVQPKLLLLQKSMVLVEGICRQLVPEMNFWKIAELWVKDHYENIGYVERLKQCKAYRSMMNIGLLVSKIDRSLDIVISHGQAANARKSGGITKSTFCLTLVIAFLTLIILFK

SEQ ID NO: 48335 - protein, 743 aa, Gibberella zeae PH-1
MAAAATPTAAARPSPAPADSREDSRSSSSSTSPAPADNEESDFFLGANDSQSSIGVPNFQDMQVEDACQPPVHRLPNEILISVFAKLSSTSDLFHCMLVCKRWARNTVDQLWHRPACTNWKNHASICQTLGMENPSFRYRDFIKRLNLAALADKVNDGSVMPLSVCTRVERLTLTNCRNLTDSGLIALVENSNSLLALDISNDKNITEQSINAIAKHCNRLQGLNISGCESISNESMITLATRCRYIKRLKLNECGQLQDDAIHAFAENCPNILEIDLHQCARIGNGPVTSLMVKGNCLRELRLANCELIDDEAFLTLPYGRTFEHLRILDLTSCHRLTDAAVQKIIDVAPRLRNLVLAKCRNITDTAVHAISKLGKNLHYVHLGHCGNITDEGVKKLVQNCNRIRYIDLGCCTNLTDESVKRLALLPKLKRIGLVKCSSITDESVFHLAEAAYRPRVRRDASGMLVGNEYYASSLERVHLSYCVNLTLKSIMKLLNSCPRLTHLSLTGVAAFQRDDFQPYCRQAPPEFTQHQRDVFCVFSGTMVSKFRDFLNTSPQFEDMWDNGWNRPAVFGSRRAVAASQPTAPPGDGVDDEMVDDENDFEGLDGSEMVVDAQAQNPVNGNGTVNPNGLTNQTFQQAIPIPPPLPLPGFPIGQHPTFFQPHTRFLSSSPFLRQDPRLFRPMFFQTSINNMTEGGISQPVTSQASAALLGYGGPANGESPTGASTATIHRPQENGDQSDSMN

SEQ ID NO: 48336 - protein, 447 aa, Lactobacillus sakei subsp. sakei 23K
MARKMLTAEAIKQLVDQENVKFLRLMFTDINGIIKNVEVPISQLDKVLSNKMMFDGSSIDGFVRIEESDMYLRPDLSTWLIFPWEAEHGKVARLICSVYTADGEPFLGDPRNNLKKMVREMQDKGFKDFNIGPEPEFFLFKLDEIGKPTLKLNDQGGYFDFAPVDLGENCRRDIVLELEKMGFEVEASHHEVAPGQHEIDFKYADAVDAADNIQTFKLVVKTIARKHGLHATFMPKPLHGVNGSGMHINMSLFNQDGTNAFFDENGKEQLSETVYHFLAGLLRHARAITAINNPTVNSYKRLVPGFEAPVYVAWSGHNRSPLIRVPQSRGLSTRLELRSVDPSANPYLAISSILAAGLSGLEQGLSPEAGVDRNIYSMDETERKENHITDLPSTLHNALKELAKDDIIKDSMGTYLYQSFMDSKSLEWAAYRQQVSEWEREQYLELY

SEQ ID NO: 48337 - protein, 634 aa, Bacillus clausii KSM-K16
MCGFVGDLLIRNGSHLPDHLWIQTLEAIHHRGPDSTGTYKDETVRFGFKRLSIIDLEHGDQPLAYSKGRYHIVFNGEIYNYIELRSQLIQRGYTFRTDSDTEVLLALYAADGKNAVKQLRGMYAFAIWDKHKKELFCARDRFGIKPFYYLKTDERFFFASEQKSIMPLLEQISIEQEALQHYATFQFVPEPNTLTKGIHKLLPGHTLTVNADFCVQIEAYAERTFQPRSGPTVTELANQTRKLLTDSVEKHMRSDVPVGAFLSSGIDSTSIAALAQQVHPNLLTFTVGFETEGYSEIAVAKETAKALGVKNIHKVISADEFIQELPNIVWHMDEPVADPAAVPLYFVAQEASKHVKVVLSGEGADELFGGYNIYREPLDLAWFKKLPPTFHAGLKRVVAHMPSKLKGRNYIIRGTTPLNERYIGNAFIFSEKEKTQLFRDYDRTKPYTNVTAPLYEQAKGMDESTIMQFVDMHTWLPGDILVKADRMTMAHSIELRVPFLDKDVFAFARMLGQDMKLSHKTTKFVLRQAMKDLIPANIVPRKKLGFPVPIRVWLKNELYDWAKQLIESSNTEDVFHKPFLLQMLQAHRDGHGDYSRRLWTVLTYMMWHDIHVAKRLISTHQQKDAERCKTLAHF

SEQ ID NO: 48338 - protein, 515 aa, Arabidopsis thaliana
MSDTKISAVAVAAAVVVVTTVTVWIWKGLNVAWLRPKKNEAYLKRQGLSGTPFTFLVGDIKREASMVEQEKSRPINLTDDYTHRVMPLIQQTVKDHGKTSYMWMGPIASVIVTKPEHIKDVLNRVYDFPKPPVHPIVELFATGVALYEGEKWSKHRKIINPSFHLEKLKIMIPAFYESCSEMISKWEKLVTEQGSSNEIDVWPYLGDLTSDVISRTAFGSSYEEGKRIFELQEEQGRRVLKALELAFIPGMRFLPTKSNLRMRQINKEVKSRLREIIMKRQRGMDTGEAPKNDLLGILLESNSGDHGMSIEDVVEECRLFHFAGQETTAVLLVWTMIMLSHHQKWQDQAREEILKVIGKNNKPNFDALSRLKTMSMILNEVLRLYPPGILLGRTVEKETKLGEDMTLPGGAQVVIPVLMVHRDPELWGEDVHEFNPERFADGISKATKNQVSFLPFGWGPRFCPGQNFALMEAKMALVLILQRFSFELSPSYTHAPHTVLTLHPQFGAPLIFHML

SEQ ID NO: 48339 - protein, 618 aa, Emericella nidulans
MIMNAWLAAKMKLVAVLLALATVEARPTVDTTYPYTGPAVPIGDWVNPTINGNGKGFPRLVEAPAVKPRSAHPKNNVNVISLSYLPDGMHIHYQTPFGLGQAPSVRWGTSPANLNKVAHGWSHTYDRTPSCAQVKAVTQCSQFFHEVSLPHLKPETTYYYRIPAANGTTQSDILSFKTARAPGHKRSFTVAVLNDMGYTNAHGTHRQLLKAANEGAAFAWHGGDLSYADDWFSGILPCADDWPVCYNGTSTQLPGGGPIPEEYKQPLPQGETANQGGPQGGDMSVLYESNWDLWQQWMTNLTVKIPHMVMPGNHESCAAEFDGPGNPITAYLNEGIPNGTWAAENLTYYSCPPSQRNFTAFQHRFHMPGKETGGVGNFWYSFDYGLAHFVSLDGETDFANSPFSTFERDLTGNETHPRPEETETTDSGPFGTIDGDRYDDNTAYAQYQWLKDLASVDRTKTPWVFVMSHRPMYSSAYSSYQNHVRNAFENLLLQYGVDAYLSGHIHWYERMFPMTANGTIDESSIADNQQPNTTNSGKSMTHIINGMGGNIESHSWFDEGEGLTEITAKLDRTHFGFSKLTVVNETVVNWEFVKGDDGSTGDWLTLVKGETCTINVSG

SEQ ID NO: 48340 - protein, 106 aa, Oryza sativa
  misc_feature (12)..(12): Xaa can be any naturally occurring amino acid
  misc_feature (20)..(20): Xaa can be any naturally occurring amino acid
  misc_feature (76)..(76): Xaa can be any naturally occurring amino acid
  misc_feature (82)..(82): Xaa can be any naturally occurring amino acid
TRRLPPGVGAMXRAGVLVSXRAQHGSHHRAPYDNDYCIVSGMWNATLDRRRVFEAMEIVVFLRTGVRPRSWDEPDXAAWTEXDYDDTAAVAGGDTSLDTHVSIDSD

SEQ ID NO: 48341 - protein, 115 aa, Thermoanaerobacter tengcongensis MB4
MDLIKAVESEQLKKDITPFNVGDTVRVYYKVIEGDRERIQPFEGIVIKRSGSGLRETFTVRRVSYGVGVERTFPLHSPRLEKIEVIRRGKVRRAKLYYLRKRVGKAATKIKELME

SEQ ID NO: 48342 - protein, 259 aa, uncultured bacterium
QPNAMGGREVGGLANQLAVHRGFDPDSIKLISEFWQTDNLATRPGLKAIELFEAVERGDIQVIWIMATNPVVSMPDNVFIQRALQKCPLVIVSDVTHDSDITQYADLLLPAAGWGEKQGMVTNSERMLTRQRKFLPSKGEAKPDWKIIAEGRKKLCERLDKPNAFDFKSESSVFREYAAMTGLNKDTPFLLDLSKYAEISDEEYKSWNPVQWGSSRPFADGKFSTENRKARFVVTTAPLIKGESSLWLNTGRQRDQWHT

SEQ ID NO: 48343 - protein, 148 aa, Zea mays
MEQTFIMIKPDGVQRGLVGEIICKFEKKGFTLKGLKLITVDRPFAEKHYQDLSAKPFFNSLVDYIISGPVVAMIWEGKNVVLTGRKIIGATNPAASEPGTIRGDFAIDIGRNVIHGSDSVESANKEAALWFPDGPVNWQSSLHSWIYE

SEQ ID NO: 48344 - protein, 268 aa, uncultured bacterium
QPNAMGGREVGGLSNMLAANMDIDNPEHHATVKAFWQAPHLITKPGLRAVDMFQAAADGKVKCLWIMATNPVASMPNRALVEAALKNCELVIVSDTAAQTDTLNYAHIALPATGWSEKNGTVTNSERRISRQRGLVEPMGEARHDWDILSMVGRAMGFEAAFAYQHPAEIFAEHCALTAANNNGSRALDLGPLANLTIAQYDNLRPQQWPLSDTHRIGTARLFADGSFYTPNGKANFVAITPRLPDQQTSADYPFVLNTGRVRDQWHT

SEQ ID NO: 48345 - protein, 345 aa, Synechococcus elongatus PCC 6301
MTLLLAGDIGGTKTNLMLAIASDCDRLEPLHQASFASAAYPDLVPMVQEFLAAAPSAEVRSPVVACFGIAGPVVHGTAKLTNLPWQLSEARLAKELGIAQVALINDFAAIAYGLPGLTAEDQVVVQVGEADPAAPIAILGAGTGLGEGFIIPTAQGRQVFGSEGSHADFAPQTELESELLHFLRNFYAIEHISVERVVSGQGIAAIYAFLRDRHPDQENPALGAIASAWQTGGDQAPDLAAAVSQAALSDRDPLALQAMQIFVSAYGAEAGNLALKLLSYGGVYVAGGIAGKILPLLTDGTFLQAFQAKGRVKGLLTRMPITIVTNHEVGLIGAGLRAAAIATQP

SEQ ID NO: 48346 - protein, 266 aa, uncultured bacterium
QPNAMGGREVGGLANQLAAHMDFSDESIKLVSDFWNAPNIAEKPGLKAVELFSELEAGKIKALWIMATNPAVSMPQASRINQALANCDYLVVSDCITSNDTTRHANVLLPATTWGEKDGTVTNSERRLSRQRAFLPAPGQARPDWWIICQVAQKMGYTQSFTYQTPADIWREYASLSGYQNGGMRDFDVSALANISNQQYQNMQPQQRPVNSSQARVSSLFSDKRFYHADHKARFISVTANCTYPQTSEQFPLVLNSGRIRDQWHT

SEQ ID NO: 48347 - protein, 335 aa, Nicotiana tabacum
MVHEKQVIEEVSGWLRVFEDGSVDRTWTGPPEVKFMAEPVPPHDYFIDGVAVKDVVADEKSGSRLRIYLPERNDNSANKLPVILHFHGGGFCVSHADWFMYYTVYTRLARAAKAIIVSVFLPLAPEHRLPAACDAGFAALLWLRDLSRQQGHEPWLNDYADFNRVFLIGDSSGGNIVHQVAVKAGEENLSPMRLAGAIPIHPGFVRSYRSKSELEQEQTPFLTLDMVDKFLGLALPVGSNKDHQITCPMGEAAPAVEELKLPPYLYCVAEKDLIKDTEMEFYEAMKKGEKDVELFINNGVGHSFYLNKIAVRMDPVTGSETEKLCEAVAEFINKH

SEQ ID NO: 48348 - protein, 106 aa, Gibberella zeae PH-1
MSQASTKVQQLIDNNSVVVFSKSYCPYCKQTKKTLDDLNTEYELLELDEVADGSALQDALEKISGQRTVPNVYIKQQHIGGNSDLQSLNSGGKLKNLLKEANALKA

SEQ ID NO: 48349 - protein, 525 aa, Picrophilus torridus DSM 9790
MNGFDLTINNLLETAARDNGDQKIVYMGKSVTYNEFYKNALNLSRNLIRIGVRKNDVVAVIDYDSLMYMYAYYSIPMIGSILHTVNIRYPPEIIFYTMQRADDSYIMIDESFMDLIVKNRDYLNFIKGIIVNSAGHRHFDVNIPVYYFDDLLKDSDAKFEEPDENDTATLFFTSGTTGLPKGVSFTHRQLVLHSIASIAALSNEPIKYNINDVIMPLVPMFHVHAWGIPYTSIMNGLKYVLPGKYDVPRILETMVTERISMSAMVPTILYMLLSDKNAKQAFQNLNLKVIIGGAALSRGLAERARAYGIDVVSGYGMSETAPILTLGVYNRKVINKSDEEKFEFRLKTGIPIPMVSLRVVNNNRDVENNGKEIGEIIVRAPWLTKGYIKDEEKTRELWRDGWLHTGDLAVVDEYGYVKIVDREKDAIKSGGEFIPSLILEDLISTISGVNEVAVVAKSDDKWGERPVAFINGNLSVEELKLKMMEFVDTGRIAKFWIPDDFIFVNEMPKTSTGKIDKKVLREKLR

SEQ ID NO: 48350 - protein, 321 aa, Candida albicans SC5314
MEVLHQLTTNHTSSLSNLINNHPTSFSSILKEVDITNHSLTYIEKLWASYYIYMNNDILATGLLFFITHELMYFGRCLPWFIIDKTPWFNRYKIQPTKIPTNQEQWECFKTVLKQHFLVEALPIWLFHPVCAKLGITYDVPFPNWKIQAIQIAIFFICEDFWHFVFHSLFHQGWFYKNIHKVHHKYAAPFGLAAEYAHPVEVMALGVGTVGFPILYAYLATVYTNMPPLHLFTLTTWIVLRLFQAVDSHSGYDFPWSLNKFFPLWAGAAHHDEHHHYFIGNYASSFTLWDWLFQTECGTYARKRRERNSQASAESKHKKTL

SEQ ID NO: 48351 - protein, 478 aa, Vibrio sp. Ex25
MMQQIKNETLKSVFKQWSSEEGIVVINPATEQELVRLKPSSLEELDTLIGQCKTEQVRWAKLSAKERSRRLKKWYQLLLDNAEDIATIITLEQGKPLTESKGEVMYGASFVEWFSEEAKRAYGEVIPAPTTDRRLSAIRQPVGVCAAITPWNFPIAMITRKAAPALAAGCGMLIKPSELTPLTAIAVVELAYQAGIPKELLPVVVSEQAAEFGQVLSTDPRIKKVSFTGSTRVGKILMKQASDSVKAVSMELGGNAPFIVFDDADLDAAAEGLVASKFRNAGQTCVCTNRLYVHEDVKQAFIEKVLSKLNKLQLGNGLEKGVTLGPVITMASKHRLEAVIDQAVQEGASIANSPQRRSGRFMEPVLLDSVKQYMSIVQQELFGPVLPIITFENDEQVLGMANDTEYGLACYFYTNNFKRIVAFSEGLEYGMVGVNEGIISTEVAPFGGVKESGVGREGAKQGLDEYLETKYICLGGLS

SEQ ID NO: 48352 - protein, 489 aa, Haloarcula marismortui ATCC 43049
MSQPDSQTAWDRLYIDGEWRDAGTSETIPVTNPATGDEIAAVPAGTEGDVNDAYQAAEAAQSDWAALSREERNEYVQAMIGVMQERLDEIVELLATESGSVQAKATAEANFAMADFQSALEMVPPEEEVRDSMYHEDKDHHIVREPAGVVGIISPWNFPLHLTTRALGPALALGNTVVIKPATDTPITGGLLLADIAEEAGLPDGVVNVVTGHGSDIGDRMAGHPTARVMSFTGSTAVGRSVASQAGDALALPALELGGNGPFVVTEDADIEAAAKAGSVGAFGHQGQVCISINRHLVHEDVYDEYVEKLVEHAESLTIGNPLDEDVEFGPIINESQVEQLTSFIEQTVDAGATLETGGEVEDLFLEPTVLSECTNDMSAACNEHFGPVAPVIPFESDEEAVELANDTEYGLAAGVYSSDVEHGRSIADQIDAGMVHVNDHPIQDEPNAPFGGMKNSGLGRYNGEWIMDELTETKWISVQHEERDYQLL

SEQ ID NO: 48353 - protein, 551 aa, Haloarcula marismortui ATCC 43049
MPGGAPLNLRSFLWRGENVFPDSEIVSRTHQGIHRYTIAEYAERVRKLASALEQAGIERGDRVGTFAWNNHWHQEAYYGVACMGAQVHMINLLLPDEHIQHIVADAEDEILIVDPVMLEKLEGAYDEEAFDSVEQYIVMGDTVPETSLEPVVDYESFIADGDPDYSFPQLPEDQPAGMCYTSGTTGKPKGVEYTQKMYWTQVMALMTSQAGIKTDDVELTYVPMFHVSGWCRPFTTIAAGAKTVLPGPNPSAEDLAKLIEEEDVTVSAAVPTVFMDLLEYARDTDVDFSSVRYFTSGGSATPRSLMEDYKQEFDVDLISGYGMTETSPVTHAYEPKPGMTDLPEEELFDLRSHSAGLPIAGLEFKVVNTDGEEVPWDGESLGELWMRGPWVTQEYYNAPDATEQAVTDDGWFKTGDIVRVSPEGYVDVVDRMDDLVKSGGEWIASVEVENAVMGHDEVVEAAVVPVPHERWDERPAAFVVTRDAVSDEAALRQEIKDLVAESYPSWWVPDAIRLVDGIPKGATGKFSKQTLRDEYVDESVIETVAENAPAT

SEQ ID NO: 48354 - protein, 832 aa, Solibacter usitatus Ellin6076
MGPTFGRGAMTNGWIDIKNTDMMLIMGGNPAENHPCGFKWAIEAKRNRNAKMIVVDPRLTRTASTADIFVQIRAGSDIACLGGLIHYAIENGRIAHDYLLHYTNAAFLIKEGFQLPEDGLFSGFDHKTATYDRSTWDYEESKPGEAANDLSLEHPRSVFQLLKRHYSRYTPEMVERITGIPKEQFLKAAELFTSIRKDGDMKKAATIIYAVGWTHHSFGTQIIRTAAILQLLLGNIGRAGGGINALRGHSNIQGATDMAGIFDLLPGYLKMPAAADANFKAYTDRITPKAAKPGAWDSMNYWSNTPKFAVSLLKALYGDAATKQNDWAFDYLPKLERKHSWTEIWDDMYRGTIKGMFAFGMNGVAIGPNSQKNIDALKKAEWLVVCEIYPDETSEFWKSPGITTGEMKNIPTTVYRLPGAGFAEKDGTFVNSARWLQWKNAALPPPGEAKLDQEILARIYLRVRELYQKEGGKFPAPILNATWNYTDPHNPSLSEIAREINGRAVADVTDAKLGQTIKAGQQLPGFGWLRDDGSTAAGNWLFCGSWTEAGPMMQRRGTDDPSGLGVYPNWAWSWPANRRVLYNRASCDPAGKPWDADRTQISWNEAQQKWTGIDVPDFKIDSPPKDHMGPFIMNAEGVGRIFAPLAAFADGPFPEHYEPVESTIENPLHPGQSKNPVARRFQSSADKFGTPAEGYNIVCTTFRLTEHYHYWTKNNPMNVQLVPEPFVEIPAELADEMGLRGGEHVKVTSARGHYIAKAMVTRRIKGMMIDGRKTYQIGIPIHWGYRGIAEDEGKTALTPANMLSPAAIDPNAYTPEFKGFLVKLEKAKLEKA

SEQ ID NO: 48355 - protein, 236 aa, Brassica napus
MAQLPCDNDGACLRCKAKPPQEETLTCGTCGTPWHAACLSSPPETLASTLQWHCPDCSGEIDPLLPVSGAESGGGSDLVAAIRAIEADESLTDADKAKKRQELLSGKSATDEDDDEEEGKKSAGGLDVDLLKALGENLNCSFCIQLPERPVTTPCGHNFCLKCFEKWIGQGKRTCAKCRSPIPPKMASNPRINSSLVSAIRLARVSKSAGAGTGKVFHFISNQDRPDKAFTTERAK

SEQ ID NO: 48356 - protein, 188 aa, Solibacter usitatus Ellin6076
MQTRRAFLQAGAAAAVLGFDLAPAYAQMRELKISRTTETRSTCPYCSVSCGVIIHTLGDRAKNVTPQVVHVEGDPDHPINRGTLCPKGSSLQQDIVNSRRLLHPEVRRPGSDHWEPISWDAAIDEIAQRVKKTRDESFIEKDPQGRTVNRCEGIAWTGGCTDTNEFNYLVVKTMRSLGVCSLENQARV

SEQ ID NO: 48357 - protein, 226 aa, Xanthomonas axonopodis pv. citri str. 306
MSHSAALPFRTQAVIFDMDGLMLDSERAITACLAQAAADQGLQIEPAFWLRMVGTGDAACRRLLGERIGEQPADTMLAHAQRLYAAAVERGIPHRPGIMALLDYLAAQHMPRAVATSTQRPLALRKLEAADLLWRFDAVCTASDVVHPKPAPDIYLLAARTLAVDPAHCLVLEDSPTGVHAALAAGMTPIQIPDLLEPDATVRALGHRILPSLVDAQRLLEARLSG

SEQ ID NO: 48358 - protein, 260 aa, Arabidopsis thaliana
  misc_feature (242)..(242): Xaa can be any naturally occurring amino acid
MSIRSKTGSRFFKKLGHKDSSIAMTKQKQYVSDVNLTVCGSNKPSSTPGKDIEYFGLIPVDLFISNILSRLPLKSKAKCRCVSKLWSSIIRRPNYNQLFPIKSPAPRILFTIEYAGILFFYSSPQPHNPDENSSLVATLHQNTGNTKFYEICGPVCGRVLCRQYNSVGVIYNPITGESSNLPKLSLKGINKSEWLCDKARYSFGYDPIEKQLKVLCITWLRTGSEHLSNEYQVLTLGTENKXLFWRKIQGCAIHFFWDNT

SEQ ID NO: 48359 - protein, 536 aa, Prochlorococcus marinus str. MIT 9303
MHQLMSFPDFSASDAHVQWQRFNNLLWYHNDLGIWLDISRMHINAEDFERLGPRFDQAFKAMQALEQGSIANADEQRMVGHYWLRQPQLAPDQEVRDHIAKEIDLIETFGSNVVNGLIKAPNGKQFTDVLWIGIGGSGLGPLLMIRALQNAEQGLRFHFFDNVDPDGMSRVLGNLGDALSTTLVVTVSKSGATPEPHLGMEQARQRLEEMGGRWSGQAVAVTMLNSQLDQLAQKESWLKRFDMFDWVGGRTSITSAVGLLPAALIGCNTRDFLAGAAQMDEATRVPDLHSNPAALMAAAWFVAGDGLGRRDMVVLPYRDRLEVFSRYLQQLVMESLGKRLDRDGNVVHQGLAVYGNKGSTDQHAYVQQLRDGVDNFFATFIEVLEDIENIPAINNEHPGDFLDGFLQGTRAALSQGGRQSLSISMRRFDPRRLGALVALFERAVGLYGELVNINAYHQPGVESGKKAAAAILNLQSRVEALLADGVDRSAGEIHQVIGEGSEEAIFWIMRHLTANKRGYVAEGDWGIPTSLRFSKG

SEQ ID NO: 48360 - protein, 517 aa, Oryza sativa (japonica cultivar-group)
MASHAVTDALLLPRSEGAVAGAVDFRGRPASRASTGRWSAAMFVLGVEIAERFAYHGVSANLISYLTGPLGESTAGAAAAINLWSGVATMLPLLVACVADAWLGRYRTIVLASLLFVVSMGMLTLSSALPAFHGDGGGCSYTSKSLSCAPSTAQVAIFYVSLYLVALAEAGHKPCAQAFGADQFDQNDAKESVSRSSFFNWWYFGMCSGTAMTTMVSSYIQDNIGWGLGFGIPCLVMAFALAMFLLGTRNYRYYVSTQSSPFARLARAFVALIRGSKDEYVLIDFLSDVDSSTFFTKQAATLDRRIGESFRVPPAALQTFISVTIIAFIPVYDRAFVPVARRFTRASSGITMLQRIGTGLVLALAAMVVAALVEARRLGVARDAGMVDDPKAALPMSLWWMVPQYVLFGLSDVFAMIGLQEFFYDQVPDALRSLGLAFFLSIFGVGHFFSSFIISAIDGATKKSGASWFANNLNRAHLDYFYWLLAGLCAVELVAFVFVSRVYVYKKRVPHNGCDVM

SEQ ID NO: 48361 - protein, 430 aa, Xylella fastidiosa Ann-1
MTAIAKIYAREILDSRGNPTLEAEVTLENAVCGRAAVPSGASTGTKEAVELRDGDKTRYLGKGVRAAVDNVNGVIAAALVGFDGADQTGLDHRLINLDGTENKGRLGANALLGVSLATAHAVAAARKQPLWMYLSTLGESKLSLPVPMMNIINGGAHADNNVDFQEFMVLPVGFASFSEALRAGTEIFHALKSVLKGQGLSTAVGDEGGFAPDFRSNVEALDAILEAIGRAGYIAGEDVLLGLDVASSEFRDNGKYNLVGENKRLTSGQFVDFLDDLVAQYPIISIEDGLAEDDWLGWKQLTERIGHKVQLVGDDLFVTNPKVFQEGITSGIANAILIKLNQIGTLTETLESIAMAHRAQYAAIVSHRSGETEDTSIADIAVATTATQIKTGSLCRSDRVAKYNQLLRIEQALGVGARYAGRDAFVSLKS

SEQ ID NO: 48362 - protein, 238 aa, Oryza sativa (japonica cultivar-group)
KILAIKDFLEDEDQSEDELLSLLQSLADMDITYKALQETDIGRHVNGLRKHPSGEVRLLVKQLIRKWKEIVDDWVRLHNSSGDASNSIITDGNSPEKIQGKNQQSSQVSEFKYSPSPSRHNNSSSERVSNGIASIAATKHRASPAPAHHNARQINNTHHSTTSSSAPARMVKEQKDSHLDLERLDSARKRLQENYQEAQNAKKQRTIQVMDINEIPKPKNRNAFIRKGNGGGFPARHR

SEQ ID NO: 48363 - protein, 279 aa, uncultured bacterium
QPNAMGGREVGGLANQLAAHMDFSGPERERVKRFWQSPQLAEKPGLKAIELFQAAARGEIRFLWIMSTNPMVSMPDTSLVQRALEKVELVVVSDCMADTDTTAMAHVLLPAASWGEKNGTVTNSERCLSRQRGFLPSPGEAKPDWWILTQVAHRLGFRQQFPYQHAHDIFSEHARLSGFENKGSRDFDISALAQLSRQQYDALSPIQWPVNSDYPNGRQRFFEDGRFYTDNGKARFIATCCQLPQDIPATEFPTTELPTPDIPTMLNMNSGRIRDQWHT

SEQ ID NO: 48364 - protein, 266 aa, uncultured bacterium
QPNAMGGREVGGLANQLAAHMDFAAADRERVKRFWNAPGVAEKPGLKAIDLFKAAEKGDIKFLWIMSTNPVVSMPDADLIKRALKKVELVVVSDCMADTDTAAFAHVLLPAASWGEKNGTVTNSERRISRQRGFLPSPGEAKPDWWMLTQVAQRLGFSEQFDYQKPYDVFIEHARLSAFENEGKRDFDLSGLADINEAQFEALAPIQWPVNNTFPQGRARFYDDGYFYTPSGKARFVSNAAIMPERVDQPGLLSMNTGRIRDQWHT

SEQ ID NO: 48365 - protein, 519 aa, Solibacter usitatus Ellin6076
MRMPANAAQRAQESAIERRTKILLVDDTPENLVSLEAALAGLGEELVLASSGKQALRHLLEDDFAAILLDVRMPEMDGFETAELIRSRPRSRQTPILFLTGYRNEEHLFRGYDLGAVDFLFKPIVPEVLRSKVAVFVELSRTNAKLKEQTDALRVQAEVLQKAEQRFRSLLEAAPDAMLVCREDGEIVMVNSQAEILFNSHRDKLVSRSIRSIVPGWGWQSGQPVQRGIELLAYPDGRAPFQAEISFSPVQTEEGVVVTCSIRDITERKKTEERIRELNSNLEERVVERTEALMRSNEELQQFAYVASHDLQEPLRTVSIYAQLLAKRYQGQLAGDADQFIRFIVEGSERMEKLIHDLLDFSRVDARGTDYFTRMSCDEALNDAIGNLYSLIDENAAVITRGPLPSLTGDPVQLTRLFQNLLVNSIRYRSEAAPRIQVEAQEQNGEWLFSVQDNGIGIEPQYAEKIFGIFRCLQPRDKSSGSGMGLAICRKIVSRHEGRIWVESALGEGAKFYFTLPRK

SEQ ID NO: 48366 - protein, 275 aa, uncultured bacterium
QPNAMGGREVGGLSNQLAAHMDIDNEVHRGIVQRFWNSPGIADKQGLKAVDLFEAIHDGKIKAVWIMSTNPVVSLPGADRVKSALEKCEYVVVSDCMEKTDTTSLANVLLPAATWGEKNGTVTNSERCISRQRSFLSSPGEAKPDWWAVAEVARRMGFVDGFDYAAPHEIFREHAELSGFENQDSSEKRRDFDISALTDIDSDMYENFDPVQWPVYKNAQGAITGTPRMFADGKFFTPNQKARIITVEPRLPVNNTSTEFPLILNTGRCRDQWHT

SEQ ID NO: 48367 - protein, 174 aa, Arabidopsis thaliana
MVYHSSFVDEEGITKACGCPLLPLKSHIKGPAPISEQDKTDIVDEAITFFRANVFFTNFDIKSPADKLLIYLTFYINVALKRLEGCRTLAVGTKAIINLGLEDIPVPGETGFPFPGLFSLPQSQDEAELFRNYLKQVREETSGRLLSVAYRANGTPNKWWLAFAKRKFMNVVVL

SEQ ID NO: 48368 - protein, 266 aa, uncultured bacterium
QPNAMGGREVGGLANMLAAHMELDNEAHRDIVQTFWQSPKIVNKPGLKAVDLFNAIDEGTIKAVWIMATNPAVSMPDADKVREALYKCEFVVVSDIMQSTDTTACAEVLLPALGWGEKDGTVTNSERRISRQRAFLSAPGEAKADWWVICQVAKRMGYAKAFEYKNSYEIFKEHARLSGYENQGTRDFDIASLADQTFQQYDEILPVQWPTQGHQGTARMFTTSRFYTPNKKARFIPVTPRLPVNLTSGAYPLILNTGRVRDQWHT

SEQ ID NO: 48369 - protein, 267 aa, uncultured bacterium
QPNAMGGREVGGLANQLAAHMDFSEQDIETVKTYWNSPNIAKQPGLKAVDMFNAITSGQVKAVWIMATNPLVSMPEADKVRQALKQCELVIVSDCVKQTDTTELADVLLPALAWGEKDGTVTNSERRISRQRAFLPTPGEAKADWWIINEVAKRMGFNDAFNYQSPDEIWREHAALTAANNDGQRDFDLTGLKDLSKSDYSRLQPVQWPCRDNSSTDKNHMFEDRHFFHPDKKARFIPVKSCGDFPKASVEYPLILNSGRIRDQWHT

SEQ ID NO: 48370 - protein, 135 aa, Synechococcus elongatus PCC 6301
MAMSAVLSGGLNFPAKTLRRATRAAACSPFRLGLFLALRQTAVPLQDIAGTAGIAQGYSRRNLNELIAENELMWLMQVGLLRREVDGQGLTNRFRLTPLGQQLVLIWQQQGDRLPPAGLRDRFYNAVCRWLRLPF

SEQ ID NO: 48371 - protein, 413 aa, Glycine max
MGASGKWVKALIGLNNKSDLGGKKKKWRLWKSSSAGENRSQGNDYASSVASDSFNFAVATVVRAPPKDFKLLKQEWAATQIQTAFRAFLARRALRALKGVVRLQALVRGRLVRKQAAVTLRCMQALVRVQARVRARRVRMSIEGQAVQIMLNERRTKAELIKQAEEGWCDSKGSLKDVKTKLQMRQEGAFKRERAIAYSLAHKQWRSTPISNSRANAALNNHEMDKANWGWSWLERWMAAKPWESRLMEQTHHADATEKTPPPPPPKKCVDSSNSKTSELCNIKIRKNNVSTRISARPPHIGQATRLSSSPSSEFHYDESCSNSSSICTSTTPIPCDRTEDSNNSRPSYMNLTESTKAKQKTSNHQYNRSQRQQSMDEFQFLKRTAVFSNASDPSTNFSRPLYLPTYMDKSSR

SEQ ID NO: 48372 - protein, 130 aa, Triticum aestivum
VSSGCLNSGDWMNGSAVRPNFLDFQGLDFEAAFGLRRAYSEGDIQKLGANNPRPGIAGNVQASGERLVTISDLKSEERKQKLNRYRKKKIQRNFGRKIKYACRKALADSQPRVRGRFAKMDDGDMLKPRK

SEQ ID NO: 48373 - protein, 517 aa, Zea mays
MASELSHGTRRDVCIESMARPIAVDHRISIHYYFRIADNLLRQANVYREEKNVLDLYILLLRYSSLLLETIPKHRDYNAFKAREKEFLKKGPHNSEKILGIVNELESLKPVVQQQIATGNSRGADEPNGVYGTYAASSELEHHTSGPYVSKSLSGSPTRLLQKPLPGSKHQAAMSQNVQPYRHAMKPSTNMLYPKEETLSRHSILGPNGLQGNLGQWARPVTGIRIEYPHNPELTQSDISSLMPTTLNQDGLRGPSTASQGKSDDMLSVLSLDDGRWSLPLEPASVSPGLEAEFSHLNIRQPSPPPVLAQVHPEHGQIPPSRVADPRPGLATSATGRYQNLHVPVALMECFLRVAELNTAKNLETCGILAGTLKKRTFYVTTLIIPKQKSTSDSCQATNEEEIFEVQDKGSLLSLGWIHTHPTQTCFLSSIDLHNHYAYQIMLPEAIAIVMAPTDTTRKHGIFHLTEPCGMGVIHDCDATGFHPHEEPLDGTPIYEHCSHVYMNPNVRFEMTDLREA

SEQ ID NO: 48374 - protein, 483 aa, Oryza sativa
MASSNSTSSARRRAARAPPPPNLGDLSGVSAPLPSNGLHAPSISTHPTRAATPNPSPPGASIVVVVRPAMQPASPVSGDAGPVAEAVPPRGAPQVLVRRRSVPFSPDSPLAPGSRGGGERRSTFREDVSHAAAETYLVTRLAFILLRYLGVGYRWISQLAALIIYAILLMPGFIRVGYYYFFSRQVLRSVIYGDQPRNRLDLYIPRDPKKPSPVVAFVTGGAWIIGYKAWGALLGRRLAERGIIVACIDYRNFPQGTISDMVSDASDGISFVCETVGAYGGDPNQIYLMGQSAGAHIAACALLEQAAKESRGEQISWSVTQIKAYFGLSGGYNIENLVDHFHERGLYRSIFLSIMEGKKSLPHFSPETVAKKLCPETIALLPQIVLLHGTDDYSIPFSASETFAGVLKQAGAKAKLLLYEGKTHTDVFLQDPLRGGRDKLVEDVISVIHADDADAREKDALAPIPGRLVSEWQIKLAHRISPF

SEQ ID NO: 48375 - protein, 347 aa, Aspergillus oryzae
MASQTGLDVLRYLVTHIGLCIDNPLVARTLGPFQDCTSNQAIAYGELSKPKHKELITSSVAEARNLLSRFPGLALEELAVEIAMVKLALRIAPHINGHVHIQTNPYYSYSVEKTTVNALRIIQLFQYLQPGFEQSRICIKIPSTWEGMVACRALEQAGVRTLATTLFTLTQAVLAAEVGCTYVAPYVNQLKVHFEPGFTDPNKLLPLCVAIQKYYKSVNAKTQFLPASLTSTDEIFAMAGVDHITIAPNLLQQLSQPDSVPQIQSLFDSDAPAVLPPSSLSFVNDESAYRLAFTRDLHGASEEKLTQVRELGSRFFKTSVLTHSYIQAVNIFCDMQDKLVQIMKSVV

SEQ ID NO: 48376 - protein, 759 aa, Oryza sativa
MASSHHQEVQEQGHGDGEEEEQDNSQITSPLLRSSMRLGSPEENSPVEQVALTVPVGDDPATPVLTFRIWVLGTASCVVLSFLNTFFWYRKEPLTVTAISAQIAVVPLGRLMAAALPERVFFRGRPWEFTLNPGPFNVKEHVLITIFANAGAGSVFAINVITAVRVFYGKRISFFVSLLVVLTSQVEVTSTCSQFNNKTHPASSSSEFYATIRRFRRLGHSAMQVHAAAENQNSVYLEISQFFLVAFVCSFAYYIFPGYLFQMLTSLSWICWIFPKSVLAQQLGSGLHGLGIGAIGLDWSSISSYLGSPLASPWFATANIAAGFFIYIYVITPIAYWINLYKAQNFPIFSDGLFTVTGQKYNISTIIDSQFHFDTKAYEKNGPLYISTFFSISYGLGFACLTATVVHVLLFHGRYPPLPSPSRYTKLMKRYKQVPEWWFISILIASVAITMFTCEYYIEQLQLPWWGVLLACALAIFFTLPIGIVTATTNQTPGLNIITEYIMGYLYPGRPVANMCFKVYGYIGPQQALAFLQDFKLGHYMKIPPRTMFMAQQVVGTLIAAFVYLGTAWWLMDTIPNICNTELLPPGSPWTCPYDHLFYDASVIWGLIGPRRIFGDLGTYSAVNWFFLGGAIAPLLVWFAHKAFPGQKWILLVNMPVLIAGISQMPPATSVNYTAWIFVAFLSGYVVYKYRRDWWERHNYLLSGALDAGLAFMAVLLYLCLGLEKISLNWWGNDLDGCPLASCPIAEGITVQGCPVASA

SEQ ID NO: 48377 - protein, 303 aa, Yarrowia lipolytica CLIB122
MLSSDLESFQKHLLSSRKILALVGAGLSQSSGLPTFRGEGGIWRNYDAAELATPEAFHNDPSTVWQFYAHRRHMSLKAKPNPGHYALAELARRLRGRFLTLTQNVDGLSSRAEHPQEALLKLHGDLFALKCTSFFCSYTTEDNFADPLTPALSITDNYNSAQLQRHRIPVEDLPTCPHCKEGLLRPGVVWFGESLPFKVMNTADEFLEDEDVDLIIVVGTSGSVWPAAGYVERVALSGGKVAIFNMEIDHYQYGESEAETTDSEDSSNEDAVIEGWAFKGNASEWLPKALEPVIGRAFMKRRS

SEQ ID NO: 48378 - protein, 499 aa, Yarrowia lipolytica CLIB122
MLRTTRILPSKFGVAARTRAVTQFQRCYSSANEELDVLVIGGGPGGYVAAIKAAQAGLKTGCIEKRGSLGGTCLNVGCIPSKSLLNNSQMYHAIKTDSANRGIEVSDVKMNIAKLQEAKETSVKGLTGGIEMLFKKNKVNYYKGAGSFVSDSEVKVDPIDGGEAVTLKAKNIIIATGSEPTPFPGITIDEKKIVSSTGALALEAVPKKMVIIGGGIIGLEMGSVWSRLGSEVTVVEFQNAIGAGMDDEIAKAAQKMLTKQGIKFKLGTKVLSGAIEGDGVKVEVENVKKGDKETLDADVLLVAIGRRPYSEGLNLEAAGVEKDDKGRIIIDQEYRTNKSNIRCIGDVTFGPMLAHKAEEEGVATAEYIATGHGHVNYAAIPSVMYTHPEVAWVGQTEQQVKEAGIKYNVGKFPFAANSRAKTNLDTEGTVKFIADKETDRILGIHIIGPNAGEMIAEGVLALEYGASCEDIARTCHAHPTLSEAFKEAAMATYDKAIHF

SEQ ID NO: 48379 - protein, 755 aa, Bacillus cereus G9241
MKALVVATTLAIPFAAYSTPALAALKAEANQSMVAASERTYATEIKIYKDQKDEPSMVSQYIKDPKVTIAAGKKIVTVTIQDSDYFQYLRIEDRNQPGVFHDVKVLSEDKRKNGTKVVQFEIGEFEKKHNMQMHILIPAIGYDHKYQVQFEIKDPTVGNKETEKPDDNSNSGNTETDYPVDNQNMITDNKLRELVNKKVFNRKDLNTPITKEELLQVKDLFLNTNEILDYSALKYMPNLKSLTVANAKIKDPSFFTSLKQLKHLALRGNEFSDVTPLVKMDHLESLDLSNNKITNVAPLIEMKNVKSLYLSGNQIEDVTALAKMEQLDYLNLANNKITNVAPLSALKNVTYLTLAGNQIEDIKPLYSLPLTDLVLTRNKVKDLSGIEQMKQLEELWIGKNEIKDVTPLSKMTQLKELHLPNNELKDITPLSSLVNLQKLDLEANYISDLTPASNLKKLVFLSFVANEIRDVRPVIELSKTAYINVQNQKVFLEETEVNKEVKVPIYEKDGKISTKIRLKSGGGTYSNDAVKWSTSGEKIYEFGVKDPFADTGIFFTGSVIQNVVESQGDNTSKEDEKVEAVEFKDVPKGHWSEEAINYLAKENIFKGYGNGQFGFGDSITRGQVASLVQRYLKLENKVEQKERFTDTKGHMFEQDIATVAQAGIMQGDGTGEFRPDGVLTRYEMSVVLYKVFQLKEDENNKMNFNDVPTGHWAEGYVKALADNNISKGDGKGNFLGDDFVTREQYAQFLYNAITK

SEQ ID NO: 48380 - protein, 339 aa, Populus trichocarpa x Populus deltoides
MPTKEQVGALSKELRDRALVHDYVFKAIDALPVTAHPMTQFATGVMALQVQSEFQKAYEKGIHKSKYWEPTYEDSLSLIARVPIVASYIYRRIYKDGKVIPMNDSLVIGGNFSHMLGFDSPEMQELMRLYVTNHSDHEGGNVSAHTGHLVASALSDPYLSFAAALNGLAGPLHGLANQEVLLWIKSVVEECGENITTEQLKDYVWKTLNSGKVVPGFGHGVLRKTVPRYTCQREFALKHLPDDPLFQLVSKLYEVVPPVLTQLGKVKNPWPNVDAHSGVLLNYYGLTEARYYTVLFGVSRSIGICSQLIWDRALGLPLERPKSVTMELLENHCKKAPAN

SEQ ID NO: 48381 - protein, 744 aa, Oryza sativa (japonica cultivar-group)
MDFFLTVTDSSIGPPGAAQYANGLLGLDARGAAHCWKTRIGRGEGGKWVAARRRGGAAGRGGRWPISPALVERSGVGEASPAAGRRRGGWEAVMETAHEVAIYIDRFHNLDLFQQGWYRLKISAAWEEDEYRAPVSPARVVQYEVPDIGSKGAFGLWKIDDVDNSFYTQPFQIKYSRQDIYLSVMVSFYIPNTEDEGPATSSVILKFELIYVPTLEDRTEIEDPSDIYVPVHEFRIPYKALLGLHAYFPVHFDAFHPVLVDLTMHIVYLKAGVTKSSQKASEQGLCSKSCYIIKALLSSREILLEEVMKMSAGIGKTLEDLDDADLTLGKHEPIDSSKAGLPKYSKGLYIPTKCIGHLTGVLHDLIERSDNVVRSTNDILLYTLSKEDLLELFQAVSDQVSFLWNAFLKFHSLSGKSSPRHSLLRSSSSRKLHPDPVQNSSSRAELHRRSIAQMKGHHLDLRLIRNQWILCDPGAECLLSQTNEDRTCGDFKEMGRRLSNEVVAFLKRKIDRYSRNGGCKDLKLSFVGHSIGNIIIRSALADPKMQPFLKNLYTYMSISGPHLGYWYSSNSLFNSGLWLMKRLKGVQCMHQLTFSDEQDPQNTFFYKLCKLNTLDNFKNIILVSSPQDGYVPYHSARIDSCPASSSDNSKKGQVFTEMLNNCLDQLRAPSSETRVFMRCDVSFDQSSHGRRRSLNTMIGRAAHIEFLENDLYARHTHTHTHTHTRKPSVNKKLKVRYRNRSKKV

SEQ ID NO: 48382 - protein, 295 aa, Photorhabdus luminescens subsp. laumondii TTO1
MNIIFPFLAVLIWSINAVVSKASATAIDPAAISFYRWFLAFLTLTPFVVLSVIRRWKTICQYWWKLLILGALGMVLYQSLAYYAAHSISATFMGILSSLIPLLTVIISIFVLRVVPTVGLALGTVLSLSGLIWLVSAGDPISLLQHGLGRGELMMLLASISYALYGVLTKHWSIPLPNWQSLYVQITFGVLLLLPNFLLTKDVQLNASNISLVLFAGIPASIIAPYLWIQGVIKLGANTTTIFMNLTPIFTAIIAILVLHEEMHSYHLIGGSITLLGVILAQQLRTPLIRKTSGN

SEQ ID NO: 48383 - protein, 345 aa, Ralstonia solanacearum GMI1000
MKALVYEGPGKISLENKPKPELQAPGDAVVRVTLTTICGTDLHIIKGDVPTCEPGRTLGHEGVGVIESVGAAVTSLKPGDHVLISCISSCGKCANCRRGMYSHCETGGWILGHRIDGVQAEYVRVPHAETSLYKVPPGVDEEALVMLSDIFPTGFECGVLNGRVQPGSTVAIVGAGPIGLASLLTAQFYSPARIIMIDTNVARLEVASGLGASDCINVTRENAAAAVKRLTDGMGVDCAIEAVGVPATFELCQELVAPGGVIANIGVHGVKADLHLETLWSQNIAITTRLVDTVSTPMLLKTVRAGKLLPGQLITHRFKLDDILAAYDTFRNAGETHALKVIIAT

SEQ ID NO: 48384 - protein, 1282 aa, Oryza sativa (japonica cultivar-group)
MDAGAEPLLPPPASAVDHLGRPASRRTSGRWLAALFIIGTSKKLPPRNQGGGCCGGESTSKRRRALTALSLSLSPELIRVQLPSVAIAGVEISERFAFGGISGNLITYLTGPLGQSTASAAAAINAWNGAALLLPLLGAAVADSWLGRYRIIICASLLYILGLGMLTLSPVLVPHQQAESGDNADNNASSSMDIHVAFFYLSLYIVAFAQGGHKPCVQAFGADQFDENDPEECASRSSFFNWWYFGIYGGNVITVSILNYIQDNIGWQLGFGIPCIAMSLSLAVFLLGTKSYRFYPLRSNTSLFDQVGKSLLAKIRWWCASWCSKSSGDLHCTQASSSQGDHNDAEKACFPDEATAVLKLFPIGATCLIYAIVFAQWITLFTKQASTLDRWIGKVHIPAAALQSLISVSIVISVPIYDRILVPLTRRYSKNPRGITTLQRIGIGLIISVILMVVSALVETRRLMVARDFGLVDNPEATIPMSFWWVVPQFILTGLADMFTMVGLQEFFYDQVPDGLRSLGLALYLSIFGIGSFISSFLVYAIDKVTSMTGDSWFSDNLNRGHLDYFYWLLAVLSVLGLAAYLHFSRVYVHKKKGISVHLERFAWRRRSSLGATARAEVGERFAYSGIMGNLVIYLTGPLRQPTAAAAAAVNVWMGTSMLLPLLGSAVADSWLGRYRTIVCASLLYILGLGMITVSSVLAPEESSESSNLAAHVAFFYFSLYVVAFAQGGHKPCAQALGADQFDENDPGELASRSSFFNWWFFASYGGNTVTVPILNYVQESVSWQLGFAIPCIAMAVSLAIFLIGTRSYRFYPPKSKGNPFGEVAEWIRRWIASSCSKLPDSSDELLPSSSSEGDVSNSSSEFVPKEAAELVKLFPIWASSLIYAAVMAQCITFFTKQASTLDRRVGSLVLPAASNGALFNATIMVFLPIYDRIFIPVARRYTKNPSGITTLQRIGVGLVLSIITMIVAAMVEMRRLRIARDFGLVDKPEAVVPMSFLWIVPQNILAAISDMFAVIGLQEFFYGEAPESLRSFSMALFLSIIGVGNFISSFIVYAIDRVTSSFGDSWFSNNPNRGHVDYFYLLITVLNALSLACFLYFAKMYEHRKKWDSGCEQHLPMAYKMKGVFKGLKVISQIFVVKEHQMEIGYPTDVKHVTHIGWDSPTGSAASPSWMNDMKGSPDYSSLNNFGPSTGTSWTSQVCSTDFDHPQDISPFGLYVENAGKEANPPHPDIPKPPRKSRRKKSKNNSPTASSRSSRSRSKRSFSSTADTVVDNSIQNEVRIV

SEQ ID NO: 48385 - protein, 267 aa, uncultured bacterium
QPNAMGGREVGGLANQLAAHMGFSEQDIETVKTYWNSPNIARQPGLKAVDMFNAITSGQVKAVWIMATNPLVSMPEADKVRQALKQCELVIVSDCVKQTDTTELADVLLPALAWGEKDGTVTNSERRISRQRAFLSTPGGAKADWWIINEVAKRMGFNDAFNYQSPDEIWREHAALTAANNDGQRDFDLTGLKDLSKSDYSRLQPVQWPCRDNSSTDKSHMFEDRHFFHPDKKARFIPVKSCGDFPKASVEYPLILNSGRIRDQWHT

SEQ ID NO: 48386 - protein, 466 aa, Glycine max
KTFPTFDPRTGDVIANVAEGDAEDVNRAVHAARKAFDEGPWPKMTAYERSRIILRFADLLEKHNDEVAAIETWDSGKTYEQAANVEIPMVVRLFRYYAGWADKIHGLTVPADGPYHVQTLHEPIGVAGQIVPWNFPLLIFSWKVAPALACGNTVVMKTAEQTPLSALYVSKLFLEAGLPPGVLNVISGFGPTAGAALCSHMDVDKLAFTGSTSTGKRVLELSAHSNLKPVTLELGGKSPFIVCKDADVDAAVEASHFALFFNQGQCCCAGSRTFVHESIYGEFVEKAKARALKRVVGDPFKNGVEQGPQIDSVQFEKIMKYIRSGVESGAQLESGGQRIGSKGYYIQPTVFSNVQDNMLIAKDEIFGPVQSILKFKDLEEVIRRANATSYGLAAGVFTKNMDTANTLMRALQAGTVWINCYDVFDAAIPFGGYKMSGQGRVRGIYSLRSYLQVKAVVTALKNPAWL

SEQ ID NO: 48387 - protein, 401 aa, Arabidopsis thaliana
MATKRSVGTLKEADLKGKSVFVRVDLNVPLDDNSNITDDTRIRAAVPTIKYLMGNGSRVVLCSHLGRPKGVTPKYSLKPLVPRLSELLGVEVVMANDSIGEEVQKLVAGLPEGGVLLLENVRFYAEEEKNDPEFAKKLAALADVYVNDAFGTAHRAHASTEGVAKYLKPSVAGFLMQKELDYLVGAVANPKKPFAAIVGGSKVSTKIGVIESLLNTVDILLLGGGMIFTFYKAQGLSVGSSLVEEDKLDLAKSLMEKAKAKGVSLLLPTDVVIADKFAPDANSKIVPATAIPDGWMGLDIGPDSIKTFSEALDTTKTIIWNGPMGVFEFDKFAAGTEAVAKQLAELSGKGVTTIIGGGDSVAAVEKVGLADKMSHISTGGGASLELIEGKPLPGVLALDEA

SEQ ID NO: 48388 - protein, 271 aa, uncultured bacterium
QPNAMGGREVGGLANTLAAHMDYDSPGARSRVADFWGTGAVADGPGYKAVDMFEAVHRGDIRVIWIMGTNPAVSLPDSARVREALARCPTVIVSDCVAHTDTTDLADILLPAAGWGEKDGTVTNSERRISRQRCFLPLPAEVKPDWWIMSSVAGKLGFGEAFNYKRPADIFREHAALSAHENNGERLFNLAGLANLSDAGYEALIPVQWPVMEGAGVEAEGSTRLFSDGRFVTDNQRARFVAINTRLPAQQTSDDYPMVVNTGRIRDQWHT

SEQ ID NO: 48389 - protein, 271 aa, uncultured bacterium
QPNAMGGREVGGLANTLDRSHGLRSPGARSRVADFWGTGAVADGPGYKAVNMFEAVHRGDIRVIWIMGTNPAVSLPDSARVREALARCPTVIVSDCVAHTDTTDLADILLPAAGWGEKDGTVTNSERRISRQRCFLPLPAEVKPDWWIMSSVAGKLGFGEAFNYKRPADIFREHAALSAHENNGERLFNLAGLANLSDAGYEALIPVQWPVMEGAGVEAEGSTRLFSDGRSVTDNQRARFVAINTRLPAQQTSDDYPMVVNTGRIRDQWHT

SEQ ID NO: 48390 - protein, 268 aa, uncultured bacterium
QPNAMGGREVGGLANTLTAHMTLENSDHRALVKEFWQCGDLPDKAGLKAVDLFNAVNEGKVKAIWVMGTNPVVSMPNANLVREALQKCDFVVCSDAVKRTDTLDLAHVKLPAAGWGEKSGTVTNSERRVSRQRAIFPLHGDAKPDWRIVSEVAKRMGFGAASDYQSPREVFVEFAALSGYQNKGERDFDISAYAELAEAEFEAMTPKQWPITAETLDGTPRMFVDGRYFTPNRKAKFIPTIARAPQEKVSDDYPLILNTGRIRDQWHT

SEQ ID NO: 48391 - protein, 318 aa, Arabidopsis thaliana
MMGNKRNLGFVIFFWALVVAVVATAIEHRRNERTKGVNGLDKIIIRDRRGRSAEVYLYGGQVSSWKNENGEELLVMSSKAIFQPPTPIRGGIPVLFPQYSNTGPLPSHGFVRQRFWEVETKPPPLPSLSTAHVDLIVRSSNEDLKIWPHKFEYRLRVALGHDGDLTLTSRVKNTDTKPFNFTFALHPYFAVSNISEIHVEGLHNLDYLDQQKNRTRFTDHEKVITFNAQLDRLYLSTPDQLRIVDHKKKKTIVVHKEGQVDAVVWNPWDKKVSDLGVEDYKRFVTVESAAVAKPITVNPGKEWKGILHVSVVPSNRKA

SEQ ID NO: 48392 - protein, 500 aa, Escherichia coli
MMTEPHVAVLSQVQQFLDRQHGLYIDGRPGPAQSEKRLAIFDPATGQEIASTADANEADVDNAVMSAWRAFVSRRWAGRLPAERERILLRFADLVEQHSEELAQLETLEQGKSIAISRAFEVGCTLNWMRYTAGLTTKIAGKTLDLSIPLPQGARYQAWTRKEPVGVVAGIVPWNFPLMIGMWKVMPALAAGCSIVIKPSETTPLTMLRVAELASEAGIPDGVFNVVTGSGAVCGAALTSHPHVAKISFTGSTATGKGIARTAADHLTRVTLELGGKNPAIVLKDADPQWVIEGLMTGSFLNQGQVCAASSRIYIEAPLFDTLVSGFEQAVKSLQVGPGMSPVAQINPLVSRAHCDKVCSFLDDAQAQQAELIRGSNGPAGEGYYVAPTLVVNPDAKLRLTREEVFGPVVNLVRVADGEEALQLANDTEYGLTASVWTQNLSQALEYSDRLQAGTVWVNSHTLIDANLPFGGMKQSGTGRDFGPDWLDGWCETKSVCVRY

SEQ ID NO: 48393 - protein, 565 aa, Oryza sativa (indica cultivar-group)
MDEEARAAGCSPAPPRAPAASCGAAAELCLCSPTGVEGIEQVPGCPCFEDAGAVVVSGEAPEGPGVLCSEDGAELKLAEQGALDVRLGSPAVGIHEQQLLHRGTSGSDEAGAINEISPVEVSPSEASSNLDTAGAIGGSPLMLESLPETSDTRGCEQEVMPGVVVGSSNRDASSEVGVESECGSDADGRNGLGEGELVSSVDGGGAEKSSKVTGVLSEEGVDGMETALEPCVASVGSITQVEEGVDRMETSLDDSEASDGSTTQDFDTDVETESSGSSIEEQDTGYGVHIPHTEQAICEVARGNKSSEVKSSDRMSSVTLPTLILASGAAMLPHPSKVLTGGEDAYFIACDGWFGVADGVGQWSFEGLYARELMDGCKKAIMESQGAPEMRTEEVLAKAADEARSPGSSTVLVAHFDGQVLHACNIGDSGFLVIRNGEIYQKSKPMTYGFNFPLQIEKGDDPFKLVQKYTIDLQEGDAIVTATDGLFDNVYEEEIAAVISKSLEAGLKPSEIAEFLVARAKEVGRSATCRSPFSDAALAVGYLGYSGGKLDDVTVVVSVVRKSEV

SEQ ID NO: 48394 - protein, 410 aa, Pseudomonas putida KT2440
MTAPFTLLAEAVRQHGSPLWAYDTRTIADRVEQLNVFDTVRFAQKANPNLHVLRLMRAHGLVLDAVSLGEMERAFAAGASVDGDPAGVVLTCDALDRPTLERVVASKIEVNAGSIDMLHQLGERSPGHRVWIRINPGFGHGHSRKTNTGGENSKHGIWHEELDEALACIKAHGLHLVGVHMHIGSGVDYQHLEQVARSMIELIGRLGVDIEAFSIGGGLSTPYRSTDKPVDLQRYAQTWAVARKEIEAMLGHPVRMEIEPGRFLVAESGYLVAEVRAVKQVGRNTFVIIDAGFNDLMRPAMYGAYHGMTLLDADGQAVDRPRQPTVVAGPLCESGDVFTQDDQALTPQDLPQAQVGDLLVIHDAGAYGASMSSNYNSRPLLPEFLIENGALRMIRRRQTVQDLLSLEADF

SEQ ID NO: 48395 - protein, 376 aa, Yarrowia lipolytica CLIB122
MDIALETIDTFVFDYVYAKVLPYKMKLAPQVAKFLRVQDFSKSLIDRNTGFFFPEAAAKLATAKNPEFYGEPVFWKHAYDHVLACGSIFARDHIIRQIISFTIITATFGALLYLSFATLSYLFVFDRDTFNHPRFLKNQITLEITQALSAIPFMSLCTAPWFVAEVRGYSRMYLEVEKHGWLYLILQFPLFLMFTDCGVYLIHRGLHHKWVYKHLHKPHHKWIMPSPFASHAFHPLDGYFQSLPYHIFPFLLPLNKISYLILFTFINFWTIMIHDGEFLVNSPVINGTACHTVHHLYFNYNYGQFFTLWDRVGGSYRQPEDEFFDHSLRKDEQTIRRQVGEFEKIRAKEESADDRVYVGDTAAKKTVAVKRNTKQD

SEQ ID NO: 48396 - protein, 348 aa, Kluyvera ascorbata
VAQRPDTHGYSTSRGIPRLRRAISRWYHDRYDVEIDPESEAIVTIGSKEGLAHLMLATLDHGDTVLVPNPSYPIHIYGAVIAGAQVRSVPLVQGVDFFNELERAIRESYPKPKMMILGFPSNPTAQCVELEFFEKVVALAKRYDVLVVHDLAYADIVYDGWKAPSIMQVPGARDVAVEFFTLSKSYNMAGWRIGFMVGNKTLVNALARIKSYHDYGTFTPLQVAAIAALEGDQQCVRDIAEQYKRRRDVLVKGLHEAGWMVEMPKASMYVWAKIPDKYAAMGSLEFAKKLLQDAKVCVSPGIGFGDYGDTHVRFALIENRDRIRQAIRGIKAMFRADGLLPSEHKSAE

SEQ ID NO: 48397 - protein, 325 aa, Gibberella zeae PH-1
MATLLARPQAQLSPAEALHLAQQAPTILKGNPKAFSASPLVSLFSAAETVELWTIYENLIVTCLQTGDDDSAHLCLERLILRFGGENERVMALKGLIKEAEATNNNELSAVLKEYEDILQQDGTNIYIAKRRVALLRSMGKTPEAISSLVSLLEFNPTDAESWAELSDLYLSQGLYSQAIYALEEVIVLAPNAWNLHAKLGEVTLMAANETSDGSPQKYLANSVKRFCRSIELCEDYLRGYYGLKKVTDKILAEATKFKKQQPEEDEFSLPDQDTLKKLNQAATQKLAEIVRRYGAQEPLWQGYNVDEIAAARELLDKSSSEVVR

SEQ ID NO: 48398 - protein, 249 aa, Triticum aestivum
  misc_feature (65)..(65): Xaa can be any naturally occurring amino acid
  misc_feature (126)..(126): Xaa can be any naturally occurring amino acid
  misc_feature (164)..(164): Xaa can be any naturally occurring amino acid
MDPKIGGNGISRAAPLEALLFDIDGTMCVSDPFHHRAFSELLQNLGYNGGAPITPEFGMAHMAGXRSNEQIGRFLFPDWPQARLDAFFAEKEALFARYAGEGLREVPGLAELCRWARERGLKRAAXTNAPRANAELMIGILGLADFFQLVVAGEDCGEGRSKPXPRPYSARLTAGAPADRLWCLMVFEDSRRRRPAPGVAAGMPRRGCSRARPREPQGSVPRPARTMVVRDYRDAELWPALDPRRRSPR

SEQ ID NO: 48399 - protein, 338 aa, Cryptococcus neoformans var. neoformans B-3501A
MFYVIGLGLSDEKDITVKGLEAVKNSARVYLESYTSILMVEKEKLEAFYERPVITATREMVELEADDILKDADKVDISFLVVGDPLGATTHSDLLLRAQSRNIPTSIIHNASILTALGSTGLQMYSFGQTLSLPFYTETWRPDSWYPRLEENLRLGVHTLVLLDIKVREQSEENMARGRLIYEPPRFMNPAQAFNQMLLTESIRHPAPRHPSQSQSTDQTQKPSQLPSSSHSDSEEEEEEEAERVDPYPSLMPPSQTLAISLSRVGTPSQRLISGTLSELAALDEEEFGGPLHSVVIVGKRLHPLELEYAGKFAVGGEQGDWWKVGKEVYGVERETFY

SEQ ID NO: 48400 - protein, 271 aa, uncultured bacterium
QPNAMGGREVGGLANTLAAHFEFGDPQSHQTVSDFWQTDNLATRAGLKAIDLFDAMNDGKIKAVWVMATNPVVSLPDSEKIKAAIEKCPFVVVSDCIADTETTRLADVVLPAQGWSEKSGTVTNSERRISRQRRVLPSPGEAKPDWWILKEVAQKMGFKDQFDYRHEGEIFKEYCEMTALGNETGKARDLCLIGLTKLDEKGYGELTPQQWPVLEYQPEIIEQRMFTNGEFFTESGKAQFIAVEHDKPIADTSVEFPLIMNTGRIRDQWHT

SEQ ID NO: 48401 - protein, 271 aa, uncultured bacterium
QPNAMGGREVGGLANTLAAHFEFGDPQSHQTVSDFWQTDNLATRAGLKAIDLFDAMSDGKIKAVWVMATNPVVSLPDSEKIKAALEKCPFVVVSDCIADTETTRLADVVLPARGWSEKSGTVTNSERRISRQRRVPPSPGEAKPDWWILKEVAQKMGFKGQFDYRHEGEIFKEYCEMTALGNERGKARDLCLIGLTKLDEKGYGELTPQQWPALEYQPDIIEQRMFTNGEFFNESGKAQFVAVEHDKPIADTSVEFPLIMNTGRIRDQWHT

SEQ ID NO: 48402 - protein, 246 aa, Staphylococcus epidermidis RP62A
MKKPDIQQLKDIVNNSNQIVFFTGAGVSVASGIPDFRSMGGLYDEISKDGQSPEYLLSIDHLHDNKESFINFYHERLLIADKKPNIVHQWIAQLENQQKSLGVITQNIDGLHEDAGSHNIDELHGTLNRFYCINCYEEYSKSYFMTHHLKYCEKCGNVIRPDIVLYGEMLNQKTVFKALDKIQHADTLIVLGSSLVVQPAAGFVSEFKGDNLVIINRDATPYDHTASLVIHDDMTSVIEEIVNSNS

SEQ ID NO: 48403 - protein, 267 aa, uncultured bacterium
QPNAMGGREVGGLANQLAAHMDFAEQDIETVSTFWNAANIARQPGLKAVDMFDAILSGEIKAIWIMATNPLVSMPEVHKVRQSLENCELVIVSDCIQDTNTSQYADVLLPALAWGEKDGTVTNSERRISRQRAFLDAPEEARADWWIVNEVAKRMGFEDAFSYQTIDEIWREHAALSAFENNGQRDFDLSGLMDLPAEDYDQLQPLQWPFYRNASPDKSHMFEDRGFLSCRLKARFIPVQRCSELSLTSVEYPLILNTGRIRDQWHT

SEQ ID NO: 48404 - protein, 312 aa, Solibacter usitatus Ellin6076
MTPGNPTLQHEASAQSNPIRIVVLGEVLWDVFPDSVRLGGAPLNFAVHASRMGFESLLVSAVGDDDLGRRAHQAVAKMGLDTSLLHTSARWQTGTASVQLDASGYPAFQIPRPAAYDDARLTEKDILRLTAWSPAWLYHGTLFPSKKEGRSTLSRLIQALPQTMRFYDVNLRPGFDSPELVTGLLADADVVKLNETELREVSRFAGLPSEIEAFGRAGAEQYGWRAVCVTLGERGCAILTGKDYLVAAAHPVDVVDTVGAGDAFAAAFLHGLSRQWAIENIAAFANRVGAIVASRAGAIPDWSVAETADPLH

SEQ ID NO: 48405 - protein, 500 aa, Arabidopsis thaliana
MDSIWILSLLFFIIFLLLAAFKRKNHGKHRRIPSPPGFPIIGNLHQLGELQHQSLWKLSKKYGPVMLLKLGKVPTLILSSSETAKQALRDYDLHCCSRPSLAGGRELSYNNLDMSSSPYNEYWKELRKLCSQELFSANKIQSIQPIKDEEVKKVIDSIAESSSLKNPVNLSKTFLALTTSVVCKAAFGVSFEGSVLNSDRFNKLVRDTFEMLGSFSASDFIPYVGWIIDKFNGLQGWRKKSFRDLDAFYEQIFDLHKEEKEVGSEDLVDVLLRLEKEEIVVGNGKLTRNHIKAILMNILLGGIDTSAITMTWAMAELAKNPRVMKKVQAEIRNQIKNKERISFDDTDKLEYLKMVIKETWRLHPPTPLLLPRDVITEFEINGYTIPAKTRLHVNVWAIGRDPDTWKDPEMFLPERFNDSNIDAKGQNFELLSFGSGRRICPGLYMGTTMVEFGLANMLYHFDWKLPEGMVVEDIDMEEAPGLTVSKKSELVLVPVKYLDH

SEQ ID NO: 48406 - protein, 262 aa, uncultured bacterium
QPNAMGGREVGGLANQLAVHLDIDNPEHHAAVPNFWQTDTLATENGLTAVDLFNAVESGQVKAVWIMPTNPVDSLPEADRVRHALMACDTVVVSDCVASGDTLACADIRLPALGWGEKSGMVTNSERCVSRQRPFVKAPGDARADWWIISEVARRMGYASAFPYQHEHQIFAEYSALTALAGRFGKRLDMTAAAELSADQYEQWQPQQWPLQGEPRCFGDGHFATPDGRVRFVACENPNVHRIGDAFPIILNSSRIRDQWHT

SEQ ID NO: 48407 - protein, 263 aa, uncultured bacterium
QPNAMGGREVGGLANMLANHLDIENAEHRDAVQTFWQSPTICTAPGLKAVDLYEACADGKIKALWVMSTNPAASMPDAAGVAEAIANVPFTVVSDIMERTDTCDLADVLLPAAGWGEKDGTVTNSERRISRQRAFLPVPGAARPDWQIICDVAREMGHGDAFDFDSPASVFREYAALSASLTRFGRDFDISGLTEISDRDYAAFAPTQWPIPKQKSAGGRFFEGGGFFHSDGRARMLPVSAPLAQVANGYQLNTGRIRDQWHT

SEQ ID NO: 48408 - protein, 534 aa, Synechococcus elongatus PCC 6301
MTLQTEMEAALEVAALNREMLIILDFGSQYSELIARRIRETQVYSEVLSYRTTADQIRQLSPKGIILSGGPNSVYDDYAPVCDPEIWNLGIPVLGVCYGMQLMVQQLGGQVDRAERGEYGKAALVIDDPTDLLTNVEPGSTMWMSHGDSVKTMPEGFELLAHTDNTPCAAIADHQRKFYGVQFHPEVVHSVHGMALIRNFVYHICDCEPTWTTETFVEEAIREIRARVGDKRVLLALSGGVDSSTLAFLLHRAIGDQLTCMFIDQGFMRKGEPERLMEVFNEKFKIHVEYIQARDRFLQRLEGITDPEEKRKRIGHEFIRVFEEESRRLGPFDYLAQGTLYPDVIESADTNVDPKTGERVAVKIKSHHNVGGLPKDLQFKLVEPLRRLFKDEVRQVGRSLGLPEEIVKRHPFPGPGLAIRILGEVTAEKLNILRDADLIVRQEVNRQGYYDEFWQAFAVLLPVKSVGVMGDKRTYAYPVVLRFVSSEDGMTADWSRAPYDLLETISNRIVNEVKGVNRVVYDITSKPPGTIEWE

SEQ ID NO: 48409 - protein, 247 aa, Triticum aestivum
  misc_feature (75)..(75): Xaa can be any naturally occurring amino acid
  misc_feature (113)..(113): Xaa can be any naturally occurring amino acid
  misc_feature (155)..(155): Xaa can be any naturally occurring amino acid
  misc_feature (160)..(160): Xaa can be any naturally occurring amino acid
  misc_feature (162)..(162): Xaa can be any naturally occurring amino acid
  misc_feature (170)..(170): Xaa can be any naturally occurring amino acid
  misc_feature (181)..(181): Xaa can be any naturally occurring amino acid
  misc_feature (184)..(184): Xaa can be any naturally occurring amino acid
  misc_feature (187)..(187): Xaa can be any naturally occurring amino acid
  misc_feature (191)..(191): Xaa can be any naturally occurring amino acid
MGSAASPPRALDAATQEDLKRVSAHRAVDMVESGMTLGLGTGSTAAHALDRLGALLRTGALRAVAGVPTSLKTEXAHAARVGIPMLALADAAEIHLSIDGADEVDPDLNLVKXAGGSLLREYRGPAPACRIVRASVPPLDTGPCLRVFPWRAKGXPNRKXSXIAGFHARXRTSGPRPATGXEEXFLXDNGXHIVEMFFEDGIHGNLRDISDSLLRITGVVEHGMFLGMATKVIVAKKDGTVAVLSKK

SEQ ID NO: 48410 - protein, 311 aa, Yarrowia lipolytica CLIB122
MRQVSHPNIVELKAFFHSNAEKDDVYLNLVLEYVPETVYRALRHFSKARLSMPNIEVKLYTYQLFRSLAYIHSLGICHRDIKPQNLLLDPATGILKLCDFGSAKILVPGEPNVSYICSRYYRAPELIFGAQNYTTKIDVWSGGCVMAELMLGQPLFPGESGIDQLVEIIKVLGTPSREQIRTMNPNYMEHRFPQIKPHPFSRVFKRGPPDAIELITPLLEYSPGQRLSAIEALVHPYFDELRDPETVLPDSRNPNNAVRQLPALFNFTRHELSIAPELNQKLVPAHAREALGVDLDNFVPLTVQEMAANLS

SEQ ID NO: 48411 - protein, 254 aa, Kluyveromyces lactis NRRL Y-1140
MRSIKCVIVGDGAVGKTSLLISYTTNTFPQDYIPTVFDNYSTTIALPDPYNPDSEPQIFKLNLWDTAGQEEYDRLRPLSYPQTDIFLICFSVNEPNSFENVYDKWFPEIKHSTNFENLDLYHQSGKLPILLVGTKADLRDDDHERDRLQESNSDFVSQQQIQELVNKLGLMGYVECSAATQVGVREVFEKAVDCVVFEPDRLVRESLQQKQQAQDSQQKPKTKQVNKKNTTAQPESSTKPQKSKRSIKRKCTIL

SEQ ID NO: 48412 - protein, 154 aa, Zea mays
  misc_feature (80)..(80): Xaa can be any naturally occurring amino acid
RNIFTKIPARLKRGSGLCSACENFTSEAVTYLGKEQTQDRIVEFLHDACSQSFSFEQKCVELMDSYATLLFAKITEIRPXAFCKRYGLCRDTALLSGVGSDSTCVFCHHLLDEIMSKLKDPDAEFEIIQILVKECNKIEGHVQQVGFLALPLSL

SEQ ID NO: 48413 - protein, 194 aa, Oryza sativa (indica cultivar-group)
MAAKRGSESDGDELGGGAAAEGTSPNDGGASPPPLAAAPAVCFIRSAGDFAGGAFIGSIVGYGQGLFTKKGFKGSFSTAGSSAKSLVVCLLRRLRGKDDIVNAGIAGCCTGLALSFPGTPQALLQSCATFAAFSCIMEGLNKQQAAMAQTLGGSALTVSHQNGGVLPPFTLPPLLDASDALSSCCQSLVLKPKH

SEQ ID NO: 48414 - protein, 130 aa, Cucumis sativus
KLPALYNELFKLVGLDAIYVPLLVDDPTKFLDTYSSSDIGGFSVTIPHKEAVFKYCDEVDPVAKATGAVNFVLRRQSDGKLCGYNTDCYGAISAIEDGLLGLHNDSFAVSSRLAGKLVVVIGAGGVGKTT

SEQ ID NO: 48415 - protein, 211 aa, Thermoanaerobacter tengcongensis MB4
MKVLIISNGEIKDYGFYKNIVEEVDMVICADGGANHAYKMKIRPFLIIGDFDSVDREVLEFYQKEGVKVEKFPTMKDETDTQLALKKAIELGAKDITFIGVIGDRFDHSYANLSLLLYSLKRGVKSRIINEKNEIHLIDDYIEIEGKKGELLSLLPYSGEVKGIYTKGLFYPLSGQSMSMENPYGISNVFTEEKASIKIEEGFLLVIKPKD

SEQ ID NO: 48416 - protein, 482 aa, Escherichia coli O157:H7 EDL933
MKLNDSNLFRQQALINGEWLDANNGEVIDVTNPANGDKLGSVPKMGADETRAAIDAANRALPVWRALTAKERANILRNWFNLMMEHQDDLARLMTLEQGKPLAEAKGEISYAASFIEWFAEEGKRIYGDTIPGHQADKRLIVIKQPIGVTAAITPWNFPAAMITRKAGPALAAGCTMVLKPASQTPFSALALAELAIRAGIPAGVFNVVTGSAGAVGNELTSNPLVRKLSFTGSTEIGRQLMEQCAKDIKKVSLELGGNAPFIVFDDADLDKAVEGALASKFRNAGQTCVCANRLYVQDGVYDRFAEKLQQAVSKLHIGDGLDKGVTIGPLIDEKAVAKVEEHIADALEKGARVVCGGKAHERGGNFFQPTILVDVPANAKVSKEETFGPLAPLFRFKDEADVIAQANDTEFGLAAYFYARDLSRVFRVGEALEYGIVGINTGIISNEVAPFGGIKASGLGREGSKYGIEDYLEIKYMCIGL

SEQ ID NO: 48417 - protein, 426 aa, Escherichia coli O157:H7 EDL933
  misc_feature (4)..(4): Xaa can be any naturally occurring amino acid
  misc_feature (9)..(10): Xaa can be any naturally occurring amino acid
  misc_feature (13)..(13): Xaa can be any naturally occurring amino acid
  misc_feature (243)..(243): Xaa can be any naturally occurring amino acid
MSSXKELMXXRSXAIPRGVGQIHPIFADRAENCRVWDVEGREYLDFAGGIAVLNTGHLHPKVVAAVEAQLKKLSHTCFQVLAYEPYLELCEIMNQKVPGDFAKKTLLVTTGSEAVENAVKIARAATKRSGTIAFSGAYHGRTHYTLALTGKVNPYSAGMGLMPGHVYRALYPCPLHGISEDDAIASIHRIFKNDAAPEDIAAIVIEPVQGEGGFYAATPAFMQRLRALCDEHGIMLIADEVQXGAGRTGTLFAMEQMGVAPDLTTFAKSIAGGFPLAGVTGRAEVMDAVAPGGLGGTYAGNPIACVAALEVLKVFEQENLLQKANDLGQKLKDGLLAIAEKHPEIGDVRGLGAMIAIELFEDGDHNKPDAKLTAEIVARARDKGLILLSCGPYYNVLRILVPLTIEDAQIRQGLEIISQCFAEAKQ

SEQ ID NO: 48418 - protein, 347 aa, Arabidopsis thaliana
MSETEFKVLLETFTFPADSAPFKSCHASTIVEVVKDHFLAAYFGGTREGAPDVKIWLQHFKDGQWDSPVIVDEEPGVPMYNPVLFKLPSHELLLFYKIGQEVQKWSGCMKRSYDKGITWTEREQLPPGILGPIKNKPILLEDGTLLCGSSVESWNSWGAWMEVTSDAGRTWRKKGPIYIQGKSLSVIQPVPYQTAAGNLRILLRSFTGIDKICISESLDGGENWSFAVPTVLPNPNSGIDGVKLKDGRLVLAYNTDSRGVLKLGVSLDDGDSWTDILTLEESPGMEYSYPAVIQAGDGNVHVTYTYNRTQIKHVVLKTATDIDSKPYRHGEAGGGHVNLDLYEPNIN

SEQ ID NO: 48419 - protein, 500 aa, Arabidopsis thaliana
MATILFLSLLFLSCILLAAFTHKKRQQHQRKPPSPPGFPIIGNLHQLGELPHQSLWRLSKKYGHVMLLKFGSIPTVVVSSSETAKQVLKIHDLHCCSRPSLAGPRALSYNYLDIAFSPFDDYWKELRRICVQELFSVKRVQSFQPIKEDEVKKLIDSVSESASQGTPVNLSEKFTSLTVRVTCKATFGVNFQGTVLNSDRFEKLIHDTYLFLGSFSASDYFPNGGWIIDWLTGLHGQRERSVRALDAFYEQMFDLHKQGNKEGVEDFVDLLLRLEKEETVIGYGKLTRNHIKAILMNVLIGGIGTSAITMTWAMTELMRNPRVMKKVQSEIRNQIGKKSMITLDDIDQLHYLKMVINETWRLHPPSPFLIPRQVMSEFELNDYVIPVKTRLYVNVWAIGRDPDTWKDPEEFLPERFVNSSIDAKGQHFELLPFGSGRRMCPAMYMGTTMVEFGLANMLYHFDWKIPVGMVAEDIDLEESPGLNASKKNELVLVPLKYLDH

SEQ ID NO: 48420 - protein, 468 aa, Propionibacterium acnes KPA171202
MAVAATGIPAESGEPAMDKPRMKGRHLVMMSLGSAIGTGLFVGSGKGVAAAGPATLVAYIVAGLLVIAIMYMLGEMVAAHPDSGAFSVYTSRAMGSAAGFAMGWVWWIELVVVVAAEAIAAASTLVAMWPIAPVWLLTLIFLVVLTAINLLGADRFGEFEFWFALLKVVAVVVFLTIGVLLICGVLAAPAAGTSNLVGHGGFLPNGWSGVATALLLVAFSFGGIEIMAVAAAETEDPAHNVSRAVRTIVWRILVFYMGSVAIMVIAVPWDDPELGASPFVAVLNRAGIPAASEVMTLVIVLALLSSLNANLYGAARMLGSLAERGMAPRVAMRTRGRSVPTVAVLASVAFGFCCVLATFEWGDAVLGTLLNIVGSTIIVTYFFTICSHYVLRRRAEKEGAPLPMRLKGFPVVNWAAMILLIGIVVLGMFSPDVRAQLMSTGALVVILYVIGVGWSHHAGRSPFHPTTD

SEQ ID NO: 48421 - protein, 998 aa, Cryptococcus neoformans var. neoformans B-3501A
MDRLQRTRSQHFVSSPRKTASPLIARHTLYPRHPPKKRRLGVTTFVASHNEAGQNYSNELEDDLEKAIMKTGESSSAPARRTSRSRSQSRPVRRKSNDKVWADSLPNGQDGEDAASPKKRKRSRAGSLSTEDSWVETSGDEWEPDFIAESDRNMIHYAPSTALHRLRKAELVRLWRVAGMWDSEDIPDDMNEDETIGDMGKKELVDGLISARKHQTGRLISPLPSSPNRLIRRQSTLSPIPATPPPSSPLAESSSPDVTPKPRPRTRSRVRLETPVVRRQPRPSRPTRTLTKRHTKSEARSRRVRAQLTKKVNGKSENGDEIELTESSDSDDDVNGIESTPIVKRLRPRGVGERKSFMKEPSTDITDFEDDAEEADAEATEVEEEPQPKERKLRRKSISQASLSKYGGDIDMAPTSEQRSSKNLPTRGAKKKAIQRMQGGESGTEDEDMEVDEERDIGMKEGTPTPQPAIPPRRGRASRSSTPKLDEDSAMVGSPTPSVATETETSTPRPVHTTRSGKTFGAIQNRRRQLLQEARNDPDMDEEDESDEEDGEPELDIDLSEATVASLIRLLRDELVQMCETRGIEVGGTKPQLAKALLEWRDEQKGSYPSSASTARPSPPRTAMPRRKSKSKSKTKSKFKSNKHVPAIGTAAHAPGKPTPVLLRSHIHANDPETPPLSKGEEGDVEEEKKGTEAELNLDLQELGLEDSVIKPSQLIKLEKIGSGGFKDVYVGKFRGRKVAISEFRSHLSEMDIRELKLLAEFSHPNIVRFVSPFLSSERIIAYIEQRGICIPEDSTHVPCMLVSELCENGDLFDYIRNVPCPTLKRLLSLMLDIARGLEYLHTRKPSIIHRDCKSSNILINRSGVAKVGDFGLARVKNSTRSMIRSLVGTVNWQAPELWHPTPRYDYKVDVFSAGMVYWEMMSGWIGEKKYPWEGHNEHYIYDAVGTKHRRPPVTGMRKHWGSEPVNLMERMWHQDPAERPTMTDVVHDLESILAELK

SEQ ID NO: 48422 - protein, 106 aa, Nostoc punctiforme PCC 73102
MIAIALFKLTFISPALAAETSNGAKIFEANCASCHIGGGNILISQKTLKKEALSKYLENYNSDSIEAIIHQVQNGKNAMPAFKGKLSAEEILDVAAYVFQNAEQGW

SEQ ID NO: 48423 - protein, 336 aa, Desulfitobacterium hafniense Y51
MSVRIAINGFGRIGRLSMRAILERKSSLDIVAVNDLGSPDLLGHLFKYDSIHDILPYDVEVKENTLEVLDQKVAFLAEKDPGKLPWRELGVDLVIEATGRFTKREQAALHLQAGAKKVIISAPGKHEDITIVMGVNEHLYNPAEHHILSNASCTTNGLAPLAKVLLEEFGIEQGMMTTTHSVTNDQRILDLEHKDWRRARAAYESMIPTTTGATKAVELVLPDLKGKLKGLAVRVPTPNVSLIDFVANLSRSTTKEEVNQKLREAAEGSLKGYLAYSELPLVSHDFNGNPHSAIVDGLSTLMLGERMVKVLAWYDNEWGYSNRIVDLVEYIAGQGL

SEQ ID NO: 48424 - protein, 342 aa, Thermoanaerobacter tengcongensis MB4
MYNLKDMTLEEMEEFFVNLGESKFRAKQLYKWIYDKRVTDFDLMTDISKNLRAKLKEIAYISELKIIERRVSQIDDTVKYLFLLEDKNIIEGVAIKYKFGNTACVSTQVGCNMKCKFCASAIGGKVRDLKASEMVDQVMAIDSDYGKISNIVLMGSGEPFDNYDEVMKFIKIVNNPYGLKIGKRHITISTVGIVPKIYQFADEELQVNLSISLHAPNNELRNELMPINRAYPLEELMKACRYYIEKTNRRITFEYALIDGVNDKKEHAYQLVDLLKGMLCHVNLIPINYVKEIGFRKSNNEKVMMFKKIIENAGITCTVRRELGSDIEAACGQLRRKYLKEG

SEQ ID NO: 48425 - protein, 268 aa, uncultured bacterium
QPNAMGGREVGGLANQMAAHMDFNNPEAVDLVSRFWNAENMAQKDGLKAVDLFQAVEEGKIKAIWVMGTNPAVSLPNTDQVVRALQACPLVVVSDCIADTETLRYADVCLPATGWSEKNGTVTNSERRISRQRSILAPSGEAQHDWWIISEVAKRMGFGEAFNYGHPYEIFAEHAALSGFENNGSRDFDISLFQDIDRETYDALQPIQWPVTANSPYGTARMFSDGKFFTPTGKARFIPATTQTARQQPTEELPYILNTGRIRDQWHT

SEQ ID NO: 48426 - protein, 266 aa, uncultured bacterium
QPNAMGGREVGGLANQLAAHMDYSSEEMIDRVGRFWNAPNMARSDGLKAVDLFEAVEAGKVKAIWIMGTNPVVSLPNADQVKRALEACPLVVVSECIANTDTLKVANVCLPATGWSEKNGTVTNSERRISRQRSLLPPSGESRHDWWIVSEVAKRMGYGDAFAYEHPAQIFAEHAALSGFENNGSRDFDISLLQNIDEKAYDNLAPVQPNDAAPYGTARMFADGKFFTPSGRARFIPIITRAPVQQPTAEQPLIMNTGRIRDQWHT

SEQ ID NO: 48427 - protein, 437 aa, Escherichia coli
MSKIVKIIGREIIDSRGNPTVEAEVHLEGGFVGMAAAPSGASTGSREALELRDGDKSRFLGKGVTKAVAAVNGPIAQALIGKDAKDQAGIDKIMIDLDGTEKKSKFGANAILAVSLANAKAAAAAKGMPLYEHIAELNGTPGKYSMPVPMMNIINGGEHADNNVDIQEFMIQPVGAKTVKEAIRMGSEVFHHLAKVLKAKGMNTAVGDEGGYAPNLGSNDEALAVIAEAVKAAGYELGKDITLAMDCAASEFYKDGKYVLAGEGNKAFTSEEFTHFLEELTKQYPIVSIEDGLDESDWDGFAYQTKVLGDKIQLVGDDLFVTNTKILKEGIEKGIANSYLIKFNQIGSLTETLAAIKMAKDAGYTAVISHRSGETEDATIADLAVGTAAGQIKTGSMSRSDRVAKYNQLIRIEEALGEKARTTVVKRSKARHKTDFI

SEQ ID NO: 48428 - protein, 314 aa, Zea mays
MEQAGDETPGEIGREAARREAALRSGGGDAGERVDKAVVDGGEDERFRVQRKWRRFLAHVGPGALVAIGFLDPSNLETDMQAGADFKYQLLWVILVGMVFALLIQTLAANLGVKTGKHLAELCREEYPRSVNICLWIIAEMAVISDDIPEVLGTAFAFNILLGIPLWAGVVLTVLSTLLLLGVQRFGARKLEFVVAAFMFAMAACFFGELSYLRPSAGEVVVGMFVPRLRGKGAAANAIALFGAIITPYNLFLHSALVLSRKTPRSVKSIRAACRYFLVECSLAFVVAFLINVAVVVVAGSICNAAGGNLSPVD

SEQ ID NO: 48429 - protein, 259 aa, uncultured bacterium
QPNAMGGREVGGMANTLAAHMDFDAQSIGRVERFWQAPALARKPGLKAVDMFDAVASGQIRAIWIMATSPVASLPDKDFVAQALVQCPLVVVSDCYKDTDTVGLADVRLPAQGWGEKDGTVTNSERCISRQRRLVTPRFDARPDWKIVCDVAKAMGFTHGFDYVSPGQIFAEHAALSVFENSGERLFALPDHVGLSEEAYDGLKPVSWPLEGRPFASRRFSTSDGRACFVATPPALTSAVSDRFPLLLNTGRLRDQWHT

SEQ ID NO: 48430 - protein, 473 aa, Burkholderia xenovorans LB400
MKTLNTFYIGGHWVEPSAGSTQTDIVNPATETLTGHLAMGTAQDADRAIAAARAAFPAWSESSRAERVALLERIIECYRARLDDIAEAVRIEIGAPITLCKHLQAAIGLSQLEAALETLRHFEFETRHDKSYVRREAVGVAALITPWNWPLNQIAAKVAPALAAGCTIVLKPSEIAPLDAVIFAEIMHAAGTPPGVFNMIFGEGRVVGARLSSHPGVDMVSITGSTRAGVEVAVSAAPTVKRVAQELGGKSPLLILDDADLQQAVTSGVMQCMANSGQTCVAPTRMLVPRERYDDAIAIAAAVANGIVVGDPADPATRMGPISNRAQYEKVQHMIRAGIEEGARVIAGGPGRPEGLAQGFYARPTVFADVRNDMMIAREEIFGPVLVMIPYDGEEHAITIANDTQYGLAGYIATRDPERARRVAARLRVGSVRINGAMLDITVPFGGYKTSGNGREYGREGLAEFLECKSVTG

SEQ ID NO: 48431 - protein, 664 aa, Aspergillus oryzae
MRGCLQLARWLSAGPKCPAASLPKAPSGLYNTIRSFTSSAQLASRARAASKPASDLETRIAQIPIDRYRNFCIVAHVDHGKSTLSDRLLELTGTIQPGSNKQVLDKLDVERERGITVKAQTCTMIYNHNGEDYLLHLVDTPGHVDFRAEVSRSYASCGGALLLVDASQGIQAQTVANFYLAFAQGLELIPVINKVDLPSAEPEKALQQMKTSFELDTENAVMVSAKTGLNVEQLLPTVVEKIPAPVGDTQKPLRMLLVDSWYDSYKGVICLVRIFDGEVRAGDQLVSFATGIKYYVGEVGIMYPTETSQTVLRAGQVGYIFFNPGMKRSQEAKIGDTYTKVGSEKAVEPLPGFEEPKAMVFVAAYPVDADHFEHLEDSINQLMLNDRSITVQKESSEALGAGFRLGFLGTLHCSVFEDRLRQEHGASIIITPPSVPVKVMWKDGREEIVTSPARFPEEDDLRSKVAEIHEPYVLATLTFPDEYLGKVIELCEANRGVQQTLEYFTSTQVILKYELPLAQLVDDFFGKLKGSTKGYATLDYEESAWQPSNIVKLQLLVNKAPVDAVARVVHYSQIERLGRKWVTKFKQHVDRQLFEVVIQAAVGRKVIARETVKPYRKDVLAKLHASDVSRRRKLLEKQKEGRKRLRAVGNVVIEQKAFQNFLAK

SEQ ID NO: 48432 - protein, 531 aa, Oryza sativa
MTLLCVPLVSRTVEAMQADAAAAAAAGADLVEIRLDFIEGFRPREHLPSLLRGCPLPALVTYRRRAPDSASISRYIRSACADAFTPNWEGGQYDGDDATRFEALRLAMELGVDYVDIELKVADKFISFISGSKPEKCKLIVSSHNYESTPSCEELADLVARIQAVGSDIVKIATTASDIADVSRMFQVMVHCQVPMIGLVMGEKGLMSRVLSPKFGGYLTFGTLDATKISAPGQPTVKELLDIYNIRRIGPDTKVLGLIANPVKQSKSPILHNKCLQSIGYNAVYLPLLADDLARFLSTYSSPDFSGFSCSLPFKVDAVQCCHEHDPVAKSIGAINTIIRRPDGKLVGYNTDYIGAISAIEDGIGGPGSKDAAISPLAGRLVVVVGAGGAGKAIAYGAKEKGARVVVANRTYEKAVSLAAAVGGHALRLAELETFRPEEGMILANATSLGMYPNVDGTPIPKKALSFYDVVFDAVYAPKVTRLLREAEECGIKVVSGVEMFVRQAMGQFEHFTGGIEAPESLMREIAAKYT

SEQ ID NO: 48433 - protein, 541 aa, Gibberella zeae PH-1
MAPIAVFLSYYRPWAAIAIVVAVYYQIIVDQNYSVKNAPFYLGKYLLGFLSIWAVYTVFLYPALLSPLRHLPQPKPGSFINGHWAESVREPAGLPFRHWMRTIENNGLIRYKHLFNQERILVTSPEGLKEVLGQNSYDYVKPHLLRAMVGKILGYGLLLSEGNVHKMQRKNLMPAFSFRHIKELYPVFWSKAQELVHGIEKEMSEAPGSQIDIADWASRASLDIIGSAGMGHEFKSLSDPSIEDTMKMYGSMVKQSGGAKLLTVLQLVLPSMITDYLPFQRNMGVLAASKAARDTSQRLINAKKVQMAAKEKLSPDIISTALESGHFTDEGLVDTMMTFLAAGHETSAAALTWTIFLLAKNHGIQDRLREEIRQNVDGLADDVDSKKLDGLSYLHAVCQESLRLYAPIPFTVRDSLRDTTILGTFVPKGTMIILCPWAINRAHESWGADADDFYPERWMVPGQANSGGAKNNYANLTFLHGPRSCIGQKFSLAELMALTCALVGRYRFDIDKDYEVKDLTDGIVAKPREGLKVSVEEIQGW

SEQ ID NO: 48434 - protein, 430 aa, Bacillus clausii KSM-K16
MGNWTKSIEAFKEAQPLMPGGVNSPVRAFKSVGMNPVYMKEGKGAKIKDIDGNEYIDYVLSWGPLILGHANDVVVEELKKATELGTSFGAPHEYETRLAKLVIERVPSIDVVRMVNSGTEATMSALRLARGYTGRNKILKFVGCYHGHGDSLLIKAGSGVATLGLPDSPGVPESVAQNTLTVHYNDVESVRYVFETFGDDLAAVIVEPVAGNMGVVPPEPGFLETLRTWTEENGTLLIFDEVMTGFRVGYTCAQGEFGVTPDLTCLGKVIGGGLPVGAFGGKREIMEQIAPSGPIYQAGTLSGNPLAMTAGYYTLSQLTKADYSEFARKAERLEAGLSAAAKQHGIPHSINRAGSMIGLFFTDERVYNFEKAQTSDLDLFAAYFRGMLAEGISLAPSQFEGLFLSTAHSNEDIEATIAAAERVFQAIATK

SEQ ID NO: 48435 - protein, 465 aa, Aspergillus oryzae
MEPSSPFGKFFYFSYFAVGSYLAKSLLDQVGSLPLHLLYSTVEVQSHDDAYNYLLFWLTKQRFNESKNRLIASTSLSSGLDYFSEDSDDGEFDDMLDAEASDTEWKASLSNTRQLLWSPSEGIHYFRYGGRCLALTRQIEERGTMLYTRTDKLRISCLGWDASILKQLLLEARVEYSQKEKGKTVIYRGAKRSYDNDFYWARSTARPARPLSTVILDHEEKTAFIQDVQQYLHPSTMRWYSDRGIPYRRGYLFYGPPGTGKSSLAFAAAGFLGLNVYILDLNATQLTEDALAQLFQELPRRCLVLLEDIDTNEVTSRRGDESKKKRKGNNKISLSALLNTIDGVAAQEGRVLVMTTNHQENLDPALIRPGRVDYQIEFKLANRNLMMQMFQNLFRDVLPSIDSHLEDTCHRAPIRRPPAHFLPIVSSTHSPVGKGNPTMQPFKSSDSEAMLAVCIRHVNMRLFHP

SEQ ID NO: 48436 - protein, 130 aa, Glycine max
  misc_feature (51)..(51): Xaa can be any naturally occurring amino acid
  misc_feature (86)..(86): Xaa can be any naturally occurring amino acid
  misc_feature (107)..(107): Xaa can be any naturally occurring amino acid
AFDHAYGGADKALAYGAKAKGARVEIANRTYDHAIQLAHAVGGYAVTLVDXNNHHSKDGLILANTTLIVKQPIDDETAVSKHASEXTGLGGDARYTPKIARLLLECXESGATIVTGLAMYIAHAYGQYEN

SEQ ID NO: 48437 - protein, 428 aa, Oryza sativa (indica cultivar-group)
MAPLRGAKRRKRQPEKALPAAGQAMPAPAPGGDWWDGFARRLAAGGGIVRCSEAANHLGRGGCSGLETTMDVDCSEGQFSKDCQNFESVFKMSRKTFDYLCSLISGDFTRKTQSFRNFRFGDKAILGVEDQVGVALLRLTTGESLLSIGNRFGMNHSAISNITWKFIEALEERAANHLKWPTPEEMATVKAKFEKIQGLPNCCGAIDTTHILMCSSAQPNSNVWLDGENRNSMVLQAIVDADMRFRDVVSGWPGSLNDSCILRTSGFYRLCEKGARLDGQTELPGEPAGSVVRDYILGDASYPLLPWLMTPYREKDLSPAKADFNKRHAATIMVVQGALAKLKERWQVLKGELWRPDKHRLPRIIYVCCLLTNIMIDLEDAARGGMPPSHNHDDGYRQQFSDVADVGAAALRDQLCQYVSRIGSSLPA

SEQ ID NO: 48438 - protein, 750 aa, Kluyveromyces lactis NRRL Y-1140
MTDSVKPLVDRIVSQPLEFKKAVQEDSYNVGGEGSSYIMISSSTQKQQQEAKEGDEHQLEHGHHQGIAATATASRKEKVVKPSSFAEALKMYTTKKSAANAAESKPNRSSQLPITASHVTPSGKLSIGLSNELLLSDDDYHGSSTEDEEHPIVSLLENKVTPDSNEMSGSGSSSASSSSAATSAPVSSSDDDDEDEDEDEVFHEANEFVQPSLALAAPAEQPGNVDEDEDSDDSSFHASSASAEDEDDENDEDVSAEEKEELKLEATEHAAASSCQFKGVSSSSTAAASESKPEEEENGEEEEEDEELKHKSPQPLSPTPPTTLQDKSSFYQFNESINDHGSNKPQRIVKNWGSKLTQLKPRGLLNHGVTCYTNAAVQAMVHIPAIQHYLFQLLRGNFKDTVKSNCVSMLLAETTMRMWSSDSTKNTYINPDKLINALEDINCMMSAWNQEDSHEYFMSLMSRLQEDSVPKGHKMTESIIYDVFGGLLQQSVKCSNCGEISTTEQPIYDLSLHLKGRKTTDQDQNSVGQDNSIDNSVDQQQSSKRRFSIEKSIRDFFNPELIKRVDNKEGYTCEKCKKVTNALKSNKIIRAPETLVVHLKKFRFNGTSSSKMKQAVSYPMFLDLTEYCHESISSLPVRYQLISVVVHEGRSLSSGHYIAHCKQPDGSWATYDDEYINKISEKQLLKEPNAYFLVYTRLTPKSVPLSSQSSNKSTDLGIPQLQRPPSSHSSSQNNSKRKNKKKNKKRRISP

SEQ ID NO: 48439 - protein, 227 aa, Zea mays
MLFLRCQPRVSSPSASASAPPFRPRVGVAAPLGVRVTGGRRGQAVVAMASADARLAGIASSIRVIPDFPKPGIMFQDITTLLLDPKAFRDTIDVFVERYKDQGITVVAGVEARGFIFGPPIALAISAKFVPLRKPKKLPGEVISEEYSLEYGTDKIEMHVGAVQANDRALVVDDLIATGGTLCAAVKLIERVGAKVVECACVIELAELKGRDKLGDRPVFVLVEADA

SEQ ID NO: 48440 - protein, 197 aa, Bacillus clausii KSM-K16
MKVTKAELAHVAVKAEQYPKNQLPELALAGRSNVGKSSFINKMLNRKGLARTSGQPGKTQTLNFYEINERLYFVDVPGYGYAKVSKTERAAWGKMIETYLSEREELKAVLQLVDIRHRPSEDDQLMYNWMKHYGIPVILVATKADKIPKGKWQKQLTAIAKTLDKEASDPLLFFSSATGLGKDEAWRTILNHLKVTE

SEQ ID NO: 48441 - protein, 466 aa, Escherichia coli O157:H7 EDL933
  misc_feature (345)..(345): Xaa can be any naturally occurring amino acid
MGQSSQPHELGGGLKSRHVTMLSIAGVIGASLFVGSSVAIAEAGPAVLLAYLFAGLLVVMIMRMLAEMAVATPDTGSFSTYADKAIGRWAGYTIGWLYWWFWVLVIPLEANIAAMILHSWVPGIPIWLFSLVITLALTGSNLLSVKNYGEFEFWLALCKVIAILAFIFLGAVAISGFYPYADVSGISRLWDSGGFMPNGFGAVLSAMLITMFSFMGAEIVTIAAAESDTPEKHIVRATNSVIWRISIFYLCSIFVVVALIPWNMPGLKAVGSYRSVLELLNIPHAKLIMDCVILLSVTSCLNSALYTASRMLYSLSRRGDAPAVMGKINRSKTPYVAVLLSTGAXFLTVVVNYYAPAKVFKFLIDSSGAIALLVYLVIAVSQLRMRKILRAEGSEIRLRMWLYPWLTWLVIGFITFVLVVMLFRPAQQLEVISTGLLAIGIICTVPIMARWKKLVLWQKTPVHNTR

SEQ ID NO: 48442 - protein, 689 aa, Propionibacterium acnes KPA171202
MKGNFHSTYDQGFARVAACTTTVHIGDPASNVAGILDTCRELSSRSVAIAVFPELCLTGYAIDDLLLQDVVLDAVLDAIETVRQASRSLFPVIIVGAPLQRGNRLYNCAVVIHRGQVLGVVPKSHLPNYREFYEKRHFAVGAGTTGMIDLSGRQKSHAASTEIPFGPDQLFRATDLPDLTFHVEVCEDLWVPVAPSSQAALAGAVVEVNLSGSPITVGKSRQRHELCKVTSSRNLQAYVYAAAGPGESSTDLSWDGQTMIYENGSLLAATDRFSPEPGYCLADIDLDLLRQERLRQGSFDDNALAQPAQAPWRTTIFTLDPPHDDIGLERPVNRFPFVPNDPDQLAQDCYEAYNIQVYGLRRRLESMGSPKIVIGVSGGLDSTHALLVAAKAMDQMGRPRTDILAFTMPGFATTDHTKNNALDMCRALGIPCEVLDIRPAATQMLKGMSHPAGDGAEVYDVTFENVQAGLRYDYLFRIANQRGGIVLGTGDLSELALGWCTFGVGDQMSHYGVNTGVPKTLIQHLIRWCISSGQFNEATNVVLESVLGTEISPELVPARPGEKIQSTQAKIGPYELQDFTLYHLLRHGMRPSRIIFLSHHAWRDASVGSWPPGFRDEDRHSYDLSAIKDWTRLFLRRFVGNQFKRSTLPNGPKVVAGGSLSPRGDWRMPSDAVVRAWLDDLETVPDERF

SEQ ID NO: 48443 - protein, 269 aa, uncultured bacterium
QPNAMGGRKWAGWPIPLPLTWINSPSPSRVADFWGTGAVADGPGYKAVDMFEAVHRGDIRVIWIMGTNPAVSLPDSARVREALARCPTVIVSDCVAHTDTTDLADILLPAAGWGEKDGTVTNSERRISRQRCFLPLPAEVKPDWWIMSSVAGKLGFGEAFNYKRPADIFREHAALSAHENNGERLFNLAGLANLSDAGYEALIPVQWPVMEGAGVEAEGSTRLFSDGRFVTDNQRARFVAINTRLPAQQTSDDYPMVVNTGRIRDQWHT

SEQ ID NO: 48444 - protein, 497 aa, Geobacillus thermoleovorans
MTMISAQTTEADLWIDGEWRPAASGERFDVIDPATGEVTARVANAGEDDVDAAVAIAEEAFSVRRWLAISPLERGRILRRIAELIRQHHCELAQLMTRENGMPINLALFIEIPLADCFDFFASLVVKPQGEVLPFSVAGSAPDYMAWTMKEPIGVAGLITPWNFPLLMPTWKIAPALAAGCTMVVKPAPETPLTALKLAEICHEAGVPEGVINVLPGLDEAGKALVRHPRVPKIAFTGETETGRHILQAAAPHIKRVTLELGGKSPNIIFADADLEQAAKSALFGVFYNSGQVCQAGSRILVERTVYEPFVERLAERAKKLKVGPGTNPRSDLGPVISREQYEKVLRYIEIGKQEGARLAAGGRALDGGGGGYFIEPTVFADVSPSMRIACEEIFGPVAAVIPFADEEEAVRIANGTMYGLAAAVWTNDIKRALRLARRVKSGTVWLNTYQVLSPTVPFGGYKQSGLGRELGMQALDAYLETKTVICDLNDRPMTLF

SEQ ID NO: 48445 - protein, 273 aa, uncultured bacterium
QPNAMGGREVGGLANMLAAHMDLDNAQHRELVQEFWQSPTIADKPGLKAVDLFRDIEAGKVKAVWVMATNPVVSMPDRDFVARALEKCELVVVSDCVASNDTLKYAHVALPATGWSEKNGTVTNSERRTSRQRGLLAPAGEARHDWQIISDVAKKMGLSEGFDYRHSYEIFNEHSALSGYKNGRDKNESLRDFDISGLGQLSLRQYDNLRPVQWPLTNEKPQGSKRLFSDGKFFTASGKAQFIVIKPRLPEQSINRDFPFVLNSGRIRDQWHT

SEQ ID NO: 48446 - protein, 268 aa, uncultured bacterium
QPNAMGGREVGGLANMLTAHMTLKNSDHRALVKDFWQCGDLPDKAGLKAVDLFNAVNEGKVKAIWVMGTNPVVSMPNANLVREALQKCDFVVCSDAVKRTDTLDLAHVKLPAAGWGEKSGTVTNSERRVSRQRAIFPLHGDAKPDWWIVSEVAKRMGFGAAFDYQSPREVFVEFAALSGYQNEGERDFDISAYAELDEAEFEAMTPKQWPIKAEAPNGTPRMFVDGRYFTPNRKAKFIPTVARAPQEKVSDDYPLILNTGRIRDQWHT

SEQ ID NO: 48447 - protein, 256 aa, uncultured bacterium
QPNAMGGREVGGLATQLCAHMGFDPISRDKVSRFWQTNRLAHEPGYKAVDMFEQVASGKIKAIWIMATNPVVSLPRSSKIAEALSVCPLVIVSDCVANTDTSRYADVFLPAAGWGEKDGTVTNSERQISRQRSFLPARKEVRPDWTIICDVARKMGFQEAFDFHHPNEIFAEHAALSGFENEGERLFDISHLESITRDEYDALEPFQWPRHKPFSDQAYPNPTQRANFIPVGDPSLHRGDHEFLLNTGRIRDQWHT

SEQ ID NO: 48448 - protein, 369 aa, Aspergillus oryzae
MATDTHPTINKASVLRPGGSFYYEDREKPSLESDRDVIVRVVATGLCGSDVHYWQHGRIGRYVVENPIVLGHESSGIVVSRGAKASGIEVGDRVAIEPGIACNTCNPCRSGRYNLCKDMRFAATPPYDGTLSTYYRVPVECCYKLPEHISLRDGALVEPLGVAVHGCRLAGDLQDKSVIVFGAGPVGLLCCAVASAFGASTVVAVDIVAARLESARKYGATHTYQMSAEKSPELNADALAATAGLMDGANVVLDASGAEPCINCGIHALAHGGTFVQVGLGRPNLSLPVGQICDKEAVFKGSFRYGPGDFKLAVGLLNSRRVRVDGLVTHEFSFSQVEEAFKHVAGKGGIKSVIYGPDVDVEAAKQASV

SEQ ID NO: 48449 - protein, 390 aa, Burkholderia xenovorans LB400
MNDATDIQEADVLVIGGGLHGTSSAFHMARRGANVIVLEADYVARHSSGVNAGGVRTLGRPLPEIPLALMSREIWHGMNDLLGEDGGFVPSGQLKIAETDDELEACRQRVALLESHGFTHEKVIDRQTVLDLEPALARHVTGGIWAERDGYALPYRTTTAFRLAAQRLGARFLEGTPVRRIEQRGTRWFAVTPHGTFSAQKLLVTAGAWSGELAQQVGEPVPVHPEGLMLMVTHRVAPFCSATLGATGRPLSFKQFDNGTVVIGGKLIGIADLAHRHGEVDFVRLVRSARTVTDLFPHLRHLGVNRAWAGVEAFTEDELPVISASRKASDLYYSFGYCGSGFQLGPGCGKLVSELMLDGAPSISLDAFAIDRFGRNAASSLTRAASLATH

SEQ ID NO: 48450 - protein, 242 aa, Methanosarcina acetivorans C2A
MQLPDILNRFKIPAFKFEEKGSIMKDNLPEKGAIVQRDRETYAIAPHLPGGVVDPDTLIKIAEVAKKYGAAALKATSAQRIAIVGLKEEDLDNVWADLNIKPGAAIGLCVRSIKICPGTTFCKQAKQDSLGLGLKLDEKYHGMPMPSKLKIGVSGCPNSCAEPAIKDIGIMGTAKGYNLMVGGSAAATPRLADVVAKGLSEDEVLDAVERILTYYKNSGTKKRLGKFIDGMSLEEFKTQVGL

SEQ ID NO: 48451 - protein, 945 aa, Candida albicans SC5314
MTKKGHEYIQLSTFSEHENEHEPESSSTTSSPPPPGIRQYEKQHEWNFTDLQLQFVLLRLGVISDEVYHNQNFSLSDPDIHISKEVEYMINKIDQLSISEAIEIIRDALADHNGDVNFLIEDYQLLERLISQIPNNIESQKSNQNVETNLDELPEMKYPMQSTFKNKTYLTIIDWSLQIRLEAALIHYHSPYPEIRAITDPFDDPNTPVETFRAYFIALFWTFIGSLINSFFYHRMPGISLGTHTIQILLLPSGKLWEKLIPLNKTITINNTKINLNPGPWNFKEMMLSTIIYSCSASTPYSINNIFVMKLDRFYGLKWVNWIFQILFTVSTQLLGFSFAMIMKKVCVYPSKAIWPTILPTIALNRALMNQDNASNNSIVHGWKISPYSFFLVTFTLSFIYNWIPSYFFKALSLFNWPTWFNPNSIHLVNITGSNVGLGFNPIPSFDWNVIGGSSMVIPFYTFVNRYLGTFLGFIIILIVYYTNNNWTAYLPINSNRLFNKKAQLYNVHDILNDDNKLFDNEKYQQIGPPYFSAANLVIYGAYFCLYPFAILYHGLTEWNSMKTSFINVWTSIVDAFKSESEMGVSVESNDDNNLSLHRQYGRYANDPHCKMMAHYPDVPDWWFITILVVSTSFAIAAVWFYPVETPIWGIFFTIAINFIFLIPLTSIASVTGFSFGLNVLVELIVGYAIPNSGIALITLKAYGYNIDSQASNYITDQKLAHYAKIPPRAIFKGQLLSTLLNIIISLSVANWQLNNVENICDPHQKDNFKCPGANTYFYSSIQYGEIGPAKVFGGLYPILKWCFLLGVLLVFPCVWLKRNGPTKIFQRYFQPTIIIGGMLDFAPYNLSYFTGGLYISYIFMFYIKKNYLLWWEKYNYILTSALSAGVAFSALIIFFTVQYHPHPLHWWGNSIGQQGIEGGEISPIWKNIDTAPDGYIGLRKGHFP

SEQ ID NO: 48452 - protein, 1065 aa, Desulfitobacterium hafniense DCB-2
MNAENGNRNTKKWNKVLVIGSGPIVIGQAAEFDYAGTQACRALQEEGVEVVLVNSNPATIMTDQEVADRIYIEPLTVEFLERIIERERPDGIIATMGGQTGLNLAFQLAEKGILQRCGVQLMGTSLDSITKAEDREHFRSLMRELGEPVPPSVIVSDLEEALSFGEEIGYPVIVRPAYTLGGTGGGIAHNREQLKEIAKSGLQASLIDQILVEKSVAGWKEIEYEVLRDSQGNCITICNMENMDPVGVHTGDSMVVAPCQTLTDREVQALRTSSRKIVAALGIEGGCNVQYALHPERLEYVVIEVNPRLSRSSALASKATGYPIAKVAAKIALGYTLPELTNAVTGKTSACFEPALDYVVVKIPRWPFDKFSDADRRLGTQMKATGEVMGLGRNLETALQKAVRSLEIKAFGLLLPEFQELTDEEILERCQKPDDQLLFILAEGLRRGLSLEQIQKASSWNPYFLTAIERIVRMSETLQFSPWNGELLLKAKRMGFADRELARLWQTTEKEIYAYRQEKGLQPVFKMVDTCAGEFEALTPYFYSSYDQEDEGIPTQRRKVVVLGSGPIRIGQGIEFDYCSVHSVLALKKAGVETIIINNNPETVSTDFDTADRLYFEPLTLEDVSAVLEREQPEGVIVQFGGQTAIGLAKPLAERGYNILGTGIEDIDRAEERGQFDEVLHTIGAKRPKGGQASSLAEAVEVAARIGYPLMIRPSFVLGGRAMEIVYSASELENVVNRAMADFPGQELWMDQYLVGKEVEVDAISDGKNVSLPGIMEHLERAGVHSGDSIAVYPPQTLSEPLIQRITLLTTEIARALNVIGLLNIQYVIFQDEVYVIEVNPRSSRTVPFISKVTGLSIVDYATEVILGKTLTELELPLGLWPLPERVAVKVPVFSFSKLHRVEPSLGPEMKSTGEVMGVDRTYEKALYKALLAGGFNMSAHGSLLVTLADRDKAEGIPLVKKFADLGFRILATEGTAKTLREEGIQVAPVAKLHQGSTEITDAIRQGVIQCVLNTTTHNKKQESDGFAIRRTAVEQGIPCFTSLDTASAWVHVLMSFLPSLMSLK

SEQ ID NO: 48453 - protein, 84 aa, Triticum aestivum
HLVATVGKFSLIWNFQKVKDSNHHCYRDQEGLKSCYCYKVVLKEESIVDSRFMHENFAGSDSPEAPLVVATPMKVSSFSIANRR

SEQ ID NO: 48454 - protein, 374 aa, Methanosarcina acetivorans C2A
MFKFADELGPFKIIHVYEPSVGLKAVLVVDNVARGPAIGGVRIAPDVSTEECFRLARAMTLKNAAADLSYGGGKVVIYGDPKMPLEKKSQILRALASALRYTEEYIFAPDMGTDEVCMACIKDEIGRVVGLPCEVGGIPLDEVGATGWGLFHATEVALQYCDFELKGARVAVQGFGAVGKHAARFLTRKGAVLVGAADSQGTIHDLEGLDVDTLIRLKREGKSVLDYPGGEKLGCDEILSVPCDIWIPAARPDVINEGNVHLLKAKLVVEGANIPVTEGAEKILYEKGILYVPDFIANAGGVICAASEYQGATRCTAFGSIEEKVRGNTEQVLEAAKTKGILPREAAVELAVKRIKRAMRYRRWSIFSSAPGFV

SEQ ID NO: 48455 - protein, 374 aa, Brassica napus
MASLGGSKSLFLDRRFDPSVSGVMVCGDGRSRGRISMRLRGRDHGDNNSTVYGYFAYRAAKKWIAFNPKTGGLGFRGLHSSLLSRFSVGNAPDVSFDSSPAEELAKGSSDSVADKLCVKPLKLVSGSCYLPHPDKEATGGEDAHFICAEEQALGVADGVGGWAELGIDAGYYSRELMSNSVNAIQDEPKGSIDPARVLEKAHTSTKSQGSSTACIIALTDQGLNAINLGDSGFMVVREGHTVFRSPVQQHDFNFTYQLESGSNGDLPSSGQVFTVAVAPGDVIIAGTDGLFDNLYNNEITAIVVQAVRAGTDPQVTAQKIAALARQRAQDKNRQTPFSTAAQDAGFRYYGGKLDDITVVVSYVAASKEVGKTLK

SEQ ID NO: 48456 - protein, 543 aa, Synechococcus elongatus PCC 6301
MNIHTVATQAFSDQKPGTSGLRKQVPVFQKRHYLENFVQSIFDSLEGYQGQTLVLGGDGRYYNRTAIQTILKMAAANGWGRVLVGQGGILSTPAVSNLIRQNGAFGGIILSASHNPGGPEGDFGIKYNISNGGPAPEKVTDAIYACSLKIEAYRILEAGDVDLDRLGSQQLGEMTVEVIDSVADYSRLMQSLFDFDRIRDRLRGGLRIAIDSMHAVTGPYATTIFEKELGAAAGTVFNGKPLEDFGGGHPDPNLVYAHDLVELLFGDRAPDFGAASDGDGDRNMILGNHFFVTPSDSLAILAANASLVPAYRNGLSGIARSMPTSAAADRVAQALNLPCYETPTGWKFFGNLLDADRVTLCGEESFGTGSNHVREKDGLWAVLFWLNILAVREQSVAEIVQEHWRTYGRNYYSRHDYEGVESDRASTLVDKLRSQLPSLTGQKLGAYTVAYADDFRYEDPVDGSISEQQGIRIGFEDGSRMVFRLSGTGTAGATLRLYLERFEGDTTKQGLDPQVALADLIAIADEVAQITTLTGFDQPTVIT

SEQ ID NO: 48457 - protein, 225 aa, Pinus echinata
ANPFYKPGEIAKQAKAAGARIIVTLAAYVEKLADLQSHDVLVITIDDAPKEGCQHISVLTEADETQCPAVKIHPDDVVALPYSSGTTGLPKGVMLTHKGLVSSVAQQVDGENPNLYFHSDDVILCVLPLFHIYSLNSVLLCALRAGAATLIMQKFNLTTCLELIQKYKVTVAPIVPPIVLDITKSPIVSQYDVSSVRIIMSGAAPLGKELEDALRERFPKAIFGQ

SEQ ID NO: 48458 - protein, 319 aa, Moorella thermoacetica ATCC 39073
MRTIGVLTSGGDAPGMNAAIRAVVRQAAALKIDVIGISRGYAGLIQGDFRRLNTGSVAGIIHRGGTILLTARSEEFRTEAGRATALDNLHREGIEGLVVIGGDGSFHGAVHLAKKGLPVIGIPGTIDNDIAGTDYTIGFDTAVNTAVEAISRIRDTATSHERIFIIEVMGRRSGQIALAAGIAGGAESILIPEYPVNYDRVVEKLEQGRHRGKLHSIIVVAEGVGSALEVSEEIARRTRLESRVTILGHIQRGGAPTAFDCMLASRLGARAVDLLADGASSRMVGIAANELVDRDLETVLREKKSIDPELYRLAEVLAL

SEQ ID NO: 48459 - protein, 390 aa, Glycine max
  misc_feature (121)..(121): Xaa can be any naturally occurring amino acid
VKKASFFNWYYFSIYLGAIVSCSLIVWIQDNAGWGLGFGIPALFMGLSTISFFIGTHLYRFQKPGGSSYTRMAQVLFASVRKWNLVVPEDSSLLYEMPDKKSTIKGSCKLVHSDNLRWINXEGSFPPYESKSGDYSNPWRLCTVTQVEELKSLIHMFPIWATGIIFAAVYAQMSTLFVEQGTMMNTCIGSFKLPPASLSIFDVISVVLWVPLYDRIIVPILRKFTGKERGLSMLQRMGIGLFISVLCMLAAAVVEIMRLQLARELDLVDKPVDVPLSVLWQIPQYFFLGAAEVFTFVGQLEFLYDQSPYGMKTLGTALTLLNFSLGNYLSSFILTMVTYFTTLDGKPGWIPDNLNKGHLDYFFLLLAGLSFLNMSLYIVAAKRYKQKKAC

SEQ ID NO: 48460 - protein, 425 aa, Coccidioides immitis RS
MAPNNSETAALLKEATALSKTDPSKAETIFQKVLSLGTGSTEAASRDYETALVGLGELYRDQKRPKELAELLRTSRSSFSSFAKAKSAKLVRQLLDFFAAIPNTLDIQISVIKSCIDWAVSERRSFLRQNLETRLVTIYMQKQTYYDALTLINSLLRELKRLDDKLVLVEVQLLESRVYHALGNQPKARAALTSARTSAASVYTPPLLQAGLDMQSGMLHAEDKDFNTAYSYFIEALEGYHSLEEERKATSALQYMLLCKIMLNSVNDVNSLLASKQAIRYAGTSLEAMKAVAKAHSNRSLEEYERALSDYRYELGSDVFIRNHLRRLYDAMLEQNLIKVIEPFSRVEIDHIAKMVGLDTQQVERKLSQMILDKVIIGVLDQGAGCLIIFDETERDQGYDAALETIDKLSSVVDVLYTNQASLLE

SEQ ID NO: 48461 - protein, 225 aa, Pinus ponderosa
ANPFYKPGEIAKQAKAAGARIIVTLAAYVEKLADLQSHDVLVITIDDAPKEGCQHISVLTEADEAQCPAVKIHPDDVVALPYSSGTTGLPKGVMLTHKGLVSSVAQQVDGENPNLYFHSDDVILCVLPLFHIYSLNSVLLCALRAGAATLIMQKFNLTTCLELIQKYKVTVAPIVPPIVLDITKSPIVSQYDVSSVRIIMSGAAPLGKELEDALRERFPKAIFGQ

SEQ ID NO: 48462 - protein, 405 aa, Ustilago maydis 521
MSSTAPPLKPWVPPQPTRETDLEWAPLTTLDLSLIQGDDFTDVPESVVRSVGEAFSRDGFIYAENHGLSWEHVLRQFAIGQYAFHGVSEADKAKYKADILGTGSFVGYKEQGHWKLNGVKDRIEQLNFGSQSFAPDARRRLFPESLQELLPEIQEFARFNHAVILRKILSVLSLVLKLPADYLWNLSKEPEKRGLDLLRYALYHTPDQQDDDKLGGVRLQGHTDFNSVSILWSQPITSLEVLMPDNKWRLVKHRDNALVINLGDAMHFISGGYLKQTIHRVVAPPSDQAHYERLGIFYFALFNDDVSLEPLEQQSEVVRQAYAQRKQREGAGFWDAAKANGQPIPTAGDWERLRVKAYGQQNAKKAQDGHDVEEIAGQKVTGYNGERVKPRRIQHAALQASVKAN

SEQ ID NO: 48463 - protein, 521 aa, Oryza sativa (indica cultivar-group)
MSKDDSSDVPAAEAPAKRAPLNKYALACAILASMNSILLGYDISVMSGAQKFMKKDLNISDAKVEVLAGIINIYSLVGSLAAGRTSDWIGRRYTMVLASVIFFAGALIMGLAPSYAIVMLGRFVAGVGVGYALMIAPVYTAEVAPTSARGLLTSFPEVFINAGVLLGYVSNFAFYRLPLHIGWRVMFLVGAVPPVFLAVGVLAMPESPRWLVMQGRIGDARRVLEKTSDSPAEAEERLADIKNAVGIPEGISDEDEVVAVVHKSRGSHGEGVWRDLLLRPTPAVRRILIACLGLQFFQQASGIDAVVLYSPRVFDNAGLHSDSDSIGASVAVGASKTLFILVATFLLDRVGRRPLLLTSAGGMVISLVTLASALHMIEHRSEGQATALVGLSIAMVLVFVASFSIGMGPIAWVYSSEIFPLRLRAQGCALGTAMNRVVSGAVSMSFISLYKAITFAGSFYLYAGIAAAGWVFMFFFLPETQGRSLEDTVKLFGGDERDANGTVGREDGHGQNKSTELTTQQ

SEQ ID NO: 48464 - protein, 269 aa, Oryza sativa (indica cultivar-group)
MAPVSALAKYKLVFLGDQSVGKTSIITRFMYDKFDNTYQATIGIDFLSKTMYLEDRTVRLQLWDTAGQERFRSLIPSYIRDSSVAVIVFDVASRQSFLNTSKWIEEVRTERGSDVIIVLVGNKTDLVDKSYYAMIEQYNNLAQNSLPYNFSWIKLKAPLVVALAIKIYQFVASVPVLKANLVLSCTFSCNRQVSIEEGEGKAKDLGVMFIETSAKAGFNIKALFRKIAAALPGMETLSSAKQEDMVDVNLKSSNANSSQSQAQAGGCSC

SEQ ID NO: 48465 - protein, 392 aa, Synechococcus sp. RS9917
MKAMILAAGKGTRVQPITHVIPKPMIPILQKPVMEFLLELLKEHGFKEVMVNVSHLAEEIENYFRDGQRFGVEIAYSFEGRIEDGELIGDALGSAGGLKKIQDFQPFFDDTFVVLCGDALIDLDLSEAVRRHREKGAIASLVTKRVPRDQVSSYGVVVTDEQDCIRAFQEKPKVEESLSDTINTGIYIFEPEIFAHIPSGQPFDIGSDLFPKLVELGSPFYALPMDFEWVDIGKVPDYWQAIRSVLQGEVRQVGIPGKEVRPGVYTGLNVAANWDTIKVQGPVYVGGMTKIEDGATILGPSMIGPSCHICEGAVIDNSIIFDYSRIGPGVQLVEKLVFGRYCVGKNGDHFDLQEAALDWLITDARRQDLVEPSPQQKAMAELLGTDLTTAAN

SEQ ID NO: 48466 - protein, 389 aa, Salmonella typhimurium
MTDTTILQNNTHVIKPKKSVALSGVPAGNTALCTVGKSGNDLHYRGYDILDLAEHCEFEEVAHLLIHGKLPTRDELNAYKSKLKALRGLPANVRTVLEALPAASHPMDVMRTGVSALGCTLPEKEGHTVSGARDIADKLLASLNSILLYWYHYSHNGERIQPETDDDSIGGHFLHLLHGEKPTQSWEKAMHISLVLYAEHEFNASTFTSRVIAGTGSDVYSAIIGAIGALRGPKHGGANEVSLEIQQRYETPDEAEADIRKRVENKEVVIGFGHPVYTIADPRHQVIKRVAKQLSEEGGSLKMYHIADRLETVMWETKKMFPNLDWFSAVSYNMMGVPTEMFTPLFVIARVTGWAAHIIEQRQDNKIIRPSANYTGPEDRPFVSIDDRC

SEQ ID NO: 48467 - protein, 300 aa, Synechococcus sp. RS9917
MSDAELSRGSEGGARLAIRLLQDAAQRGDLDPWDVDVIAVVDGFLDQLRQRIAVPRQVAHALQGRGGSYEQDLADSSEAFLAASVLVGLKAEVLEAQTFPPEPVLEECCEAELGDQGWLNPEFDLPRRPERLLERRPVAPPPLRRPVTLGELIEQLESIAEQLDSDELELRRRQRQKRFSRREAIAQVAALAHREKLPETTAALGVFLSRWEAALHWTDFETLVQRWAEAAAADLDTDRVGVFWALLFLSSQGQVELQQEGHLHAPLRLKRVLASGSAAQLPLTTLQVPAVMPAEEARVA

SEQ ID NO: 48468 - protein, 217 aa, Glycine max
MDPKNVKSDLVLILDYGSQYTHLITRRIRSLSVFSLCISGTSSLSTIADLNPSVVILSGGPHSVHTPDSPSFPDGFLQWAQSNGVTVLGICYGLQLLVQRLGGDVRVGDKQEYGRMEICADKPSALFGPEKVGKRQVVWMSHGDEAVALPDGFHVVARSDQGAVAAIENPPAKLYGLQYHPEVTHTEDGMETLRRFLFDVCGVGAGWKMEDVMEEEI

SEQ ID NO: 48469 - protein, 395 aa, Lactobacillus sakei
VTGNPKHVVYVWLDALSNYITALGYGSDDDQLFNKYWPADVHLVGKEIVRFHAIYWPIFLMALGLPLPKQIFGHGWLLMKDGKMSKSKGNVVYPEMLVERYGLDALRYYLMRAIPFGNDGVFTPEDFVSRINYDLANDLGNLLNRTVAMINKYDDGHVPSYQADVTAFDADLQATATQTIAQYSTLMDQLKFSDALDTIWQLISRANKYIDETEPWVLAKDDSRKAELDSVLAHLAESLRIVALLLQPVMTHAPREMFAQLGLDFDQEAQREMVYGRFPSDIKVIAKGTPIFPRLDLDEEVAYIKEQMMAAQKAGLVNEKVKAKQVAAEEVADFDPKATELVSEKDAIKFEDFDQSEIRVAEIKAVSKVEGADKLLKFRLDAGDQGDRQIISGIA

SEQ ID NO: 48470 - protein, 268 aa, uncultured bacterium
QPNAMGGREVGGLANMLAAHMDYSVENTATVSEFWNTKNLSQTPGLNAVDLFEAVADGRIKAIWIMGTNPVVSMPNADRVRAALQSCDTVIVSDCMADTDTTATANILLPATGWGEKSGTVTNSERRISRQRVLIHPVGQAKSDWWIISQVGQAMGFNDAFDYHSPRDIFIEHAQLSAFKNTGNRLFNISTLSHLSEQQYNQLEPIQWPVTPLKPKGTARLFEDRLFFTPSKKANFVVISPQLPQLHTPNNDFPLTLNTGRIRDQWHT

SEQ ID NO: 48471 - protein, 271 aa, uncultured bacterium
QPNAMGGREVGGLANTLAAHMDYDSPGARSRVADFWGTGAVADGPGYKAVDMFEAVHRGDIRVIWIMGTNPAVSLPDSARVREALARCPTVIVSDCVAHTDTTDLADILLPAAGWGEKDGTVTNSERRISRQRCFLPLPAEVKPDWWIMSSVAGKLGFGEAFNYKRPADIFREHAALSAHENNGERLFNLPGLANLSDASYEALIPVQWPVMEGAGVEAEGSTRLFSDGRFVTDNQRARFVAINTRLPAQQTSDDYPMVVNTGRIRDKWHT

SEQ ID NO: 48472 - protein, 463 aa, Coprinopsis cinerea okayama7#130
MSSSTPPNDPPSNSEKKPEETPLLSSTDQTDNAQMDTSPDTVPPPPPEETWDDIPEDILSLSADEIATRTRLIDNDIKVMRSETLRLQHEQSVMKEKIRDNGEKIKQNKVLPYLVANVVEILDLDPEGEEAGSAQDENSMRKGKCAVIKTSTRQTVFLPMIGLVPPENLKPQDLVGVNKDSYLILDTLPVEFDSRVKAMEVDERPTEKYTDIGGLEKQIEELVEAIVLPMEQADKFKTLGIKPPKGCLMYGPPGTGKTLLARACAASTNACYLKLAAPSLVQMFIGDGAKLVRDAFALAKEKAPAIIFIDELDAIGTKRFDSDKSGDREVQRTMLELLNQLDGFGSDERIKVIAATNRIDILDPALLRSGRLDRKIEFPLPNETARARILEIHSRKMSCSPDVNYDELARSTDEFNGAQLKAVCVEAGMIALREGATKLNHEHFLSGIAEVQSKKKNNLMYFA

SEQ ID NO: 48473 - protein, 493 aa, Arabidopsis thaliana
MGETAAANNHRHHHHHGHQVFDVASHDFVPPQPAFKCFDDDGRLKRTGTVWTASAHIITAVIGSGVLSLAWAIAQLGWIAGPAVMLLFSLVTLYSSTLLSDCYRTGDAVSGKRNYTYMDAVRSILGGFKFKICGLIQYLNLFVIAIGYTIAASISMMAIKRSNCFHKSGGKDPCHMSSNPYMIVFGVAEILLSQVPDFDQIWWISIVAAVMSFTYSAIGLALGIVQVAANGVFKGSLTGISIGTVTQTQKIWRTFQALGDIAFAYSYSVVLIEIQDTVRSPPAESKTMKKATKISIAVTTIFYMLCGSMGYAAFGDAAPGNLLTGFGFYNPFWLLDIANAAIVVHLVGAYQVFAQPIFAFIEKSVAERYPDNDFLSKEFEIRIPGFKSPYKVNVFRMVYRSGFVVTTTVISMLMPFFNDVVGILGALGFWPLTVYFPVEMYIKQRKVEKWSTRWVCLQMLTVACLVISVVAGVGSIAGVMLDLKVYKPFKSTY

SEQ ID NO: 48474 - protein, 270 aa, uncultured bacterium
QPNAMGGRKWAGWPIPWPLTWNDSPGARSRVADFWGTGAVADGPGYKAVDMFEAVHRGDIRVIWIMGTNPAVSLPDSARVREALARCPTVIVSDCVAHTDTTDLADILLPAAGWGEKDGTVTNSERRISRQRCFLPLPAEVKPDWWIMSSVAGKLGFGEAFNYKRPADIFREHAALSAHENNGERLFNLAGLANLSDAGYEALIPVQWPVMEGAGVEAEGSTRLFSDGRFVTDNQRARFVAINTRLPAQQTSDDYPMVVNTGRIRDQWHT

SEQ ID NO: 48475 - protein, 316 aa, Oryza sativa (japonica cultivar-group)
MLLHHRLLPRLLLSPSTPVTTTLLVHRTSLFPTRRILSPCCSALSQVAAAPETVDHSDGDEPQGDVQVQLPLDRLFVPPGASVSAGDAEAVTARVLKGSNIVLGPYARGDANVIAADFVKSSVRPDDCPRDGLPEFALVGRSNVGKSSLLNSLVRRKRLALTSKKPGKTQCINHFKVNDSWYLVDLPGYGYAAAPQEARTNWDEFTRNYFLGRENLVSVFLLVDASIPAKKIDLDYASWLGQNKVPMTLVFTKCDKRKKKKNGGKRPEENVENFQSLIREYFEAAPPWIMTSSVTNQGRDEILLHMSQLRNYWLKH

SEQ ID NO: 48476 - protein, 303 aa, Brassica napus
  misc_feature (290)..(290): Xaa can be any naturally occurring amino acid
MLPVRKTKRAFYSADAGDGVFTPGKKRRRCLSSPASVSKAGPDLLDTIPDDLVVSILRRLASTSRCPADFINVLMTCKRLKSLATSPLVLSRLSRKAIAVKAQNWSEDAHRFLKRCVDAGSLEACYTLGMIRFYCLQNRGNGASLMAKAAISSYAPALYSLAVIQFNGSGGSKNDKDLRAGVALCARAAFLGHVDALRELGHCLQDGYGVPAETSPKGRRFLVQANARELAAVLSSGNEACSWLTLSQPQVTNQIRGCPLLSDFGCNVPAPEIHPANRFLADWFAVRGGXAPGDGLRLCSHGG

SEQ ID NO: 48477 - protein, 361 aa, Aspergillus oryzae
MSESIRQVIELNPSLVLKAVQQLEFEDRPVPDLLEPYDVSVRIEYTGICGNDVHYWQRGRIGQFILEKPMVLGHESAGVVEKVGSKVKSLAVGDHVALEPGVPCRRCTFCKAGNYNLCSEMAFAATPPFDGTLAKYYVLPEDFCYKLPTNVSLQEGAVVEPLSVAVHLVRQAALQPGQSVVVFGAGPVGLLCCAVARAFGASKVIVVDVQPKRLEFARAYAATAHFLPGVETSPADNAVRLREENELEMGADVVIEASGAEPSVYTGIHILRPGGTYVQGGMGKEEVKFPITAACTKELNIRGSFRYSSGDYKLAIELIAAGKINVKALITQVFKFEDAPRAFEEVKSGKGIKTLIAGPGV

SEQ ID NO: 48478 - protein, 225 aa, Pinus radiata
ANPFYKPGEIAKLAKAAGARIIVTLAAYVEKLADLQSHDVLVITIDDAPKEGCQHISVLTEADETQCPAVTIHPDDVVALPYSSGTTGLPKGVMLTHKGLVSSVAQQVDGENPNLYFHSDDVILCVLPLFHIYSLNSVLLCALRAGAATLIMQKFNLTTCLELIQKYKVTVAPIVPPIVLDITKSPIASQYDVSSVRIIMSGAAPLGKELEDALRERFPKAIFGQ

SEQ ID NO: 48479 - protein, 232 aa, Yersinia pseudotuberculosis
MVKFKAIRGVAFDLDGTLVDSAPGLARAIDMALAHQGLPAAGEALVSTWIGNGADVLVERALHWAGREHNAQLVAQTRELFDHYYAKTVEQGSQLFPQVKATLAQLAANGLPIGLITNKPTPFVAPLLTSLGIADYFSVIIGGDDVVVKKPHPAPLYLLLGKLGLHAREMLFVGDSRNDIMAAQAAGCPCIGLTYGYNYGEAIATSHPDCVLAHFADLLPAIGLPSLKDQEV

SEQ ID NO: 48480 - protein, 225 aa, Pinus contorta
ANPFYKPGEIAKQAKAAGARTIVTLAAYVEKLADLQSHDVLVITIDEAPKEGCHHISVLTEADETQCPAVKIHPDDVVALPYSSGTTGLPKGVMLTHKGLVSSVAQQVDGENPNLYFHSDDVILCVLPLFHIYSLNSVLLCALRAGAATLIMQKFNLTTCLELIQKYKVTVAPIVPPIVLDITKSPIVSQYDVSSVRIIMSGAAPLGKELEDALRERFPKAIFGQ

SEQ ID NO: 48481 - protein, 199 aa, Vibrio vulnificus CMCP6
MNKKILVPIACGTEEMEAVTVIDMMARAGYDVTVASADFDGKLTLTASRGVILGAQCRLVDVADEQFDVIVLSGGVAGAETFRDSPILIEMLKQHMYEGKLVAAICAAPALVLQHHNLYPKAIMTCHPNFMSHIGEQNWRPKRVTYDVNHNLLTSQGPGTALEFAMEIIILLSGKQHARQVAEPMVTVPVLNYHKLGEE

SEQ ID NO: 48482 - protein, 255 aa, Oryza sativa (indica cultivar-group)
MAARKFFVGGNWKCNGTGEDVKKIVTVLNEAEVPSEDVVEVVVSPPFVFLPQVKGLLRPDFSVAAQNCWVRKGGAFTGEISAEMLVNLQVPWVILGHSERRALMGESSDFVADKIAYTLSQGIKVIACIGETLEQREAGTTMEVVAAQTKAIAEKISDWTNVVLAYEPVWAIGTGKVATPAQAQEVHDGLRKWLVTNVSPAVAESTRIIYGGSVNGANCKELAAKPDVDGFLVGGASLKPEFVDIIKSATVKSSA

SEQ ID NO: 48483 - protein, 225 aa, Pinus merkusii
ANPFYKPGEIAKQAKAAGARIIVTLAAYVEKLADLQSHDVLVITIDDAPKEGCQHISVLTEADETQCPAVKIHPDDVVALPYSSGTTGLPKGVMLTHKGLVSSVAQQVDGENPNLYFHSEDVILCVLPLFHIYSLNSVLLCALRAGAATLIMQKFNLTTCLELIQKYKVTVAPIVPPIVLDITKSPIVSQYDVSSVRIIMSGAAPLGKELEDALRERFPKAIFGQ

SEQ ID NO: 48484 - protein, 341 aa, Sporothrix schenckii
MDNYQKLEKVGEGTYGVVYKARDLTAGGRIVALKKIRLEAEDEGVPSTAIREISLLKEMRDPNIVRLYNIVHAEGHKLYLVFEFLDLDLKKYMDSLPVSDGGRGKALPEGTGTRLHTLGLGDDIIKKFMSQLCAGIRYCHSHRILHRDLKPQNLLINKEGNLKLADFGLARAFGVPLRTYTHEVVTLWYRAPEILLGGHQYSTGVDMWSVGCIFAEMAMRKPLFPGDSEIDEIFKIFRLLGTPTEDVWPGVTTYPDFKASFPRWVQDTETPICPTLDPMGQELLELMLVYDPASRLSAKQACNHPYFDDLEKALPGTAAAAARQHTTTAAAGGAYNGSGYH

SEQ ID NO: 48485 - protein, 225 aa, Pinus roxburghii
ANPFYKPGEIAKQAKAAGARIIVTLAAYVEKLADLQSHDVLIITIDDAPKEGCQHISVLTEADETQCPAVKIHPDDVVALPYSSGTTGLPKGVMLTHKSLVSSVAQQVDGENPNLYFHSEDVILCVLPLFHIYSLNSVLLCALRAGAATLIMQKFNLTTCLELIQKYKVTVAPIVPPIVLDITKSPIVSQYDVSSVRIIMSGAAPLGKELEDALRERFPKGIFGQ

SEQ ID NO: 48486 - protein, 487 aa, Pseudomonas aeruginosa PAO1
MTDLNTSQGQQLRRVLKPRHLNMIAIGGSIGTGLFVASGATVATAGPGGALLSYALIGLMVYFLMTSLGEMAAYMPVSGSFCTYGSRFVEDGFGFALGWNYWYNWAVTIAAELVAAQLVMSFWFPEVPGIYWSAIFLGIMFGLNVISARGFGESEFWFALIKVVTVVIFIGVGLATIFGIMHGVESPGFSNFTMGDAPFVGGFQAMVGVAMIAGFSFQGTELIGIAAGESENPRKNIPIAIRQVFWRILMFYILAIFVIGMLIPYTDPNLLKNDASDISVSPFTLLFERAGFAAAAGVMNAVILSAILSAGNSGMYASTRMLYNLALEGKAPRLFSRVSRSGVPRNALYATTLVGALCFLTSAFGDSTVYTWLLNTSGMCGFIAWLGIAISHYRFRKGYLAQGGRLEDLPYRAKLFPFGPLFAFALCMVITLGQNYQALVGERIDWIGLLATYISLPLFLAIWLGYRWKKRARFVRYHEMDVSPTNT

SEQ ID NO: 48487 - protein, 225 aa, Pinus chiapensis
ANPFYKPGEIAKQAKAAGARIIVTQAAYVEKLADLQSHDVLVITIDDAPKEGCKHISVLTEADETQCPVVKIHPDDVVALPYSSGTTGLPKGVMLTHKGLVSSVAQQVDGENPNLYFHSEDVILCVLPLFHIYSLNSVLLCALRAGAATLIMQKFNLTTCLELMQKYKVTVAPIVPPIVLDITKSPIVSQYDVSSVRIIMSGAAPLGKELEDALRERFPKAIFGQ

SEQ ID NO: 48488 - protein, 332 aa, Oryza sativa (indica cultivar-group)
MSTPIPHEFQNLRFFKGPLFRGAFPQPSRDLPQKNQPNATATPPDHHHHHHPTQLVRLQEFLLLFLGFLPPLRRLAPPPAPASPLPASPLASSLVSARRCGKILAWICRSGLSWLSWFCLVLDSEYEVKAKKTWMEVTYASAVEQEICTAFLFVSQVHGVEYAFGAHDYPSSGVFEVEPRQCPGFRFRKSIFLGTTCLDPIQVRQFMELQSVNYNGDTYHLITKNCNHFCKDMCYKLTGNKIPKWVNRLARIGAICNCLLPESLKISPVGHDPNSRPEDCEKRRLRNPLSCFSSISSQRQLPPSSPFPTSPVKEPLAYSSSRKSSAPSLRNR

SEQ ID NO: 48489 - protein, 409 aa, Arabidopsis thaliana
MSSSSSCLFFTFILLLSLFSSYASPSNSTSETVPLRPQREIQKMKLIRKQLQKINKPAIKTIHSSDGDTIDCVPSHHQPAFDHPLLQGQRPMDPPEMPIGYSQENESHENFQLWSLYGESCPEGTIPIRRTTEQDMLRANSVRRFGRKIRRVRRDSSSNGHEHAVGYVSGSQYYGAKASINVWTPRVISQYEFSLSQIWIIAGSFAGDLNTIEAGWQISPELYGDTNPRFFTYWTSDAYQATGCYNLLCSGFVQTNNRIAIGAAISPVSSYKGGQFDISLLIWKDPKHGHWWLQFGSGTLVGYWPVSLFTHLREHGNMVQFGGEIVNTRPGGSHTSTQMGSGHFAGEGFGKASYFRNLQMVDWDNTLIPISNLKVLADHPNCYDIRGGVNRVWGNFFYYGGPGKNSKCP

SEQ ID NO: 48490 - protein, 363 aa, Xanthomonas axonopodis pv. citri str. 306
MTSWRCAQYRASSAKPHEVCVQPRCSACHRIAGVLPAAHRARSATHAMRTSFSPDIYVCVTTLACNQQSHCQETTMPVPNYPRPPFKPQKQSFPGRTEKMDPRPDHGEDSYVGHGQLKGKRALITGGDSGIGAAVAIAYAREGADVAIAFLPDEQEDAARIGALIEKAGVKALLVGCDISDPSQAAALVDKVNSTLGGLDILVNNAGYQKYFETFEDITLDEWRKTFDTNVHAAFNLVRLSVPLMTDGGSIINTASVQSKKPTPNILPYAATKGALANLTIGLAGVLAEKNIRVNAVLPGPIWTPFIPSGMDEESVENFGGQTPMGRPGQPVELASAYVMLAADTASYTSGTLLTISGGAVTL

SEQ ID NO: 48491 - protein, 334 aa, Desulfitobacterium hafniense Y51
MTIRIGINGFGRIGRNVFRAAYGRENIEIVAVNNRSTGEILPHLLKYDSVHGIFPAQIQHTEDGFTVDGQLVKVVSHTDPGDIPWGELGVDIVIESSGKFNNGPACQKHLNNGARKVVISAPAKEEDITLVMGVNEEIYDPQKHHIISNASCTTNCLAPVAKVIHENFGLKRGLMTTVHSYTNDQQILDQSHKDLRRARAAGLSIIPTTTGAARAVALVLPELKGKLNGFSMRVPTPNVSVIDLVAEIEKNTTIEELNGVLRHASENKLKGILDYTDLPLVSSDFNGSSASSIVDGLSTMVMEDNLIKVISWYDNEWGYSCRVVDLVEYVSRQI

SEQ ID NO: 48492 - protein, 122 aa, Cryptococcus neoformans var. neoformans B-3501A
MSRSPITCHVLDSSQGKPASGVKVSLQILKAELSGPNEAKDKILADGTTDIDGRCSTLLSPNEKLSPGIYKMVFFTGDYFKATGTETFYPVVEITFNYADPSQHYHIPLLLSPFSYTTYRGS

SEQ ID NO: 48493 - protein, 149 aa, Oryza sativa (indica cultivar-group)
MANAPWPEIRFCELYNVGYLLALVQFYDAMDLPISLDLREIPSKWQPLFIEEDPWEHVVGMGLGAVFVNQLVKWDEKLKEDLDKMLERAKQANERRYFDSNGGMEELEPPPGQAEIPGFIDNQQIVSISADSYNSWVTIYHIWKYDYQK

SEQ ID NO: 48494 - protein, 313 aa, Aspergillus nidulans FGSC A4
MEQLNVGGPLSRWWSHTTTTYSPTTIEFFGSAAVLFIGFWVPSLIFTWMDTLGPKHIPWRKIQAPARQPQYAAVKKGLVNSLQNQLLTSVLHLAYLGMLHFFTSGAKTTIYNVDSALPSPTRMARDIVISIVLQDIIFYHSHRGLHHPKIYRHIHKKHHEFTTPIALAALYAHPVEYFLSNILPVALPPALLGAHVVTFWFMLTWALLLAIIAHCGYELPPIYGWNMEVHDMHHELFVGNFGTIGFCDVLYGTRLTDSKATRVARDRLKEDTTEDTITAKNISSSAFNPLQRNGLGLEQGDWQGFFSHHTRHH

SEQ ID NO: 48495 - protein, 209 aa, Solanum tuberosum
MADQYEQNKPSVEETVGANVEATDRGLFDFIGKKKEEKPSHAHEEEAISSEFCEKVKVSEEEHKEEEKKEEKKLHRSSSSSSSSSDEEEEIGEDGQIIKKKKKKGLKEKIKEKISGDHKEEVKTEDTSVPVEKYEETEEKKGFLDKIKEKLPGGGHKKTEEVAAPPPPPPAAVEHEAEGKEKKGFLDKIKEKLPGYHSKTEEEKEKEKN

SEQ ID NO: 48496 - protein, 320 aa, Bacillus subtilis
TKGGIRFHPNVTEKEVKALSIWMSLKCGIIDLPYGGGKGGIVCDPRDMSFRELERLSRGYVRAISQIVGPTKDVPAPDVFTNSQIMAWMMDEYSRIDEFNSPGFITGKPLVLGGSHGRESATAKGVTICIKEAAKKRGIDIKGARVVVQGFGNAGSYLAKFMHDAGAKVVGISDAYGGLYDPEGLDIDYLLDRRDSFGTVTKLFNDTITNQELLELDCDILVPAAIENQITEENAHNIRAKIVVEAANGPTTLEGTKILSDRDILLVPDVLASAGGVTVSYFEWVQNNQGFYWSEEEVEEKLEKMMVKSFNNIYEMANNR

SEQ ID NO: 48497 - protein, 326 aa, Synechococcus elongatus PCC 6301
MAETFMFNALRAAIDEEMARDPNVLVLGEDVGHYGGSYKVTKDLYQKYGDFRLLDTPIAENGFTGMAVGAAMTGLRPIVEGMNMGFLLLAFNQVANNAMLRYTSGGNFTIPIVFRGPGGVGRQLGAEHSQRSEAYFHAVPGLKIVACSTPCNAKGLLKAAIRDNNPVLFFEHVLLYNLKEDLPDEEYICPLDKAEIVRPGKDVTVLTYSRMRYHCLQAVKTLEKEGFDPEVIDLISLKPFDFEAIEASVRKTHRVVIVEECMKTGGIAAELSAAIMERCFDELDAPVVRLSSQDIPTPYNGKLENLTIVQPEQIVAAVKDLLSAKV

SEQ ID NO: 48498 - protein, 322 aa, Bacillus subtilis
TKGGIRFHPNVTEKEVKAVKALSIWMSLKCGIIDLPYGGGKGGIVCDPRDMSFRELERLSRGYVRAISQIVGPTKDVPAPDVFTNSQIMAWMMDEYSRIDEFNSPGFITGKPLVLGGSHGRESATAKGVTICIKEAAKKRGIDIKGARVVVQGFGNAGSYLAKFMHDAGAKVVGISDAYGGLYDPEGLDIDYLLDRRDSFGTVTKLFNDTITNQELLELDCDILVPAAIENQITEENAHNIRAKIVVEAANGPTTLEGTKILSDRDILLVPDVLASAGGVTVSYFEWVQNNQGFYWSEEEVEEKLEKMMVKSFNNIYEMANN

SEQ ID NO: 48499 - protein, 313 aa, Candida glabrata CBS 138
MAEYPYKLRTKEPELKYEEFNGAKFAYVLWPSEGAPKARVLLVHGFGEYTKINHRLMDHLALAGYESFTFDQRGAGLTSPGKQKGITNEYHTFNDLDHFVAKNLLECKEKDIPLFLWGHSMGGGIILNYASKGKHRDQVSGYIASGPLIILHPHSSPNKITQWLSPVLAKCLTKTRIDTGLDLEGITSDPRYRKFLENDKPMSVPLYGSFGQIYDFLERGKRLYNDQDGFVSRKYPRDKPLFIQHGKDDTINDPQGSQKYYDMCPAQDKTLRIYDHARHSILSLEKDELFAPIFNDLQAWLDEHSQARIKSKL

SEQ ID NO: 48500 - protein, 225 aa, Pinus flexilis
  misc_feature (18)..(18): Xaa can be any naturally occurring amino acid
  misc_feature (50)..(50): Xaa can be any naturally occurring amino acid
ANPFYKPGEIAKQAKAAXARIIVTQAAYVEKLADLQSHDVLVITIDDAPXEGCKHISVLTEADETQCPVVKIHPDDVVALPYSSGTTGLPKGVMLTHKGLVSSVAQQVDGENPNLYFHSEDVILCVLPLFHIYSLNSVLLCALRAGAATLIMQKFNLTTCLEPMQKYKVTVAPIVPPIVLDITKSPIVSQYDVSSVRIIMSGAAPLGKELEDALRERFPKAIFGQ

SEQ ID NO: 48501 - protein, 948 aa, marine gamma proteobacterium HTCC2207
MLEFYEPQADYGTPKSTSTNMVTLSIDGVEVTVPEGTSVMRAAAESGVKIPRLCATDQLKSFGSCRVCLVEIEGRRGFPVSCTTNVEAGMEVKTQSDEIGKLRRNVMELYISDHPLDCLTCPTNGDCELQDTAGELGLRSVRYGFEGENHLVAEKDESNPYFTFDPSKCIVCSRCVRACEEVQGTFALTIDGRGFESKVSASQAEDFMDSECVSCGACVNACPTATLTEKSIIEAGKPEHSVTTTCAYCGVGCSFKAEMKGSQVVRMTPYKDGKANEGHACVKGRFAFGYATHKDRITVPMIRDSIDDPWREVSWEEAVTYTAKRFKAIQAQYGRTSIGAISSSRCTNEEVYLVQKMVRAGFGNNNVDTCARVCHSPTGFGLKTTLGESAGTQTFASVADADVVIVMGANPTEAHPVFGSRLKRRLREGAKLIVIDPRKIELVSSPHITADYHLPVRPGTNVTLLNALAHVVVNEGLEAREYIADRCDVAEFEKWVAFIGDERHSPENTETITGVSAADLRAAARLYATGGNGAIFYGLGVTEHSQGSTAVMGIANLAMLTGNIGRDGVGVNPLRGQNNVQGSCDMGSFPHELPGYRHISDKATRDLFEGEWGVTLDSEPGLRIPNMFDAALDGEFKGLYCQGEDIAQSDPNTQHVEAALRSIECLVVQDIFLNETAKFAHVFLPGASFLEKDGTFTNAERRISRVRKVMPPLSGKADWEGTMALANALGCKMEYSHPSDIMDEIARLTPTFNGVSYDRLEQLGSIQWPCNDSTPEGTPIMHVDQFVRGKGFFAMTEYVATTERANRKFPLLLTTGRILSQYNVGAQTRRTDNSEWHGEDLIEIHPHDAEERGINHGDWVGINSRVGDTVLRADVTDRVKPGVVYTTFHHPVSGANVITTDNSDWATNCPEYKVTAVQLSKVTQPSNWQARQKSFDKQQQGLLKDARH

SEQ ID NO: 48502 - protein, 225 aa, Pinus lambertiana
ANPFYKPGEIAKQAKAAGARIIVTQAAYVEKLADLQSHDVLVITIDDAPKEGCKHISVLTEADETQCPVVKIHPDDVVALPYSSGTTGLPKGVMLTHKSLVSSVAQQVDGENPNLYFHSEDVILCVLPLFHIYSLNSVLLCALRAGAATLIMQKFNLTTCLELMQKYKVTVAPIVPPIVLDITKSPIVSQYDVSSVRIIMSGAAPLGKELEDALRERFPKAIFGQ

SEQ ID NO: 48503 - protein, 357 aa, Oryza sativa (indica cultivar-group)
MGIAAGAALPGGPAGPAGGLFACRSAAASMRQTYLDLAAAAVAARSASCTSWADAMRASSPTRSSRSASDVDEFTAWVRKHPSALSKFEEIAAKSRGKKIVMFMDYDGTLSPIVADPDTAYMSDAMRAAVREVAKTFPTAIVSGRCRDKVRNFVGLSDLYYAGSHGMDIKGPSSNPESALCQPASEFLPMIDEVYKTLVEKTKSTPGAKVENNKFCLSVHFRCVDEKRWNALGEQVKAVIKEYPKLKLTQGRKVLEIRPSIKWDKGKALEFLLESLGFANCGDVLPVYIGDDRTDEDAFKVLRKRGQGLGILVSKCPKDTNASYSLQDPTEVMEFLLRLVEWKRKSSSSSLMIRPRV

SEQ ID NO: 48504 - protein, 225 aa, Pinus monticola
ANPFYKPGEIAKQAKAAGARIIVTQAAYVEKLADLQSHDVLVITIDDTPKEGCKHISVLTEADETQCPVVKIHPDDVVALPYSSGTTGLPKGVMLTHKGLVSSVAQQVDGENPNLYFHSEDVILCVLPLFHIYSLNSVLLCALRAGAATLIMQKFNLTTCLELMQKYKVTVAPIVPPIVLDITKSPIVSQYDVSSVRIIMSGAAPLGKELEDALRERFPKAIFGQ

SEQ ID NO: 48505 - protein, 368 aa, marine gamma proteobacterium HTCC2207
MKTRAAVAFGAGKPLDIVEVDLDGPRAGEVLVEVKATGVCHTDAFTLSGDDPEGAFPAILGHEGAGVVVEVGPEVKNLKPGDHVIPLYTAECRECEYCLNPKTNLCQAVRSTQGQGLMPDGTSRFSFEGKPILHYMGCSTFSNYTVLPEISLAKVREDAPFDKICYIGCGVTTGIGAVAFTMKVEAGSTVAVFGLGGIGLNVIQGAKMVGATRIIGIDLNPARAALGKQFGMTDFINPKDVENVVDHIIQMTGGGVDYSFECIGNVDVMRQALECCHKGWGESCIVGVAGAGKQITTRPFQLVTGRSWRGTAFGGARGRTDVPRIVDWYMEGKINIDDLITHKMPLDDINKAFDLMHAGESIRSVVEF

SEQ ID NO: 48506 - protein, 195 aa, Western X phytoplasma
MIKKSVFIKSIQGPIDCPVPRLSEVFLMGRSNVGKSSFINALTNKKKLALFSKTPGKTTTVNYFLLNDSFYLVDSPGYGYSKRNKTFKQSVFPMINNFLQNNYFVKIIFQIIDFKVGPTKMDLDIYHNLREYNLPVFLILNKKDKVLKNQVINQMQRIKKEFGAFEENIPMFLLSCKNKDGLNEIVNLIYDKINT

SEQ ID NO: 48507 - protein, 225 aa, Pinus strobus
ANPFYKPGEIAKQAKAAGARIIVTQAAYVEKLADLQSHDVLVITIDDAPKEGCKHISVLTEADETQCPVVKIHPDDVVALPYSSGTTGIPKGVMLTHKGLVSSVAQQVDGENPNLYFHSEDVILCVLPLFHIYSLNSVLLCALRAGAATLIMQKFNLTTCLELMQKYKVTVAPIVPPIVLDITKSPIVSQYDVSSVRIIMSGAAPLGKELEDALRERFPKAIFGQ

SEQ ID NO: 48508 - protein, 225 aa, Pinus monophylla
ANPFYKPGEIAKQAKAAGARIIVTQAAYVEKLADLQSHDVLVITIDDAPKEGCKHISVLTEADETQCPAVKIHPDDVVALPYSSGTTGLPKGVMLAHKGLVSSVAQQVDGENPNLYFHSEDMILCVLPLFHIYSLNSVLLCALRAGAATLIMQKFNLTTCLELMQKYKVTVAPIVPPIVLDIAKSPIVSQYDVSSVRIIMSGAAPLGKELEDALRERFPRAIFGQ

SEQ ID NO: 48509 - protein, 166 aa, Triticum aestivum
MAAWAAAKKLTLKSSDGEDFEVEVAVAMASQTIKHMVEDGCADNIIPLPNVNAKVLSKVIEYCTQHAPKADDAATADSATAVKPDEETLKAFDAEFVKVEQATLFDLILAANYLDIKGLLDLTCQTVADMIKGKTPEEIRKTFNITNDFTPEEEEEVRKENQWAFE

SEQ ID NO: 48510 - protein, 84 aa, Glycine max
  misc_feature (37)..(37): Xaa can be any naturally occurring amino acid
LRRPSPPQKNPTVHPSRRAAASPLPTQIDGSNWLPMXEETNIKKEEEEFSTGPLSVLMMSVKNNTQVLINCRNNKKLLGRVRAF

SEQ ID NO: 48511 - protein, 1122 aa, Armoracia rusticana
MSGSRPSQSSEGSRRSRHSARIIAQTTVDAKLHADFEESGSSFDYSTSVRVTGPVVENQPPRSDKVTTTYLHHIQKGKLIQPFGCLLALDEKTFKVIAYSENAPELLTMASHAVPSVGEHPVLGIGTDIRSLFTAPSASALQKALGFGDVSLLNPILVHCKTSAKPFYAIVHRVTGSIIVDFEPVKPYEVPMTAAGALQSYKLAAKAITRLQSLPSGSMERLCDTMVQEVFELTGYDRVMAYKFHEDDHGEVVSEVTKPGMEPYLGLHYPATDIPQAARFLFMKNKVRMIVDCNAKHARVLQDEKLSFDLTLCGSTLRAPHSCHLQYMANMDSIASLVMAVVVNEEDGEGDAPDSTTQPQKRKRLWGLVVCHNTTPRFVPFPLRYACEFLAQVFAIHVNKEVELENQIVEKNILRTQTLLCDMLMRDAPLGIVSQSPNIMDLVKCDGAALLYKDKIWKLGTTPSEFHLQEIASWLYEYHTDSTGLSTDSLYDAGFPKALSLGDAVCGMAAVRISSKDMIFWFRSHTAGEVRWGGAKHDPDDRDDARRMHPRSSFKAFLEVVKTRSLPWKDYEMDAIHSLQLILRNAFKDGESTDVNTKFIHSKLNDLKIDGIQELEAVTSEMVRLIETATVPILAVDSDGLVNGWNTKIAELTGLPVDEAIGKHLLTLVEDSSVEIVKRMLENALEGTEEQNVQFEIKTHLSRADAGPISLVVNACASRDLHENVVGVCFVAHDLTGQKTVMDKFTRIEGDYKAIIQNPNPLIPPIFGTDEFGWCTEWNPAMSKLTGLKREEVIDKMLLGEVFGTQTACCRLKNQEAFVNLGIVLNSAVTSQESEKVSFAFFTRGGKYIECLLCVSKKLDREGVVTGVFCFLQLASHELQQALHVQRLAERTALKRLKTLAYIKRQIRNPLSGIMFTRKMMEGTELGPEQRQILQTSSLCQKQLSKVLDDSDLERIIEGCLDLEMKEFSLNEVLTASTSQVMMKSNGKSVRITNETGEEVMSDTLYGDSIRLQQVLADFMLMSVNFTPSGGQLTVTASLRKDQLGRSVHLAYLEIRLTHTGAGIPELLLNQMFGTEKDVSEEGLSLMVSRKLVKLMNGDVQYLRQAGKSSFIISAELAAANK

SEQ ID NO: 48512 - protein, 387 aa, Xanthomonas axonopodis pv. citri str. 306
MLALNYHGSRDVRVETVPGPLLVERDDLILRVTATAICGSDLHLYRGKIPDLRPGDILGHEFMGIVEEVGPDVTAVKPGDRVVIPFVVACGRCFHCVLQEFSACETTNTGKGAALNHKDMRPPAALFGFSHLYGGLSGGQAEYVRVPKANVGPLAVPDALHDEQVLFLSDILPTGYQAVVNAGVKQGSTVAIFGAGPVGLMAAACCRMLGAERVFMVDRHAYRLDFASRTYGVIPINFDEVDDPADVIVSQTNGRGVDASIEAVGFEAEGSAIETALTNLKLEGSSGVAIRQCIAATRRCGVVSVPGVYAGFIHAFMFGDAFDKGLTFKMGQTHVQKHMPHLLECIGNGQLKPSAIISHRMSLADAARGYDLFDKKQDDCRKVVLTP

SEQ ID NO: 48513 - protein, 1122 aa, Armoracia rusticana
MSGSRPSQSSEGSRRSRHSARIIAQTTVDAKLHADFEESGSSFDYSTSVRVTGPVVENQPPRSDKVTTTYLHHIQKGKLIQPFGCLLALDEKTFKVIAYSENSPELLTMASHAVPSVGEHPVLGIGTDIRSLFTAPSASALQKALGFGDVSLLNPILVHCKTSAKPFYAIVHRVTGSIIVDFEPVKPYEVPMTAAGALQSYKLAAKAITRLQSLPSGSMERLCDTMVQEVFELTGYDRVMAYKFHEDDHGEVVSEVTKPGLEPYLGLHYPATDIPQAARFLFMKNKVRMIVDCNAKHARVLQDEKLSFDLTLCGSTLRAPHSCHLQYMANMDSIASHVMAVVVNEEDGEGDATDSTTQPQKRKRLWGLVVCHNTTPRFVPFPLRYACEFLAQVFAIHVNKEVELENQIVEKNILRTQTLLCDMLMRDAPLGIVSQSPNIMDLVKCDGAALLYKDKIWKLGTTPSELHLQEIASWLYEYHTDSTGLSTDSLHDAGFPKALSLGDAVCGMAAVRISLKDMIFWFRSHTAGEVRWGGAKHNPDDRDDARRMHPRSSFKAFLEVVKTRSLPWKDYEMDAIHSLQLILRNAFKDGESTDVNTNIIHSKLNDLKIDGIQELEAVTSEMVRLIETATVPILAVDSDGLVNGWNTKIAELTGLPVDEAIGKHLLTLVEDSSVEIVKRMLENALEGTEEQNVQFEIKTHQSRADAGTISLAVNACASRDLHENVVGVCFVAHDLTGQKTVMDKFTRIEGDYKAIIQNPNPLIPPIFGTDEFGWCTEWNPAMSKLTGLKREEVIDKMLLGEVFGTQKSCCRLKNQEAFVNLGIVLNGAVTSQESEKVSFAFFTRGGKYIECLLCVSKKLDREGVVTGVFCFLQLASHELQQALHVQRLAERTALKRLKAIAYIKRQIRNPLSGVMFTRKMMEGTELGPEQRQILHTSALCQEQLSKVLDDSDLESIIEGCLDLEMKEFSLNEVLTASTSQVMMKSNGKSVRITNETGEEVMSDTLYGDSIRLQQVLADFMLMSVNFTPSGGQLTVTASLRKDQLGRSVHLAYLEIRLTHTGAGIPEFLLNQMFGTEEDVSEEGLSLMVSRKLVKLMNGDVQYLRQAGKSSFIISAELAAANK

SEQ ID NO: 48514 - protein, 1122 aa, Armoracia rusticana
MSGSRPSQSSEGSRRSRHSARIIAQTTVDAKLHADFEESGSSFDYSTSVRVTGPVVENQPPRSDKVTTTYLHHIQKGKLIQPFGCLLALDEKTFKVIAYSENAPELLTMASHAVPSVGEHPVLGIGTDIRSLFTAPSASALQKALGFGDVSLLNPILVHCKTSAKPFYAIVHRVTGSIIVDFEPVKPYEVPMTAAGALQSYKLAAKAITRLQSLPSGSMERLCDTMVQEVFELTGYDRVMAYKFHEDDHGEVVSEVTKPGLEPYLGLHYPATDIPQAARFLFMKNKVRMIVDCNAKHARVLQDEKLSFDLTLCGSTLRAPHSCHLQYMANMDSIASLVMAVVVNEEDGEGDAPDSTTQPQKRKRLWGLVVCHNTTPRFVPFPLRYACEFLAQVFAIHVNKEVELENQIVEKNILRTQTLLCDMLMRDAPLGIVSQSPNIMDLVKCDGAALLYKDKIWKLGTTPSELHLQEIASWLYEYHTDSTGLSTDSLHDAGFPKALSLGDAVCGMAAVRISLKDMIFWFRSHTAGEVRWGGAKHNPDDRDDARRMHPRSSFKAFLEVVKTRSLPWKDYEMDAIHSLQLILRNAFKDGESTDVNTNIIHSKLNDLKIDGIQELEAVTSEMVRLIETATVPILAVDSDGLVNGWNTKIAELTGLPVDEAIGKHLLTLVEDSSVEIVKRMLENALEGTEEQNVQFEIKTHQSRADAGTISLAVNACASRDLHENVVGVCFVAHDLTGQKTVMDKFTRIEGDYKAIIQNPNPLIPPIFGTDEFGWCTEWNPAMSKLTGLKREEVIDKMLLGEVFGTQKSCCRLKNQEAFVNLGIVLNGAVTSQESEKVSFAFFTRGGKYIECLLCVSKKLDREGVVTGVFCFLQLASHELQQALHVQRLAERTALKRLKAIAYIKRQIRNPLSGVMFTREMIEGTELGPEQRQILHTSALCQEQLSKVLDDSDLESIIEGCLDLEMKEFSLNEVLTASTSQVMMKSNGKSVRITNETGEEVMSDTLYGDSIRLQQVLADFMLMSVNFTPSGGQLTVTASLRKDQPGRSVHLAYLEIRLTHTGAGIPEFLLNQMFGTEEDVSEEGLSLMVSRKLVKLMNGDVQYLRQAGKSSFIISAELAAANK

SEQ ID NO: 48515 - protein, 239 aa, Glycine max
MEGANWRITDEEAGPSSSSGIASTKQQNPPETFHHQHHRKEAAAEEEETEEEEEDDVDHHNNSTFVPGPLLSLKDQIEKDKEDESLRRWKEKLLGCMESDLDGQIHPEVKFHSIGIISEDFGEVITPLSVDESQNGHILFTLKEGSHYQLKLKFSVLHNIVSGLAYCNNVWKGGLQVDQSKGMLGTFAPQKEPYVHTLKEDITPSGVLARGVYFAKIKFEDDDGRCHMELKYSLEIKKR

SEQ ID NO: 48516 - protein, 465 aa, Cryptococcus neoformans var. neoformans B-3501A
MPHHHSLPTSSADFGDFNSAPASSIQTSSLSQDDLLGSYDETIRHSPSVKSHPSPDPRASNLDLLFLDHNAEEHRRPEPTYSPRSRPTGVLPESVPHARSPRRLSTFSSSTSPTSPPSITDAGCDIIFHPFYDHMDVNATRAMQKMQGHGERGASKRSDKMQLRGQASHSRIAPSSSPPHSRLLDTLATTTKLASKWRSVIAHPTSPNTADQTHNGQPKPQIRHAETSPMDITHDTPFASAEQIAGSYIPPTGAPGFTQASVLGMKHHGDGPFEPLTLIGRKDSTSNVLTPEDAIGLKACLPPRQRLTNQWTLLFSLDQHGASLSTLYRLIDIYSVSHQSSGNILVIRDGHGNRFGTYMNEPIVKREGTYYGSGESFLFKLTHSCQTIPYRWTGKNKYFALCEAGFMSFGGGAGAYGLILDSTFTHNSSATCPAYNNDILCELEPLKSQHAQSFQCLGLEVWSTL

SEQ ID NO: 48517 - protein, 323 aa, Bacillus subtilis
TKGGIRFHPNVTEKEVKAVKALSIWMSLKCGIIDLPYGGGKGGIVCDPRDMSFRELERLSRGYVRAISQIVGPTKDVPAPDVFTNSQIMAWMMDEYSRIDEFNSPGFITGKPLVLGGSHGRESATAKGVTICIKEAAKKRGIDIKGARVVVQGFGNAGSYLAKFMHDAGAKVVGISDAYGGLYDPEGLDIDYLLDRRDSFGTVTKLFNDTITNQELLELDCDILVPAAIENQITEENAHNIRAKIVVEAANGPTTLEGTKILSDRDILLVPDVLASAGGVTVSYFEWVQNNQGFYWSEEEVEEKLEKMMVKSFNNIYEMANNR

SEQ ID NO: 48518 - protein, 472 aa, Hordeum vulgare subsp. vulgare
MDVPLASKVPLPSPSKHEQCNVYSHKSSSKHADLNPHAIDSVLGIILGGGAGTRLYPLTKKRAKPAVPLGANYRLIDIPVSNCLNSNISKIYVLTQFNSASLNRHLSRAYGSNIGGYKNEGFVEVLAAQQSPDNPDWFQGTADAVRQYLWLFEEHNVMEYLILAGDHLYRMDYEKFIQAHRETDADITVAALPMDEERATAFGLMKIDEEGRIIEFAEKPKGEQLKAMMVDTTILGLEDARAKEMPYIASMGIYVISKHVMLQLLREQFPGANDFGSEVIPGATSTGMRVQAYLYDGYWEDIGTIEAFYNANLGITKKPIPDFSFYDRSAPIYTQPRHLPPSKVLDADVTDSVIGEGCVIKNCKIHHSVVGLRSCISEGAIIEDTLLMGADYYETEADKKLLAEKGGIPIGIGKNSHIKRAIIDKNARIGDNVMIINVDNVQEAARETDGYFIKSGIVTVIKDALLPSGTVI

SEQ ID NO: 48519 - protein, 320 aa, Bacillus subtilis
TKGGIRFHPNVTEKEVKALSIWMSLKCGIIDLPYGGGKGGIVCDPRDMSFRELERLSRGYVRAISQIVGPTKDVPAPDVFTNSQIMAWMMDEYSRIDEFNSPGFITGKPLVLGGSHGRESATAKGVTICIKEAAKKKGIDIKGARVVVQGFGNAGSYLAKFMHDAGAKVVGISDAYGGLYDPEGLDIDYLLDRRDSFGTVTKLFNDTITNQELLELDCDILVPAAIENQITEENAHNIQAKIVVEAANGPTTLEGTKILSDRDILLVPDVLASAGGVTVSYFEWVQNNQGFYWSEEEVEEKLEKMMVKSFNNIYEMAKNR

SEQ ID NO: 48520 - protein, 454 aa, Arabidopsis thaliana
MVDLVSSLPDDLLGHILSLLTTKEAALTSILSKRWRYLIAFVPYLEFDDSAFLNPEEGKQTREGTRQSFIDFVDRVLALHGDSPIRKFSLKCKTGVDLDLLNQWICNVLQRGVLLIDLSMDLGHRCMFIEIFMSRTLVELKLGSGCRIAFGPEHISALPMLKTLTLDSVSWSDSGQLERLLSACPALEALNLANVHGSYPNATVSIASLKTLTIKSVSLSGPAHVFSFDTPNLLCLNYTALFEDDYPLVNLEYLVEAQIKFVLTDRLIKLVSVRKNGLLMLSEVQKLIRGISSVRKLYLSPGTLQVLGQCSQAMPVFNNLTFLVIESSMDIRWQAMPVLLKNCPRLETLVIKGGLVHCVAADCGDACTCISREEKGRSLASCPVKRLEIREFQGTLREMEMIKHFYYCFLCLKEMEIYVKDGRPQFLAPLASDSNPFKHLLGRNVIIKVHGSLT

SEQ ID NO: 48521 - protein, 211 aa, Staphylococcus epidermidis RP62A
MYKAVVFDFDGTVIDTEKHLFDLINTHLKIHQVAPISLEFYKQFIGGEATELHTYLEDAIGFKNKEKIYDQYYQTSVELPVNSTIIQLMQYLKKRHIPMAITTSSYKKNIYPIFNQLGLDTYIDVVVGRENVDSVQPNPEIYLKAVQELNYNPTTCLAIEDSVNGATAAMLAGLDVVVNTNIITKDQDFSTVQCVGQDMEFEDIKNSLFKE

SEQ ID NO: 48522 - protein, 272 aa, Salmonella typhimurium LT2
MKSLFKATLLATTMAVAMHAPITFAADAAKPAATADSKAAFKNDDQKAAYALGASLGRYMENSLKEQEKLGIKLDKDQLIAGVQDAFADKSKLSDQEIEQTLQTFEARVKSAAQAKMEKDAADNEAKGKTFRDAFAKEKGVKTSSTGLLYKVEKEGTGEAPKDSDTVVVNYKGTLIDGKEFDNSYTRGEPLSFRLDGVIPGWTEGLKNIKKGGKIKLVIPPELAYGKTGVPGIPANSTLVFDVELLDIKPAPKADAKPADAADAKAADAAKK

SEQ ID NO: 48523 - protein, 440 aa, Streptococcus agalactiae 2603V/R
MANDWKKSARGLALMTLEEVFDKGAYSNIALNKSLKKSRLSDKDRALVTEIVYGTVARKITLEWYLSHFIVDRDKLELWVYHLLLLSLYQLLYLDNIPDHAIVNDAVTIAKNRGNKKGAEKLINAVLRRVSSETLPEIASIKRQNKRYSVAYSMPVWLVKKLIDQYGETRALAIMESLFERNKASLRVTDLSQKQTIKETLNVRDSHIAETALVADSGNFASTSFFQDGLITIQDESSQLVAPTLKVSGNDQVLDACSAPGGKTSHIASYLTTGAVTALDLYDHKLELVMENAKRLGLSDKIKTKKLDASKAHEYFLEDTFDKILVDAPCSGIGLIRRKPDIKYNKANQDFEALQEIQLSILSSVCQTLRKGGIITYSTCTIFEEENFQVIEKFLENHPNFEQVELSHTQEDIVKRGCISISPEQYHTDGFFIGQVKRIL

SEQ ID NO: 48524 - protein, 356 aa, Aspergillus oryzae
MESNNPSWFLYGPGEARLQSLPIPEIQDPHDVIVRIAYVGVCGSDVHFWKHGGVNKKVSKEQPLVLGHEAAGTIHTVGTAVKSVQVGDPVAIEPGIPCRRCRACKHGTYNICREMKFAAVPPDVHGTLTKYYRVPEDFVYKIPSGMSLQEAVLMEPLSVAVHSTRLVNITPGQTIVIMGSGSVGLLCGAVAKAFGAHRIILADILEHKLSFGSEFLDCETFLVSLDETPEESAARLLDMLDAPDGVDAVIEASGAEGSVQIGIYALRRGGSYVQAGVGKPKAEIPILALSQKELHVHGCFRYGPGDYDLALKLITKGSIDVKRLITSVTPFEQAPQAWDKTARGEGIKNLIQGVQD

SEQ ID NO: 48525 - protein, 389 aa, Haemophilus somnus 2336
MSVIKMTDLDLAGKRVFIRADLNVPVKEGKVTSDARIKATIPTLKLALEKGAKVMVTSHLGRPTEGEFKPEDSLQPVVDYLKGAGFNVRLAQDYLNGVEVNEGEIVVLENVRVNKGEKKNDPELSKKYAALCDVFVMDAFGTAHRAQASTYGVAEFAPVACAGPLLAAELEALGKALKEPQRPMLAIVGGSKVSTKLTVLDSLSKIADQLIVGGGIANTFIAAEGHNVGKSLYEADLIPEAQRLSKVTNIPVPVDVRVGTEFSETALSTEKSVADVSGEESIFDIGDKSAEQLADIIRNAKTILWNGPVGVFEFPNFRKGTEIVSNAIAEATANGAFSIAGGGDTLAAIDLFGIKDKISYISTGGGAFLEFVEGKVLPAVEILEKRANG

SEQ ID NO: 48526 - protein, 178 aa, Myxococcus xanthus DK 1622
MTTVIRETKETQVRVELAPGKGVTNVDTGLKFFDHMLATFARYAGLDLSLHARGDLTHHVMEDVAITLGTAVQQVIPATAARFAERTIPMDDALVQACLDAGGRFYYQGPLKNRLYEHWMRSFSEHARVTLHLRVLRGKDSHHATEASFKALGLALRDAMVDSGSVFSMKGSVSLEVK

SEQ ID NO: 48527 - protein, 225 aa, Pinus remota
ANPFYKPGEIAKQAKAAGARIIVTQAAYVEKLADLQSHDVLVITIDDAPKEGCKHISVLTEADETQCPAVKIHPDDVVALPYSSGTTGLPVGVMLTHKGLVSSVAQQVDGENPNLYFHSEDVILCVLPLFHIYSLNSVLLCALRAGAATLIMQKFNLTTCLELMQKYKVTVAPIVPPIVLDITKSPIVSQYDVSSVRIIMSGAAPLGKELEDALRERFPKAIFGQ

SEQ ID NO: 48528 - protein, 92 aa, Glycine max
GNRDVTGSQNSVEIDALARFAVEEHNKKQNALLEFEKVVTAKQQVVSGTLYTITLEAKDGGQKKVYEAKVWEKSWLNFKEVQEFKLVGDAPA

SEQ ID NO: 48529 - protein, 225 aa, Pinus longaeva
ANPFYKPGEIAKQAKAAGARIIVTQAAYVEKLADLQSHDVLVITIDDAPKEGCKHISVLTEADETQCPAVKIHPDDVVALPYSSGTTGLPKGVMLTHKGLVSSVAQQVDGENPNLYFHSEDVVLCVLPLFHIYSLNSVLLCALRAGAATLIMQKFNLTTCLELMQKYKVTVAPIVPPIVLDITKSPIVSQYDVSSVRIIMSGAAPLGKELEDALRERFPKAIFGQ

SEQ ID NO: 48530 - protein, 103 aa, Glycine max
AALEKVQELGGITDVHGAANSVEINNLARFAVEEQNKRENSVLEFVRVISAKQQVVAGVNYYITLEAKDGLIKNEYEAKVWVREWLNSKELLEFKPVNVSSTQ

SEQ ID NO: 48531 - protein, 209 aa, Synechococcus elongatus PCC 6301
MQLSDRPLTAPGTAPRQATVSRRTGETDVQVFLNLDGTGRCQADTGIPFLDHMFDQIASHGLIDLEITAKGDLHIDDHHTNEDVGITFGLALAEALGDRKGIVRFGHFVAPLDEALVQVALDFSGRPHLTYGLTLPTERVGTYETQLVREFFVAIANNAKLTLHLRQLDGINSHHIIEATFKAFARSLRMATEVDPRRAGQIPSSKGVL

SEQ ID NO: 48532 - protein, 208 aa, Pinus nelsonii
ANPFYKPGEIAKQAKAADARIIVTQAAYVEKLADLQSHDVLVITIDDAPKEGCKHISVLTEADETQCPAVKIHPDDVVALPYSSGTTGLPKGVMLTHKGLVSSVAQQVDGENPNLYFHSEDVILCVLPLFHIYSLNSVLLCALRAGAATLIMQKFNLTTCLELMQKYKVTVAPIVPPIVLDITKSPIVSQYDVSSVRIIMSGAAPLGK

SEQ ID NO: 48533 - protein, 100 aa, Glycine max
LGGFTDITGAQNSIDIENLARFAVDEHNKKENAVLEFVRVISAKKQVVSGTLYYITLEANDGVTKKVYETKVLEKPWLNIKEVQEFKPITVAVNPLSVTV

SEQ ID NO: 48534 - protein, 221 aa, Prochlorococcus marinus subsp. pastoris str. CCMP1986
MYMNYLISSFYLGYYFKVEFQVSIFVGNLPFRAEREDILELFTPYGEVMNCSLPLERDTGRKRGFAFVEMADEALETSAIDGLQGTELMGRPLRINKAEPRGGGGGPRRGGGGGRGGYGGGGNGGGYGGGGNGGGYGGGGNGGGYGGGGNGGGYGGGGRGGYGGGGNYSEPASSYVNKSSGAEGWEDRSYGNSSENSDFENGRSRRKRSVASNSEISQEGN

SEQ ID NO: 48535 - protein, 474 aa, Coccidioides immitis RS
MPSMKRRKLSHTPPQGEAEDGFSDSETSQASLQETPGNDEKIEATTTKSFKDLGIIDSLCEACDSLGYKAPTQIQAESIPLALQGRDLIGLAETGSGKTAAFALPILQALMDKPQSMFGLVLAPTRELAYQISQQFEALGSLISVRCAVIVGGMDMVSQAIALGKKPHIIVATPGRLLDHLENTKGFSLRSLKYLVMDEADRLLDLDFGPILDKILKVLPKERRTYLFSATMSSKVESLQRASLSNPLRVSVSSNKYQTVSTLLQNCLIIPHKHKDIYLIYLLNEFPGQSVIIFTRTVNETQRLAILLRALGFGAIPLHGQLSQSARLGALGKFRSRSRNILVATDVAARGLDIPSVDLVLNYDLPSDSKTYIHRVGRTARAGKSGRAFSLVTQYDVEIWQRIEAALGKELDEYKVEKEEVMVLSDRVGEAQRHAITEMKELHENRGKKGATLRNRRIGKGAKRSRDEMDREEG

SEQ ID NO: 48536 - protein, 120 aa, marine gamma proteobacterium HTCC2207
MVDSTPTLFTRIINREIPAEILYEDDKCIVINDISPQAPIHMLVIPRQPIAKLADAIEADKALLGHLMWVAGEVARQAGVEEAFRLVVNNGRAAGQTVFHLHLHVLADPSGSQDFSESTI

SEQ ID NO: 48537 - protein, 427 aa, Pseudomonas aeruginosa PAO1
MGDAFQEPLWRQVLSGAQMLFVAFGALVLMPLITGLDPNVALFTAGLGTLLFQLVTGRQVPVFLASSFAFITPIILAKGQFGLAATMGGVVAAGFVYTFMGLAVKIKGTGFIDKLLPPVVIGPVIISIGLAMAPIAANMAMGKAGDGSELLPYRTAMMISMPALLTTLVVAVFGKGIFRLVPIIAGVLVGFALSFVFGVVDTAAIVAAPWLELPKFTAPEFNWQAILFIVPVALAPAIEHIGGVIAVGGVTGQDYLKKPGLHRTLLGDGLATSAAGLFGGPPNTTYAEVTGAVMLTKNYNPKIMTWAAVIAITLAFVGKFGAILQSIPVPVMGGILCLLFGTIASVGMNTLIRHKVDLSEARNLVIVSVTLVFGIGGVLIGSGTGPDDIGLKGIALCAIVAIVLNLLLPGNDGWQNKALDEQHKDSH

SEQ ID NO: 48538 - protein, 225 aa, Picea sitchensis
ANPFYKPAEIAKQAKAAGARIIVTQSAYVDKLTDLQSDDLIVITIDGAPKEGCKHISVLTEADETQCPSVEIHPDDVVALPYSSGTTGLPKGVMLTHKGLVSSVAQQVDGENPNLYFHSEDVILCVLPLFHIYSLNSVLLCALRAGAATLIMQKFNLTTCLELIQRYKVTVAPIVPPIVLDITKSPNFSQYDVSSVRIIMSGAAPLGKELEDALRERFPKAIFGQ

SEQ ID NO: 48539 - protein, 232 aa, Glycine max
RVRLMASSDSWMKEYNEAVKLADDINGMISERSSFPASGPETQRHASAIRRKITILGTRLDSLQSLLSKVPAKTEKEMNRRKDMLANLRTKVNQMASTLNMSNFANRDSLLGPEIKSDAMSRTVGLDNSGLVGLPRQIMKEQDDGLEKLEETVISTKHIALAVNEELNLHTRLIDDLDPHVDGTDSRLRRVQKNLAVLNKRTKGGCSCLCMLLSVIGIVGLVVVIWLLVKYL

SEQ ID NO: 48540 - protein, 374 aa, Prochlorococcus marinus subsp. pastoris str. CCMP1986
MADFYQILGVSRDADANTLKSAYRKLARQYHPDVNKDPGAEDKFKEIGKAYEALADPETRARYDQFGEAGIGGAAGMPDMGDMGGFGDLFETFFNGFGGQSSQGGRSQRRGPQQGDDLRYDLNIDFKDAIFGQQREINIPHLETCEVCRGTGAKKGTGPTTCTTCGGSGQVRRATRTPFGNFTQVAECPTCNGVGQIISDPCTSCGGNGVKQVRKKLRINIPAGVDSGTKLRVSGEGNVGLKGGPPGDLYVFIKVKNDSNLKREGINIYSEISVSYLQAILGDTVDIITVDGKVNLKIPSGTQPNSTLSLENKGVPRLGNPVARGNHQVLVKVKLPTRITEDERNLLEDLASKYTEQNSSSNSGLFSRLFGKDS

SEQ ID NO: 48541 - protein, 542 aa, Synechococcus sp. RS9917
MNVPNTSEKSFRHSGGVAPVVLTILDGWGYREGSDHNAIRSAQTPVMDALWHAYPHALIEASGAHVGLPDGQMGNSEVGHLTIGAGRIIRQELVRISETVRNGQLGEREALRELAADLRRSGGTLHLLGLCSDGGVHSHVDHLCGLLRWAAAEGLERVAIHAITDGRDTPTDSAPRYIRQVEEAIHSCGVGELASLCGRYWAMDRDHRWERTSKAHALLTDPTLPSSGLSAAEAVAASYAQGTTDEFLEPVRLNDRCLRDGDGLVVFNFRPDRARQLVQALCLEHFDGFERGHHPRLNVVTFTQYEADLPVAVAFPPESLDQLLGQVVAEHGLKQYRTAETEKYPHVTYFMNGGIEQPLDGEDRHLVPSPRVATYDQAPAMAAASLTDSCIAAIEKGVYSLIVINYANPDMVGHTGVMAAATEAIQAVDHCIGRLLDAVGRMGGTMLITADHGNAEVMQGPDGQAWTAHTTNPVPVILVEGERRKVPGLGNAIQLRDNGGLADIAPTLLQLLDLPKPDAMSGASLIEAIDALASRSRLPQPV

SEQ ID NO: 48542 - protein, 764 aa, Cryptococcus neoformans var. neoformans B-3501A
MSSLPEDGISGASADDAGEDVQPADTVGNAVNMRDLSHVFDTSLQMPLESQPGSTVATPSLSPSLISTAEWEQELASSPPANSAVHTSRPFPSASVTSRQNEQPSILNSHYLSPIPSSPSQKSVTAPLNAPDYLSQRTLPPEPAFPFPSIKHITPNEKSTPSNPPVAGSGQASAALSRPNSSASNDGTSASLAGKNEDSSAAMKSVSRPESIAATTNGHDIISHASGEKRPGTAIKSGRSSSSAVKPPAELISKKSFFHKMFHPNQDKHDGKNASGQSRLHLELPRDAPSNGLASGRVSPSVMGPNTTESPPLTPSGNISDIDSRPPSRAPSRPPSVRRQNSAPGHDISVQTFVDPKNAVTPPVGVLAPQPQRRLSQRSAGSPSRRSASAGQGVTAKKDESAGNSGTKFTLKDLVGLGDNKVKKASAAGSAKGSDRGSTRGSEIGDNNSTASLLKKYGVCDRAAIGKGATAVVRLAHKWDRREEKLYAVKEFRKRRKNETEKDYVKKLTSEFCISSTLHHINVVETVDLVQDEAHHWCEVMEYCPGGDLYAAIKKGGMSSQEVECSFKQIMQGIAYLHSMGVAHRDIKPENLLLDGRGHVKITDFGVSDVFRMCWEKKTHMSKGLCGSEPYIAPELFEQKEYDARLVDVWAAAIVFYCMQFQELPWRIAKPSDPTFAAYMQQYKPQHVVDASGGTHHPTPPPINNLIPRECRSVIKHMLDPDPKTRWTVDEALKDKWLGNVEVCQEGQENSHRHITAGMDIVRV

SEQ ID NO: 48543 - protein, 258 aa, Xylella fastidiosa Ann-1
MTQSRWRLDGRTALITGASTGIGLAVARELLGLGADVLLVARDADLLGRVRDELAEEFPERELHGLAADVADDVDRRAILDWVEDCSNGLHVLINNAGGNVTRAALEYTEDEWREIFEINLFSAFELCRYTQPLLACHASTAIVNIGSVSGLTHVRSGVPYGMSKAALHQMTRNLAVEWAEDGIRVNAVAPWYIRTRRTSEPLSDLYYYEQVIERTPMRRIGEPEEVAAAVAFLCLPASSYVTGECIAVDGGFMRYGF

SEQ ID NO: 48544 - protein, 568 aa, Oryza sativa (japonica cultivar-group)
MDSTAGSGIAAPAAAAVCDLRMEPKIPEPFVWPNGDARPASAAELDMPVVDVGVLRDGDAEGLRRAAAQVAAACATHGFFQVSEHGVDAALGAALDGASDFFRLPLAEKRRARRVPGTVSGYTSAHADRFASKLPWKETLSFGFHDRAAAPVVADYFSSTLGPDFAPMGRVYQKYCEEMKELSLTIMELLELSLGVERGYYREFFADSSSIMRCNYYPPCPEPERTLGTGPHCDPTALTILLQDDVGGLEVLVDGEWRPVSPVPGAMVINIGDTFMVSEHGVDAALGRAALDGASDFFRLPLAEKRRARRVPGTVSGYTSAHADRFASKLPWKETLSFGFHDRAAAPVVADYFSSTLGPDFAPMGRVYQKYCEEMKELSLTIMELLELSLGVERGYYREFFADSSSIMRCNYYPPCPEPERTLGTGPHCDPTALTILLQDDVGGLEVLVDGEWRPVSPVPGAMVINIGDTFMALSNGRYKSCLHRAVVNQRRERRSLAFFLCPREDRVVRPPPSAATPQHYPDFTWADLMRFTQRHYRADTRTLDAFTRWLAPPAADAAATAQVEAAS

SEQ ID NO: 48545 - protein, 432 aa, Thermoanaerobacter tengcongensis MB4
MTQLEYALSGIITKEMKIVADYEGVSEEFILEEVKKGEIVIPANVNHINLVPKGIGKGLSTKVNANIGTSDAFPEIGKEIEKLKVAIDAGADAVMDLSTGGDVNKSRREIIKNSSVPVGTVPMYQAAVESISRYGSIVAMPEEFIFKVIEEQAKDGVDFITVHCGLTLESLKRLKDNKRIMNVVSRGGAFTIAWMIHNEKENPLYQYFDRLLDIAKKYDVTLSLGDGLRPGCLEDATDAAQIQELIILGELVKKAREAGVQVMVEGPGHVPIDQIEANVKLQKSLCHNAPFYVLGPVVTDIAPGYDHITAAIGGAIAAFAGADFLCYVTPAEHLGLPDIQDVKEGVIAAKIAAHAADIAKGIKKAREKDLAMAKARANLDWNEQIQLSIDPEKAEKYRVTKNKPNVETCSMCGKFCAMQIVSEYLGTPTTSC

SEQ ID NO: 48546 - protein, 485 aa, Oryza sativa (indica cultivar-group)
MASANVLLLPEAGSGHLMSLIEAGKRLLAHGGRGDGEGPAVTVTVLVVRPATSESAAEVDAHVGRVEASGLGVRFHRLPAVEPPPMGCAAGNVQEFKSRYMQLQAPHVRAAAAELGAAALVVDFFATGVLDAAREAGVPTYVYFTSTAALLALMLRLPALEEEVPVDFEEFDGTVDVPGLPPVPAGSLPAFMGRKESPNFKWFVYHGRRFMDADGIIINTVAELEPALLAAIADGRCVPGRTAPPLYPIGPVLDLEDKPSSNARCVRWLDAQPPASVLFLCFGSMGWFDAAKAREVAAGLERSGHRFLWALRGPPAAGTVHPTDASLDELLPEGFLERTKGRGLVWPTWAPQKEILAHAAIGGFVTHCGWNSTLESLWHGVPLVPWPLYAEQRLNAFELVRDMGVAVPLGVDGKRRDSFVEAAELERAVRSLMDDASEVGRKAREKAAEMKAVCRNAVAPGGGSSYAALQRLLGAIRGGFSTMTQ

SEQ ID NO: 48547 - protein, 556 aa, Aspergillus nidulans FGSC A4
MADKVQADEPQIQPESSIPDSRSSLKGDAHHAEVSRQPYGPPGLRGVVANPFVLLCAACSTLGGLSFGYDQGVISVTLVMEQFLGRFVEVAEGHPGSGFWKGLMTAMLELGAFVGALNQGWLADKISRRYSIVVAVAIFNVGSVLQTAAVDYAMLTVGRTIGGIGIGMLSMVAPLYISEVSPPECRGALLVLEEFCIVLGIVIAYWITYGTRFMAGEWAWRLPFLLQIVPSFVLLGGVIVLPFSPRWLASKGRNDEALQSLSQLRRLPTTDHRIQQELLDIKIDVRFHQELNAEKHPTLQGSGTTKSLLRELAGWADCFKSGCWRRTQVAVLVMFFQQFVGINALIYYSPTLFKTMGLDYDMQLLMSGIINVTQLVGVCTSLWTMDALGRRPLLLWGAAIMGISHVIIAALVGIYSDNWPAHRTRGWTSVAFLFVYMLAFGATWGSVGWALPAEVFSSFLRAKGVALATCGTWLFNFIIGLITPPLIQDTGYGAYVFFAVFCILAFIWTFFCVPETSGRTLEQMDAVFKDNSISAERARRQAIENELMGEHHGVTA

SEQ ID NO: 48548 - protein, 585 aa, Arabidopsis thaliana
MEVEEEVSRWEGYADWRNRAAVKGRHGGMLAASFVLVVEILENLAYLANASNLVLYLREYMHMSPSKSANDVTNFMGTAFLLALLGGFLSDAFFSTFQIFLISASIEFLGLIILTIQARTPSLMPPSCDSPTCEEVSGSKAAMLFVGLYLVALGVGGIKGSLASHGAEQFDESTPKGRKQRSTFFNYFVFCLACGALVAVTFVVWLEDNKGWEWGFGVSTIAIFVSILIFLSGSRFYRNKIPCGSPLTTILKVLLAASVKCCSSGSSSNAVASMSVSPSNHCVSKGKKEVESQGELEKPRQEEALPPRAQLTNSLKVLNGAADEKPVHRLLECTVQQVEDVKIVLKMLPIFACTIMLNCCLAQLSTFSVQQAASMNTKIGSLKIPPASLPILPVVFIMILAPIYDHLIIPFARKATKTETGVTHLQRIGVGLVLSILAMAVAALVEIKRKGVAKDSGLLDSKETLPVTFLWIGLQYLFLGSADLFTLAGLLEYFFTEAPSSMRSLATSLSWASLAMGYYLSSVIVSIVNSITGSSGNTPWLRGKSINRYKLDYFYWLMCVLSAANFLHYLFWAMRYKYRSTGSRS

SEQ ID NO: 48549 - protein, 121 aa, Arabidopsis thaliana
MNPKRCAACKYLRRRCPKDCVFSPYFPPNDPQKFACVHRIYGAGNVSKMLQQLPDQTRAEAVESLCFEAKCRVDDPVYGCVGIIHLLKTQIQKTQNELAKTQAEIAVAQTKLSQTQNSDFM

SEQ ID NO: 48550 - protein, 242 aa, Thermoanaerobacter tengcongensis MB4
MDFKILKEKLPQSNLTVVLTGAGISKESGIPTFRGEDGLWKKYNPEELATPWAFQRNPALVWEWYDYRRRIISKAKPNKCHLLIAEFEERFKNVRVITQNVDGLHEAAGSTNVIELHGNIWKVKCTKCDFRGINREVPLSKIPPECPKCGSIVRPDVVWFGEPLPSDKLTEAMELSQRADLFIVIGTSLMVQPAASLPFLALERGAFVVEVSPEETPLSRKAHLFFQMGAVEFAMKFEEKEG

SEQ ID NO: 48551 - protein, 607 aa, Glycine max
MGTSQSREGLEVTDSDSDYENEEETEHYEDAKTTHSTELDDVDAKLKALKLKYQTPSSSAKPLPQNAVKLYLHIGGNTPNAKWILSDKHTSYAFHKDTDENENDDVWLLTVGSKVRARVSSEMQLKMFGDQRRVDFVADGVWALKFPSDDTYRRFVTEFQSCMFENVYGIECTEENKVKIYGKEFIGWVKPEAADDSVWEDAVSGEPSPSPSPSRRRNDLMEEFEEAANGGVQTLTLGALDNSFMVNDTGVHVYRNFDRGIHGKGVAVKFAGDGSTPNKALLMRAETNMMLMSPLNDGKPHASKLHQLDIETGKIVTEWKFGKDGADLTMRDITNDTKGSQLDPSESTFLGLDDNRLCQWDMRDRKGIVQNIATASSSPVLHWSQGHQFSRGTNFQCFATTGDGSIVVGSLDGKIRLYSKTSMRMAKTAFPGLGSPITSVDVTYDGKWVLGTTDTYLVLICTLFTDKDGRTKTGFSGRMGNRIPAPRLLKLTPLDSHLAGANNKFHGGHFSWVTENGKQERHLVATVGKFSVIWDFQQVKNSAHECYRNQEGLKSCYCYKIILKDESIVESRFMHDKFAVSDSPEAPLVVATPMKVSSISMSGKRHG

SEQ ID NO: 48552 - protein, 447 aa, Burkholderia xenovorans LB400
MCFISLPRGYIPMRIHALADRRTILRIRRLWLHYGIFWLGAVATGLVAVMYAKLIDFGYDTFLRYTTSHRWLPLLLTPAVAALGVWITRRWFVGAEGSGIPQVIATLHEGRELGPRLLSMRILIGKIGVSFLSILGGLTIGREGPTIHVGAALMFSLRRFYPARFRSIRGAALERNLALAGAAAGLSAAFNAPLAGVVFAIEELTRSFEQRTSGVLITAIIFAGVVSLGLQGNYTYFGTIDIDGHFPDMLAIAAVMLGVVTGVAGGAFCWLLLNTNRWMPARLVVWRKDHPVAFGAACGLVIALIGVAAGGHTFGSGYAEARGMLEGNSQLGASYPILKMASMVGSYLPGAPGGLFAPSLAIGAGIGNALHLVFGQMQLPMLIALGMVGYLAAVTQSPITAFVIVIEMINGHALVLSLMTTALIASQVSRLFAPPLYEALSKRYVAG

SEQ ID NO: 48553 - protein, 522 aa, Oryza sativa
ISTMQFSSVFPLEGKACVSPIRRGGEGSASDRLKIGDSSSIKHDRAVRRMCLGYRGTKNGAQCVLTSDAGPDTLHVRTSFRRNFADPNEVAAVILGGGTGTQLFPLTSTRATPAVPIGGCYRLIDIPMSNCFNSGINKIFIMTQFNSASLNRHIHRTYLGGGINFTDGSVEVLAATQMPGEAAGWFQGTADAVRKFIWVLEDYYKHKAIEHILILSGDQLYRMDYMELVQKHVDDNADITLSCAPVGESRASDYGLVKFDSSGRVIQFSEKPKGTDLEAMKVDTSFLNFAIDDPTKFPYIASMGVYVFKRDVLLNLLKSRYAELHDFGSEILPRALHEHNVQAYVFADYWEDIGTIRSFFDANMALCEQPPKFEFYDPKTPFFTSPRYLPPTKSDKCRIKDAIISHGCLLRECTIGHSIVGVRSRLNSACELKNTMMMGADLYETEDEISRLLSEGKVPIGVGENTKINNCIIDMNARVGRNVVITNSEGVQESDRPEEGYYIRSGIVVILKNATIKDGKVI

SEQ ID NO: 48554 - protein, 504 aa, Candida glabrata CBS 138
MPEVFEEINIPQIGRSYKQPIGIFIDNEFVPSSNGEKIETINPATEEVITSFYAATEDDVDKAVKSARESYENVWFKISPAEKRDMLLKLADLIEEEKPLLAALETLDAGKPYHTNAMDDIDQIIHLTKYFAGATDKFTQGKTIPIDHEKLVYTLKSPYGVCGMIIPWNYPLAMASWKMQGCLAAGNTLVIKPAENTSLSLLYLAQLFKKAGFPKGVVNVVPGKGSVVGNSLGLHMDVDKISFTGSTKVGSSILELAGKSNMKDVTLECGGKSPAVVFQDADIDNAIEYIANGIFYNSGQNCTANSRVYVQEDIYDDFIKRFTEHTKENWKFGSKCDPFDKDCTVGPVVSEKQFETVNDYIRHGKEEENLQIHQTVEKCDCKGYFISPTIFTDVPQGSKLMKEEIFGPVVVVAKFKDYKEAIKLANDTNYGLASMVFTKNISVANWFARDIKSGTVWINSSNEEDPTVPFGGFKQSGIGRELGETGVESYMQIKTVHLNMSEKI

SEQ ID NO: 48555 - protein, 324 aa, Synechococcus elongatus PCC 6301
MTAQAPTVICLGEMLWDCLANDRDLPAEQVQSWTPWPGGAPANVATALVKLGVQSGLITCLGSDPEGDRLFQVLQDNGVAIAAVQRHPRLPTRQVQVLRTAQGDRQFGGFGAIACDQFADTELQAEQLPQAWFRLAKVLCLGTIPLAYPSSAIAAQQALTWANQQGMTVLLDVNWRPSFWPDPSLAPDRIRAILPQIQQLKLAREEAEWLFDTVDPATIQARQPQLQAVLITDGDRGCHYWVAGWQGHCPSFPVKAIDTTGAGDAFVAAWLAQNTQMDFQWTSAEQVQTAIRWASAAGALTTLNPGAIAAQPTSDAIQSLLSKT

SEQ ID NO: 48556 - protein, 467 aa, Ustilago maydis 521
MSSNATTNSIPENVSAKTGLGSSATAPPYTIPISSRPPKQTYLQTTLFALVFNICIISVHLFQLLSWPLSLHPATKPIYHSHIAYTKLAFARILLIISQFFGPSQLIISIGDGKGGYLDPETFVHRNKQTGKIVSIDLPSRSIWMSNHQVYTDWLYLWCLAYYADLADSILIILKKSLKWIPFIGWGMQFYRFIFLARNWASDQAQLAKQLGEVASQNQNDAFSSASTDTAKKLLLLIFPEGTLVSSQTRPVSAKFAEKMGIKDMENLLLPRSTGLFFCLRTLAKEMHDLWLVDFSVGYPGVPPAGHGQDFYTLRSIFMQGVPPPAIHVHLTMTRITKPVAGDTSSNAVAVAQLATADIDAPPLGANIKPAESSEEERSAFETWLRQRWTNKDAEMHRFYTDGDFVQGEFTSLVKQGKQADPAQAHGKYVVLPVELRSLKEIGDAACWGISFIVLWSASKVYKAVFG

SEQ ID NO: 48557 - protein, 340 aa, Prochlorococcus marinus subsp. pastoris str. CCMP1986
MTLRVAINGFGRIGRNFMRCWLSRGAYTNIEVVGINVTSDPKTNAHLLKYDSVLGKLDGVDIQYTDDTFVINNKTIKCFSDRNPMNLPWKDWGVDLVIESTGVFNTDIGASKHLEVGAKKVILTAPGKGSGVGTYVVGVNADQYKHSDYDILSNASCTTNCLAPVVKVLDQTFGINKGLMTTIHSYTGDQRILDNSHRDLRRARAAATNIVPTSTGAAKAVALVYPEMTGKLTGIAMRVPTPNVSAVDFVFESSKSVTSQEVNNALKESSLGSMKGIIKYGDEPLVSSDYAGTNESSIVDSDLTMSIGDNLVKVLAWYDNEWGYSQRVVDLAEIVAQKWE

SEQ ID NO: 48558 - protein, 328 aa, Bacillus cereus G9241
MVERLYGHHFHLQDEYFGGSAIDLNGQPLPQRTLAACLASDAVLLGAVGGPRWDSAKERPEKGLLALRKGLGVFANVRPVTVESATAHLSPLKKADEIDFVVVRELTGGIYFSYPKERTDEVATDTLTYHRHEIERIVSYAFQLASKRKKKVTSIDKANVLESSKLWRTVTEEVALRYSDVELEHILVDAAAMELIRNPGRFDVIVTENLFGDILSDEASVLAGSLGMLPSASHAEKGPSLYEPIHGSAPDIAGKNKANPIAMMRSVAMMLGQSFGLTREGCAIEEAISAVLKSGKCTADIGGTETTTSFTKAVMQEMEEQALVGRGR

SEQ ID NO: 48559 - protein, 744 aa, Moorella thermoacetica ATCC 39073
MAELEEGIVSLFQDRKGTAVDRWVATTCGYCGTGCGLYLGIKDDRAVAVKADTEAAVNKGHLCLKGLYEWKTLHHPERAKVPLCRRGREMHPVTWEKALEETAERLRQALAAGGPEAVGIYHGGQLTLEEYYAIHKLAKGVLGTPNIDANTRLCMASTVSGYTRSFGVDAPPGCYEDLDVSRLVFIFGANPAEMHPQLWQRILRNRKLNGARIMVADPRLTLPARVADLRLRLRCGSNIPLLYGLINILIKEDMLDRDFIRRATAGFEDLARAAAAFPPERVADLTGVPAADIVAAARLFGRSPSAVTVFCQGVNQTSQAVDAVTLINSLHLITGKIGRPGSAPFSLTGQASALSMREIGGGGSLPGFRNPENPEHRRQVADYWGIPEERLPRRVNDINRMLELIDTGRLKVLWVIGTNPAVSLPDLGFSRRQLEKVFLIVQDIFYPMETAAFADIFLPGAGWGEKTGVVTNSERRLNLVRRAVAPPGEARDDLAIVSSVARYLGAGGLFAWQGPENAFRELRELTRGRPNDMTGVDYALLEHLGGVQWPCPEGGRGTPRLYTDGVFPTRAEEAQGYGEFNHPEGRARLWAVPYAPPPEVPDGEFPFWLNTGRIIEHYHTRTRTKRIPELQALVPGAYVEINPHDAARLKISEGEVVRVVSRRGWIEVPARLTDVVAPGEVFVPFHFGDLDPGEGGRQQAANHLTGRNVDPLSGQPLAKTGACRIERQEAGSMGQEGQGENCSG

SEQ ID NO: 48560 - protein, 194 aa, Bacillus cereus G9241
MRESSQIRETTETKIKLSLQLDEGKNVSVQTGVGFFDHMLTLFARHGRFGLQVEAEGDVFVDAHHTVEDVGIVLGNCLKEALQSKEGINRYGSAYVPMDESLGFVAIDISGRSYIVFQGELANPKLGDFDTELTEEFFRAVAHAANITLHARILYGSNTHHKIEALFKAFGRALREAVERNANITGVNSTKGML

SEQ ID NO: 48561 - protein, 138 aa, Oryza sativa (japonica cultivar-group)
MAGKKVQVCALFLALNVLFTMQMGAVVQACEPYCPTPTPPVTPPPSPPSGGGNKCPIDALKLSVCANVLNLLKLKIGVPESEQCCPLLGGLVDLDAAVCLCTAIKANILGINLNIPVDLSLLLNYCHKTCPSDFTCPL

SEQ ID NO: 48562 - protein, 302 aa, Oryza sativa (japonica cultivar-group)
WQVPALVQELLATVQEPPGRFVQPEQHRPDAAPPASFPIVDLGRLSSPSPDDDGGGDEAAKLRRALDSWGLLQVTNHGIEASLMDELMSASKEFFRQPLQMKREFSNLNDGEQFRAEGYGNDKVRSKDQILDWSDWIYLKVEPEDERNLALWPKHPSSFRDALHEFVVRCRRVKRDVLRAMARIAGLDDDDQHFVDQLGGRATVHARFNYYPPCPRPDLVMGIKPHSDGTVITVLLVARGADGLQVLRYGVWYSVPSSSTHALLINVGESTEVMSNGMFRSPVHRVVNSAEKERISLAMRSG

SEQ ID NO: 48563 - protein, 226 aa, Ralstonia solanacearum GMI1000
MPHRIKELFENNRKWVERVNAEDPAFFSGLANQQNPEYLWIGCSDSRVPANQIIGLPPGEVFVHRNIANVVVHSDLNCLSVLQFAVEVLKIRHITVVGHYGCSGVKAALTNQRFGLADNWIRHVRDVAEQHDTYLGTVIREQDRHDRLCELNVIHQVNNVCLTTVVQDAWERGQPLTVHGWIYGVKDGLLRNLGMAVNSNEELHGQLASAWLNYGKKGSVPTPVGY

SEQ ID NO: 48564 - protein, 267 aa, Zea mays
  misc_feature (229)..(229): Xaa can be any naturally occurring amino acid
  misc_feature (250)..(250): Xaa can be any naturally occurring amino acid
  misc_feature (263)..(263): Xaa can be any naturally occurring amino acid
MAENMNSELNMIGSLLPLFPCITFDVEYAGTLHRSSAATRIAPSKQYALVKKNVDAVPIVMLGITLSNEYGNLPLTADGEGRLFQLAWEVTFSDFDPRRDRHAPESVTFLRSQGVCLDKARARGVSSAAFAAKLAAILSATPRPNELTWAAFGGAYDFAYMLKILTGGQPLPETWHEFMAQTHALLGGGRVFDAKYMAEHCERTDLGGLGLRRMAATLGMRWDFPELPXLAGRKSHIACFICTIMRRRIXYRDGGDILVGLLXGIHW

SEQ ID NO: 48565 - protein, 617 aa, Oryza sativa (japonica cultivar-group)
MDSDYGVPRELSALQKARALYRPDLPPCLQGTTVKVEYGDAAIAADVAGAHVISHAFPHTYGQPLAHFLRKTAAVPDATVITEHPVVRVGVVFSGRQSPGGHNVIWGLHDAIKAHNANSKLIGFLGGTDGLFAQKTLEISDEVLSSYKNQGGYDLLGRTRDQIRTTEQVNAAMTACQALKLDALVIIGGVTSNTDAAQLAETFAESKCSTKVVGVPVTLNGDLKNQFVETTVGFDTICKVNSQLISNVCTDALSAEKYYYFVRLMGRKASHVALECALQSHPNMVILGEEVAASKLTIFDITKQICDAVQARAEKDKNHGVVLIPEGLVESIPELYALLQEIHGLHDKGVSVENISSHLSPWASALFEFLPPFIRKQLLLHPESDDSAQLSQIETEKLLAQLVEAEMNKRLKEGTYKGKKFNAICHFFGYQARGALPSKFDCDYAYVLGHVCYHILAAGLNGYMATVTNLRSPVNKWKCGAAPITSMMTVKRWSRGPAASQIGKPAVHMASIDLKGKPYELLRQNSSSFLMEDIYRNPGPLQFEGPGGETKPISLCVEDRDYMGRIKQLQEYLEKVKSIVKPGCSQDVLKAALSAMASVTEMLTIMSSPSFSGQATI

SEQ ID NO: 48566 - protein, 144 aa, Cryptococcus neoformans var. neoformans B-3501A
MALKRINKELIDLGRDPPSSCSAGPINDNLFQWQATIMGPADSPYSGGVFFLSLTFPTDYPFKPPKVQFTTKIYHPNINANGSICLDILRDQWSPALTISKVLLSICSMLTDPNPDDPLVPEIANTYKTDRARYEATAREWTRK

SEQ ID NO: 48567 - protein, 87 aa, Glycine max
MCPLRFILVFFSAVLAGYFAWKTVRSDPKIEVFSEDSANEDKSFKKEDFDFKKMIQNGFWGFVDMASGSYLWRNLRPTNKDAELKSS

SEQ ID NO: 48568 - protein, 847 aa, Pseudomonas putida KT2440
MTYNPQVNLTNCDREPIQIPGSIQPHGCLLACDASATVVLRHSVNAPQMLGVANDINGQKLHAVLGDEVTHTLRNALARTRDASRPALSFGVTLPNGAAVDIAAHLYKGTAILEFEPAGASIAEPIELARTLIAQLREIDQTHKLFRDAARFVRAVLGYDRVMIYQLGADGAGKVVAESKRSDLESFMGQYFPASDIPQQARALYLRNPIRVISDAQFNTVAINPVLDPSGEPLDLSYAHLRSVSPIHCEYLCNMGVGASMSISVIVNGELWGMIACHHYAPRTLAMGQRVAAEMFGEFFSLHIETLRSRQKLEAAVRIHKALDSLLRDANQAADIDGFFHARLPRLMSLIPCDGIGMSLLGRWSCAGLAPPQTAVPDLLRLADMVSEGRIWASNRLSTVLPSAQAYFNDVSGVLIIPMSQHPRDYLIFFRKEVVETLDWAGDPNKTYDSGALGDRLTPRKSFAIWKETVHQQSLPWTEQDRQFGDAIRTAIVEVVLHNSELLASERAKADVRQRMLNEELNHRVKNILSLIGALVAHPTPESQTLQDYVATLKGRIQALSLAHDQVVRGDGGGRLAKLLEAELSPYRTAADVIELQGPNVILDARAYSVMALVLHELATNAAKYGALSRAGGKLSVSWAIDASNACAISWREMGGPTVRPPSRSGFGTVLIDRSIPFDLGGTSAVEYHPEGLQGFFRIPAKHLSVAEAAETALPATPLARANGAFAARSGLCVLILEDQLVIAVGLEQILNDAQIKDVITASSEDQAMQLLGSHKPDAAILDVNLGTGTSISVADELVRRQVPFLFATGYGDGISIPEHLQHVPVARKPYDANAILASLQSLLELG

SEQ ID NO: 48569 - protein, 140 aa, Glycine max
  misc_feature (45)..(45): Xaa can be any naturally occurring amino acid
  misc_feature (78)..(78): Xaa can be any naturally occurring amino acid
  misc_feature (106)..(106): Xaa can be any naturally occurring amino acid
  misc_feature (132)..(132): Xaa can be any naturally occurring amino acid
LSTATRAGMVAPFTGLKTMAGFPTSKTNNDITPRASNGGRVSFFXERTPDGKNEVDTLRHLPDDDDAQLAKEPATVLXKGWIPWLEFEKEDGFVYREHKRAPGYYXGRYWTMSDTETFGRTDRSPVLKRLSXGNTGYPQA

SEQ ID NO: 48570 - protein, 545 aa, marine gamma proteobacterium HTCC2207
MNGIYDRHLDKNQANYQPLTPLTLLERAATVFPDHIAIIHGDMQITYGQFYSRCRRLASALTDQGIGSGDTVSVMLANTPAMLEVHYAVPMCGAVLHAINTRLDASVIAFQLDHGESKVLITDLAFSQTVKFALKLIAVKPLVIDYLDPVFPQQGQLLGDDYEAMLASGDPDFDWLMPDDEWDAIALNYTSGTTGDPKGVVYHHRGASLLAQGNVITASIPKHAVYLWTLPMFHCNGWCFPWTMSAVTGTHVCLREVRADAIWAAMIEHKVTHLCGAPVVMSTILGVEKEHRQALSQVVDFFTAAAAPPEGVLAEMREAGFNVTHLYGLTEVYGPAVVNDWNQQWEALPASQQARVKARQGVRYHALEGLDVVDPQTMKPVPRDGETLGEVMFRGNVVMKGYLKNQQATDEAFKGGWFHSGDLGVVHPDNYIQLKDRSKDIIISGGENISSIEIEEVLHKHAAVSFAAVVAMPDKKWGETPCAFIEVIEGAQLSSEDLDRWCRQHMAGFKVPRHYVFEPILKTSTGKVQKFALRQRAAKMAIQVD

SEQ ID NO: 48571 - protein, 402 aa, Daucus carota
MVATTLESPRVETLAGSGIQLIPKEYVRPKDELISITNIFEEEKSDEGPQVPTVDIADILSEDKAVREKCYERIKDAAVEWGVMHLVNHGISNELMDRVRVAGQAFFAEPIGEKEKYANDPGTGMIQGYGSKLANNASGQLEWEDYFFHLVYPEEKADLSIWPKRPQDYIPATREYAKELRGLATKLLSALSFGLGLEEGRLEKEVGGMEELILQMKINYYPKCPQPELALGVEAHTDVSALSFILHNTVPGLQLFYGGKWVTAKCVPDSIIVHIGDTLEILSNGKYKSILHRGLVNKEKVRISWAVFCEPPKEKIILKPLPETVTEAEPPLFPPRTFAQHMAHKLFRKSQEAIDDSKKVQPQEQNNAETDIPQPEEQQKTEESNPQKIEILKPGEEASSSP

SEQ ID NO: 48572 - protein, 389 aa, Daucus carota
MVATTLESPRVETLAGSGIQLIPKEYVRPKDELISITNIFEEEKSDEGPQVPTVDIADILSDDKAVREKCYERIKDAAVDWGVMHLVNHGISNELMDRVRVAGQAFFAEPIGEKEKYANDPGTGMIQGYGSKLANNASGQLEWEDYFFHLVYPEEKADLSIWPKRPQDYIPATREYAKELRGLATKLLSALSFGLGLEEGRLEKEVGGMEELILQMKINYYPKCPQPELALGVEAHTDVSALSFILHNMVPGLQLFYGGKWVTAKCVPDSIIVHIGDTLEILSNGKYKSILHRGLVNKEKVRISWAVFCEPPKEKIILKPLPETVTEAEPPLFPPRTFAQHMAHKLFRKSQEAIDDSKKVQPQEQNNAETDIPQPTEQQKTEESNPQKI

SEQ ID NO: 48573 - protein, 462 aa, Coccidioides immitis RS
MSTLEELEDLEREDKDKRKEQEERDGQKSDKDGDAEMKDADQKKEEDDLLDEEILRSSTRDIINRRKLLDNDMRIMKSEYQRLMHEQNTMKEKIKDNLDKIENNRQLPYLVGNVVELLDLDVEKEAVEEGANIDLDATRVGKSAVIKTSTRQTIFLPLIGLVDHEKLKPGDLIGVNKDSYLVLDTLPAEYDSRVKAMEVDEKPTEQYTDVGGLNKQIEELVEAIVWPMREAERFKKIGIKAPKGALMYGPPGTGKTLLARACAAQTDATFLKLAGPQLVQMFIGDGAKLVRDCFALAKEKAPAIIFIDELDAVGTKRFDSEKSGDREVQRTMLELLNQLDGFASDDRIKVLAATNRVDVLDPALLRSGRLDRKIEFPLPNEEARAQILKIHSRKMTVDDGVNWAELARSTDEFGGAQLKAVCVEAGMIALRKGMSKVGHEHYVDAIAEVQAKKKDTNVGIYV

SEQ ID NO: 48574 - protein, 466 aa, Moorella thermoacetica ATCC 39073
MASSILRKKDIATAMEMAAMDQYRLRRELKAMDLFFLVIGITIGGGIFVLPGVMAAEHAGPGVTISFLIGAVVAIFTGLCYVEFASMVPVAGSAYTYSYIALGEIFAWIIGWDVLLEFTLVCSAVAVGWSGYIVELLKDMGLSLPPAFTTDIAHGGIVNLPAVFILLVVAYIIYGGISLTGKVNDAIGIIKLLTVVFFIIVALPFVKPVNWQPFLPFGWQGVMTAAALGFFAYGGFDAVTTAAEETRNPNRDIPLGLILGLVVVASLYVLVSLVLTGVIPYTKLDTPAPVAFALSYLGKRWGGSLVAAGAICGLFTVMMGAMLGGSRILFALSRDGLLPPVFSRVHATRRTPYVATLIVLTVAVLTGGFLSLGELVELVNIGMLTAYLLTSISILVMRLRYPEIERPFRVPAVWLVAPVATLGVVALTFSLPGATLVRFAIWFIVGMLIYFGYGIRHSKLANRENN

SEQ ID NO: 48575 - protein, 282 aa, Arabidopsis thaliana
MVRKMKLPFLNKNTSSSSFSSNSSSSSSSWPWPSSHQQNLKTISSKASFIVNKPKDVYEPEPPPRSFSSSPSSSSYSFFSSTSHAIENPPEIESIENVIKGLKSSKRLIFERRGTSNSILEEATKRDDHEEEEDGLMLLSLESNDPYTDFKNSMEKMVEVHVLHHDWISLEKLLFWFLKVNVKASHRYIFAAFVDLVLNLAVGPSKDVAGEPNSDVVVEDSLSSSWPVSLYSSSDENSSTSVRFLPETSIGEKGRDVCCLSSLFELEEKIKDNIDPNDYVSS

SEQ ID NO: 48576 - protein, 528 aa, Prochlorococcus marinus subsp. pastoris str. CCMP1986
MSKKLLKKERDPSILILDFGSQYSELIARRIREADVFSLVVSNFTSVKEIQDINPKGIILSGGPSSVYEDNAPKCDAKIFDLGIPILGICYGMQLMVKELGGEVTPAINKAEYGRAPINIDCESDLLSNVQDKSIMWMSHGDSINNLPEGFIKISHTENTLHAAISNKQKKLFGVQFHPEVIHSEFGMTVIKNFVYSIAKCKADWTTETFLEETIPRIKQQVGDKRVLLALSGGVDSSTLAFLLNKAIGKKLTCMFIDQGFMRKGEPEFLMEFFDKKFHIKVEYINARERFIDKLNGITDPEEKRKIIGREFIRVFEEESNRLGPFQYLAQGTLYPDVIESAGTNLDPKTGERIAVKIKSHHNVGGLPKDLQFKLVEPLRKLFKDEVRKVGGALGLPDEIIKRHPFPGPGLAIRILGDVSHEKLNCLRDADWIVRDEIKKAGLYNDIWQAFAVLLPVKTVGVMGDKRTYAWPIVLRCVSSEDGMTADWSRIPYETLERISNRIVNEVEQVNRVVFDITSKPPGTIEWE

SEQ ID NO: 48577 - protein, 821 aa, Moorella thermoacetica ATCC 39073
MKAIIMAGGEGSRLRPLTCKRPKPLVPVANRPVMEYCVDLLRELGIKEVGVTLQYLPQLIEEYFGDGSDFGLHLHYFVEDKPLGTAGSVKNAAAILDETFVVVSGDALTDFDLRPAIARHKESGALATLVLTAVDNPLEYGVVITNPDGSIRSFLEKPSWGEVFSDRVNTGIYILEPEVLELIPEGRPFDFSKDLFPRLLKEKRPLYGVTLSGYWCDIGNLTQYRQAQEDILRGRVKVRVVGQDKGGGVVMGEGVEIAPGARIEGPVLIGGACHIATGAVVGPFTVLGPYTRVEEGATVRRSVLWDNVYTGEGANVRGAVVCSRASLQRRVQVYEGAVIGDGTQVDAGAEVRPEVKVWPEKTLGRETVVHESLIWGRGVARPLFVGSQAPGYLHGDLTPFQVTRLGMAYGASFPPGTTVGLSTFAGGAGEMLYKALAAGLMAAGVQVADLGRLLTPIHRFAVRSLGLDGGCHIKRDAAERDKVWLHLVNSRGHDLNPAAVRKIENLYWREDGRRVQEVPASIYFPGLEGAYRDWLLATLGDHGLKKRALRVALGGQGQVAGVAGTILQDAGAEVIRLDLDPAKTWQAVQEDLPYFAGEIRRYGADLGAALDSNGEELILFTGEGRRVAPAQQMTLLARVYLETHRGASLVLPVTAPRVLEQVAGGLHGRVERVKGHPGIYHEAMARADGETALGQQHLQLDALAALVHILDWLASREESLDSAVAALPPVYTASRTVACPWEAKGRVMRTLISEEPADGVELLDGVQVRHGKGWSLVLPDGETPHYHIYSEAFSQEAAEELAGFYEERLKELIAREKSKGR

SEQ ID NO: 48578 - protein, 361 aa, Lotus japonicus
MGDAAGRGLECQKTMDGKESNRNGLEKELPLCCLKAIASDPELDAKCHSTVVSGWFSAPQTCSGKSGKDAYFNNPMWPGEAHSIKVDKILYKEKSEYQEVLVFESSIYGKVLVLDGIVQLTEKDECAYQEMIAHLPLCSIASPETVLVVGGGDGGVLREVSRHSSVKRIDICEIDKMVIDVSRKFFPELAVGFDDPRVHLHVGDAVEFLRCTPEGKYDAIIVDSSDPVGPAQELVEKPFFETLAKALRPGGVLCNMAESMWLHTHLIQDMISVCRETFKGSVHYAWASVPTYPSGLIGFLLCSTEGPPVDFVNPINPIEKLEGADKHKRKLRFYNSEMHTAAFALPAFLKREVSLIRDPSA

SEQ ID NO: 48579 - protein, 389 aa, Arabidopsis thaliana
MTMMSDLTQDLVEEILSRVPITSLGAVRSTCKGWNALSKERILCIGEPKQQFLGFMMLDYRLCSMRFNLHGILNEDFVSISMYQVETSQVFYCAGLLLCVTREKSSRLIIWNPYLGQTRWINTKTTKTGYNTYALGCDNNKNHKILKVFCDDYQCYYEIYDVKSNSWSAFNVTDPNWHIDYDICALVNGNTYFLTKERILVEDSDEDEDEVETPEILICFDFTAERFGKFLHLPFQFDIDFGDTGGLSCVKEEKLAVLLKRYDQNVIEIWVTTKIEPNVVFWKPFLKVDIETVLGALLDFQLDSFFIDEEKKLAVVFSSNKSKCYKTAYIIGEDRYLKEVDLGECKPLRSPIVCFSSYVPSLVQINQIAVPKRRENKRKRKSKGKGREV

SEQ ID NO: 48580 - protein, 880 aa, Oryza sativa (indica cultivar-group)
MAGKEIYHKMKDKVKDAFSSSGPETGKGKTKLSGKRVKHGYHLVKGKSNHPMEDYLVAEYRQEGEHDLGLFAIFDGHLGHTVPDFLRSHLFDNILKQPEFLSNPQAAIRNAYQLTDAKILESAAELGRGGSTAVTAILISSENSVNLVVANVGDSRAVISKSGVAKQLSVDHEPNKERHSIEKKGGFVSNLPGDVPRVDGQLAVARAFGDRSLKKHLSSEPDVVEEPIDENTDFLILASDGLWKVMSNQEAVDEIKDFKDAQAAAKHLTEQAVNRKSKDDISCIVARRPAATLDDLEVASASTPPIGNPNLAGLRALCDDKACKLMCDCTGELEWQNMYVEEPQIVDLCDKSDDESDYEVEMELEVESEEDGEKGDVHVDASKGKEVDKGKAIAEEETDRRIVLYQSESAPLASHQPFSSAPKASHEPSDSSPIPNQPTYDTKPIANDPPSDSDEDNDYILGDEAQSDDDEEAAEIEKHYKKVKRKVKAGQLENLDDFFLERGQPSVHGGVEDAGNETPYANSDEEDSVDETGSDGEVRTKRSKEPRYKKSEGVPKFELGMKFNCKKQFKKAITKYALAEKKVINFIKDDGQRVRAQCDWHNCPWRHFPDKQFQKKFWRCAKAPCRMLFNLARAKLAQVTQAGAQAILNTHPEHWSRAWFRSTHVHCLQPVEGMSAWPEDDREALNAPGYIKMPGRPRTKRRREMHEPPKPTKMSKYGTVIRCTSCKQIGHNKSTCAKHHGASSSNLGSSKQLPSPSQQMVLSNTPGSSAQSRKRKAVSLTTTSTTEHSKSNQSKSKAAMDSQEVVRVAAKAKVSTAQGGSAREDLQAIVPHSNSSTTASVRLTSGKATVTVSAQEPTKNKPKKRAGGSLILLPWEAKKL

SEQ ID NO: 48581 - protein, 284 aa, Escherichia coli
AGKPTDKPNLVCGPVQISWHKFARYWDVELREIPMRPGQLFMDPKRMIEACDENTIGVVPNFGVTYTGNYEFPQPLHDALDKFQADTGIDIDMHIDAASGGFLAPFVAPDIVWDFRLPRVKSISASGHKFGLAPLGCGWVIWRDEEAVPQELVFNVDYLGGQIGTFAINFSRPAGQVIAQYYEFLRLGREGYTKVQNASYQVAAYLADEIAKLGPYEFICTGRPDEGIPAVCFKLKDGEDPGYTLYDLSERLRLRGWQVPAFTLGGEATDIVVMRIMCRRGFEM

SEQ ID NO: 48582 - protein, 446 aa, Oryza sativa (japonica cultivar-group)
MGAIGEWRRGPVIGRGATATVSIATDRRTGGVFAVKSVDVARAGALRREQGMLSALASPFVVPCVGSGVSAAVDGSGGACYDLFLEYAPGGSLADEIKRCGGRCEEPLIRSRVGDVLRGLAYVHAAGIAHCDVKGRNVLVGADGRAMLADFGCARWMAAEDCNAGGVTIRGTPMFLAPEAARGEAQGTAADIWALGCTVIEMATGGAPWPRFADPVAALHHVAHSVDVPESPAWFSAEGKDFLARCLIRDPAKRWTAEQLLEHPFVASAASDSTSKAVQIEQRVSPKSILDQCLWESTSTDSDATVALAPADRLRALSAGASVAPDWTWSMDDWIAVCGGRADDHDTTPSPQPDTTTSFFRGDEASSDLVFPGGGELAAAADGPRGHDDDDDDDDHGVSSSPCSWRRSETERGAVAVAATVPLMAKSSEITGVERSIESRVASGSG

SEQ ID NO: 48583 - protein, 213 aa, Zea mays
RPGKCPSSVFLLCRLPSSTPLPSPHHLQPRLSTAAQASLRLRSARAADVLKSKGKSADGSWLWCTTEDSVYDAVKSMTQHNVGALVVVKPGQNKSIAGIVTERDYLRKIIVQGRSSKSTKVGDIMTEENKLITVNPDTKVLQAMQLMTENRVRHIPVIDGTGMLGMVSIGDVVRAVVAEHREELNRLNDYIQGGYGRRVQRRPPPIAVSEVRL

SEQ ID NO: 48584 - protein, 322 aa, Coprinopsis cinerea okayama7#130
MPGAIPSPRYLPTVIRESFPPAPKFTSEDVPDLTGKVIIVTGANAGMGKQTAKVLLSRNAKVYMAGRNEAKLSKAIEELKEATGKEGLPLILDLADLKSVKKAVEDFTSKEKELHVLFNNAGVMVPSLDDLTAQGYDSQFGTNVLGHFYLTKLLLPTLLATAKNPISCPEGKVRVVHTSSIASIMADGVNFETLKDGPERRKKGEWGLYHQSKLGNVILSNELARRYGDEGLVSTSVNPGAIKTDLLRHTKWWDKLMIKAVLHPVEYGALTQLYAGTSEDGLKFNGEYLIPWARLGEPNPVALDKKLGEELWKWLEEQVVDI

SEQ ID NO: 48585 - protein, 417 aa, Microscilla sp. PRE1
MSQLDKTCVIIGASHAGVNCAFALRKEGWQGGIVLYDADPSLPYHRPPLSKAYLTSDAGIEKYLLKSAESYEKDNITLRLGIQVSAIDRTHKILTLNDGNTRSYDKLVIATGARPIIPPTKGIKTAKNLYPLRNAADVQNIRQALESNENKRVVIVGAGYIGLEIAASLKNRGAQVTVLEREDRVLARVTAPEMSAYFQQLHVSQGVEIVTNKNVVSIAPRNGFNTITCSDGTQYDADVIVMGVGIRVNLELAEDAGLNISNGICVNAAGQTNDEDIYAIGDCTLHYNPHYNRHIRLESVQNAVDQAKVTAAAICGKEVAYNAIPWFWSDQYDVKLQIVGLSSGYNELLIRREDDGRKFSSWYFKDDELLAVDAINNAKAYVIATKFIKERRKVDKIKLTDASVALSPLNLSAESHD

SEQ ID NO: 48586 - protein, 244 aa, Streptococcus agalactiae 2603V/R
MQLKDKNIFITGSSRGIGLAIAHQFAQLGANIVLNGRSEISEDLIAEFADYGVKVIAISGDVSSFEDANRMIKEAIASLGSVDVLVNNAGITNDKLMLKMTVEDFESVLKINLTGAFNMTQSVLKPMTKARQGAIINISSVVGLTGNVGQANYAASKAGLIGFTKSVAREVAARGIRVNAIAPGFIESDMTDVIPEKMQEAILAQIPMKRIGKGKEVAQVASFLAEQEYLTGQVIAIDGGMTMQ

SEQ ID NO: 48587 - protein, 335 aa, Haemophilus somnus 2336
MKTLGQFIVEKQAEYPNAKGELSGILSSLRLVAKIIHRDINKAGLTNNIIGNSGVENVQGETQMKLDLFAHNTMKQALITREEVAGFASEEEENFVAFDTERGRNAKYVILTDPLDGSSNIDVNVAVGTIFSIYRRVSPIGTPVTLEDFLQPGHKQVAAGYIVYGSSTMLVYTTGNGVNGFTYDPSLGVFCLSHENIQIPPNGKIYSINEGQYLKFPMGVKKYIKYCQEKDKSTDRPYTSRYIGSLVSDFHRNMLKGGIYIYPSATTYPKGKLRLLYEGNPMAFLAEQAGGIASDGKDRILDIQPKELHERVPLFVGSREMVRKAEEFMREFSEE

SEQ ID NO: 48588 - protein, 258 aa, Ralstonia solanacearum
SVKNAAVNVPYGGAKGGIRVDPRKLSSGELERLTRRYTSEIGIIIGPNKDIPAPDVNTNAQIMAWMMDTYSMNEGSTATGVVTGKPIALGGSLGRREATGRGVFVVGSEAARNLGIDIKGARIVVQGFGNVGSVAAKLFHDAGAKVIAVQDHKGIVFNGAGLDVDALIQHVDHNGSVAGFKAETLSADDFWALECEFLIPAALEGQITGKNAPHIGAKIVVEGANGPTTPEADDILRERGILVCPDVIANAGGVTVSY

SEQ ID NO: 48589 - protein, 145 aa, Nicotiana sylvestris
MASLAAFAAVQPTTNVKGLAGSSITGTKLHLKSSRLNLKPTKSRAGPVVAKVGDKSVVFDLEDLGNTTGQWDLVGSDAPSPVNSLQSKFFETFAAPFTKRGLLLKFLILGGGSTLAVFSSTASGDILPIKKGPQLPPKLGPRGKI

SEQ ID NO: 48590 - protein, 143 aa, Nicotiana tabacum
MASLATLTAVQPTTTIKGLRAIAGTKLNVKSSRLNLKPSKSRAGAVVAKVGDKSVVFDLEDLGNTTGQWDLVGSDAPSPVNPLQSKFFETFAAPFTKRGLLLKFLILGGGSTLAVFSSTASGDILPIKKGPQLPPKLGPRGKI

SEQ ID NO: 48591 - protein, 388 aa, marine gamma proteobacterium HTCC2207
MSDRIPRDSDNDYSEVMAKTRRDFAADKTSSKLDHIGHYSVDPATTAGNIENFIGVAQVPLGLIGPLRVNGEHASGDFYVPMATSEGTLIASYNRGARLLRDSGGVKVTVVDDAMQRAPVFVFNDAREARDFGLWVEQNVEEIAAQAETTTSSGKLRNIEQYAAARMRYLRFNFTTGDAAGQNMVGKATFIACEWIMKTYPGIQRYMLSGAMDTDKKHSQINTLHSRGKRVVAEVLIPGELLEKTMGVTAEVLFKARQINQVGSFMAGSSSTGAHAANGIAAVFIATGQDAANVAESSSSIIFADVDKAGNYYLSITLPSLIVATYGGGTGLPTQQECLDMLGCNGAGKVHKLAEIIGATVLAGEVSLMSAVLAGDWVTSHDALGRNR

SEQ ID NO: 48592 - protein, 215 aa, Pseudomonas aeruginosa PAO1
MSDLQQLFENNVRWAEAIKQEDPDFFAKLARQQTPEYLWIGCSDARVPANEIVGMLPGDLFVHRNVANVVLHTDLNCLSVIQFAVDVLKVKHILVTGHYGCGGVRASLHNDQLGLIDGWLRSIRDLAYEYREHLEQLPTEEERVDRLCELNVIQQVANVSHTSIVQNAWHRGQSLSVHGCIYGIKDGLWKNLNVTVSGLDQLPPQYRLSPLGGCC

SEQ ID NO: 48593 - protein, 590 aa, Ustilago maydis 521
MADFYVRSAQALDQVLGDECSVKAAAGAHADSGRVLAIVINSLAYRSALMHAIDECRVAKLEERIFTLAATPARARASSVKDKNKPGKQQGKKAAGKYPSKQALLLVLCHDLLFQARGIQASKTWPPKLTLERYRPSLHSALVKLQIRLGKSRIQDLRSGALYEQMTARIPRWIRINPLRATRDQVLQWLSDNRYTQVDVRDDEIGGIKQFAESTHVAGLLAFHPKATSALLKSEMYRENWIVMQDLASCFPAYILDPPAGSSVIDATSAPGNKTSHLSAIMHSKSGSTRENGRIDAFERDAARYKTLVKRLDAVGALALPRPQPTQHGNVTAHRRDFLTTNPDDFPNVTHMLLDPSCSGSGIVNRLDFLKEDDDVEHDPLDADALDSDTTTKLARRLRQLSEFQQLMIRHAFKFPALRKVVYSTCSVHAQENELVVINALQTHEAQSRGWKLAPRKHVIPTWPVRGDTDACTGKHHVAESVIRCIPGGKGEGDKPNVESCNGFFVACFIRDDQIQHDEQETAANKRPFQEQDDVDDDGQAEDEAQEPQQQQQQQQQQPQSKNANAAANRKKKLQKRRKKQRLEFQQQQL

SEQ ID NO: 48594 - protein, 991 aa, Candida glabrata CBS 138
MLHQDNCYGVAFRAIATADEELFKQTVRFYHSLGFSTIKDFNKFKHGENVVLASGTSDDSLREVWLESFKLSETDSLGFRVPQQEASNKAQSQGAFVKVRLVMHEPLKDVYSTAQTSHITYFSADLPAIAKEFGDKVTKVSDSVLQMNDPMGNQLSFTSFASPLDEKPTNMDAFLKPLEKEDDITASQSTDAVNQLKESLQSGSNLQKKKKIAVMTSGGDSPGMNAAVRAVVRTGIHYGCDVFAVYEGYEGLLRGGKYLKKMHWEDVRGWLSEGGTLIGTARSMEFKKREGRKRAAGNLISQGIDALVVCGGDGSLTGADLFRSEWPSLVEELVKDGTFTSEQVAPYRNLTIVGLVGSIDNDMAGTDSTIGAFSALERICEMVDYIDATAKSHSRAFVVEVMGRHCGWLALMAGIATGADYIFIPERAVPHGQWQDELKEVCQRHRNKGRRNNTIIVAEGALDDQLNPVTAEDVKDVLVDLGLDTKVTILGHVQRGGTAVAHDRWLATLQGVDAVKAVLEMTPETPSPLIGILENKIIRMPLVESVKLTKSVATAIENKDFDKAISMRDTEFIELYENFLSTTVKDDGSEMLPVTERLNIGIVHVGAPSAALNAATRAATLYCLSHGHKPYAIMNGFSGLIQTGEVQELSWIDVENWHNMGGSEIGTNRSVAAEDMGTIAYYFQKNKLDGLIILGGFEGFKSLKQLRDSREQYPIFNIPMVLLPCTISNNVPGTEYSLGVDTCLNALVNYTDDIKQSASATRRRVFVVEVQGGHSGYIASFTGLVTGAVSVYTPEDPISLKSIREDLSLLKENFRHDKGENRNGKLLVRNEQASSIYSTELIADIISESSKGRFGVRTAMPGHAQQGGAPSSKDRVIASRYAVKCIKFIEQWNKKNKATALDKDAKVLRFKFDKHGAKIPTVEHEDDSAAIICVNGSHISFKPIASLWENETNIELRKGHEVHWTEFNEISNILSGRLRLRAEVEASNNRV

SEQ ID NO: 48595 - protein, 233 aa, Zea mays
  misc_feature (106)..(106): Xaa can be any naturally occurring amino acid
  misc_feature (133)..(133): Xaa can be any naturally occurring amino acid
  misc_feature (219)..(219): Xaa can be any naturally occurring amino acid
MAALTSAKGALLPSWARSSSGGHGGDLWRVLGKALATAGGGGGGGCSLLLPRRWQSSLPQLDHVADRSNEESGGGGGEIDWDNLGFGLTPTDYMYVTRCSPEDRGXFPRGELCRYGNIELSPSSGVLNYAQGXLFEGMKAYRRPDRAGYTLFRPEENARRMQRGAERMCMPAPSVEQFVHAVRQTVLANRRWVPPQGKGALYLRPLLIGSGPILGLAPXPEYTFLIYAAPVGN

SEQ ID NO: 48596 - protein, 463 aa, Moorella thermoacetica ATCC 39073
MTLLFRRKSISEATELAELKEYKLRRDLNLLELFFLVIGATIGAGIFVLPGVAAAKYSGPAVSISFFLGGLVCICVGLCYVEFASMVPVAGSAYTYAYLALGEIFAWIVGWDLLFEFTAGTSTVSVGWSGYFVEFLRGFGIHLPKMITTDIAHGGFINAPAIIAILLVTYIVYSGIREAGKINAYLSLGKLCALALFLVLAIPFIKPVNWHPFLPFGWKGVMTGAALTFFAFTGFDGVTTVTEETKNPQRDVPIALVSGLGFITILYIVVSAVLTGVVPYTKLDVPDPAAFALVSIGKSWGGGIIAIAAIFGLFTVMMGNGLSATRILFAMSRDGLLPPIFARVHKTRRTPYIATLIIFSVALIGGGFLSIGELAELANIGGLTAFTLTAISTLVMRYSQPAARRPFKVPAIWVVAPLGTVGGIALISSLPPITFIRFGIWMVIGLVIYFSYGRKYSKADIGG

SEQ ID NO: 48597 - protein, 308 aa, Pseudomonas putida KT2440
MTSKLEQLKQFTTVVADTGDLDAITRLKPVDATTNPSLLLKAAAIPGYADLLKQVKADAKGNVDLACDKFAVAVGSGILKVIPGRISTEVDARLSFDEPALLNKARQLIALYEAAGVAKERVLIKLASTWEGIRAAEQLEKEGIQTNLTLLFSFAQAQACADAGVFLISPFVGRIYDWYKKSTGQEYVGAEDPGVQSVTRIYNYYKANGYNTVVMGASFRNIGQIEQLAGCDRLTISPELLQQLSDDQGELPQVLKPGNAGEAKQHLNESQFRWAMNEDAMGTEKLAEGIRQFARDQEKLEKLIAEKA

SEQ ID NO: 48598 - protein, 110 aa, Kluyveromyces lactis NRRL Y-1140
MADTYIPKTDLSRSELSRDELTQLEEFEMKYGPMSLIRESMLQRTPVIISLRNNHKLIARVKSFDKHCNMVLENVKEIWTENVNGKKVNRERFVAKLFLRGDSVIIVVKT

SEQ ID NO: 48599 - protein, 382 aa, Ustilago maydis 521
MIRIRHPQGTASFRVDDNATTLGELQSYIAEQSGIAALDQELKIGYPPKSLHISKLSESVLLSSEKIGIKKGEQVIAARKAGGSGASSSCGPQPSACSSASSLSYPTTSFGAIGAPKANVSTATGPRTSYGLGARTLQDALTARAPASSTSTASTSSKPGSVADGSVSIAIASSPSSRLTLKVVPDDNSCLFNSVGYVFTQRLGSDVCQNLRQTVASEIRSDREKYPDIVLGQPRDSYISKILSPTTWGGAIELSILSHHFGVEIDSIDVATGSVHRFGEDKAYENRAIIVYSGIHYDALTLQDGTDETTVFPNLTAIGLDETEDEVLSAAKQLCQELKKRRYYTDTASFSLKCKTCGTKLKGEKQAVQHAKQTGHGDFGEV

SEQ ID NO: 48600 - protein, 426 aa, Phalaenopsis sp. SM9108
MAFSVGLTRFIVSSHPKTAKEILSSPAFADRPIKESAYELLFNRAMGFAPFGDYWRNLRRISSTYLFSPRRVSSFEKQRSEIGEGMVRDMKRMMERNGVVEVRRMLHYGSLNNIMLTVFGKKFDFAKDEGLELELILKEGYELLGIFNWGDHLPLLGWLDLQGVRRRCRTLVAKVNVFVKKIIDEHKRRANGVGIDEGEGEDFVDVLLGLEEKDRLSESDMVAVLWEMIFRGTDTVAILLEWTLARMVLHPDIQSKAQVEIDSVVDSSRPVLDSDIQRLPYLQSIVKETLRMHPPGPLLSWARLAIHDVPVDGHMIPAGTTAMVNMWAITHDECNWAEPNKFNPDRFIDEDVNILGSDLRLAPFGSGKRVCPGKTMALAAVHLWLAQLLKSFKLLPSRNGVDLSECLKMSLEMKNPLVCVAVPRFE

SEQ ID NO: 48601 - protein, 463 aa, Arabidopsis thaliana
MRSDHYFSLRSPTEDFVGGYPSDEEWHGYINNNDRVLLKVISYSSPTSAGAECLDHDCSWVEQWIHRAGPREKIYFRPEEVKAAIITCGGLCPGLNDVIRHIVITLEIYGVKNIVGIPFGYRGFSDKDLTEMPLSRKVVQNIHLSGGSLLGVSRGGPSVSEIVDSMEERGINMLFVLGGNGTHAGANAIHNECRKRKIKVAVVGVPKTIDNDILHMDKTFGFDTAVEEAQRAINSAYIEAHSAYHGIGVVKLMGRNSGFIAMQASLASGQVDICLIPEVLLCYYFKFQNMIDELALRDPMHLKVPFNLHGPNGVLKHLKYLIETKGSAVICVAEGAGQNFLEKTNAKDASGNAVLGDFGVYIQQETKKYFKEISTPIDVKYIDPTYMIRAVRANASDGILCTVLGQNAVHGAFAGYSGITVGIINTHYAYLPITEVIAYPKSVDPNSRMWHRCLTSTGQPDFI

SEQ ID NO: 48602 - protein, 108 aa, Phalaenopsis sp. SM9108
MESRMIRYMIWDGLAGDVIELPGVKGKFLSMILDFCKKRVAWAAGGDGTLEGLKSDFVNVDLGTLIHLGAASFYLKTNDLVDLTSQTLANRIQGKTIEEVCRALNPEE

SEQ ID NO: 48603 - protein, 390 aa, Arabidopsis thaliana
MSEYRFRYDDDGMWLWPSSVSFISEDCFYRFLRITGVYAYCLMRIVGIGQSQTVSFDLKQESKQPISLVTLFELVAVDLQTLNDNLLSIVGAENPVLISAAEQIFGAGGKRMRPGLVFLVSHATAELAGLKELTTEHRRLAEIIEMIHTASLIHDDVLDESDMRRGKETVHELFGTRVAVLAGDFMFAQASWYLANLENLEVIKLISQVIKDFASGEIKQASSLFDCDTKLDEYLLKSFYKTASLVAASTKGAAIFSRVEPDVTEQMYEFGKNLGLSFQIVDDILDFTQSTEQLGKPAGSDLAKGNLTAPVIFALEREPRLREIIESEFCEAGSLEEAIEAVTKGGGIKRAQELAREKADDAIKNLQCLPRSGFRSALEDMVLYNLERID

SEQ ID NO: 48604 - protein, 392 aa, Oryza sativa (japonica cultivar-group)
MMEPAHAPGRDRLSALPDNVLRRIMSFLNARQSVQTCVLSRRWRHLWRSLPRINADYTEFCFACLDEKKEKVQEARFKKFVSTLLLRRDPVPLLDKFWLRYQVSDGNNNEKASAEAGLWISHALQLQTPVVEVLTFQFPLMLDHAVFTSDYLRKLGLSNAYLRMGFFEQLSRGCPQLEDVFLNDCIILDDEISSTTLKTLNIYASRFSEDYRASISTPSLTSLTLYKPDASVPSLKDMKSLVSASIILDDNTDIHELLMSLSGVRNLDLECPQKMVTIAKNTQWCPEFKDLVNLSLGQFCLGSKLYALTVFLKNSPKLEKLTLDPPEVIIDKLEERSFECEHLKIVEVICSEDDSTLLKLVEDIFVTSGMNSLQINRKSSYKQYYSDDFFQI

SEQ ID NO: 48605 - protein, 503 aa, Oryza sativa
  misc_feature (104)..(104): Xaa can be any naturally occurring amino acid
  misc_feature (117)..(117): Xaa can be any naturally occurring amino acid
MGGRVSKAVACCCCRSQHHGVVVESSEKTAEEDHGESYELPAFQEFSFEQLRLATSGFAVENIVSEHGEKAPNVVYKGKLDAQRRIAVKRFNRSAWPDPRQFLXKKLNQLDNSGAKXLANLLGCCCEGDERLLVAEYMPNDTLAKHLFHWEAQAMKWPMRLRVVLYLAEALEYCTSKGRALYHDLNAYRVLFDDDCNPRLSCFGLMKNSRDGKSYSTNLAFTPPEYMRTGRITPESVIYSFGTLLLDVLSGKHIPPSHALDLIRDRNFNMLTDSCLEGQFSNEEGTELVRLASRCLHYEPRERPNVRSLVQALAPLQKDLETPSYELMDIPRGGATSVQSLLLSPLAEACSRKDLTAIHEILEKTGYKDDEGTANEMSVGIHFSLSFQMWTNQMQDTLNSKKKGDNAFRQKDFSSAIDCYSQFIEVGTMVSPTIYARRCLSYLMNDKAEQALSDAMQALVISPTWPTAFYLQAAALLSLGMENEAQEAIKDGCAHETSSSSGH

SEQ ID NO: 48606 - protein, 316 aa, Pseudomonas putida KT2440
MHEHDVLCFGETMAMFVAEQAGDLAGVGQFGKRIAGADSNVAIGLARLGFKVRWLSRVGDDSLGRFVLDSLRCEGLDCSGVEVDANYPTGFQLKARSEDGSDPAVEYFRRGSAASRLSAAMVSPVWLQARHVHATGIPLALSDSCRALSHALLDGMRAAGRSISFDPNLRPSLWPDQSSMVREINALAAKADWVLPGLEEGRLLTGQHTPADIAAFYLDQGVELVVIKLGDAGAYFRSAKGEGQVAPVPVSRVVDTVGAGDAFAVGVLSALLEGRPVAEAVARGNWCGSRAVQSRGDMEGLPLRHELEAYDLRRSA

SEQ ID NO: 48607 - protein, 400 aa, Coprinopsis cinerea okayama7#130
MTLAAPKINSVGNVVASVDPPEDSGSGNFLVVSNGPNSAPLTGTNINVRRNTLHATLSTTLANLDMNKETKLELRNEDLVDIHDLGQGNGGSVKKVEHTPTKMIMAKKTVLIDAKPSVRKQILRELHIMHDCRSDYIISFYGAFLADNNICICMEFMDKGSLDGIYKKIGAIDIDIVGKIALAVLEGLTYLYDVHRIIHRDIKPSNILCNSRGQIKICDFGVSGELINSIADTFVGTSTYMSPERIQGAQYTVKSDVWSLGISLIELALGRFPFSQSDSDESDDEFSDASDYEGTLSPQPAGSVSLADLPPPKPRRQKNANGNGSTTKKDKRKSKGHIVNEPAPRLTPEGRYPKAAESFIDACLLKDPDARQTPKDLLKHEWIENARMSSVDVEAWANTF

SEQ ID NO: 48608 - protein, 202 aa, Zea mays
NSRVDPRVRPRVRALELLGLRDNGAEDASPPSSSSSSSSSSSPDHQEIDVSLIITDYCMPGMTGYDLLKRVKGSSSLKDIPVVIMSSENVPARISRCLQDGAEEFFLKPVKPADMKKLKSHLLKRKQPKQKNKPQAQAVESPEQQLDPHPQPVHEPEEAAADRNGVNKRKAAAMEEGLTVVVTAPESTKPRRLSTSSLTVET

SEQ ID NO: 48609 - protein, 543 aa, Burkholderia xenovorans LB400
MTALQPDTVQLWPDEVYLIGCAGAPRGNPDPAGASAEKVGFKAYNLLRMAELGLPVPPAFVLGTHYCRDARAREIATASTVWEPGLQELERTTGQRFGDPRQPLLLSVRSGAPVSMPGMMDTLLNVGLCDTTLAGMLRQTGNPRLVWDTYRRLVASYGELVAGVPSSIFEAEYAAFAGTRDEHGLDFTELRELTHRCLAAYERAAGQPFPQDPQVQLANAIGSVLASWQSDRACAYRKQCGISDAIGTAVTVQTMVFGNAGGRSGAGVGFTRDPVSGEPTLWVDFLFNAQGEDVVSGRRSARGHEELAQAMPAAWKALQDAATRLEHALGDMQDVEFTVQDARLYMLQTRNGKRTPQAAARIALDLLDEGVISAEVARERTAALKPAALTRTRIVASGDRPLTPLAHAASASNGVAAGEIAFDEARARMRHAAGASVVLVRRDAETDDIAALEVAAGLLTQRGARTSHAAVVARQLGKVCLVGCTGLRLDESARTLQLGDTVLHEGDEVTLDGNDGAIYAGTARTVIEPMAELQARLERLRAP

SEQ ID NO: 48610 - protein, 398 aa, Burkholderia xenovorans LB400
MLSHSLAFLSGGLLALSWWQIVLATLVSTHITIVSVTVYLHRCQAHRALDLHPLASHFFRFWLWMTTGIVTGKWAAVHRKHHAKCETQEDPHSPQFKGIWKVLLGGAELYRTEAKNGETLRRFGHGTPVDWMERNVYEKYPDLGVSLLMVIDILLFGVVGVSVWAIQMMWIPFWAGGVVNGLGHFWGYRNFGPPDASTNVFPIGILIGGEELHNNHHAYATSAKMSNRWYEFDIGWMYICVLSALGLAKVRKVALRPHLVKGKSVLDDETLQAVLRNRCEVMASYARTAEHAYRQELVRAKHMSRRERAALMRGVRKWFRDGQPAQDGARQPVPTELCDNHAKLLVYVELREDLAAIWERSNRSREQLLCQLEAWCRRAEQSRIDALREFSLRLRHYG

SEQ ID NO: 48611 - protein, 486 aa, Microscilla sp. PRE1
MIMSTVKNYKLYIDGEWIDATTGESQEILSPTDETVVGTVQMGVEADAQIALEAAERAQKQWKKVPARKRADLLRTFAAEIKANKNQLAELLVREQGKLLAVAKMEVEVTASFIEYACDGARSIEGDIIPSDNPAEHIMIHKIPRGVVVAITAWNFPLALAGRKLGPALVAGNSVVLKPTQETPIATLELGNIANKVGLPKGLINILTGQGSVLGNALVANPITKMVSMTGSTPAGQQIFRTAAENLIHVQLELGGKAPCIVFDDADLEQAVEGAFHSRFDNCGQVCTSNERLYVHESIYNEFMERFMEKVKGLKLGNPMDAATTIGPKVNAKEVAHMEHLVTKSVEEGATVAIGGKKPQGKAFEKGHWFEPTILTDVKQNMTIVHEESFGPILPVIKFSEFNEVIGYANDCEYGLAAMVFTNDMNKIMRLNDELEFGEIYINRGHGEQHQGFHNGYKLSGTGGEDSKYGFEQYMEKKTFYIKYKA

SEQ ID NO: 48612 - protein, 833 aa, Oryza sativa (indica cultivar-group)
MGMVLGKITVETPKHEVLHTGAGYEVRKYPPCVVAEVTYDPAEMKGDRDGGFTVLGNYIGALGNPQNTKPEKIDMTAPVITSGEPESIAMTAPVITSGEPEPVAMTAPVITAEERGQGKGQMTMQFLLPSKYSKVEEAPRPTDERVVLRQVGERKYGVVRFSGLTGDKAVKEKAEWLKAALEKDGFTVKGPFVLARYNPPFTLPPLRTNEAGRRDRIWPILVSGAAPFRFNVGPTKRSDPYPQGCNPVYGFGRNPTSLTVAKPFNANWIESNTFVFYQASHRRREPAMAMAASPFLILPSLFPKPTILAARIHPSIFRGRHIRCSPNDAAVPESPEPAPRRGRRKSPSPSPPKAKTTRRRTKKDTQESDSEGEEEPPKRRGRRTRKSKQEAEQEAAEKEDEVRAASPGTEDSKRAVQDEDGEAEATGSDSEDGEDSPYDWPPLVCCFGAPRWEFVPTVRVSDRQMHPDIYSTWLHLQWEPPEFARAPGSAASNVAIALTRLGGRAAVLGKVGDDDFGRELVYRMNCERVQTRAIRFDDGAATATARMKVGFRDREDGSGGTRLVAETVKSAAEDSLSKAEINVDVLKEARVFHFNSEVLLTPSMEITLFRAIELSKKFGSKIFFDLNLPLPLWRSRDETKELINKAWNEADIIEYYLDGFHLTRNWPQYYHYTPEEIAPIWHDGIKLLLVTYGTLRIHYYTPKFHGCVIGTEDALITPYTTDRTGSGDAVVAAAIRKLTSCPEMYEDQDTLERNLRFAVAAGIISQWTIGAVRGFPTESAAQNLKEQNNAHDIQVYFMSAATEVVKGKVLPKQLTGFSAQIPKANLKCKDSME

SEQ ID NO: 48613 - protein, 578 aa, Ustilago maydis 521
MVGVATTRDHSHVAQALADHRLSMVGATGAKGLVKNARTLAIAVFASMGGLIYGYNQGMFGQILSMHSFSEASGVKGITNPTLAGFITAILELGAWVGVLMNGYVSDAFGRRKCVVFGVVWFILGAIIQACTRDGSYNYIIAGRTITGVGIGSLSMIVPLYNAELAPPEIRGSLVALQQQAIVAGVMISYWFTYGTNYIGGTGAAQSRAAWLIPITVQILPALMLAIGIFFLPESPRWLINVGREQESLKVIADLRRLPENDLLVQLEFLEVKAQKLFEDRVSAHDHPDLQDGSRSSNFKLGVAQYKSLVTNPANLRRTIVAVVTMLFQQWCGINFVLYYSPFIFKQIGLEGNTISLLASGVVGIVLFLATIPAVLYIDTWGRKPTLYVGCAIMGACHLAVAIIIATCSDNWPAHRAAGWVACVFVWIFAAGFGFSFGPIGWIIVAEVFPLGLRAKGVSIGAASNWLNNFAVAMSTPDFISAAPYGVFIFLGVMCFLAIAYVKFFVPETKMKSLDELDAVFGDNSGRSKWEAGMMLQAQRDVGLLRLAGIDEGKISAVTADDASDKDEKSSDIITSTV

SEQ ID NO: 48614 - protein, 136 aa, Glycine max
EHGVCAKCCCSTKQIVGRDISEVEAEQKMLEEAIKNSRERERRSLLRAMNKDKSKSSNSAPTDTKGNKVGQLFPNASLEDYAKLNRVNVGHDDGEICDDSEGEVCEDEDDNSDNEDCDEDGNSDDEDGDSENEDVM

SEQ ID NO: 48615 - protein, 343 aa, Medicago truncatula
MEINCSSKQCLIDLQRYVALKVQKSAQHYTEAALDEITILQQIAEGDTDDKKCVVKLLDHFKHSGPNGQHVCMVFEYLGDNLLTLIKYSDYRGMPINMVKEICFHILVGLDYLHKQLSIIHTDLKPENILLLSTIDPSKDPRKSGAPLILPNSKDKTMLESTAARDTKTSNGDFIKNHKKNIKRKAKQAAHGCAEKEASEGVDGNHETSGAVESSPNASSAREQASSSAGTSRLSDADGMKLKEQGNRRGSRTVRQKLLASADVKCKLVDFGNACWTYKQFTNDIQTRQYRCPEVILGSKYSTSADLWSFACICFELATGDVLFDPHSGDNFDRDEVIIFLFT

SEQ ID NO: 48616 - protein, 193 aa, Cenarchaeum symbiosum
MRKNESQRETKETEVSVSVLLDGTGSTTVNTGQPFLDHLVSSLGKHAMFDIDLKASSRDGIVHHLVEDVAITLGGAIDKALGDRSGIMRFGHASVPLDESLSEAVVDLVKRPYHRIEMKIKRPEVEGIAKEDLEHFFDSLLRNLDCCIHLTVKYGNNDHHRVESAIKSLAVALRMAVSADPRREGPPSTKGSM

SEQ ID NO: 48617 - protein, 638 aa, Desulfovibrio desulfuricans G20
MATPVESGTVPCSLEPFDVYLFGRGEHWDIYRVLGAHAHAQDGETGYRFAVWAPNAHAVSLVGPFNDWRSGDFPLFPVGTSGIWAGFVAGMEYGRLYKFAVQGADGTVRLKTDPYALYCEMRPGTASFTWSLDSYAWNDAAWMQRRREAGPPLQQPVSIYELHAGSWMRRHGEGHPFVNWDELAGTLIPYVRDAGFTHIELMPVAEHPLDQSWGYQTGAYYAPTSRFGTPDDLRRFVDLCHQQGIGVILDWVPAHFPKDDWSLGRFDGTALYEHLDPRLGEHPDWGTYVFNYGRHEVRNFLFANALYWFKEFHVDGLRIDAVASMLYLDYSRKEGEWLPNVHGGNENLEAIDFLRELNRVVHEQYPGVMMIAEESTSWPGVSRPLYTGGLGFTFKWNMGWMHDTLNYMRQDPVFRAYQHSSLTFSMLYAFSENFVLPLSHDEVVHGKGALLSKMPGDMWQQQANLRLMYAYMWAHPGKKLLFMGGEIGQWNEWSESREPDWCLREFPAHEGIRNLVRDLNGIYAQEPAMHRHDHDWSGFRWLDFSDYGCSVISFARFAEDSPPVMWVFNFTPVVRRWYRVPCPRAGEWQEVLNTDSGYYGGSNVGNGGGAVACTDNWHGGHFMELTLPPLAAVALKPV

SEQ ID NO: 48618 - protein, 222 aa, Glycine max
MAAILARKSLLALRARQLAVSGQGLHSSQNYGLRLSAHSYSTKREDEEREQLAKEISKDWSSVFERSINTLFLTEMVRGLMLTLKYFFETKVTINYPFEKGPLSPRFRGEHALRRYPTGEERCIACKLCEAICPAQAITIEAEEREDGSRRTTRYDIDMTKCIYCGFCQEACPVDAIVEGPNFEFATETHEELLYDKEKLLENGDRWETEIAENLRSESLYR

SEQ ID NO: 48619 - protein, 508 aa, Triticum aestivum
  misc_feature (37)..(37): Xaa can be any naturally occurring amino acid
GAVGTDKAAGLCSGAELESAEPGVSDARLEAPAARIXTRPHGQNLGCGSTGSDGAAAISHIPSPVEPSPSDASSNSDTNTTPGAIGGGASSPADGSLSLSQAEAADSRGREPEAAHEEPTGARGAPAAAAAVASSELAVESRGDFDGQNGLIQGELGLRAGRGGGVLRGEGAEASTTQVEEGVDRMETSLDDSEASDGSTTQEDSDTDVETESSSSSVEEQDTGYGVHVPLMEQVTCEVARENNASETKSSDRMDSVAVSTLVLASGAAVAPHPSKVRTGGEDAYFIACGGWFGVADGVGQWSFEGINAGLYARELMDSSKKIVMENQGPPGMRTEEVLAMAAVEARSPGSSTVLVAHFDGQVLHVSNIGDSGLLVIRNGQVYTQTKPMTYGFNFPLQIENGVDPSRLVQNYTIDLQEGDTIITASDGLFDNVYDHEAAAIVSKSLEADRKPTEIAELLAARAKEVGRSGSGRSPFSDAALAEGYLGYSGGKLDDVTVVVSIVRKSEL

SEQ ID NO: 48620 - protein, 108 aa, Cenarchaeum symbiosum
MEKKIDEIDFEKAGGIVPVIVQDNNTHEVLTLAYSNRESLELTRKTGLSWFWSRSRSKLWQKGEESGNTQQVKKILVDCDQDALIYLVEPSGPACHTGERNCFHHSLL

SEQ ID NO: 48621 - protein, 525 aa, Coprinopsis cinerea okayama7#130
MKHVAVLGAGLSGLSSAFHLSRLHPNVRITVLESQKRAGGWVRSTRVSLPENYGSVLLEAGPRTLRPNAQSVLELVNLLGLKEQLITVPKTSPAAKSRYLYIPPDHGTSYSGLQQIPSSFFSFVKSPLSSTLVAAVAQEALKLNNRAKGVEDESVDSFLRRRFGSRFAETFGSAIIHGIYAADSRNISVRAALPSMWDAEARGWGSLVRGMFMSVKKPQGQAYDAGNVPQLMDGVSVYSFRDGMETLTRALDSHIRMRPNVQISYNAPVTSLASTEDGFAITVEGGRTVEASHVVSALPTPILHSILSPTLATTEVNKVGSLTANSTSSVHVVNIVFPGPPCSIHPAGFGYLIPRPPTGYPSTSPEPTNLGILGTVFDSCSLADQDTEARNPHAYHTAKFTKLTVMIGGPYPLPQLPPYLSSTEVPQGVDRKTNSLPQYMQTVLEQLAAHLGHWLPTPLYWRIVPNENCIPTLSPGHLERVDELQGYLDERLGGRLQVVGAGIGGVSLGDCVEAGRTVARRLHFQ

SEQ ID NO: 48622 - protein, 198 aa, Aspergillus fumigatus
MASGPATQSLKCVVTGDGAVGKTCLLISYTTNAFPGEYIPTVFDNYTASVMVDGRPISLGLWDTAGQEDYDRLRPLSYPQTDVFLICFSIVSPPSFDNVKAKWYPEIEHHAPNVPIILVGTKLDLRDDPATAESLRQKKMDLSRTRHWPSPKEIRAHKYLECSALRQRNFKSVFDEAIRAVLNPGPAAKPKSKKCTIL

SEQ ID NO: 48623 - protein, 109 aa, Bryopsis maxima
SVNLSILKFLAFEQTFKNSLTGLPMGGGKGGSDFNPKGKSENEVMRFCQSFMTELSRHVGPNTDVPAGDIGVGAREVGFLFGQYKRLMNRFEGVLTGKALEFGGSEIRN

SEQ ID NO: 48624 - protein, 169 aa, Triticum aestivum
MMMTQVANHSKRNHTDGYFSGKQQQQQQQVGAATATSSGSEEFGRMGSKKPRSASPRGSGGPISPREKKDKVGERVAALQQLVSPFGKTDTASVLQEASGYIKFLHQQLEVLSSPYMRPPPAPGAEPEDPEHYSLRNRGLCLVPVEQTLQLTQSNGADLWAPANTSRRT

SEQ ID NO: 48625 - protein, 438 aa, Candida glabrata CBS 138
MSVTKVHARTVYDSRGNPTVEVEVYTKDGMFRAIVPSGASTGSHEALELRDGDKSKWEGKGVTKAVSNVNDIIGPKLIESKLDVKDQKAIDEFMIKLDGTKNKSKLGANAILGVSLAVARAGAAAKGVPLYQHIAELADMKKEPYVIPCPFFNVLNGGVHAGGNLALQEFLIAPVGAESFHEALRLGSEVYHKLKALAKKRIGSSAGNVGDEGGIAPSLSTPFEALDLIYDAIKEAGHEGKVKIAMDPASSEFFQGDKYDLDFKNPHPDAKNKLSGAQLGDYYKTILEKYPIVSLEDPFAEDDWEAWTNFFPKAGVQIIADDLTVTNPERIQTAIDKKTADCLLLKVNQIGSLTESINSAKLAYGAGWGVQVSHRSGETEDTFIADLVVGLRTGQIKSGSLARSERLAKWNQILRIEEELGASNTIFAGAKFHKGQLL

SEQ ID NO: 48626 - protein, 589 aa, Zea mays
  misc_feature (173)..(173): Xaa can be any naturally occurring amino acid
  misc_feature (559)..(559): Xaa can be any naturally occurring amino acid
  misc_feature (572)..(572): Xaa can be any naturally occurring amino acid
MCGILAVLGCSDWSQAKRARILACSRRLKHRGPDWSGLYQHEGNFLAQQRLAVVSPLSGDQPLFNEDRTVVVVANGEIYNHKNVRKQFTGTHNFSTGSDCEVIMPLYEKYGENFVDMLDGVFAFVLYDTRDRTYVAARDAIGVNPLYIGWGSDGSVWIASEMKALNEDCVRFXSSPPGHLYSSAGGGFRRWYTPHWFQEQVPRTPYQPLVLREAFEKAVIKRLMTDVPFGVLLSGSLDSSLVASVTKRHLVETEAAEKFGTELHSFVVGLEGSPDLKAAREVADYLGTIHHEFHFTVQDGIDAIEEVIYHDETYDVTTIRASTPMFLMARKIKSLGVKMVLSGEGSDELLGGYLYFHFAPNKEEFHRETCRKVKALHQYDCLRANKATSAWGLEVRVPFLDKEFINVAMGMDPEWKMYDKNLGRIEKWVMRKAFDDDEHPYLPKHILYRQKEQFSDGVGYNWIDGLKSFTEQQVTDEMMNNAAQMFPYNTPVNKEAYYYRMIFERLFPQDSARETVPWGPSIACSTPAAIEWVEQWKASNDPSGRFISSHDSAATDHTXAVSRRWPTAAATXAANGTVNGKDVAVAIAV

SEQ ID NO: 48627 - protein, 187 aa, Arabidopsis thaliana
MRKVSAGFGCLTSPPPPEKGLENLTVADVLSTKDTDIDTWISCRTNDTVSDAVKNTTNLVGRVKNKKQMAKHNIGSLVVLEPGDQQYIAGIVTERDYMKKIIGAGRSSKLTKVGEVMTDESKLVTVSSGTNIIKAMQLMSENHIRHVPVIDGKIVGLISMVDVVKAIVDHQNGELKRLNEFIKGDYY

SEQ ID NO: 48628 - protein, 135 aa, Oceanospirillum sp. MED92
MALERTFSIIKPDAVAKNVIGKIASRFESNGLKIVEMQMKHLTQEDAEGFYAEHKERPFFGDLVAFMTSGPVIVQVLEGENAIALNRELMGATNPQEAAEGTIRRDFAQSIDANAVHGSDSPASAEREIAYFFGK

SEQ ID NO: 48629 - protein, 507 aa, Solenostemon scutellarioides
MTSLLAHPLLPPPRRRPLPPLLPPPVSHPAGPRPGRWWRNLYDVKPVRFRCFAEWAQLFGPTFSVWFGSTLNVIVSSSELAKEVLKEKDGQLADPPRSRSAVKLSRDGKDLIWADYGPHYVKVRKVCTVVLFSPKRLELLRPIREDEITVMVESIYQDSAASGKSVVIKKYLASMAFHNITRLVFGKRFVNSEGEVDKQGQEFKAIAINGLKLGASLAVSEHIPWLRWMFPLDEDAFTQHGVRMERLTREIMQEHTLARQKTGGAKQHFFDALLTLKDEYDLSEDTIIALLWDMIAAGMDTPAISVEWAMAELVRNPRVQEKVQEELDRVIGHERIMTELDIPNLPYLQCVVKESLRLHPPTPVMLPHRSNADVKIGGYDIPKGSNVHVNVWAIARDPKSWKVPLEFRPERFLEEDVDIKGHDFRLLRFGAGRRVCPGAQLGIDLATSMIGHLLHHFRWTPPTGVRAEDIDMGENPGTVTYMRTPVEAVPTPRLPANLYKRVAVVDI

SEQ ID NO: 48630 - protein, 355 aa, Triticum aestivum
MADAEPWKTVKIPPIVQELATGVQEPPSRYVIAEHNRPAVAGSEMPDPIPIVDLSRLSDNCADEVAKLRSALENWGLFLAVGHGMEPSFLGEVMGVARDFFKLPLEEKQKYSNLVNGNEVRIEGYGNDMVVSEKQILDWCDRLYIIVEPENRRIYSLWPTQPPSFRDILSEYTVRCRKIANLFLQNLAKLLDLHEDYFVNMFDENALTYARLNYYPNCPKPDHVFGMKPHTDASVITIVFIDDNVSGLQLQKDGVWYNIPILPNALLVNVGDVMEIMSNGFFKSPIHRVVTNAEKERLSLVMFYTMNPEKEIEPLSELVDEKRPRRYRKTTTNDYIAQLFETFARGTLAIDPVKI

SEQ ID NO: 48631 - protein, 258 aa, Ralstonia solanacearum
SVKNAAVNVPYGGAKGGVRVDPRKLSSGELERLTRRYTSEIGIIIGPNKDIPAPDVNTNAQIMAWMMDTYSMNEGATATGVVTGKPIALGGSLGRREATGRGVFVVGSEAARNLGIDVKGARIVVQGFGNVGSVAAKLFQDAGAKVIAVQDHKGIVFNSAGLDVDALIQHVDHNGSVDGFKAETLSADDFWALECEFLIPAALEGQITGKNAPQIKAKIVVEGANGPTTPEADDILRDRGILVCPDVIANAGGVTVSY

SEQ ID NO: 48632 - protein, 3980 aa, Bacillus subtilis
MYTSQFQTLVDVIRERSNISDRGIRFIESDKNETVVSYRQLFAEAQGYLGYLQHLGIKPKQEIVFQIQENKSFVVAFWACILGGMIPVPVSIGEDDDHKLKVWRIWNILNHPFLIASEKVLDKIKKYAAEHDLQDFHHQLNEKSDIIQDQTYDYPASFYKPDADELAFIQFSSGSTGDPKGVMLTHHNLIHNTCAIGNALAVHSKDSFLSWMPLTHDMGLIACHLVPFITGINQNLMPTELFIRRPILWMKKAHEHKASILSSPNFGYNYFLKFLKNEPDWDLSHIKVIANGAEPILPELCDEFLKRCAPFNLKRSAILNVYGLAEASVGAAFSKLGEEFVPVYLHRDHLNLGERAVKVSKEDQNCASFVEVGQPIDYCQLRISDETNERVEDGIIGHIHIKGDNVTQGYYNNPESTEKALTSDGWVKTGDLGFISESGNLVVTGREKDIIFVNGKNIYPHDIERVAIEMEEVDLGRVAACGVYDQKTQSGEIVLFVVYKKSPEKFAPLVKEIKKHLYKRGGWSIKEVLPIRKLPKTTSGKVKRYELARQYEAGNFSTESAAINECLESSPETSGQTPIHEIETELLSIFSEVLDGKKVHLADSYFDMGANSLQLSQIAERIEQKFGRELAVSDLFTYPSITDLAAYLSESRAEIKQDAAAKPSHVTPKDIAIIGMSLNVPGASTKSDFWNLLEKGEHSIREYPESRLKDAADYLKSIQSEFNESQFVKGGYLDEIDRFDYSFFGLAPKAAQFMDPNQRLFLQSAWHAIEDAGYAGGSMNGSRVGVYAGYSKVGYDYERLLSANYPEELHQYIVGNLPSVLASRIAYFLNLKGPAVTVDTACSSSLAAVHMACKSLMSGDCEMALAGGIRTSLLPICIGLDMESSDGYTKTFSKDSDGTGTGEGAAAVLLKPLQDAVRDGDHIYGVIKGSALNQDGTTAGITAPNPAAQTEVIETAWKDAGIAPETLSFIEAHGTGTKLGDPVEFNGLCKAFEKYTAKKQFCAIGSVKSNIGHLFEAAGIVGLIKSVLMLNHKKNPPLAHFNEPNPLIHFHSSPFYVNQEVSEFTSGDEPLRGGVSSFGFSGTNAHVVLEEYISQSEYAPEDEHEPHLFVLSAHTEKSLYELAQQYRQYVSDDSQASLKSICYTASTGRAHLDHGIAMIVSGKQELSDKLTRLIQGDRNLPGVYIGYKNMKEMLPAHKEELNQQAAALIKQRLRTQDERITWLNRAAELFVQGAVIDWRALYSGETVQKTPLPLYPFERSRCWAEADQLRLNEGEKRGEAALNINQSKAHIESFLKTVISNASGIRGEELDLNAHFIGLGMDSIMLSQVKKAIADEFGVDIPMDRFFDTLTNLQSVIDYLADTVPSSFASAPPQENVPAQEKQVISEAQLESDRRDGHQEHTLEKIIASQNQLIQDALQAQLNSFNLLRNSGHHSDEKEYAKAQEKSIPSVKQGPPTVNAEQKAAQEAKPYVPFQPQNLNDQGHYTARQKQYLEDFIKKYAGKTKGSKQYTDNTRFAHANNRNLSSFRSYWKEIVYPIIAERSDGSKMWDIDGNEYIDITMGFGVNLFGHHPSFITQVIDDSTRSSLPPLGPMSDVAGEVADRIRTCTGVERVAFYNSGTEAVMVALRLARAATGRKKVVAFSGSYHGTFDGVLGVAGTKGGAASANPLAPGILQSFMDDLIILHYNNPDSLDVIRSLGDELAAVLVEPVQSRRPDLQPQAFLKELRAITQQSGTALIMDEIITGFRIGLGGAQEWFGIQADLVTYGKIIGGGQPLGVVAGKAEFMNAIDGGTWQYGDDSYPQDEAKRTFVAGTFNTHPLTMRMSLAVLRHLQTEGEHLYEQLNQKTAYLVDELNHCFEQAQVPIRMVRFGSLFRFVSSLDNDLFFYHLNYKGVYVWEGRNCFLSVAHTADDIENIIQAVKDTVEDLRRGGFIPEGPDSPDGGGRKKSGTRELSPEQKQLVMASHYGNEASAALNQSIMLKVKGELQYTSLKQAVRHIVDRHEALRTVIHPDDEVQQVQERMNIEIPVIDFTGLPHEHREPEIQKWLTEDAKRPFHFHEQKPLFRIHVLTSAHNEHLIVLTFHHIIADGWSIAVFVQELESNYAAIVQGKSISPKEADVSFRQYLDWQQAQIDSGQYEEGVRYWRRHFSEPIQQPILPSADSVRYPNGYEGDRCTVRLGRPLSEALRSLSIQMKNSVFVTMLGAFHLFLHRLTKQSGLVIGIPAAGQSHMKQHDLIGNCVNMIPVKNTSSSESTLSGYLGSMKESVNLAMRHQAVPMTLVARELPHDQVPDMRIIFNLDRPFRKLHFGKAEAEPVAYPVKCTLYDLFLNITDAHQEYVLDFDFNTNVISPEIMKKWGAGFTKLLQKMVEGDSIPLDAMMMFSDEEQQDLQALYGEHQKRVSSIASNTANFTEAYEAPVNETERQLARIWEELFGLERVGRSDRFLALGGNSLQATLMLSKVQKTFHQKVSIGQFFNHQTVKELARFIQNETKVVHLPMKTAEKKAYYPTSPAQQRVYFLHQLEPDQLAQNMFGHISITGKYDEQALISSLQQVMQRHEAFRTYFDIIDGDIVQKLENEVDFNVHVRTMSRDEFDAYSDRFVKPFRLDQAPLVRAELIKIENEQAELLMHHIISDGYSVNILTNELLALYHQKPLPDIEFEYKDFAEWQNQRLNDDAMKRQATYWLEQFQDEIPILDLPTDGSKAAERSSEGQRVTCSLQPDVIRSLQDLAQKAETTLYTVLLAAYNVLLHKYTGQEDIVVGTPASGRNHPDIERIIGIFIQTIGIRTKPHANRTFTDYLEEVKRQTLDAFENQDYPFDRLVEKLNVQRETTGKSLFNTMFVFQNIEFHEIRHNECTFKVKERNPGVSLYDLMLTIEDAGQQIEMHFDYKPGRFTKDTIEQITRHYTAILNSLAEQPEMTLSSVPMLSETERHQLLTECNGTKTPYPHKETVYRWFEMQAEQSPDHEAVIFGNERYTYRQLNERANRLARTLRTKGVQADQFIAIISPHRIELIVGILAVLKAGGAYVPIDPEYPEDRIQYMLRDSRAEVVLTQRSLLDQLPYDGDIVLLDEENSYHEDHSNLESDSDAHDLAYMIYTSGSTGNPKGVLIEHQGLANYIWWAKEVYVRGEKTNFPLYSSISFDLTVTSIFTPLVTGNTIIVFDGEDKSAVLSEIMRDSRIDMIKLTPAHLHVIKEMNIAGGTAIRKMIVGGENLSTRLAKSVSEQFKGRLDIFNEYGPTEAVVGCMIYHFDAERDKREFVPIGTPAANTDIYVADASRNLVPFGVIGEIYISGPGVARGYWNRPDLTAEKFVENPYVPGAKMYKSGDLAKRLKDGNLLYIGRVDEQVKIRGHRIELGEIEAAMHNAEAVQKAAVTVKEEEDGLKQLCAYYVSDKPIAAAQLREQLSSGLPDYMVPTYFVHLEHMPLTSNGKINRKALPAPEASLQQTAEYVPPGNETESKLTDLWKEVLGISHAGIKHNFFDLGGNSIRAAALAARIHKELDVNLSLKDIFKFPTIEQLADKALHMDKNRYVPIPAAKEMPYYPVSSAQRRMYLLSHTEGGELTYNMTGAMNVEGTIDPERLNAAFRKLIARHEALRTSFDLYEGEPAQRIHQNVDFTIERIQASEEEAEDRVLDFIKAFDLAKPPLMRAGLIEIEPARHVLVVDMHHIISDGVSVNILMKDLSRIYEGNEPDPLSIQYKDFAVWQQSDIQKRIIKSQEAYWLDQFHGDIPVLDMPADYERPAIRDYEGESFEFLIPEHLKQRLSQMEEDTGATLYMILLAAYTILLSKYSGQEDIIVGTPSAGRTHLDVEPVVGMFVNTLVIRNHPAGRKTFDAYLNEVKENMLNAYKNQDYPLEELIQHLHLPKDSSRNPLFDTMFVLQNPDHAELTFDSLQIKPYPFHHPVAKFDLTLSIQADRDNYHGLFEYTKKLFKKSRIEILSNDYLHILSAILEQPSILIEHIGLSGSNEEEENALDSIQLNF

SEQ ID NO: 48633 - protein, 454 aa, marine gamma proteobacterium HTCC2207
MTKNRTTQQWQDLDTQRHLHPFTDFDQYAKKPGHIINRAEHIYIYDTDDNQILDGMSGLWCCSLGYSQPAIAEAVSRQFEQLPYYNNFFQCSNAPAVELAERLVDMAPERFTHVFFTGSGSEANDTNIRLVRRYWDLQDKPNKRIIISRKNAYHGSTIASASLGGFKSVHQQFETLPYVEHIVDPNWFVNGGDLSPEEFGLQAARALEEKIDQIGEENIAAFIAEPIQGAGGVIVPPDSYWPEVSRILKARDILFISDEVICGFGRTGSLFGCQTLGTEPDLITFAKAVTNGFQPLGGVLVSDKVASVITAKGGEFAHGFTYSGHPIACAAAMATLDIMQSDNIFQTVHDHSAPYLQKRWAELGQHPIVGHTRGLGMFGSMELVRNKETRERLAPDQVSGGVCRDLSIANGLVMRAVGDSMIISPPLICSHAEIDTIIDRVTQALDQTAEYFSV

SEQ ID NO: 48634 - protein, 475 aa, Zea mays
MDMALASKASPPPWNATAAEQPIPKRDKAAANDSTYLNPQAHDSVLGIILGGGAGTRLYPLTKKRAKPAVPLGANYRLIDIPVSNCLNSNISKIYVLTQFNSASLNRHLSRAYGSNIGGYKNEGFVEVLAAQQSPDNPNWFQGTADAVRQYLWLFEEHNVMEFLILAGDHLYRMDYEKFIQAHRETNADITVAALPMDEKRATAFGLMKIDEEGRIIEFAEKPKGEQLKAMMVDTTILGLDDVRAKEMPYIASMGIYVFSKDVMLQLLREQFPEANDFGSEVIPGATSIGKRVQAYLYDGYWEDIGTIAAFYNANLGITKKPMPDFSFYDRFAPIYTQPRHLPPSKVLDADVTDSVIGEGCVIKNCKINHSVVGLRSCISEGAIIEDSLLMGADYYETEADKKLLAEKGGIPIGIGKNSCIRRAIIDKNARIGDNVKILNADNVQEAARETDGYFIKGGIVTVIKDALLPSGTVI

SEQ ID NO: 48635 - protein, 77 aa, Triticum aestivum
MLPPMASKSGAKLVASGSKTSRGKGPVESKGSKGPARTKKTAPIFKKWKCFPSQGFGIRKSPPSAKGAPPPDQRGEK

SEQ ID NO: 48636 - protein, 382 aa, Zea mays
  misc_feature (105)..(105): Xaa can be any naturally occurring amino acid
  misc_feature (143)..(143): Xaa can be any naturally occurring amino acid
  misc_feature (195)..(195): Xaa can be any naturally occurring amino acid
MATAGKVIKCKAAVAWEAGKPLSIEEVEVAPPQAMEVRVKILFTSLCHTDVYFWEAKGQTPVFPRIFGHEAGGIIESVGEGVTDVAPGDHVLPVFTGECKECAHXCKSAESNMCDLLRINTDRGVMIADGKSRFSINGKPIYXTFVGTSTFSEYTVMHVGCVAKINPQAPLDKVCVLSCGISTGLGASINVAKPXPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDGEFKTPPMNFLNERTLKGAFFGNYKPRPDLPNVVELYIKKELEVEKFITPRVPFAEINKGFDLMAKGEGIRCIIRMEK

SEQ ID NO: 48637 - protein, 680 aa, Synechococcus sp. RS9917
MGSAITEQGVNFSLAAPGAYRVELLLYARADAPQPERIIDLGLEHRSGDYWHVEVEGLQAGCCYGYRVFGPLEPGGHGFRPAKVLLDPCARAIAGWEVYRREAATGASPNTDCCLKAVVCERDSFDFQAHPRPHHSWNRSVIYELHVGGFTRRGDSGVAPDRRGTLRGVIDKLPYLKDLGVTAIELLPIQAFDPQDAPAGRDNVWGYSPLSWFAPHHGYIEGDDPLQARAQVRELVAACHDNGLEVLLDVVYNHTTEGNRHGPTLSWRGCGDRLYYHQNSKGDYLDVSGCGNSIAANRPLTRQLILESIRCWAIELGVDGFRFDLGIALSRGEGLQPLDHPPLFEAIEADPLLSDLKLVSEPWDCGGLYRLSDFPAQRIGAWNGRFRDDLRSFWKGDDNSTWKLGQRLRGSPDLNGGRPLALGRSVNFITAHDGFTLMDLVSFNGKHNLANGEDNRDGENHNSSWNHGVEGPSTDHAVLALRRRQQRNLITSLLLSRGVPMLLMGDEVGRSQGGNNNSWCQDSPLSWMIWGDDHCDRHLQGYVRRLLRLRQQLADLINPQQPIGEMPQRRSSDPDQLWRQWHGVELGKPDWASWSHCLAVSLQRGSRGAVLWAGFNSYFKAMHFDLPQPTSPWHRLIDTALPPGDDLPQQPEVWTPAGVPLEARSMVVMVSREMLGSLRL

SEQ ID NO: 48638 - protein, 92 aa, Arabidopsis thaliana
  misc_feature (2)..(2): Xaa can be any naturally occurring amino acid
  misc_feature (5)..(5): Xaa can be any naturally occurring amino acid
  misc_feature (7)..(7): Xaa can be any naturally occurring amino acid
  misc_feature (52)..(52): Xaa can be any naturally occurring amino acid
  misc_feature (62)..(62): Xaa can be any naturally occurring amino acid
  misc_feature (74)..(74): Xaa can be any naturally occurring amino acid
  misc_feature (81)..(82): Xaa can be any naturally occurring amino acid
  misc_feature (91)..(91): Xaa can be any naturally occurring amino acid
SXATXVXSPAQATMVAPLNGLKSSAAFPATRKANNDITSITSNGGRVNCMQXWPPIGKKKFXTLSYLPDLYRFXNWLRKFXXLIRNKWDPXF

SEQ ID NO: 48639 - protein, 332 aa, Coprinopsis cinerea okayama7#130
MSEFRPSLMHFFNSFKESLFLGNPRWTPAEIPCLKDKVIIVTGGNSGIGYDTVKALLEHEATVYIVSRNESKALPVIDELEKETGKRALYIQAELSDLSSVKRAAEQFLSKEDRLDILYNNAGIVYPFATTPEGNDLIFETNVTGHFYFTTLLLPLLLSTAKTAAPGTVRIINVSSSAHRLVPATNPLKLDAIQEGPLRDQVLRMYGYGFSKFCSNLYTNELARRYKDTNIVVMSVHPGCFHTSMTDHMPQTLANRMINKIIFIYSPDYKAYTQLWAGTAPEAGKLHGKYITPWNSVGNPRAETQDEGLMTELWTYLEGRVKAHELKQVEGA

SEQ ID NO: 48640 - protein, 116 aa, Brassica napus
MDQGDVAVAVPPAAPSSSCAGAGCKKGKRFEIKKWNAVALWAWDIVVDNCAICRNHIMDLCIECQANQASATSEECIVAWGVCNHAFHFHCISRWLKTRQVCPLDNSEWEFQKYGH

SEQ ID NO: 48641 - protein, 306 aa, Coprinopsis cinerea okayama7#130
MKSLLLAAIREACIRVGFFYVSNHGIPEETIEGAKEAAKRFFSLPLEKKMEIENKKQPNFKGYSPLFSGKNDPYGAADLQEGFEFGWEPLEGTTDEGNKEYDNVSGAMAGGNVWPSPNDAAGFREAALKYYYAATALGKTMFPLFAQAVDAPADFFDDKTKHSAALMRLIHYPPQTGDVDDRTMGIGAHTDWEIFTILWQQPGIQALQVLNSSNEWVNAPPIPGTLVINIGDELARMTNGIFKSTVHRAVNRSGVERYSIPLFFGIDFNTPLEPIPTCVSAERPFKYEIITAGEYIKSRLQATYNH

SEQ ID NO: 48642 - protein, 339 aa, Salmonella typhimurium LT2
  misc_feature (168)..(168): Xaa can be any naturally occurring amino acid
  misc_feature (185)..(185): Xaa can be any naturally occurring amino acid
  misc_feature (306)..(306): Xaa can be any naturally occurring amino acid
  misc_feature (314)..(314): Xaa can be any naturally occurring amino acid
MGSSHHHHHHSSGLVPRGSHMKAMNKVWVIGDASVDLVPEKQNSYLKCPGGASANVGVCVARLGGECGFIGCLGDDDAGRFLRQVFQDNGVDVTFLRLDADLTSAVLIVNLTADGERSFTYLVHPGADTYVSPQDLPPFRQYEWFYFSSIGLTDRPAREACLEGARRXREAGGYVLFDVNLRSKXWGNTDEIPELIARSAALASICKVSADELCQLSGASHWQDARYYLRDLGCDTTIISLGADGALLITAEGEFHFPAPRVDVVDTTGAGDAFVGGLLFTLSRANCWDHALLAEAISNANACGAXAVTAKGAXTALPFPDQLNTFLSSHSLAQAMTVK

SEQ ID NO: 48643 - protein, 258 aa, Ralstonia solanacearum
SVKNAAVNVPYGGAKGGVRVDPRKLSSGELERLTRRYTSEIGIIIGPNKDIPAPDVNTNAQIMAWMMDTYSMNEGATATGVVTGKPIALGGSLGRREATGRGVFVVGSEAARNLGIDVKGARIVVQGFGNVGSVAAKLFQDAGAKVIAVQDHKGIVFNGAGLDVDALIQHVDHNGSVDGFKAETLSADDFWALECEFLIPAALEGQITGKNAPHIRAKIVVEGANGPTTPEADDILRDRGILVCPDVIANAGGVTVSY

SEQ ID NO: 48644 - protein, 271 aa, Oryza sativa (japonica cultivar-group)
MAAAAETSAKVGAPRRWSLQGKTALVTGGTRGIGRAVVEELAALGATVHTCSRKEEELSERLKEWEARGFRVTTSVCDLSVRDQRERLLRQVADLFGGKLDILVNNVGTNIRKPTTEFSAEEYSFMMATNLESAYHLCQLSHPLLKASGSGSIVFISSVCGLVAVFSGSLYAMTKGAINQLTKNLACEWARDNIRSNSIAPWYIRTSLTEGLLANKDFEGAVVSRTPLRRVGEPEEVSSLVAFLCMPGSSYITGQTISVDGGMTINGLYPS

SEQ ID NO: 48645 - protein, 235 aa, Arabidopsis thaliana
MNGSSAFHIILSVTFMVFLFGGLCEAGVVVNVDIINDIGPNVQLGLHCKSKDKDLGPQSLAPQQHWGFRKTLDFWGVTLFFCHFEWENQSKWFDILVAGRDRNTCAEHPCVWSIRPSGPCRLTGKEKAESRAEPERIGDKCKSTDIVVNQAVTIPMPNGIPCYIVLFSRPIIVTGNGQNPQSQILELAYWVKLIEPLKPLREITSEAIFEFEHGQTQDTIPSCHLFSRMGNFMDK

SEQ ID NO: 48646 - protein, 134 aa, Triticum aestivum
  misc_feature (71)..(71): Xaa can be any naturally occurring amino acid
MGRLTSPLRALDAAAQEDLKRVFAQRAVDMVESGMKMGLGSGSMAGHALVRLGALLGTGAVRAVSGVPTYXKMEAHAERVGIPMLALADAAEIHLSIDGANEVDPDLNLAKSRGACLRKSVDECLNTIKLEREG

SEQ ID NO: 48647 - protein, 198 aa, Glycine max
MKNNNVKDDEAMLADIDRFLFENFKSLFLDDREEPDNNINRRAEMSPKLDPIRFDSSRRFFTDATTEEGSSSAMSESETAEESTVVPGNCVVVLANSGNPSEDFQRSMEGVVEARLRNCEKVDWDFMQELLFCHMNLNQKKSHKFILSAFVNVVTAMRSPPEIAPPKPTPPRSVRTVRIGREVRKKTKEAVTLEFRSQ

SEQ ID NO: 48648 - protein, 799 aa, Saccharomyces cerevisiae
MVLPILPLIDDLASWNSKKEYVSLVGQVLLDGSSLSNEEILQFSKEEEVPLVALSLPSGKFSDDEIIAFLNNGVSSLFIASQDAKTAEHLVEQLNVPKERVVVEENGVFSNQFMVKQKFSQDKIVSIKKLSKDMLTKEVLGEVRTDRPDGLYTTLVVDQYERCLGLVYSSKKSIAKAIDLGRGVYYSRSRNEIWIKGETSGNGQKLLQISTDCDSDALKFIVEQENVGFCHLETMSCFGEFKHGLVGLESLLKQRLQDAPEESYTRRLFNDSALLDAKIKEEAEELTEAKGKKELSWEAADLFYFALAKLVANDVSLKDVENNLNMKHLKVTRRKGDAKPKFVGQPKAEEEKLTGPIHLDVVKASDKVGVQKALSRPIQKTSEIMHLVNPIIENVRDKGNSALLEYTEKFDGVKLSNPVLNAPFPEEYFEGLTEEMKEALDLSIENVRKFHAAQLPTETLEVETQPGVLCSRFPRPIEKVGLYIPGGTAILPSTALMLGVPAQVAQCKEIVFASPPRKSDGKVSPEVVYVAEKVGASKIVLAGGAQAVAAMAYGTETIPKVDKILGPGNQFVTAAKMYVQNDTQALCSIDMPAGPSEVLVIADEDADVDFVASDLLSQAEHGIDSQVILVGVNLSEKKIQEIQDAVHNQALQLPRVDIVRKCIAHSTIVLCDGYEEALEMSNQYAPEHLILQIANANDYVKLVDNAGSVFVGAYTPESCGDYSSGTNHTLPTYGYARQYSGANTATFQKFITAQNITPEGLENIGRAVMCVAKKEGLDGHRNAVKIRMSKLGLIPKDFQ

SEQ ID NO: 48649 - protein, 853 aa, Arabidopsis lyrata
MRVVVPNCHHFYIFFVVLILIRSVFSSYVHTLSSTESLTISSKQTIVSPGEVFELGFFNPAATSRDGDRWYLGIWFKTNLERTYVWVANRDNPLYNSTGTLKISDTNLVLLDQFDTLVWSTNLTGVLRSPVVAELLSNGNLVLKDSKTNDKDGILWQSFDYPTDTLLPQMKMGWDVKKGLNRFLRSWKSQYDPSSGDFSYKLETRGFPEFFLLWRNSRVFRSGPWDGLRFSGIPEMQQWEYMVSNFTENREEVAYTFQITNHNIYSRFTMSSTGALKRFRWISSSEEWNQLWNKPNDHCDMYKRCGPYSYCDMNTSPICNCIGGFKPRNLHEWTLRNGSIGCVRKTRLNCGGDGFLCLRKMKLPDSSAAIVDRTIDLGECKKRCLNDCNCTAYASTDIQNGGLGCVIWIEELLDIRNYASGGQDLYVRLADVDIGDERNIRGKIIGLAVGASVILFLSSIMFCVWRRKQKLLRATEAPIVYPTINQGLLMNRLEISSGRHLSEDNQTEDLELPLVEFEAVVMATENFSNSNKLGEGGFGVVYKGRLLDGQEIAVKRLSTTSIQGICEFRNEVKLISKLQHINLVRLFGCCVDENEKMLIYEYLENLSLDSHLFNKSLSCKLNWQMRFDITNGIARGLLYLHQDSRFRIIHRDLKASNVLLDKDMTPKISDFGMARIFGRDETEANTRKVVGTYGYMSPEYAMDGIFSVKSDVFSFGVLVLEIVSGKKNRGFYNSNQDNNLLGYAWRNWKEGKGLEILDPFIVDSSSSPSAFRPHEVLRCIQIGLLCVQERAEDRPVMSSVVVMLRSETETIPQPKPPGYCVGRSPFETDSSTHEQRDESCTVNQITISAIDPR

SEQ ID NO: 48650 - protein, 295 aa, Beta vulgaris
MAILSDYEEEEHQPQPEKKQPSKKFSATFDPSNPLGFLQSTLEFVSKESDFFAKESSAKDVVSLVQKVKEKYIEEVENKKKKLLDESAAAAAAAAAAAASSSSSDLEKKVDDNESAEETEKSKYKAPNSGNGQDLENYSWIQSLQEVTVNVPVPPGTKSRFIDCQIKKNHLKVGLKGQPPIIDGELFKPVKPDDCFWSLEDQKSISMLLTKHDQMEWWRSLVKGEPEIDTQKVEPESSKLSDLDPETRSTVEKMMFDQRQKSMGLPTSDDMQKQDMLKKFMSEHPEMDFSNAKFN

SEQ ID NO: 48651 - protein, 230 aa, Glycine max
HGVMAVQLWETLKEAIVAYTGFSPSTFFTVLALLFAVYYVVTGLFGSSDDHHHRHRHVEEEEEEEMPPLRPPVQLGEITAEELKAYDGTDPEKPLLMAIKAQIYDVSQSRMFYGPGGPYALFAGKDASRALAKMSFEEKDLTGDISGLGPFELDALQDWEYKFMSKYVKVGTVKSEEVPVTEPESIGEPLESTSRDIDAAAKPTDTEDGKLETPAVKSDETPSNVDADKE

SEQ ID NO: 48652 - protein, 334 aa, Magnaporthe grisea 70-15
MAVLTGSSLDSAAFRSYLDSLVPSTARAELTGSVLPALVHAIGDVSALLRRAHTVAHVGTTNAFGDQQLNVDLAADDVIRAACKSCPSVVTASSEEVPIEEALRSGEVDAAGSSERYTVAYDPLDGSSIIAPNWTVGAILGVWDGATALGQSPRRSMVAAILGVFGPRTTAIVALRVPGIGEPACFELGIDGESLTMVQPNIRLASPPLNTRYFAPANLRAAAECDKYSALVSHFISQKYTLRYSGGLVPDVVHALVKGHGVYISPTTPQSAGKLRRLYELSPIALVVECAGGKAVDSSSGVGVLDVTISDCDERGGVICGNNIEVDLASKYLQ

SEQ ID NO: 48653 - protein, 191 aa, Zea mays
  misc_feature (70)..(70): Xaa can be any naturally occurring amino acid
  misc_feature (182)..(182): Xaa can be any naturally occurring amino acid
METSSHKRAREAVDLAAAAAAAGEAVWPESDAKRLRPQDLLDMLEDDTDAAAAGDLASVMRSLEEEIASXDEAAEAAPSQQPELGFLLEASDDELGLPPAGSAAASSEEAGLAGPPEPAAPAAAALYGQIWAFDDEIDGGFGGYSPEAAAAAAAAAAWDDDVFGAGLFAFGDDACGPSDLAXLRHETMPAV

SEQ ID NO: 48654 - protein, 562 aa, Nocardia farcinica IFM 10152
MILMTSRAQPTWKGDPSMAHDRAGRPARASDLDDIAHLVTAYFSRVPDPRDPAQRVVFGTSGHRGSSLDCAFNEAHILAITQAIVEYRATRGITGPVYLARDTHALSEPAWTTALEVLAGNGVTAMIDARDRYTPTPALSHAVLRHNRGGTKHQADGIVVTPSHNPPRDGGFKYNPPHGGPADTGVTDAIAARANELLADGLTGVRRATYQQALATGVERYDYLDHYIADLPNVLNLDAIRGAGIRLGADPMGGASVDYWEEIGQRYDLELEVVNPFVDPTWRFMTLDSDGKIRMDPSSRYAMAGLVAIKDDYDISTGNDADADRHGIVTPDGGLMNPNHFLAVAIEYLVANRMGWDALTKIGKTVVTSSMVDRVVSVLGRQVHEVPVGFKWFVPGLFSGSLAFGGEESAGASFLRMDGTVWTTDKDGILLALLAAEIAAVTGQTPSARYGELERRYGSPAYARIDAPAGAEQKKLLSQLTPDMITSEEIAGEPITAVLTRAPGNGAPLGGLKVTTENAWFAARPSGTEDKYKIYAESFQGPEHLAQVQAAAEEMVGKALQP

SEQ ID NO: 48655 - protein, 236 aa, Novosphingobium aromaticivorans DSM 12444
MVLHEATLFLDLDGTLFELVDNPEDVRADHRTQALIGQLLQHMDGRVAVVSGRSLAQIDDMLGDAAGTLWISGSHGCEYRWDGVIQSPSRPAALDDVAASFRNFAQNQPGVLVEEKSLGVALHYRTAPEAGASALALAQEMAGLHDLYLQHGKSMVELRAGSENKGSAILTMMAHPGLAGTTPVFAGDDVTDEPGFEAVLELGGHAILVGEPRPTLATFRLRSPEELREWLWRATV

SEQ ID NO: 48656 - protein, 676 aa, Solanum tuberosum
MAIQKWLLFLFLHLHVLNIVAQLPDLRFGICGKSGNYTENSTYKNDLNTLLTSLSSKIDKYGFYNASIGQNSDRASVIVLCRGDVELDDCRGCVDNVVQKIAQLCPNQKEVFGGYDGCMLQYSNQSIIDTPSLSVQLFLWNTANASKPEEFNQELGKLLENLRDRAAQGGPLQKYATGTTIGPDIQPIYALVQCTPDLSRQSCFDCLTDAYGTLPQCPCLGKTGGRIIGIRCNFRYEISRFFVDVPLEAPPPAGNDNKTVPTGTENKTPPTGKDDKTTRTIIIIVVSTVTIVILMICIAVILIRRRKRKLVNGIQGTSVDDTSIAESFQYDFSAIRAATDDFSDANKLGEGGFGPVYKGKLQNGQEVAVKRLSADSGQGDLESKNEVLLVARLQHRNLVRLLGFCLDGTERLLVYEFVPNASLDHFLFDSVKRRQLDWERRSKIIGGIAKGILYLHEDSRLRIIHRDLKASNVLLDAEMNPKISDFGMARLFELDETQGSTNRIVGTYGYMAPEYAMHGQFSVKSDVFSFGVLVLEILSGQKNTCFRNGESVEDLLSFAWLSWRNGTTIDFVDPMLKESTGLIRDIMRNIHIALLCVQESVADRPTMAAVVLMLSSFSLSLPMPSGPAFYMHSNITAETSLIKEYNTRMTDSSELAKSKSIGSSRNEASISELYPR

SEQ ID NO: 48657 - protein, 676 aa, Solanum tuberosum
MAIQKWLLILFLHIHVLNIVAQLPDLRFGSCGGNGNYTENSTYKNNLNTLLTSLSSKIDNYGFYNASIGQNSDRASVIVLCRGDVELADCRGCVDNVVQKIAQLCPNQKEVFGGYDGCMLQYSNQSILETTSFSLKYYFWNPANATKPGEFNQELGRLLENLRDRAVDDGPLQKYASGNATGPDFQAIYALVQCTPDLSRQSCFSCLSDAYGNMPRCPCLGKRGGRIIGVRCNFRYESSRFFEDVPLEAPPPAGNDNTTVPTGTDDKTVPTGEDDKTTRTIIIIVVSTVTVVILIICIAVILIRRRKRKLVNEIQSTSVDDTSIAESFQYDFSAIRAATDDFSDANKLGEGGFGPVYKGKLQNGQEVAVKRLSADSGQGDLEFKNEVLLVARLQHRNLVRLLGFCLDGTERLLVYEFVPNASLDHFLFDSVKRRQLDWERRSKIIGGIAKGILYLHEDSRLRIIHRDLKASNVLLDAEMNPKISDFGMARLFELDETQGSTNRIVGTYGYMAPEYAMHGQFSVKSDVFSFGVLVLEILSGQKNTCFRNGESVEDLLSFAWSSWRNGTTINFVDPMLKESTGLIRDIMRNIHIALLCVQESVADRPTMAAVVLMLSSFSLSLPMPSGPAFYMHSNITAGTSLIQEYNTRVTDSSERAKSKSIGSSRNEASITELYPR

SEQ ID NO: 48658 - protein, 258 aa, Ralstonia solanacearum
SVKNAAVNVPYGGAKGGVRVDPRKLSSGELERLTRRYTSEIGIIIGPNKDIPAPDVNTNAQIMAWMMDTYSMNEGATATGVVTGKPIALGGSLGRREATGRGVFVVGSEAARNLGIDVKGARIVVQGFGNVGSVAAKLFQDAGAKVIAVQDHKGIVFNGAGLDVDALIQHVEHNGSVDGFTAETLSADDFWALECEFLIPAALEGQITGKNAPQIRAKIVVEGANGPTTPEADDILRDRGILVCPDVIANAGGVTVSY

SEQ ID NO: 48659 - protein, 651 aa, Solanum tuberosum
MAIQKWLLILFLHIHVLNIVAQLPDLRFGSCGGNGNYTENSTYKNNLNTLLTSLSSKIDNYGFYNASIGQNSDRASVIVLCRGDVELADCRGCVDNVVQKIAQLCPNQKEVFGGYDGSNATKPEEFNQELGRLLENLRDRAVDDGPLQKYASGNATGPDFQAIYALVQCTPDLSRQSCFSCLSDAYGNMPRCPCLGKRGGRIIGVRCNFRYESSRFFEDVPLEAPPPAGNDNTTVPTGTDDKTVPTGEDDKTTRTIIIIVVSTVTVVILIICIAVILIRRRKRKLVNEIQSTSVDDTSIAESFQYDFSAIRAATDDFSDANKLGEGGFGPVYKGKLQNGQEVAVKRLSADSGQGDLEFKNEVLLVARLQHRNLVRLLGFCLDGTERLLVYEFVPNASLDHFLFDSVKRRQLDWERRSKIIGGIAKGILYLHEDSRLRIIHRDLKASNVLLDAEMNPKISDFGMARLFELDETQGSTNRIVGTYGYMAPEYAMHGQFSVKSDVFSFGVLVLEILSGQKNTCFRNGESVEDLLSFAWSSWRNGTTINFVDPMLKESTGLIRDIMRNIHIALLCVQESVADRPTMAAVVLMLSSFSLSLPMPSGPAFYMHSNITAGTSLIQEYNTRVTDSSERAKSKSIGSSRNEASITELYPR

SEQ ID NO: 48660 - protein, 258 aa, Ralstonia solanacearum
SVKNAAVNVPYGGAKGGVRVDPRKLSSGELERLTRRYTSEIGIIIGPNKDIPAPDVNTNAQIMAWMMDTYSMNEGATATGVVTGKPIALGGSLGRREATGRGVFVVGSEAARNLGIDVKGARIVVQGFGNVGSVAAKLFQDAGAKVIAVQDHKGIVFNGAGLDVDALIQHVEHNGSVDGFKAETLSADDFWALECEFLIPAALEGQITGKNAPHIRAKIVVEGANGPTTPEADDILRDRGILVCPDVIANAGGVTVSY

SEQ ID NO: 48661 - protein, 715 aa, Geobacillus kaustophilus HTA426
MTMTNELLRYFRAKEKERASETAAATQCPFCSVQCTLQLVEERIVERRRYKAVPTDNPTSNGRLCLKGMNAHQHALHPERLLFPLAKVDGRFVRVSWEEALSLIVERIISIQKEDGVDAFAVYGGGSLTNEEAYLLGKFARVALKTRHIDYNGRFCMSAAAAAMNDAFGLDRGLTNPLSDIPLAQTIILAGTNVAECQPTLMPYFYEAKKNGAFIIVVDPRETKTAALADLHLPLKPGTDTALAVGIGKVLLDEGYIDEAFVCERTVGFTEWKQHIEAVKMDEIARVTDVPAEKIRLAARKYGEAADAIVLTARGLEQQADGYAAVRHWMNVVLATGKIGRPGSGFGSITGQGNGQGGREHGQKADQLPGYRSIEHPEHRRYIANIWGISPDELPRKGVSAYEMMQKIGAGEITGLLVMGSNPVVSSPNAAFVAKALQKLKFLVVADMFLSETAELADLVLPVSSYLEDEGTVTNVEGRVCFRPAARKRPGEVKHDWEILCAIAHKLGKGRYFSFTSAEEIFNELRLASRGGKADYYGVTYERLRRERVYWPCPDAHHPGTPRLFTERFAHPDGKARFAVLPFRPEKEETDEWYPLYLTTGRVLAHYLSGTQTRRSPALSARQPEAVVEIHPRTAKRYGIGPGMLVRIETRRGAAVVRSRYNDQIREDTIFVPFHWSGLQQINNVTSDELDPHCRMPAFKRCAARVRPVVDLGRN

SEQ ID NO: 48662 - protein, 323 aa, Vigna angularis
MVLAARNPMKSEGILPREVPVVDFSGERAEVAKVIVKACEEYGFFKVINHGISKEVIAKSEEAGFGFFGKPMVEKKVAVPAYGCKNIGVNGDMGEVEYLLLSATTDSIAHISKTISTDPLNLRKSLSAYTEAVKELACEILEVMAEGLGVPDTWVFSRLIRDGESDSVLRLNHYPPIINRDKDKSSQITKVGFGEHSDPQILTILRSNDVGGLQISLPDGVWIPVTPDPSAFYVNVGDVLQVMTNGRFVSVRRRAMTNSYKCRMSVAYFGAPPLHQTIVAPSVMVTPQRPSLFRPFTWAEYKKATYSLRLGDTRLQLFRNCKR

SEQ ID NO: 48663 - protein, 676 aa, Solanum tuberosum
MAIQKWLLILFLHIHVLNIVAQLPDLRFGSCGGNGNYTENSTYKNNLNTLLTSLSSKIDNYGFYNASIGQNSDRASVIVLCRGDVELADCRGCVDNVVQKIAQLCPNQKEVFGGYDGCMLQYSNQSILETTSFSLKYYFWNPANATKPEEFNQELGRLLENLRDRAVDDGPLQKYASGNATGPDFQAIYALVQCTPDLSRQSCFSCLSDAYGNMPRRPCLGKRGGRIIGVRCNFRYESSRFFEDVPLEAPPPAGNDNTTVPTGTDDKTVPTGEDDKTTRTIIIIVVSTVTVVILIICIAVILIRRRKRKLVNEIQSTSVDDTSIAESFQYDFSAIRAATDDFSDANKLGEGGFGPVYKGKLQNGQEVAVKRLSADSGQGDLEFKNEVLLVARLQHRNLVRLLGFCLDGTERLLVYEFVPNASLDHFLFDSVKRRQLDWERRSKIIGGIAKGILYLHEDSRLRIIHRDLKASNVLLDAEMNPKISDFGMARLFELDETQGSTNRIVGTYGYMAPEYAMHGQFSVKSDVFSFGVLVLEILSGQKNTCFRNGESVEDLLSFAWSSWRNGTTINFVDPMLKESTGLIRDIMRNIHIALLCVQESVADRPTMAAVVLMLSSFSLSLPMPSGPAFYMHSNITAGTSLIQEYNTRVTDSSERVKSKSIGSSRNEASITELYPR

SEQ ID NO: 48664 - protein, 808 aa, Geobacillus kaustophilus HTA426
MKRKLVLIGNGMAGVRCIEEILKLDREAFEITIFGSEPHPNYNRILLSKVLQGDTRLDDITLNSWEWYERNGIRLFVGETVTEVDIKRRLVRTDRGRVVEYDELIFATGSNPFILPVPGADLPGVTAFRDIQDCERMIEYAKTYKKAAVIGGGLLGLEAARGLLHLGMDVDVIHIFDYLMERQLDPTASKLLQRELEKQGMNFLLRKETAELFGNGRVEGVRFKDGTSIAADLVVMAVGIRPNVELARKSGIEVNRGIVVNDYLETSVPHIYAVGECAEHRGVVYGLVAPLYEQGKVLAQAICGRKGKPYEGSVVSTQLKVSGVDVFSAGEFMDVEGTESIKLYDEARSVYKKVVVREGKIVGAVLFGDTSEGRKLFDMIQRGDSLEALSLSLLAPASSGGKGSLVAAMADTDVVCGCNGVTKGAICQAIAEHGLKTVAEVRDYTNASRSCGGCKGLVAELLEHMLGEEANRYAVKETICGCTDLSREEVLEAIEQRRLMTVKEVMSVLGWKNEEGCSKCRPALNYYLGMLYPGEYDEEAESLFVNERLHANIQADGTYSVVPRIYGGVTTAEQLRNIADVAEKYNVPMIKITGGQRIDLLGVKKEDLPRIWADLGMPSGYAYAKALRTVKTCVGKQFCRFGTQDSTGLGIRMEQTFERLKTPHKVKMAVSACPRNCAESGIKDVGVVGVEGGWEIYVGGNGGTHLRAADLLCTVKTEDEVIEMTGAFLQYYRESAHYLERTSKWVERVGLEHIREVLFDVETRRALLERLHKALSATKDPWREIVENERLQQLLFRDIGDKEPVPVE

SEQ ID NO: 48665 - protein, 258 aa, Ralstonia solanacearum
SVKNAAVNVPYGGAKGGVRVDPRKLSSGELERLTRRYTSEIGIIIGPNKDIPAPDVNTNAQIMAWMMDTYSMNEGATATGVVTGKPIALGGSLGRREATGRGVFVVGSEAARNLGIDVKGARIVVQGFGNVGSVAAKLFQDAGAKVIAVQDHKGIVFNGAGLDVDALIQHVEHNGSVDGFKAETLSADDFWALECEFLIPAALEGQITGKNAPQIRAKIVVEGANGPTTPEADDILRDRGILVCPDVIANAGGVTVSY

SEQ ID NO: 48666 - protein, 339 aa, Salmonella typhimurium LT2
MGSSHHHHHHSSGLVPRGSHMKAMNKVWVIGDASVDLVPEKQNSYLKCPGGASANVGVCVARLGGECGFIGCLGDDDAGRFLRQVFQDNGVDVTFLRLDADLTSAVLIVNLTADGERSFTYLVHPGADTYVSPQDLPPFRQYEWFYFSSIGLTDRPAREACLEGARRMREAGGYVLFDVNLRSKMWGNTDEIPELIARSAALASICKVSADELCQLSGASHWQDARYYLRDLGCDTTIISLGADGALLITAEGEFHFPAPRVDVVDTTGAGDAFVGGLLFTLSRANCWDHALLAEAISNANACGAMAVTAKGAMTALPFPDQLNTFLSSHSLAQAMTVK

SEQ ID NO: 48667 - protein, 111 aa, Shewanella sp. MR-4
MTELEVVDLVIGEGKEAVKGALITTQYRGFLQDGTQFDSSYDRGQAFQCVIGTGRVIKGWDQGLMGMKVGGKRKLFVPAHLAYGERQIGAHIKPNSDLTFEIELLEVLTRD

SEQ ID NO: 48668 - protein, 241 aa, Thermoplasma volcanium GSS1
MPDYEKQKRNAAVEAASYVKTGMVIGIGTGTTARYLIEELGRRVSEENLKIKGVCTSKKSEELARAAGIEISENPEQIIDLTIDGADQVNLHGTLIKGGGGALLREKIVAYNSKEMYVIVDSRKIDDENFGSFPLPVEVVPFLHRMTLENLRKICPSTDLRKNSDGTLFITDNGNYIADMKFGRIRETNELEKKIKSIPGVVDVGLFNNIADKIFEGNDDGCNIYVVSEKGRIEKEKGQFK

SEQ ID NO: 48669 - protein, 341 aa, Musa acuminata
MDHEAEAHRTDLMTITRYVLNEQSRHQESRGDFTILLSHIVLGCKFVCSAVNKAGLAKLIGLAGETNVQGGSKRKLDVLSNEVFVKALISSGRTCILVSEEDEEATFVDPSLRGKYCVVFDPLDGSSNIDCGVSIGTIFGVYMVKDKDNVTLDEVLQPGKNMLAAGYCMYGSSCTLVLSTGSGVNGFTLDPSLGEFILTHPDIKIPKKGKIYSVNEGNAKNWDGPTTKYVEKCKFPKDGDSPKSLRYIGSMVADVHRTLLYGGIFLYPADKKSPNGKLRVLYEVFPMSFLMEQAGGQAFTGKQRALDLVPTKIHQRSPIFLGSYDEVEEIKALYAAEENTA

SEQ ID NO: 48670 - protein, 248 aa, Nocardia farcinica IFM 10152
MTRQWRTRSGRIGVLTGAGISTDSGIPDFRGPRGVWTEDPIAELMSTYDQYLSDPDLRRRSWLARRANPAWQAEPNAGHLALVDLERAGRAVTIITQNVDRLHQRAGSSPQRVVEIHGNMFEVVCVGCDYETGMADVLARVEAGEPDPACPECGGILKAATIMFGQQLDQRTMTKAALTAQTSDIFLAVGTSLQVEPAASMCALAVDAGADLVIVNAEPTPYDSIATEVVHEPIGTALPRLVKEILDA

SEQ ID NO: 48671 - protein, 306 aa, Escherichia coli
MSTRVWVLGDAVVDLLPESQGRLLQCPGGAPANVAVGIARLGGKSAFIGKVGDDPFGRFMYQTLSKENVDTRYMSLDPQHRTSIVAVGLDEQGERNFTFMVRPSADLFLQPDDLPAFGPGEWLHLCSIALSAEPSRSTAFLAMEKIRQAGGNISFDPNIRSDLWQSEALLRKYLDRALSLANIAKLSEEELLFISGESQVQQGAYSLVQRYSLTLLLITQGKNGVLVYFQGQFIHYPAKPVSVVDTTGAGDAFVAGLLAGLADSGIPTNTRQLERIIAQAQICGALATTAKGAMTALPRQHDLPSQ

SEQ ID NO: 48672 - protein, 443 aa, Mannheimia succiniciproducens MBEL55E
MKNIVIVGGGAGGLELATYLGNNLGKKQRANVVLVDRNQTHLWKPLLHEVATGVLDSETDAVSYRAHAHNHYFNFEQGSITRIDRTNKYVELAPVTGQEGDVLVVARRIPYDYLVIAIGSKSNDFNTKGVAENCIFLDSPNQALRFQHKMLELFLKFSENNALEEIGEDDSKQRLVQDGKVNIAIVGGGATGVELSAELFNAAQHLSSYGYGKIQSGHLQVTLIEAGDRILPALPERISSSVQQELENLGVTVKTGTMITEATEKCLITKEGEEINADLMVWAAGIRVSAITQQFDGLEVNRINQLNVKNTLQTTVDDSIFAIGDCAFLLQKDGKPVPPRGQAANQMATICGQNIVALFNNKPLKDFHYFDKGSLVSLSKFTALGNITTGKRSSLTIEGRLARLAYISLYRLHQQKLHGCFKTGLIILIGRLNRFIRPSLKLH

SEQ ID NO: 48673 - protein, 210 aa, Schizosaccharomyces pombe
MASNTAPKNVVTINQKLVLLGDSAVGKSSLVLRFVKDQFDDYRESTIGAAFLTQTLPIDENTSVKLEIWDTAGQERYKSLAPMYYRNANCAIVVYDITQASLEKAKSWIKELQRQAPEGIVIALAGNKLDLAQERRAVEKADAEAYAAEANLLFFETSAKTAENVNELFTAIAKKLPLEDKLNQARGAVNRGVNLSEARPAAQPSGSCSC

SEQ ID NO: 48674 - protein, 553 aa, Arabidopsis thaliana
MAPIDVGDFVPDGSISFFDDDDQLQTVSVHSLAAGKKVILFGVPGAFPPTCSMNHVNGFIEKAEELKSNGVDEIICLSGDDPFMITACSENKHVKFVEDGSGEYIQLLGLELEVKDKGLGVRSRGFALLLDNLKVIVVNVGSGGDCSLFQLMKMTTTTMSNLPTDLLEEIISRVPRKYMRAVRLTCKRWNGMFKSQSFTKMHIGKEEAATRELRQTRMIVMMDYNVYLMGIAVNEIPSIETLGKLTCLDDSEQVKISQVFCCEGLLLCILKDDDTKIVVWNPYLGQTRWIQTRLICCVSGWKKYALGYGNNSENRSCRSPKILRVTDNFNIFSENIPLQYEIYDFDSDVWTTLDVSPHWFIMSERGLSLKGNTYWGAKERHAYGSIDHIICFDFTRERFGPLLPLPFSAWGAQFASLSSVREDKITALFQNCRAYKLELWITTKIDVNNATWSKFFTMDTPYLHEILSLKTFFIDEENKIVVVSNKERDTKGDLTHDSIDIINGEARCLWKLGLGKPADKNCWPLVCPYVPSVVQIKQHKGGKTKEQSDYKRH

SEQ ID NO: 48675 - protein, 372 aa, Bacillus anthracis str. Ames
MKAEEKFSPGLDGIVAAETKISFLDTVKGEIVIQGYDLIELSKTKEYLDIVHLLLEEHLPNEDEKATLEKKLKEEYAVPEGVFNVLKALPKETHPMDGLRTGVSALAGYDNDIENRSLEVNKSRGYKLLSKVPNIVANSYHILNNEEPIEPLKELSYSANFFYMLTGKKPTELEEKIFDRSLVLYSEHEMPNSTFTARVIASTQSDLYGALTGAVASLKGSLHGGANEAVMYMLLEAGNVEKFEELLQKKLYNKEKIMGFGHRVYMKKMDPRALMMKEALKQLCDVKGDYTLYEMCEAGEKIMEKEKGIYPNLDYYAAPVYWMLGIPIQLYTPIFFSSRTVGLCAHVIEQHTNNRLFRPRVNYIGERHVLSK

SEQ ID NO: 48676 - protein, 461 aa, Ostreococcus tauri
MSHVHSPRSTSRRGDALFALTRRYVVVYVLGTFGDWIQGAYLYAAYRRHGLSKRTISGVYVLGYGVSATLGTALASVGDRRGHRVMVMAYGTMYAASCALMRSNAMWAVLTSRILGGMSYSVLFSNFESWVITEADEKGIERRRLARLFSVATFFNAASAVAAGLVANAVVELTDTRRLSWIGMDDTRSKLEQEVDFGESTLASSRNVYSPAFDVGVVSLLLCAAGAKHLWPKYDSSASNPSLSPSISSKETEGSSIQRAVQVILASHDLLRLGFANSLYEAALHLFVFVWTPILEQRSGEGVQVPHGMIFSGFMVCKMFGSQVFHILESRLLPERLLRIVLACSAVAFCSAVVFTHYWFTLGVFCVFEFGLGIYWPVMAVLRAKYVPNKMRATMTSAFRIPLNILVIGLLLIASRASDTVLLMTCGMIMVSSYISFGTQEAHIAAPAVDDIVPPADQHII

SEQ ID NO: 48677 - protein, 271 aa, Streptococcus agalactiae 2603V/R
MKKKLKTFSLILLTGSLLVACGRGEVSSHSATLWEQIVYAFAKSIQWLSFNHSIGLGIILFTLIIRAIMMPLYNMQMKSSQKMQEIQPRLKELQKKYPGKDPDNRLKLNDEMQSMYKAEGVNPYASVLPLLIQLPVLWALFQALTRVSFLKVGTFLSLELSQPDPYYILPVLAALFTFLSTWLTNKAAVEKNIALTLMTYVMPFIILVTSFNFASGVVLYWTVSNAFQVFQILLLNNPYKIIKVREEAVRVAHEKEQRVKRAKRKASKKRK

SEQ ID NO: 48678 - protein, 320 aa, Geobacter metallireducens GS-15
MPQLNMVQAINLALREEMARDDRVVLLGEDVGRDGGVFRITEGLFEEFGPKRVIDTPLSESAIVGAAVGMAAYGLRPVAEIQFMGFIYAAFDQLFAHAVRIRTRSRGRFTAPLVVRTPYGAGIKAPELHEESTEAFFCHMPGVKVVVPSGPYNAKGLLMAAIRDPDPVLFLEPTRLYRMVKEEVPEGEYTIPLGKARIARPGNAVTVVAWGSMLQRVMKAVEGYDAEVIDPMTLSPFDWEALLASVEKTGRLVVAHEAPLTCGLGAEIAATVAQEAILHLRGPVIRVAGPDTPVPLAKLIDHYLPSPERIRAALDDVLQY

SEQ ID NO: 48679 - protein, 1119 aa, Robiginitalea biformata HTCC2501
MKFRNDKIIYSPSDLSAHSSCKHLTQLNKKLVKGEIDNPEPATNRVLQILKKRGIAFEEDHLKKLKEQSQRVVEINPEDPKAEDQTLAAMAKGVAVIYQARLKEAGKWSGWADFLIKVDQPSSLGDWSYEVWDTKLANETRAGTILQIGLYSSRVAQVQGRTPEYMGVIKPEGEERYRYDEYAAYIRLVKSNLEQALESDSITYPDPVSYCDICKWWKNCNATRRKDDHLTFVAGMGKSQMKELYTHKVETLAELANLDLPILFDPIVGVKDTYYKLREQARLQLTSRKNGYEPIYETLELEERKGLYKLPEPSPNDIYLDFEGDRMVEPDGLEYMTGYVHNGQYTALWAKNETEEKVIFEQFIDFAFALKQKDPTLHIYHFANYEVTALKRLMGKYATRENEVDIFLRSNTFIDLHSVVRQSIRASVEKYSIKDLEIFFGYERKMNLRELSKYKSELELLIQSGDFDKLPTSHKDAVQLYNQDDCESLVRLQIWLEEIRIDLIQKGSDIIRPEDGDGSASEKITAHQERIQPIMDVLLAGIPPVKSERNNVQQAHFVLAHMLDWYRREKKSFWWEFFRLKDLPMDELLDERKAITKLQYTGQRESIKKSFVDTYTFPPQECDLRQGNTLEDHENRLGEIHDLDKEKGILRIKKGPSKIDLPHPEAVMSLENIPTTSKEEAVIRFAEWVLENGMESAENKYRAARNLLLNIPPILSEKKAEFEDILEYTFDYVNKLDHSYLPVQGPPGSGKSFTGSQLIVRLAQQGKTIGITALSHKVIRNLLTKVWEVAQEMDFDIRMIQKVNSSNQEPAPWTLASNEDDIQNAFGTANVIAGTSFMWCKSPYEGRLDYLFIDEAGQLSLIDTLAVAHSCSNLVLLGDPQQLKQPQQGVHPDGTDVSVLEYVLQSHKTIPEELGVFLPETWRMHPNINAFVSELFYENRLKSKQHLEKQRVIGSKYDGAGLYLEQVVHSGNTSSSSEEVEKVVEIVKALTNGNVELINEKGVKATIRSEHIKIITPYNAQVQALKKRLPDLEVGTVDKFQGQEAPIIIYSVATSSLEEAPRGMDFLFSPNRFNVAVSRARTCFIMVANPAIFEAECKSPYQIKLANAFCRFREMAIEY

SEQ ID NO: 48680 - protein, 387 aa, Geobacter metallireducens GS-15
MPFDFKLPDLGEGITEAELRKWLVKEGDTVREHQPVAEVETDKAVVEVPSPRGGRVGRLARREGETVAVGATLFTIEEEGEAPPERPKSVGIVGELPEAEEAREVIATPLVRKLARERGIDLATVRGSGPRGSITPDDLEKVSAPVAQPAESFGPVELVPLRGVRRAVARNVMASQRNTAFVTGMEEADITELWELRRRELGAVETRGAHLTFLPFFIKAVQHALREHPYLNAAIDDTAETIILKRHYHFGIAVETPDGLMVPVIRDVDRKSIIELAAEIQGLGSKARKRTISLDELKGSTFTLTNYGHFGGVFATPIINWPDVAILGFGRIGERPWIHKGQIAIRRILPLSLTFDHRVTDGADAAQFLLKVVAYLEDPALLFIEST

SEQ ID NO: 48681 - protein, 514 aa, Brassica napus
MTYQRKRNKQSMAITVPRRQLFIGGQWTEPLRRQTLPVVNPATEDIIGYIPAATSEDVELAVEAARKALTRNKGNDWSKASGAVRARYLRAIAAKVTERKSELANLEAIDCGKPLDEAAWDMDDVAGCFEYYADLAQGLDSKQKAPLSLPLDTFKGYVLKEPIGVVGLITPWNYPLLMAVWKVAPALAAGCTAILKPSELASVTCLELADICREVGLPPGVLNILTGLGTEAGAPLASHPHVDKIVFTGSTATGSNIMTSAAKLVKPVSLELGGKSPIIVFDDVKIDKAVEWTMFGCFWTNGQICSATSRLLVHEKIADEFLDKLVKWTKNIKISDPFEEGCRLGPVVSKGQYERVVKFVSNARKEGATVLCGGARPGHLKKGYFVEPAIISNVTTSMEIWRDEVFGPVLCVKTFSTEDEAIQLANDSQYGLAGAVLSNDLERCDRVSKAFEAGIVWVNCSQPCFCQAPWGGTKRSGFGRELGEWGLENYLSVKQVTQYISNEPWGWYKSPSKL

SEQ ID NO: 48682 - protein, 520 aa, Oryza sativa
MERESSTPASSWLGIDEAAPFAGKKATKDAAAADAFVRRWPKVVNATLVAFIMTMPPLLILLGGGRPGAPAVWIKSTVASLAARGEPKKDVLLGGLLLPGFDEQSCVSRYQSVYYRKNMTRPPSPHLLRRLRQQEALQRRCGPGTEPYRRASERLRSGQNAGDDFVATVDGCGYLVLISYRGLGNRILAITSAFLYAMLTGRVLLLDPGKTMADLFCEPFQATSWMLPGDFPLEHFRDLGEDAPESYGNVAVNRSGSVAGLRFVYAHLDHAATPANRLLYCDDHRQFLHRVQWVILRTDSYIAPGIFLNPAYKEELDMMFPNKDAVFYLLSRYLLHPTNDVWGMVTRFYHSYLKNADERLGVQIRVFDGDEPFQHILDQILECTSQEHLLPGVVVVSVHQPSHELHQHFFRSTHDMKALAEMYLLSLTDKIVTSGWSTFGYVGAGLGGLTPYIMIKPENHTVPNPPCVRAMSMEPCDHGPPYFECTKKEIDKIIDTGNLVPHVRSCEDVPWGRKLADPIS

SEQ ID NO: 48683 - protein, 162 aa, Glycine max
  misc_feature (109)..(109): Xaa can be any naturally occurring amino acid
  misc_feature (154)..(154): Xaa can be any naturally occurring amino acid
  misc_feature (159)..(160): Xaa can be any naturally occurring amino acid
TAITYFRRVYTRKSMSEYDPRLVAPACLYLASKVEESTVQARLLVFYIKKMCAGSDDKYRFEIKDILEMEMKLLEALDYYLVVYHPYRPLLHLLQDAGVTDLTQFAWGXVNDTYKMDLILVQPPYMIALACIYIASVLKDKDTTSWFEELHVDXNIVKXXSM

SEQ ID NO: 48684 - protein, 435 aa, Geobacter metallireducens GS-15
MMFDPQSVRIDGVYEQRQPGNFMLRIKVPAGIISTEQALRVAEIADRFAGGSVHLTTRGSIELHWLKQENLAEAWRMLASVGLTTRGACGGAVRGVVCAMPGDAGYGAAQLLARRLLAHFTHNPRFEGLPKKFKIGVFTGYGDGRHLIQDLSVILREGADGNSSYDVWIAGGLGREPHASFLLEEGVAGERLIPLAEAIISLYRELTPKGKRLKHLVRERGREEFVKLVRERVAAIPPLSLGAGLATPLTSAPREGAAERLTAGIFAGELGTKRFVDLAEIARQYAGGYMVVTGEQNVLFILDDGALRDDAARALAAAGFGCDSPAERVCFRICPGNHECKMGLSPTRDVARELAGTLGEAGERLSWSICGCPNSCSHPQLADVGIATVKSVKDEQGERHPLFDLYRRYGTDGFGVVVRHGIGIDELLEAVREIG

SEQ ID NO: 48685 - protein, 409 aa, Saccharomyces cerevisiae
MVDGLNTSNIRKRARTLSNPNDFQEPNYLLDPGNHPSDHFRTRMSKFRFNIREKLLVFTNNQSFTLSRWQKKYRSAFNDLYFTYTSLMGSHTFYVLCLPMPVWFGYFETTKDMVYILGYSIYLSGFFKDYWCLPRPRAPPLHRITLSEYTTKEYGAPSSHTANATGVSLLFLYNIWRMQESSVMVQLLLSCVVLFYYMTLVFGRIYCGMHGILDLVSGGLIGIVCFIVRMYFKYRFPGLRIEEHWWFPLFSVGWGLLLLFKHVKPVDECPCFQDSVAFMGVVSGIECCDWLGKVFGVTLVYNLEPNCGWRLTLARLLVGLPCVVIWKYVISKPMIYTLLIKVFHLKDDRNVAARKRLEATHKEGASKYECPLYIGEPKIDILGRFIIYAGVPFTVVMCSPVLFSLLNIA

SEQ ID NO: 48686 - protein, 305 aa, Thermoplasma volcanium GSS1
MPIDPQVRKYLDAMSKVSVPELNKTPIEDLRKIFDTPASGAPKVKISVVEDMILDTDAAKLPARLYDDSNSDSLVLYFHGGGFVFGSIETHDSLCRRIAKYSGSKVISVGYRLGPENKFPVAQIDAFNSYLYVLKRSEELGVDSDKIALMGDSAGGNLAAVASLMARDKGIKLPRLQVLVYPSTGPDMTSKSYLEYSSIYLTKELLNWFSSQYLNSIEDALNPYFSPILADLSGLPEAIVVTDEYDPLLEQGETYSATLRDSGVPVTSIRVNGMIHGFLSNFHLFRAADVSLMMISGAIHTILES

SEQ ID NO: 48687 - protein, 416 aa, Saccharomyces cerevisiae
MSLSSKLSVQDLDLKDKRVFIRVDFNVPLDGKKITSNQRIVAALPTIKYVLEHHPRYVVLASHLGRPNGERNEKYSLAPVAKELQSLLGKDVTFLNDCVGPEVEAAVKASAPGSVILLENLRYHIEEEGSRKVDGQKVKASKEDVQKFRHELSSLADVYINDAFGTAHRAHSSMVGFDLPQRAAGFLLEKELKYFGKALENPTRPFLAILGGAKVADKIQLIDNLLDKVDSIIIGGGMAFTFKKVLENTEIGDSIFDKAGAEIVPKLMEKAKAKGVEVVLPVDFIIADAFSADANTKTVTDKEGIPAGWQGLDNGPESRKLFAATVAKAKTIVWNGPPGVFEFEKFAAGTKALLDEVVKSSAAGNTVIIGGGDTATVAKKYGVTDKISHVSTGGGASLELLEGKELPGVAFLSEKK

SEQ ID NO: 48688 - protein, 214 aa, Methylococcus capsulatus str. Bath
MEAFERMLLENKAWAKDQLLKDPGYFERLSADQKPAVLWIGCSDSRVPAEIIVHAQPGEIFVHRNIANQLIMTDFNGLSVLQYAVDVLKVRDVIVCGHYNCGGIKAALQKQSAKLLIVNKWLKHVKDVYRLHAGEIEALGSEEERVGRLVELNVIEQVYNLAHTSIIQQSWKQNRCPTLHGWVYGLQDGLLKQLVTLPPGSEVSPVYQYVDFSE

SEQ ID NO: 48689 - protein, 510 aa, Oryza sativa (japonica cultivar-group)
MATLETWVGFGSAMAGVGLLWSRMPEHVHEEARYIISSVVPMVMSYFNPYEQITVSEYGEERFRRNKMFDAVSTYLRSACLGSATKLKAKLGNNIGDDPLVILDENQEVVDCLDGARMWWRLYPKASKNTGSTIISMFPGDTDEPRCYRLVFHKRHRQLVLKTYLPGIIRRWRELTAKDRQRLLFTNHSKQGEISMWTSVPYNPPSTFDMLAMDHAKKVEIMDDLRAFQKGKEYHSKVGKAWKRGYLLYGPPGTGKTTMIGAMANFLDYDVYDLDLTSVKDNAELRKLFLDTTDKSIIVIEDIDAIEVELTTKRKGKKMDNSDEVDNNHVLVELSNKTDDKSKVTLSGLLSFVDGLWSACGSERVFVFTTNHVDRLDPALIRPGRMDKHIEMSYCRLDAFKVLAKSYLDITEHSLFGEIGRLLDETDTTPADVADNLMPRGKRNGEISRLIDEIDAPADVAGNHMLRCKRKRDADECLAGLVETLKKAKMESATPPMDTIEEEANKEEQT

SEQ ID NO: 48690 - protein, 128 aa, Glycine max
MQSKSLSLAPALTFFPGLKPPHKTLLFHQICVLVITFLAYASFHASRKPPSIVKSVLGPTVPSNGTQVSNLSSIDAGWPPFNGTRGTHRLGELDLAFLTSYSIGMYLAGHVGDRIDLRLFLVFGMMGV

SEQ ID NO: 48691 - protein, 363 aa, Ostreococcus tauri
MNSDTDGHVERDTDDNETVTIDRAQAKIYRAEENLPQLYRLLYAYASVVLDTMAEHGEWEDRRHGERVRREKTRCEEALREMEVLKPMIDTEAEAYRARATAVASSAEAQKVRVAAAVEGRVETERNAGASTGTKTSTRVSLVAARLPAAHPTGKTNASSVGEAAPSAPGVPSTRHAHSLLPPPPPPPPNEDGVPFPEGIMYNASSVDFQPKVVVQVPSTDEAATDHTRLDTRLKLYNLREKVVRGDGNCQFRAIADQLFRDQERHAECRVVVINQLRRRAEDYSPYVPEDYDAYVEAMRKDGCWGDHITLQAAADAYGVRMCVISSYKDNFIVEIQPREQRSSRVCWISFWAEVHYNSLYGI

SEQ ID NO: 48692 - protein, 335 aa, Geobacillus kaustophilus HTA426
MSFLPFDQQKPLDFIAVGRLCIDLNANEIHRPMEETMTFTKYVGGSPANIAIGMARLGMKTGFIGRVADDQMGRFIVRYLKNNGIDTSHVITDKSGSVTGLAFTEIKSPTDCSILMYRDNVADLKLEPNDIDEDYIRRAKCLLISGTALAKSPSREAVFLALDYARRHGTVVVFDLDYRPYTWQSKEETAIYYNLAAEKCDVIIGTREEFDMMERFDGQRRDDEQTARKWFDYNAKIVVIKHGKDGSIAYTKTGETFVGTIFPANIVKTFGAGDSYAAGFIYGLMNDWPIPKAMEYGAAAASIVISSHSCSDAMPTLAQIEQFIEQHRNGSAARK

SEQ ID NO: 48693 - protein, 242 aa, Zea mays
  misc_feature (189)..(189): Xaa can be any naturally occurring amino acid
  misc_feature (197)..(197): Xaa can be any naturally occurring amino acid
  misc_feature (217)..(217): Xaa can be any naturally occurring amino acid
  misc_feature (222)..(222): Xaa can be any naturally occurring amino acid
MIMAPLHEFLPEGNVEEIVRELCSETGANQEDALARIEKLSEVNPMLGFRGCRLGISYPELTEMQARAIFEAAIAMTNQGVQVFPEIMVPLVGTPQELGHQVALIRQVANKVFTSMGKTIGYKIGTMIEIPRAALVADEIAEQAEFFSFGTNDLTQMTFGYSRDDVGKFIPIYLAQGILQHDPFEVLDXRGVGELGXLATEKGRKARPDFEVGICGXHGGEXFIVAFFARLGWISFLLPFRS

SEQ ID NO: 48694 - protein, 265 aa, Legionella pneumophila subsp. pneumophila str. Philadelphia 1
MLRRFAVIGHPIAHSLSPVIHQMFAQQTQIELIYEKILGDDVKFEQQISDFFIQYGNGLNVTLPYKKRAYELAKIRTQRCTLAGAANTLWMEENQLHADNTDGIGLIRDLSRFLELKDKKILILGAGGAARGIIFPLLEAKPLQLIVANRTLEKAEELQRQFPQINVTSFAELTEFFDLIINATSTSLSGQVIVLPEEVLSHKPFCYDLAYNQKTSTAFVQYARNGGCEAVDGLGMLVEQAAEAFFTWNKVMPSTQKILEHLRSF

SEQ ID NO: 48695 - protein, 329 aa, Ostreococcus tauri
  misc_feature (1)..(2): Xaa can be any naturally occurring amino acid
XXTWIPTRALASEAEGEAAKTGTLSDRLGTVALVVGTLAGSVVGASTYASTTEELRREVEANEHVPKALRETPLGGVYGGAIERLLALREWMDDQSHNYLDPISDKLLPDHPPQAEYIPHTLVLDLDDTLINSNWKRERGWRVFKRPGVDGFLAHMAQFYEMVIFTDQLMTYGDPIIERLDPTRYVTHRLYRESAQYKNGEYIRDLSKLNRDMGQILYISSKPRSAELHPANVIPIKPWTYEDGSKDTALLDLMPFLESIVRLNVQDVRVVLDSYKKEMSATGKDIPTIFRERQLALQRRRRDKLANQTKMSRGYDVGKRAQREARAAA

SEQ ID NO: 48696 - protein, 561 aa, Triticum aestivum
MAALTPSAGARLLRRLLSTAAEVAREAPAPAAKNPKKAAARPVRKRAARAVAPQDAKEAAEAAPDAEGAKKAAEAAPDAEGAKKAAAAGTKDSRPLYRRLSALGNAGEGSVSAVMNKWLREGRETRSVDLERYVKELRRYKRHSQALELMDWMVHTKGMNMSYTNHAIRLDLIYKVRGIEAAEKYFEGLPDPAKNHRTFGALLNCYCSSKKEEKATDLYRKMDELGIASSTLPINNLMSLYMKLGQHKKVCSLFEEMKEKNVKPDNLTCCILMTSCAALNKIDDVEQVLKEMEEKGGVLGWSAYSTLASIYQSAGLVEKAESALKKLEGLVQDRDGRQPFDFLMSLYASVGNLSEVKRVWGVVKGTFPKVTNTSYFSMLQALLKLNDADYMKQVFEEWESNHECYDVKLTNVMTRAHLKNGMAKEAEQLWEKAKEMGACFDSKTCELFLDHYMGTGDMKSALNWVENVTKLPKKAGKLDPDKIPKFSKYFEEQKDVQGAERFCNCLRALGCIDGKAYESLLRTYLAAGETSRSVRQQIKDDKIEICYDIGKLLKRLGDKGR

SEQ ID NO: 48697 - protein, 794 aa, Neisseria meningitidis FAM18
MADNYVIWFENLRMTDVERVGGKNASLGEMISQLTEKGVRVPGGFATTADAYRAFLAHNGLSERISAALAKLDVEDVAELARVGKEIRQWILDTPFPEQLDAEIEAAWNKMVADAGGADISVAVRSSATAEDLPDASFAGQQETFLNINGLENVKEAMHHVFASLYNDRAISYRVHKGFEHDIVALSAGVQRMVRSDSGASGVMFTLDTESGYDQVVFVTSSYGLGENVVQGAVNPDEFYVFKPTLKAGKPAILRKTMGSKHIKMIFTDKAEAGKSVTNVDVPEEDRNRFSITDEEITELAHYALTIEKHYGRPMDIEWGRDGLDGKLYILQARPETVKSQEEGNRNLRRFAINGDKTVLCEGRAIGQKVGQGKVRLIKDASEMDSVEAGDVLVTDMTDPDWEPVMKRASAIVTNRGGRTCHAAIIARELGIPAVVGCGNATELLKNGQEVTVSCAEGDTGFIYAGLLDVQITDVALDNMPKAPVKVMMNVGNPELAFSFANLPSEGIGLARMEFIINRQIGIHPKALLEFDKQDDELKAEITRRIAGYASPVDFYVDKIAEGVATLAASVYPRKTIVRMSDFKSNEYANLVGGNVYEPHEENPMLGFRGAARYVADNFKDCFALECKALKRVRDEMGLTNVEIMIPFVRTLGEAEAVVKALKENGLERGKNGLRLIMMCELPSNAVLAEQFLQYFDGFSIGSNDMTQLTLGLDRDSGLVSESFDERNPAVKVMLHLAISACRKQNKYVGICGQGPSDHPDFAKWLVEEGIESVSLNPDTVIETWLYLANELNK

SEQ ID NO: 48698 - protein, 2214 aa, Saccharomyces cerevisiae
MATIAPTAPITPPMESTGDRLVTLELKDGTVLQGYSFGAEKSVAGELVFQTGMVGYPESVTDPSYEGQILVITYPLVGNYGVPDMHLRDELVEELPRYFESNRIHIAGLVISHYTDEYSHYLRKSSLGKWLQNEGIPAVYGVDTRSLTKHLRDAGSMLGRLSLEKSGSDRTISRSSSWRSAFDVPEWVDPNVQNLVSKVSINEPKLYVPPADNKHIELQTGPDGKVLRILAIDVGMKYNQIRCFIKRGVELKVVPWNYDFTKEDYDGLFISNGPGDPSVLDDLSQRLSNVLEAKKTPVFGICLGHQLIARAAGASTLKLKFGNRGHNIPCTSTISGRCYITSQNHGFAVDVDTLTSGWKPLFVNANDDSNEGIYHSELPYFSVQFHPESTPGPRDTEFLFDVFIQAVKEFKYTQVLKPIAFPGGLLEDNVKAHPRIEAKKVLVLGSGGLSIGQAGEFDYSGSQAIKALKEEGIYTILINPNIATIQTSKGLADKVYFVPVTAEFVRKVILHERPDAIYVTFGGQTALSVGIAMKDEFEALGVKVLGTPIDTIITTEDRELFSNAIDEINEKCAKSQAANSVDEALAAVKEIGFPVIVRAAYALGGLGSGFANNEKELVDLCNVAFSSSPQVLVEKSMKGWKEVEYEVVRDAFDNCITVCNMENFDPLGIHTGDSIVVAPSQTLSDEDYNMLRTTAVNVIRHLGVVGECNIQYALNPVSKDYCIIEVNARLSRSSALASKATGYPLAYTAAKLGLNIPLNEVKNSVTKSTCACFEPSLDYCVVKMPRWDLKKFTRVSTELSSSMKSVGEVMSIGRTFEEAIQKAIRSTEYANLGFNETDLDIDIDYELNNPTDMRVFAIANAFAKKGYSVDKVWEMTRIDKWFLNKLHDLVQFAEKISSFGTKEELPSLVLRQAKQLGFDDRQIARFLDSNEVAIRRLRKEYGITPFVKQIDTVAAEFPAYTNYLYMTYNADSHDLSFDDHGVMVLGSGVYRIGSSVEFDWCAVTAVRTLRANNIKTIMVNYNPETVSTDYDEADRLYFETINLERVLDIYEIENSSGVVVSMGGQTSNNIAMTLHRENVKILGTSPDMIDSAENRYKFSRMLDQIGVDQPAWKELTSMDEAESFAEKVGYPVLVRPSYVLSGAAMNTVYSKNDLESYLNQAVEVSRDYPVVITKYIENAKEIEMDAVARNGELVMHVVSEHVENAGVHSGDATLIVPPQDLAPETVDRIVVATAKIGKALKITGPYNIQFIAKDNEIKVIECNVRASRSFPFISKVVGVNLIELATKAIMGLPLTPYPVEKLPDDYVAVKVPQFSFPRLAGADPVLGVEMASTGEVATFGHSKYEAYLKSLLATGFKLPKKNILLSIGSYKEKQELLSSVQKLYNMGYKLFATSGTADFLSEHGIAVQYLEVLNKDDDDQKSEYSLTQHLANNEIDLYINLPSANRFRRPASYVSKGYKTRRLAVDYSVPLVTNVKCAKLLIEAISRNITLDVSERDAQTSHRTITLPGLINIATYVPNASHVIKGPAELKETTRLFLESGFTYCQLMPRSISGPVITDVASLKAANSVSQDSSYTDFSFTIAGTAHNAHSVTQSASKVTALFLPLRELKNKITAVAELLNQWPTEKQVIAEAKTADLASVLLLTSLQNRSIHITGVSNKEDLALIMTVKAKDPRVTCDVNIYSLFIAQDDYPEAVFLPTKEDQEFFWNNLDSIDAFSVGALPVALANVTGNKVDVGMGIKDSLPLLLAAVEEGKLTIDDIVLRLHDNPAKIFNIPTQDSVVEIDLDYSFRRNKRWSPFNKDMNGGIERVVYNGETLVLSGELVSPGAKGKCIVNPSPASITASAELQSTSAKRRFSITEEAIADNLDAAEDAIPEQPLEQKLMSSRPPRELVAPGAIQNLIRSNNPFRGRHILSIKQFKRSDFHVLFAVAQELRAAVAREGVLDLMKGHVITTIFFEPSTRTCSSFIAAMERLGGRIVNVNPLVSSVKKGETLQDTIRTLACYSDAIVMRHSEEMSVHIAAKYSPVPIINGGNGSREHPTQAFLDLFTIREEIGTVNGITVTFMGDLKHGRTVHSLCRLLMHYQVRINLVSPPELRLPEGLREELRKAGLLGVESIELTPHIISKTDVLYCTRVQEERFNSPEEYARLKDTYIVDNKILAHAKENMAIMHPLPRVNEIKEEVDYDHRAAYFRQMKYGLFVRMALLAMVMGVDM

SEQ ID NO: 48699 - protein, 424 aa, Staphylococcus aureus subsp. aureus MRSA252
MEITMPKLGESVHEGTIEQWLVSVGDHIDEYEPLCEVITDKVTAEVPSTISGTITEILVEAGQTVAIDTIICKIETADEKTNETTEEIQAKVDEHTQKSTKKASSTVEQTSTSKQNQPRNNGRFSPVVFKLASEHDIDLSQVVGSGFEGRVTKKDLMSVIENGGTTAQSDKQVQTQSTSVDRSSNQSSEDDSENSTIPVNGVRKAIAQNMVNSVTEIPHAWMMIEVDATNLVNTRNHYKNNFKNKEGYNLTFFAFFVKAVADALKAYPLLNSSWQGNEIVLHKDINISIAVADENKLYVPVIKHADEKSIKGIAREINTLATKARNKQLTTEDMQGGTFTVNNTGTFGSVSSMGIINHPQAAILQVESIVKKPVVINDMIAIRSMVNLCISIDHRILDGLQTGKFMNHIKQRIEQYTLENTNIY

SEQ ID NO: 48700 - protein, 668 aa, Saccharomyces cerevisiae
MEDKFANLSLHEKTGKSSIQLNEQTGSDNGSAVKRTSSTSSHYNNINADLHARVKAFQEQRALKRSASVGSNQSEQDKGSSQSPKHIQQIVNKPLPPLPVAGSSKVSQRMSSQVVQASSKSTLKNVLDNQETQNITDVNINIDTTKITATTIGVNTGLPATDITPSVSNTASATHKAQLLNPNRRAPRRPLSTQHPTRPNVAPHKAPAIINTPKQSLSARRAVKLPPGGMSLKMPTKTAQQPQQFAPSPSNKKHIETLSNSKVVEGKRSNPGSLINGVQSTSTSSSTEGPHDTVGTTPRTGNSNNSSNSGSSGGGGLFANFSKYVDIKSGSLNFAGKLSLSSKGIDFSNGSSSRITLDELEFLDELGHGNYGNVSKVLHKPTNVIMATKEVRLELDEAKFRQILMELEVLHKCNSPYIVDFYGAFFIEGAVYMCMEYMDGGSLDKIYDESSEIGGIDEPQLAFIANAVIHGLKELKEQHNIIHRDVKPTNILCSANQGTVKLCDFGVSGNLVASLAKTNIGCQSYMAPERIKSLNPDRATYTVQSDIWSLGLSILEMALGRYPYPPETYDNIFSQLSAIVDGPPPRLPSDKFSSDAQDFVSLCLQKIPERRPTYAALTEHPWLVKYRNQDVHMSEYITERLERRNKILRERGENGLSKNVPALHMGGL

SEQ ID NO: 48701 - protein, 327 aa, Staphylococcus aureus subsp. aureus MRSA252
MAKLSYLEAIRQAQDLALQQNKDVFILGEDVGKKGGVFGTTQGLQQQYGEDRVIDTPLAESNIVGTAIGAAMVGKRPIAEIQFADFILPATNQIISEAAKMRYRSNNDWQCPLTIRAPFGGGVHGGLYHSQSIESIFASSPGLTIVIPSTPYDAKGLLLSSIESNDPVLYFEHKKAYRFLKEEVPEEYYTVPLGKADVKREGEDLTVFCYGLMVNYCLQAADILAADGINVEVVDLRTVYPLDKETIIDRAKHTGKVLLVTEDNLEGSIMSEVSAIIAEHCLFDLDAPIMRLAAPDVPSMPFSPVLENEIMMNPEKILNKMRELAEF

SEQ ID NO: 48702 - protein, 473 aa, Staphylococcus aureus subsp. aureus MRSA252
MSEKQYDLVVLGGGTAGYVAAIRASQLGKKVAIVERQLLGGTCLHKGCIPTKSLLKSAEVFQTVKQAAMFGVDVKDANVNFENMLARKEDIINQMYQGVKHLMQHNHIDIYNGTGRILGTSIFSPQSGTISVEYEDGESDLLPNQFVLIATGSSPAELPFLSFDHDKILSSDDILSLKTLPSSVGIIGGGVIGMEFASLMIDLGVDVTVIEAGERILPTKSKQASQLLKKSLSARGVKFYEGIKLSENDINVNEDGVTFEISSDIIKVDKVLLSIGRKPNTSDIGLNNTKIKLSTSGHILTNEFQQTEDKHIYAAGDCIGKLQLAHVGSKEGVVAVDHMFEGNPIPVNYNMMPKCIYSQPEIASIGLNIEQAKAEGMKVKSFKVPFKAIGKAVIDSHDANEGYSEMVIDQSTEEIVGINMIGPHVTELINEASLLQFMNGSALELGLTTHAHPSISEVLMELGLKAESRAIHV

SEQ ID NO: 48703 - protein, 352 aa, Medicago truncatula
MDNLPVDIVNQILALPTPSDFDGPDTIGWGGTNTLQFTVQSAYNLQQETSFAVGGEWKTLWNWKGPHRIQTFIWLAANGRILTNYRRSKWGVGISPTCPCCAREDETIIHVLRDCVHATQTNFTTTCWYLWNWRNKSIFEIGFQRPSNPTLVIQKFTREIEDNTKLVHKSSHQKETIYIGWMRPPFGWVKLNCDGAWKASGTFAGCGGLLRDSDGRWIKGYFKKIGMCDAFHAEMWGMYLGLDMAWRENTTHLIVDSDSKILVDMITENCNFSGTTPTLVRRIRQLLSLSWTVKITHTWREGNRSADWLANFSISMDFLDFHILKTPPSELQSLLFDDISGACMPRNVRLIS

SEQ ID NO: 48704 - protein, 611 aa, Medicago truncatula
MSAVELTETYACTPSTERGRGILISGDSKSNTITYTNARSVIMMNLHNPLQVSVYGEHAYPATVARFSPNGEWVASADVSGTVRIWGTRNEFVLKKEFRVLSGRIDDLQWSPDGIRIVASGEAKGNSFVRAFMWDSGTNVGEFDGHSRRVLSCAYKPTRPFRIVTCGEDFLVNFYEGPPFRFKQSHRDHSNFVNCVRYSPDGSKFVTVSSDKKGIIFDGKTGEKIGELSSEGGHTGSIYAVSWSPDGKQVLTVSADKSAKVWDISEDNIGKVKKTLICSASGGVEDMLVGCLWLNDYLVTVSLGGTISIFSASDLDKAPRSFSGHMKNVSSLTIRRSNPRVLLSCSYDGLIVKWIQGIGYSGKLQRKENSQIKSLAAAEEEIVTSGFDNKIRRVSLHGDQCGDAEAIDIGSQPKDFSVALSSPELVLVSIDSGVVMLRGTKVVSTINLGFTVTASVVSSDGSEAIIGGQNGKLHIYSISGDTLVEEAVLEKHRGAISVIRYSPDFSMFASGDVNREAVVWDRASRDVKLKNMLYHTARINCLAWSPDSSRIATGSLDMCVIIYEIDQPVANRNTIKGAHLGGVYGLVFTDEYSLVSSGEDAFIRVWKITPP

SEQ ID NO: 48705 - protein, 1123 aa, Aspergillus nidulans FGSC A4
MENERDQSQFSGLPPFPDDVPTAPLLRLSLKDLLAGNETEIEKLSKACEDIGFFYLDMRDAGTVTQILEDADKLFEIGAGLFELPLEEKKKYDLSSQKSYFGYKAQGAAVVDRQGNLDRNEFYNVSKDDIMGISGPLPAPDIINKNRHILESFIKYSHSIVTLILSILNTSLGLPESTLTNIHRLHAVSGDQVRFVKAPPQPADDRRTALGEHTDFGSVTILFNRLGGLQVLPPGADAEWQYVKPLPGHVIVNLGDAMVKFTNGLLRSNIHRVVSPPGDQADTTRFSLVYFSRPEDDVPLRRLEGSSRIPNLDEGVVEENINSKDWIIRRALGRRVDVPDIEYDKSAGTEMLSRTTWAVRLTHGLLAPSALLYSVVSLSIYEARALPSLDGNMDMTYTFNEEDLASSVPGTPRSGLRTPPTSPLWSTGSAITTPGSSANTTSSGTTEYSHWQAEVFQPGSLTQAKRYHNNKAFQGNDGKPSGIEEKRYAFFASIRETVLPLLGADHSPERLFEIEESSHAQVTDYVLLDSQPTGIRATLKSYQLEGLSKMIYWRNNGIGGILADDMGLGKTLQALSLFQYVKDNERADSGRLGSGQWHTMEAVKKEKTCAHASDNRGPSLGILFTPIQNDLTELWSILHWLYPDVFVPATAKLFENAFSLTDGKFDSIFLSHITRFLKVVMLRRTKCDSQIGLDLPPKKETVFSVPLTELQLGWYRTILTGVDESILLGSIEQEKSQSNVVPMTDSIVESMTAAWETNKATNTKRRSHITTNTLMELRKCSIHPYLLADALPKEYNIGQHIVDASCKFIVLQKMIRQYVGLENKKVIIFSGFDQTLDLCEDLLEMEKAQFSFKYGRLDGSTSSAWRNLSVFLFQNDPRYMVFLLSTRAGGEGLNLVSSSIVIFLDDDWNPQVMRQAESRVHRIGQTQPVQIFRIHAKGTVEDQMRRRMDKKAYLADKVMGEFGNNITHHTDLEETTEDEICLIPSRPIIPRSFDAKDLVNSDFHSIMSSYALDEVSIQGMSHAEKRAWLARSERVKTNIFNGVMVETKYRRFSVYDETVLSISKASRRIGKSRVVTVGEWKVSKESMEMATPVSPTFPKQGVGDKACKMNEAPALPEDFYSAV

SEQ ID NO: 48706 - protein, 648 aa, Enterococcus faecalis V583
MTKQNIVVVGAGYAGVSATKFLAKKFKKDTDVTITLIDRHSYHTMMTELHEVAGGRVEPEAIQYDLQRLFSRKKNVKLVTDTVTGIDKENKVVKTLAGSYPFDQLILGMGGEPNDFGTPGVKENGFTLWSFDDAVKIRHHIEATVAKAAIEPDAEVRKAMLTFVVCGSGFTGIEMVGELIDWKDRLAKDAKIDPDEITLMVVEAMPTILNMLSRNDAAKAERYLEKKNVQLLLNSPIVEVAADHIKLKDGSEVPTHTLIWTAGVKATSDAADFGLEAARGSRLVANEYMQAKGYEDKNIYIIGDLVYYEETPNTPTPQIVQAAEQTGHTAAANIVADIKGGEKHAFKGNYQGFMVSIGAKWGVANLFDKIHLSGFLAIIMKHIVNLKYFFDIRSGYYMFQYIMHEIFHIKDDRSVARGHTSRYGNVLWSVPLRVFYGMVWLVESMKKIVGNGDYLKPSTWFGDGSWFTDKVVFPFPWLQEQVTTGASQATETATTAASGAADAAASGGADAATQAAHFGLSYAYGETPMQVFDHMPKWFESVMKFMMPNQEVALFMQKFMTIVEVCIALALIAGLFTWLSSAATIGLTIAFCLSGMFYWVNIWFIFVAFALMNGSGRAVGLDRWVIPWIQRKLGKAWYGTPKARYGGK

SEQ ID NO: 48707 - protein, 333 aa, Desulfovibrio desulfuricans G20
MAVTLGINGFGRIGRYLVRLLANDPELNTAVVNARADNESLARLFKYDSCHGTYPAEVKANSDGFTVNGKQIVVTRYGHNEWKWADYGVDIAVESTGTVKDRAGLALHMERGAKKTVISAPCADADLTVVMGVNDHLYDPAQHDVISNASCTTNCLAPVVKVLNDTFGVRHGLMTTVHSYTMSQRLLDGTHKDPRRGRAAAMSMIPTSTGAAKAVGLVIPELAGKLNGMAIRVPTPNVSLVDLTCELGKSATAEEINAALREAAATTLKGNMGYTEEPLVSCDYMGSTFGGVVDGPCTSVMEGNMAKLIIWYDNEAGFTNQLVRLLRKVGNSL

SEQ ID NO: 48708 - protein, 172 aa, Medicago truncatula
MAASVDPLVVGRVIGDVVDMFIPSVGMSVYFGPKHVTNGCDIKPSMAINPPKVTLTGNMDNLYTLVMTDPDAPSPSEPSMRELIHWIVVDIPGGTNPKRGKEILPYIGPKPPVGIHRYILVLFEQKGPIGMVEQPTSRVSFNTRYFASQMNLGLPVATVYFNSQKEPQAKRR

SEQ ID NO: 48709 - protein, 328 aa, Enterococcus faecalis V583
MNIHPMWNTYPTLSKELTTTLRLMEQAVQIDNQEIQAAVHDMIHSGGKLLRPAYQLLFSYFGEQRDPKKATALAASIELLHTATLVHDDIVDEADTRRGLPTLRSRFGNSTAVYTGDYLFVCCFKLLSDYSSSLKSIQLNSRSMEKVLTGELGQMDNRYNFEVTIDQYLKNISGKTAELFALSCFVGAYESGTSQRFAKRCGEIGENIGLAFQIIDDILDYTQTADAIGKPVLEDVRQGVYSLPLIYALEANREVLLPLLMKKEALTDEETQEIYRLVHELGGVEKAQELATHYTEKALKEISKLPETKAQAKEQLYEITQTILTREN

SEQ ID NO: 48710 - protein, 462 aa, Mannheimia succiniciproducens MBEL55E
MQTLTILLIRGKLMSSTVSSLEDFLSLVAQRDGNQPEFLQAVREVFTSIWPFLEANPQYRSQALLERLVEPERAFQFRVAWTDDKGQVQVNRAFRVQFSSAIGPYKGGMRFHPSVNLSILKFLGFEQIFKNALTTLPMGGGKGGSDFDPKGKSDAEVMRFCQALVAELYRHIGPDTDVPAGDIGVGGREVGYLAGYMKKLSNQAACVFTGRGLSFGGSLIRPEATGYGLVYFAQAMLAEKGDSFQGKTVSVSGSGNVAQYAIEKALQLGAKVVTCSDSAGYVYDEAGFTTEKLAALLDIKNVKRGRVKDYAEQFGLQYFPGERPWGVKVDIALPCATQNELELTDAQKLIANGVQLVAEGANMPTTIEATEALQAAGVLFAPGKAANAGGVATSGLEMAQSSQRLFWSAEEVDQKLHNIMLDIHANCKKYGTDANGNINYVAGANIAGFVKVADAMLAQGVY

SEQ ID NO: 48711 - protein, 329 aa, Euphorbia esula
MTTDFKTIPIIDISSLVSKCDEPGMAQDPTVCEVVKQLDQACREAGFFYVRGHGIPDSLIKEVKSLAHKFFHLPYEEKLKIKMTPAAGYRGYQRVGENVTKGTPDMHEAIDCYKEVTPGMYGALGKPMEGCNQWPLNLPNFKSLMEEYVSLCTDLSRKILRGIALTLCGSADALEGEIGGNPFWVLRIIGYPDVSSVKGHDSNENDIGCGAHPDYGLLTLVNQDDDITALEVRNMSGEWIAAPPIPGTFVCNIGDMLKIWSNGLYDSTLHRVVNNSPKYRVCVAYFHEPNFDAAIEPSEFCVKKTGGTRRSGKAVYGEHLVSKVQTNFG

SEQ ID NO: 48712 - protein, 837 aa, Arabidopsis thaliana
MRSRNPKASSQPLDPTSSLHTDAISPSQLSLDQISLAISLTDSLSLDCDVLSNRRLLGHLTFTVSPSSPFTQPCRSNFTIPHSFVSFSLDHNSTSPRFIFIFIYSTLPELLAVLASPSLTAHHLSFTRPLHASPQHLRQSFSPFTVLPSPPYSSLLDLTPFTHRKLDSATKELASPSSPPLNHSTSSLPSLIKTATMFSPFAVYLTKLPLQSTKQALPPFTQPRRYRLSFTFTRPQNRKTRIHNFNVLDRFNRPCTRPEINMSYYSGESSMDADYNVDEGESCERAPLPAIYRSLEGLFGFPSEKGTKPKFEREELKDLWLTIGNDMALNSMRSKSNQIRSPGIQYYQRSVANGKKFLKGDLNDAPPVMLLLIHLCGYRKWAHTNGKKRARRALCGEPPLDMPSRRYDASEPSRHRPEPVQHRPEPIGVHDFSSPEAYVTAVLAAAEEERSSIIRAVLAATKEQRSSNPTGKLRHNREILRWHGSNHRQLLTTNSVPFSTELCLYLYPSKKNLRIQVIWRICNKVCCFLIEYNPNAKVVGLRSNASQDDSHILPPNPYECFELGSANVPVYSTECTNCWEKGKKGKKGKKVKKPKRNWSSTEDVVLISGWLNTSKDPVVGNEQKGAAFWERIAAYYNSSPKLKGVEKRGHICCKQRWSKVNDVVNKFVGSYLAASKQQTSGQNDDDVVSLAHQIFSKDYGCKFTCEHAWRELRYDQKWIAQSTHGKAKRRKCEDDSEPVGLEDKEARPIGVKAAKAAAKAKGKGKLSPDEGEETNALKEIKSIWEIKEKDHAAKEKLIIIKEKKNRTKLLERLLGKTEPLSDIEIELKNKLINELLA

SEQ ID NO: 48713 - protein, 240 aa, Ostreococcus tauri
MEEGTTGGTEVDVLYRRRDGTAASARVRAEDGHDGFLGKVLKSWTAAMADETPEERRGASALAATSERVTKSELKRSASSDIMSAEQMETLREALPAMCRMREWTLTYSTKRDGISLKSLYRRSSGKENTVLVVSDSGGAIFGAFCTEAWKLHSRYVGTGESFVFSLAPEGMKYAWSGENDYFMLGAADSLSVGGGSAHAIRLEEDLLQGSSGECETFDSPPLASSDMFRVSRIELWSLD

SEQ ID NO: 48714 - protein, 270 aa, Legionella pneumophila subsp. pneumophila str. Philadelphia 1
MDYYFTKGKPQLVNMKTPVYLVTQFQQLMDLMQNQYQVSCLELMQRSGKAACDFLVYRWPKVKKISIFCGRGDNGGQGYVLAQQAKKMGMIPTVWQVGHQMSMSKPPQMHEEVWYEMNSCHQQGILLHTYSPDIDLGDPELIVDALFGVGLYGHVRPEIASLLQRLQQFTVPILAIEVPTGINASTGEIAGNALAATATITFLCMKLGLLINDGKIYSGEIAFDDLLAPEAIYQQVKGIEKSSLLDSSTCFSKKIWYRNKTQKGWQLSIN

SEQ ID NO: 48715 - protein, 131 aa, Neisseria meningitidis FAM18
MDKNLLEAVKFDEKGLVCAIAQDAETKRVLMVAWMNAEALQKTVETGFAHYYSRSRQKQWMKGEESGHTQKVRELRLDCDGDAIVMLIAQNGGIACHTGRESCFYKVWRGSAWETADAVLKDEKEIYGSTH

SEQ ID NO: 48716 - protein, 336 aa, Zea mays
MKGLFKSKPRTPVDIVRQTRECLVYLDLHSDSRSGDAKREEKMTELSKNIRDMKSILYGNGESEPVTEACVQLTQEFFRENTLRLLIIHLPKLNLETRKDATQVVANLQRQQVSSKIVASEYLESNKDLLDILILGYENMDIALHYGAMLRECIRHQSIARYVLESEHMKKFFDYIQLPNFDIASDASATFKELLTRHKATVAEFLSNNYDWFFEEFNSRLLSSTNYITKRQAIKLLGDMLLDRSNAAVMMRYVSSKDNLMILMNLLRDSSKNIQIEAFHVFKLFAANKNKPPEVVNILVTNRSKLLRFFAGFKIDKEDEQFEADKEQVIKEISAL

SEQ ID NO: 48717 - protein, 307 aa, Arabidopsis thaliana
MAIVSVSNSFLTFNSPNQLRFSRRRFSAMASSTTGVRVAEGEGNLPKLVLTSPQNSEAEIYLFGGCITSWKVASGKDLLFVRPDAVFNKIKPISGGIPHCFPQFGPGLIQQHGFGRNMDWSVVDSQNADDNAAVTLELKDGPYSRAMWDFAFQALYKVIVGADSLSTELKITNTDDKPFSFSTALHTYFRASSAGASVRGLKGCKTLNKDPDPKNPIEGKEDRDAVTFPGFVDTVYLDAPNELQFDNGLGDKIIIKNTNWSDAVLWNPHTQMEACYRDFVCVENAKLGDVKLEPGQSWTATQLLSIS

SEQ ID NO: 48718 - protein, 170 aa, Zea mays
MAAANLLSRSLLPTPNTIRTSHPTPRSPAVVSFPRRRARLSVCASVSMASPSPPPQPAAAAAGVPKHCFRRGADGYLYCEGVRVEDAMAAAERSPFYLYSKLQILRNFAAYRDALQGLRSIVGYAVKANNNLPVLRVLRELGCGAVLVSGNELRLALQAGFDPARCGSCS

SEQ ID NO: 48719 - protein, 449 aa, Enterococcus faecalis V583
MKTYDYIVIGGGSGGIASANRAGMHGANVLLIEGNEIGGTCVNVGCVPKKVMWQASSMMEMMERDTAGYGFDVEIKNFSFKQLVENREKYIDFLHGAYNRGLDSNNIERIHGYATFTGEQTIEVNGTEYTAPHILIATGGRPKKLGIPGEEYALDSNGFFALEEMPKRVVFVGAGYIAAELAGTLHGLGAETHWAFRHERPLRSFDDMLSEKVVERYQEMGMQIHPNATPAKIEKTAQNEYVITFENGESITTDAVIFGTGRQPNTDQLGLENTKVALDEKGYVKVDKFQNTTQNGIYAVGDVIGKIDLTPVAIAAGRRLSERLFNGQTDLYLDYNLVPTVVFTHPPVATIGLTEKAALEEYGEDQVKIYRSSFTPMYFALGEYRQKCDMKLICVGKEEKIVGLHGIGIGVDEMLQGFAVAIKMGATKADFDNTVAIHPTGSEEFVTMR

SEQ ID NO: 48720 - protein, 91 aa, Arabidopsis thaliana
  misc_feature (52)..(52): Xaa can be any naturally occurring amino acid
  misc_feature (72)..(72): Xaa can be any naturally occurring amino acid
MASSMLSSATIVASLDHATMVAPFSGLKSSAVFTVIRRANNDITSITINGGXVNFMHVWPPTGNNKFETLSXLPDLTDSELAMEVDYLIRD

SEQ ID NO: 48721 - protein, 734 aa, Medicago truncatula
MIAVTRKFQSCSAQSSRLLQTMRANYNLRGKHLHNFCFPVQKARDTYIVKCTNSISTHMRNGHCHLALRVFDSMPYKNLFSWNLMLTGYVKNRRLVDARNLFDLMPQKDAVSWNVMLSGYVRSGCVDEAKLVFDNMPYKDSISWNGLLAVYVQNGRLEEARRLFESKVDWELISWNCLMGGYVKRKMLGDARRLFDHMPVRNAISWNTMISGYARDGDLLQARRLFEESPVRDVFTWTAMVFAYVQSGMLDEARRVFDEMPGKREMAYNVMIAGYVQYKKMDMARELFEAMPCRNVGSWNTIISGYGQNGDIAQARELFDMMTQRDCVSWAAIIAGYAQTGHYEKVMHMLVKMKRDGKSLNRSTFCCALSTCAGMAALVLGKQVHGQAVKTGYDNGCLVGNALLEMYCKCGSIGEAYDVFERMQLKDIISWNTMLAGYARHGFGRQALLVFDSMKTAGFKPDEITMVGVLLACSHTGLTDRGTEYFYSMSKDYGITPNSKHYNCMIDLLGRAGLLEEAHNLMRNMPFEPDAATWGALLGASRIHGNAELGEKAAEMVFNMEPNNAGMYVLLSNLYATLGKWVDVGKLRLKMRQLGIQKIPGYSWVEVQNKIHKFTVGDCFHPEKDRIYAYLEEIDLKMKHEGHVSLVKLVLHDVEEEEKKRMLKYHSEKLAVAFGILTIPAGRPIRVMKNLRVCEDCHNVIKYISKIVGRLIILRDSHRFHYVSEGICSCGDYW

SEQ ID NO: 48722 - protein, 766 aa, Medicago truncatula
MHGGIMLRIYNNLRVRRVCTINFGHTSTSTRRSESVTNNNKPRVKDPDILKWNKAISTHMRNGHCDSALHVFNTMPRRSSVSYNAMISGYLRNSKFNLARNLFDQMPERDLFSWNVMLTGYVRNCRLGDARRLFDLMPEKDVVSWNSLLSGYAQNGYVDEAREVFDNMPEKNSISWNGLLAAYVHNGRIEEACLLFESKSDWDLISWNCLMGGFVRKKKLGDARWLFDKMPVRDAISWNTMISGYAQGGGLSQARRLFDESPTRDVFTWTAMVSGYVQNGMLDEAKTFFDEMPEKNEVSYNAMIAGYVQTKKMDIARELFESMPCRNISSWNTMITGYGQIGDIAQARKFFDMMPQRDCVSWAAIIAGYAQSGHYEEALNMFVEIKQDGESLNRATFGCALSTCADIAALELGKQIHGQAVKMGYGTGCFVGNALLAMYFKCGSIDEANDTFEGIEEKDVVSWNTMLAGYARHGFGRQALTVFESMKTAGVKPDEITMVGVLSACSHTGLLDRGTEYFYSMTKDYGVIPTSKHYTCMIDLLGRAGRLEEAQDLIRNMPFQPGAASWGALLGASRIHGNTELGEKAAEMVFKMEPQNSGMYVLLSNLYAASGRWVDADKMRSKMRDIGVQKVPGYSWVEVQNKIHTFSVGDCSHPEKERIYAYLEELDLKMREEGYVSLTKLVLHDVEEEEKEHMLKYHSEKLAVAFGILTIPGGRPIRVMKNLRVCEDCHSAIKHISKIVGRLIILRDSHRFHHFNEGFCSCGDYW

SEQ ID NO: 48723 - protein, 336 aa, Zea mays
  misc_feature (150)..(150): Xaa can be any naturally occurring amino acid
MGECEDGKEYRCWEELLPDALGLIFRNLPLQEVLTVLPRVCKSWGRVVAGPYCWQEIDIEEWSQQQSKPEQIGRMVELLVGRSGGSCRRISVSGLPCDPLFSFIADNARALGTLEIPRSEISDSVVEAVAPRLSNVTFLDISSCTKIGAXRALEAFGRHCRSLVGLRRVMHPIDLADKVCQHDEAHAIARSMPRLRHLEMGYMLVATEAVLEILGQCRELKFLDLRGCWAVDDRFLRERHPGLRVLGPRVVDDCYENSYWEECSDYYSDEDEDYDDDVVSWGLFVDDDDDYYYAVGSDDDEAIWDDAQGLENLEVRFYGGGGFGESFAGFDWPPSP

SEQ ID NO: 48724 - protein, 97 aa, Brassica napus
MVKSCRSLLLILLLISVSLSTERVLPGEFLPVIVSGEITPDTKAVVGCGGEAVEIKTEYSFMPEVFAGKFGSLVLNALPKGGRPASGPSKKSHDVKT

SEQ ID NO: 48725 - protein, 924 aa, Mycobacterium sp. MCS
MRQDLAQNSSTAAEHDRVRVIREGVASYLPDIDPDETSEWLESFDQLLERSGPARARYLLLRLLERSGEQRVAIPALTSTDYVNTIPTELEPWFPGDEDVERRYRAWIRWNAAIMVHRAQRPGVGVGGHISTYASSAALYEVGFNHFFRGKSHSGGGDQVFIQGHASPGIYARAYLEGRLTADQLDGFRQEHSHPGGGIPSYPHPRLMPDFWEFPTVSMGLGPMNAIYQARFNHYLHDRGIKDTTDQHVWAFLGDGEMDEPESRGLIHVAALEALDNLTFVVNCNLQRLDGPVRGNGKIIQELESFFRGAGWNVIKVVWGREWDALLHADRDGALVNLMNTTPDGDYQTYKANDGGYVRDHFFGRDPRTKALVEPMTDAEIWNLKRGGHDYRKVYAAYRAAMEHKGQPTVILAKTIKGYTLGKHFEGRNATHQMKKLALQDLKDFRDAQRIPIGDAQLEENPYLPPYYHPGPEAPEIRYMLDRRRALGGFVPERRTKSKALALPSSDAYKALKKGSGKQEVATTMATVRTFKEILRDKQIGHRIVPIIPDEARTFGMDSWFPNLKIYNRNGQLYTSVDAELMLAYRESEVGQILHEGINEAGSVGTFIAAGTSYATHNEPMIPIYIFYSMFGFQRTGDSFWAAADQMARGFVLGATAGRTTLVGEGLQHADGHSLLLASTNPAVVAYDPAFAYEIAYIIESGLHRMYGENPENVYFYLTIYNEPYVQPAEPENLDVEGLLRGIYRYRAAAEKKSNTAQILVSGVAMPSALKAAEMLAEEWDVAADVWSVTSWNELNRDGVQVEKDLLRHPDRPAGTPYITTALADAAGPVVAVSDWMRAVPEQIRPWVPGTYITLGTDGFGFSDTRPAARRFYNTDAESITVAVLEGLARDGNIDISVAVEAARRYEIDDVLAAPEQTSDPGVA

SEQ ID NO: 48726 - protein, 490 aa, Arabidopsis thaliana
MMMMIILLWSIIFMTILFLKKQLSGKKGKTPPSPPGLPLIGNLHQLGRHTHRSLCDLSRRYGPLMLLHLGRVPVLIVSSADMAQEILKTHDQAFANRPRSKLSQKLLYNNRDVASAPYGEYWRQMKSVCVIHLLSNKMVRSFRDVREEEITLMMAKIRKSSSLPFNVSKVLECLTNDVICRVALGRKYGGETDFKKLTDRLSELLGTFSIGSFVPWLAWVDWIRGWDAQLDKMGKDLDDFFEKVVQDHEDGDRRDGTDLIDALLRVKREKSPGFEIERVSIKAITLDVFVGGSDTSFTLLEWAMTELLRHPKSLNRLQEEVRTICKGKSRVSEDDIQGMKYLKAVIKEALRLHPPFPMMAPHESTEDVKLRDYHIPAGTQVMMNAWAIGREVATWGPDAEEFKPERHLDTSVDFRGQNFELLPFGAGRRICPAVSFAVVLNEVVLANLVHGFDWKLPEESKEDKTDVAESSGFSVHREFPLYAVASPYLT

SEQ ID NO: 48727 - protein, 133 aa, Glycine max
MAAASLRKGNARLPPEVNRALFVRNLPFNISSEEMYDIFGKYGAIRQIRLGNAKDTRGTAYVVYEDIYDAKNAVDHLSGFNVANRYLIVLYSQLNRMSKKTDIKKKEDEITRLQEKYGVGSKTPPPTTPDPAR

SEQ ID NO: 48728 - protein, 310 aa, Rhodococcus sp. RHA1
MALDPAVKNLIDTLNEQGLKSFEQMSIAEVRGVVESFSGLQAPKADVARVVDTVYPGPGGDQAVRLYIPESETPLPIVVYIHGGGWVAGSLDVTEQPCRALAADAKVIVAAVSYRLAPEHKFPAAPEDAFAALNWVVEHAADFGGDGTRVAVMGDSAGGNLAAVTALRARDTGAPALRAQVLIYPVIDGTARFPSREENAEGYLVTTAAIDWFWEQYLATPEDAENPYASPAKAADLAGLPSTLLLLNEYEVTRDEGVDYGRRLADQDVPVQVELYEGLVHAVYWMTGAIPRSAELHGAVVEFLGKQFAG

SEQ ID NO: 48729 - protein, 872 aa, Yarrowia lipolytica CLIB122
MSKHTEVFSSEKVSSMDKDDLVDTQVAEVTTSLLDFVALQLEIPPSENDGTYPLEVHFMAEKLEETTLEEAIKIVKTNFAYHDHDNNFRDEYRIEVRELLKVFDGKDDYEKADPDDVLMMRYWGTVFNWWSPYPEVRAVTDPYNDEDCTTETWRVWVLGTVWVAIAAFVNQFFSVRMPAISLGAGVIQLLLYPCGKALQYALPDWGFHFRGKRYSLNPGKWSQKEQLLTTIMVSCASGTPYITSNIIVQYLPQFYNQTWASSFGYQFVFMLVTQMLGFGLAGILKRVAVYPVKAMWPSLLPTLAVNKALLAPNRKENINGWLISRYTFFMIVFIGSFVYFWIPNYLMNFLQTFNWMTWIAPENADLAIVTGSVGGLGFNPIPTFDWNQATASLAPITLPLYVSSIGFAGTFFSGLVILALYYTNNSWTGYIPINSNRLFDNMGKKYNVSKILTNYRFDDKKYHDYSTPYYSAGNLMLYSAFFAVYPLSFVYTCLMDWRAMWDALKDTGKALRYVHRSSYHGREDPFSRYMKNYPEVPDWWFYVVMVIMFALSIVLVKAWPVDTPVWTLVFVLGLVFVFIIPFTVFAAYTASSLSLNVISELIIGYALPGRFMALNLIKALSVTIASQAQNYTTDQKLTHYAHLPPRSIFWLQLWATLVNGLVCLGVIQFQLNLDGICDADNKQKFTCPGETTFFTASVAWGVIGPKKMFDKYPVMKWMFLFGALAGVFFWFVQVILPQILVKYFPNKAQTIDYYRRKILYFNPIIFVVGCLGWAPYNLTYQVGGMYLAVLFNGYIKSRYLAWWRKYAYVMEAAIVTGIALAGIIIFFAVQYHPKDIDWWGNTVIYDGVDGSGIPPRLEIPEKGFFGPPSSEW

SEQ ID NO: 48730 - protein, 904 aa, Burkholderia vietnamiensis G4
MTDLSTGTPSILSLGQTKIDDDPLETAEWLDALDGVVRHAGAERAQYLFDRLAAHASSNGIATARLNVTPYANTIAVDQQPPYPGDFDIEEKLAAALRWNALAMVVRANRAYGELGGHIASYASAADLFEVGFNHFFRGANDANGGDLVYFQPHSAPGVYARAYLEGFLDEAHLEHYRQEITGAGLCSYPHPWLMPDFWQFPTGSMGIGPINSIYQARFMRYLQNRGLQRTEGRKVWGYFGDGEMDEPEAIGALSLAARERLDNLVFVINCNLQRLDGPVRSNGRIIDELEAQFTGAGWNVIKVLWGSDWDPLFARDRSGALLRAFAHTVDGQFQTFSANDGAYNRDRFFGQNAELAALAAHLSNDDIDRLRRGGHDVRKLHAAYDKASKHRGQPTVILAKTMKGFGMGSIGQGRMTTHQQKKLDIEQLKAFRDRFRLPLSDDDVEQLKFYKPDENSAVMQYLHARRAALGGYLPRRRTAASHAPAVPAMSSWGRFALDTNDKEMSTTMAFVRMLGNLLKDAELGPRVVPVVADEARTFGMANLFRQIGIYSPLGQLYEPEDMGSMLYYREDTGGQILEEGISEAGAVSSWIAAATSYSVHDLTMLPFYIYYSMFGFQRIGDLIWAAADQRARGFLIGATAGKTTLGGEGLQHQDGTSHLAASTIPNCRAYDPAFAYEVAMIVDEGMQEMIARQRDVFYYMTVTNENYAQRSLTEADLDRVRSGVLKGMYVLEPAQIEIAQVQLLGSGAILGEVQAAARMLKDDWNIDAAVWSVTSFTELHRDGVSAERAQRLLARGEPAAPYVTAALGAARGPVIAATDYVRAVPELIRAYVPSRYVVLGTDGFGRSDTRAALRAFFEVDRASIVIAALKALVDEGRQDPDVVRQAIDRYGRSGTGLTKPWLV

SEQ ID NO: 48731 - protein, 325 aa, Pseudomonas fluorescens Pf-5
MSTPLTTDQLLHAYRVMRTIRAFEERLHVEFATGEIPGFVHLYAGEEASAAGVMAHLRDDDCIASNHRGHGHCIAKGVDVYGMMAEIYGKKTGVCQGKGGSMHIADFEKGMLGANGIVGAGAPLVVGAALAARLQGTDGVSVVFFGDGGSNEGAVFEAMNMASVWNLPCLFIAENNGYAEATASNWSVACDHIADRAAGFGMPGVTVDGFDFFAVHEAAGAAVERARAGEGPSLIEVKLTRYYGHFEGDAQTYRAPDEVKHYREHNDCLMQFRERTTRSGLVQASQLDQIDADVEALIEDAVRKAKSDPKPSPADLLSDVYVAYP

SEQ ID NO: 48732 - protein, 313 aa, Synechococcus sp. WH 8103
WNTGRLEEGGNLAYKIQLKEGYFPVAPNDTAQDIRSEMLLLMGQLGIPTEKHHHEVAGAGQHELGMKFAELIQAADNVMTYKYVVRNVAKKYGKTATFMPKPVFNDNGSGMHVHQSLWKGGQPLFFGEGTYANLSQTARWYIGGILKHAPAFLAFTNPTTNSYKRLVPGFEAPVNLVYSEGNRSAAVRIPLTGPSPKAKRLKFRSGDALANPYLAFSAMVMAGLDGIKNQIDPGDGENRDLFELPAEKLAKIATVPPSLNGALEALNADRGFLTAGGVFSDDFIDNWIDFKYEEVQQLRQRPHPHKFAMYYDA

SEQ ID NO: 48733 - protein, 531 aa, Oryza sativa
DLYSLASPNPQSDLSRRSAAMGRTEGRLASVVHLPGRSRVSASPSPRRRRSPSRSPSPRRNRRRDRSPSPYRSRRDRSPSPYRDRRRQWSPYHRDRGRDVEREWARDRDHPAPRRGGGGAGAGAWSASDDDDDEQLKGLTYFEYRRVKREKLRKSMKRCIWNITPSPPRREGEDEDYGYSDEEEEEEEKKESPKKVASSDKSEEEDSKGSSESDSGESDSLSDSSKSDDTRRKKKGRKGSHRSSKRSRHRRRHHSSDTEGDDNSKAEEDSEGSYDSEDSMDRRKKKRSRRHKKSKRRGRSSRRKKRKSNDTASEGSSEEEAVAAASGSSPSPLRDSKKKSRSSRRKRSKQSDSEDQAPSDADLGVKEIDETNEPEIDPEAIKFKEMLEAQKKAALENEMPVGPMPLPRAEGHISYGGALRPGEGDAIAQYVQQGKRIPRRGEVGLSAEEIQKFEDLGYVMSGSRHQRMNAIRIRKENQVYSAEDKRALAMFNYEEKSKREHKVMADLQRLVQRTIGNDVGPSHDPFATADG

SEQ ID NO: 48734 - protein, 286 aa, Selenomonas ruminantium
MEIWFSQMDTENVKTSVRVDRQLFSRQSEYQRINVFESREFGRMIVLDGEIIFSEADEFIYNEMVVHVPMAVHPCVKNVLIIGGGDGGVAKVLTQYPEIEAIDVVEPDEMFIEVSREFFPETARGFDDDRVKITNMDGLRFLRRCRDKYDLIINDSTDPFGHTEGLFTREFYGNCYRALHDDGIMVYQHGSPFYDEDEAAFRAMHRKAYQSFPVSRVYQASIPTCPAGIWMFGFASKKYHPLKDFDAQRWNERQLETWYYTTHLHKGAFMLPKYVEDILSEEEMKK

SEQ ID NO: 48735 - protein, 645 aa, Saccharomyces cerevisiae
MVEKRSRQSSSSGSEFSVPPDVDNPPLSIPLKTLSDRYQLIEKLGAGSFGCVTLAKAQFPLSNILGKQHDIRGTLMDQPKNGHQNYITKTQGVVAIKTMMTKLHTLQDYTRVREIKFILAIPANDHLIQIFEVFIDSENYQLHIVMECMEQNLYQMMKHRRRRVFSIPSLKSILSQILAGLKHIHEHNFFHRDLKPENILITPSTQYFEKEYMNQIGYQDNYVIKLADFGLARHVENKNPYTAYVSTRWYRSPEILLRSGYYSKPLDIWAFGCVAVEVTVFRALFPGANEIDQIWKILEVLGTPIKRSDFVNTNHITAPPPGGFWDDASNLVHKLNLKLPYVEGSSLDHLLSSSQLSDLSEVVKKCLRWDPNERATAQELCEMPFFENTVASQVDARGNVTNTEQALIFAGINPVATNTKPIYFNSSTKLPAETESNDIDISNNDHDSHAMCSPTLNQEKLTLVEFLNEFVEEDNDDHSIPDVGTDSTISDSIDETELSKEIRNNLALCQLPDEEVLDHSLSNIRQLTNDIEIINKDEADNMEQLFFDLEIPEKDEFQRKQPFNEHADIDEDIVLPYVNNSNYTHTDRSHHRGDNVLGDASLGDSFNSMPDFTPRNFLIPTLKKSREKFEPHLSNSNQHFGNVTF

SEQ ID NO: 48736 - protein, 1022 aa, Medicago truncatula
MKNILKKLHIMSNNQSEDAQAERSNKSNDGSSSSPTTRNKLSNWLHSVSSNRKQSPGSPPSGERVEELSDSLTFGGGGGGLDMVVSDSTKRDSGSSSSRDPEVEEEYQIQLALELSAKEDPEAVQIEAVKQISLGSCHPDNTPAEVVAYRYWNYNALGYDDKISDGFYDLYGVLTDSTSTRMPSLIDLQGTPTANDVKWEAVLVNRVADSNLLKLEQKAMGFAVKSREDFEIVVDRNLVHKLAILVAEYMGGSVEDPESMSRAWRSLSYSLKATLGSMVLPLGSLTIGLARHRALLFKVLADSLGIPCRLVKGMQYTGSDDVAMNFVKIDEGREYIVDLMAAPGTLIPSDAAGSHIEYDDSSFVASPSSRDLDSSHITSFSSGVGSSSEETSDFRTFEKGNRYKHFADAGKESDVSSRPPTCKEELKKPLNEFKNIPNVEKIKARESVSRPNNYPYMHGRSPSWTEGISSPEAHRMKVKDVSQYMIDVTKENPKLAQKLHNVLLESGVVAPPNLFSEIYHEQLGSQNEANSPTEEDEYKHRSAQKEAKEDSDNLAPRFLPPLPPHIIHPKASPSNQLEHSKPVEGLGIGLSLDSREAAVQHTYSDAEATLVKYGKNVPVAAAAAAAAAVVASSMVVAVAKSSTDSSFEIPVAAAATATAAAVVATTAAVSKQYELGNRSDGDAEGSGNEPKGSGDGENNALGANSEGGEKSDRSVSNDSTKSDLALDDVAEYDIPWEEITMGERIGLGSYGEVYRGEWHGTEVAVKRFLLQDISGESLEEFKSEVQIMRRLRHPNVVLFMGAITRPPNLSIVTEFLPRGSLYRLIHRPNNQLDERRRLRMALDAARGMNYLHNSTPVIVHRDLKSPNLLVDKNWVVKVCDFGLSRMKYSTFLSSRSTAGTAEWMAPEVLRNELSDEKCDVFSYGVILWELFTMRQPWGGMNPMQVVGAVGFQHRRLDIPDDVDTAIANIIRQCWQTDPKLRPTFAEIMALLKPLQKPITGSQAHRASVHAHSSRSAEDPAAA

SEQ ID NO: 48737 - protein, 159 aa, Brassica napus
AEVNQSSYQSKEVNSDKPTRRRQKSEADFSSRTPELLLKKESRSSCGGFSAIAEKGLALRPKAASKTNLSADTGSFNPVPINLMDAPVGDSFSSVRKSFSASVLQEPFSNNNNKGSSSLWQSSKWSLKADLLQQAAMARSIFDGLPKPLTGRRNKKAMD

SEQ ID NO: 48738 - protein, 115 aa, Bacillus subtilis
MQKLIEDITKEQLRTDLPAFRPGDTLRVHVKVVEGNRERIQIFEGVVIKRRGGGISETFTVRKISYGVGVERTFPVHTPKIAKIEVVRYGKVRRAKLYYLRELRGKAARIKEIRR

SEQ ID NO: 48739 - protein, 118 aa, Guillardia theta
MKSNKNLIQLVESNHSNKTLPQLQVGDTVRLGVSITEGNKERIQATEGVIISKSNCGINLTITIRRVLQGIGIERVYLLHSPKLKSIEILRKSKIRRAKLYYLRTRSGKATRLQQRFN

SEQ ID NO: 48740 - protein, 606 aa, Mycobacterium sp. MCS
MSAAPTLKKALNQRQLRMIAIGGVIGAGLFVGSGVVIADTGPGSFLTYAMSGVLIIMVMRMLAEMAVANPSTGSFADYSRNALGNWAGFSVGWLYWYFWVIVVGFEAIAGAKIIQYWIDVPLWASSLVFMVLMTATNLFSVKSYGEFEFWFAGIKVAAIVAFIALGALFVVGLWPGKDADFSNLTAHGGFMPMGFGVITVGIVTVIFSMVGAEIATIAAAESADPERAVSKAANSVIVRILLFYVGSALLLVTILPWNDEGIAASPFVAAFTEMGIPYADHVMNAVVLTAVLSCLNSGMYTASRMLFVLAARREAPPSLVRVTRRGVPAQAILASSVVGFLCVIAAAVSPDTIFAFLLNSSGAIILFVYLLIAVSQIILRRRTPDSELRVKMWLFPVLSVLTAVGIVAILVQMFIDDALRSQLVLSLLSWGVVLLLYFANKHFLKRRPTKAGVTGTGKPHRVLVLANQTVNSTELLDELHRIGADQETHYFVVVPVSPIETGTAETHGPLDVEEATQKAASERLDLTLNALRGHDFTADGELGDRRPLRALADAVESFDPDQIVISTLPPEKSVWQRFDVVDRARAQHRVPVTHVVATGAEATATP

SEQ ID NO: 48741 - protein, 215 aa, Zea mays
MGSPGAGSSGGHECSFKILLIGDSGVGKSSLLVSFVAASHLDGDIAPTIGVDFKIKFLTVGGKKLKLTIWDTAGQERFRTITSSYYRGAQGIILVYDVTKRESFSNLADVWTKEIEANSTNKDCIKMLVGNKVDKDDERMVTEEEGLAFAEESGCLFLESSAKTRENVEKCFEELALKILEVPSLLEEGSSSVVKRNILKQKQESHAKNGSGCCQ

SEQ ID NO: 48742 - protein, 446 aa, Burkholderia vietnamiensis G4
MRVTRIEVPDIGDYKNIPVIEVLVGVGQRVEREQSLVVLESDKATMDVPSPAAGVIREMKVAVGETVSQGTLIALLDSDSDGERQDDAAPVPAAASAARDLACPSANVATGLVPALAPAPELKSASAPLHSAPAREGEPSRASHASPSVRKFARELGVDVARVPGSGPKGRITKDDITGFVKGVMSGQCAAPGAAAAPAGGGELNLLPWPKVDFAKFGPFEAKPLSRIKKISGANLHRNWVMIPHVTNNDEADITELEALRVQLNKEHEKAGVKFTMLAFVIKAVVAALKKFTTFNASLDGDNLVFKQYYHIGFAADTPNGLVVPVIRDADKKGLVDIAKEMAELSKAARDGKLKPDQMQGGCFSISSLGGIGGTHFTPIINAPEVAILGLSRGQMKPVWDGKQFVPRLTLPLSLAFDHRVIDGAEAARFNAYLGALLGDFRRIVL

SEQ ID NO: 48743 - protein, 590 aa, Burkholderia vietnamiensis G4
MSLIEVKVPDIGDFSGVDVIEVNIKPGDVIEKEQTLLTLESDKASMEVPSDIAGTVKEIKVKAGDKVSQGTVIALVEASTGAAAPAPAKAPDAPKPAAAAPAPAAAAPAPAPQAGSYGGSADIECDMLVLGAGPGGYSAAFRAADLGMKTVLVERYSTLGGVCLNVGCIPSKALLHTALVVEEAAALASHGITFGKPQVDLDKLRDFKGGVVKKLTTGLAGMAKARKVEVVTGIGAFLDPFHMEVQGDNGKKVVKFKQAIIAAGSQAVKLPFMPEDPRVVDSTGALELRQLPKRMLVIGGGIIGLEMATVYSTLGAEIDVVEMMDGLMMGADRDLVKVWEKFNAKRFGNVMLKTKTVGAQAKEDGIYVKFEGEKAPAEAQRYDLVLVAVGRSPNGKKIGADKAGVAVTERGFIDVDKQMRTNVPHIFAIGDIVGQPMLAHKAVHEGHVAAEAAHGEKAYFDALQIPSVAYTDPEVAWAGKTEDQCKAEGIKYGKAVFPWAASGRAIANGRDEGFTKLIFDEATHRVIGGGIVGLNAGDLISEVCLAVEMGADAEDIGKTIHPHPTLGESVGMAAELYEGVCTDLPPPRRA

SEQ ID NO: 48744 - protein, 337 aa, Pseudomonas fluorescens Pf-5
MARKISYQQAINEALAQEMRRDPSVFIMGEDVAGGAGAPGDNDAWGGVLGVTKGLYHQFPGRVLDTPLSEIGYVGAAVGAATRGVRPVCELMFVDFAGCCLDQILNQAAKFRYMFGGKAQTPLVIRTMVGAGLRAAAQHSQMLTSLWTHIPGLKVVCPSSPYDAKGLLIQAIRDNDPVIFCEHKLLYSLQGEVPEESYAIPFGEANFLRDGKDVTLVSYGRTVNTALDAARSLAGRGIDCEVIDLRTTSPLDEDSILESVEKTGRLVVIDEANPRCSMATDISALVAQKAFASLKAPIEMVTAPHTPVPFSDALEDLYIPDAAKIEKAVLTVIEWSR

SEQ ID NO: 48745 - protein, 261 aa, Glycine max
MAFFGRIGNLLRQTASRQVSSELRSSPSFFQAIRSMSYSTDEQSLREAFSKYGEVVDARIIMDRETGRSRGFGFITYTSVEEASSAIQALDGQDLHGRPIRVNYANERPRGYGGGGFGSYGAVGGGGYEGGSSYRGGYGGDNYSRNDGSGYGYGGGRYGSGGNYGDSGSGNNYSGGYAGNAGGVGNHESSTGFASNGYDGSVVDGGVGAGSGTSFADGYDGSAGSEFGSSGQLDSKASSKGDEDFGDYRDDNDADDFAKRA

SEQ ID NO: 48746 - protein, 367 aa, Pseudomonas fluorescens Pf-5
MSVSLKPVSSMRAAVWHGRHDIRVEDVPLPDAPPAGWVQIRVDWCGICGSDLHEYVAGPVFIPVDAPHPLTGIKGQCILGHEFCGEIVALGEGVQGFSVGQPVAADACQHCGTCYYCTHGLYNICENLAFTGLMNNGAFAELVNVPANLLYALPANFPAEAGALIEPLAVGMHAVKKAGSLLGQNVVVVGAGTIGLCTIMCAKAAGAAQVIALEMSGARKAKALEVGATHVLDPKECDALAEVKRLTGGLGADVSFECIGNKHTAKLAIDLIRKAGKCVLVGIFEEPSEFNFFELVATEKTVLGALAYNGEFADVIAFIADGRLDISPLVTGRIQLEEIVGQGFEELVNNKEHNVKIIVSPGQLRRS

SEQ ID NO: 48747 - protein, 567 aa, Burkholderia vietnamiensis G4
MRHAENPDIVGARERRGRGAARMKTTADHPYTTGLERDPANFIALSPLTFLERAASVWPERTAIVHGTIRRDWAETYRRCRLLAGALRGRGIGNGDTVAMIAANTPELFEAHFGVPLCGAVLNTINTRLDADTIAFILGHGDAKLLITDREFSSTVKKALARLGRAIQVIDIDDPQFGEGDLLGEKDYEALLQEAAHTEFSVAMPDDEWQAISLNYTSGTTGNPKGVVYHHRGAYLNAVSNALSWHLDEDTTYLWTLPMFHCNGWCFPWTMALVAGTSVFLRHTRAERILAAIRTEAVTHFCAASVVLNMINNAAPELKAGISHGVKVMTGGAPPPASVIAGMERMGWDVTHAYGLTESYGPVVQCVWRDSWNALDLDAKARLKARQGVRGPALEAVMVASPDTLEPVPKDGQTLGEVFLRGNNVMKGYLKNPDATVEAFSGGWFHTGDLAVWHPDGYLEIKDRSKDIIISGGENISSIEIEDILYSHPAVLEAAIVARPDDKWGETPCAFIALKADSAVTEADIIAFCRERLAHFKVPKTIVFSPLPKTATGKIQKFHLRERARQL

SEQ ID NO: 48748 - protein, 302 aa, Emericella nidulans
MTRTHPSSFQQLEKLGEGTYATVYKGRNCQTGEMVALKEIHLDSEEGTPSTAIREISLMKELHHDNILSLYDVVHTENKLMLVFEYMDQDLKKYMDTHGNHGQLEPAIVKSFAFQLLRGIAFCHDNRILHRDLKPQNLLINSKGQLKLADFGLARAFGIPVNTFSNEVVTLWYRAPDVLLGSRTYNTTIDIWSIGCIIAEMFTGRALFPGTTNEDQLQKIFRVMGTPSERTWPGVSQFPEYKSDFPVYPPQDLRQVVPRIDPYGLDLLRCMLRLQPDLRISAVDALRHPWFNDVPGAQPVPV

SEQ ID NO: 48749 - protein, 421 aa, Triticum aestivum
MAAASFTAAKFLAPAAARSGGDRARPFPAPSASSMRPLRHRPARRLGSVLAVSSDVLKAAPAAAAYPAVTREEALELYEDMILGRNFEDMCAQMYYRGKMFGFVHLYNGQEAVSTGFIKQLNQPDCVVSTYRDHVHALSKGVPARAVMAELFGKATGCCRGQGGSMHMFSEPHNLLGGFAFIGEGIPVATGAAFAAKYRHEVLKQSSPDGLDVTLAFFGDGTCNNGQFFECLNMAQLWKLPIIFVVENNLWAIGMSHLRSTSDPEIWKKGPAFGMPGVHVDGMDVLKVREVAKEAIDRARRGEGPTLVECETYRFRGHSLADPDELRRPDEKSHYAARDPITSLKKYIIEQNLASEAELKNIEKKIDDVVEEAVEFADASPLPPRSQLLENVFADPKGFGIGPDGKYRCEDPKFTQGTAQV

SEQ ID NO: 48750 - protein, 516 aa, Novosphingobium aromaticivorans DSM 12444
MEAKQREGRARLVLVTGAARGIGLACAHRFARAGDRVVMADRDLAACTFEAERLGSRHVALQLDVSDEAAVEHAMDGLLQQFGAFDVVINNAGVVDRFARPLLDVPPEDIDRLIGVNLEGPYLVVRAALRTILAGRRGAAIVNVASGAALRALPGRAAYSMTKAGVIGMTRAMAIELGPQGIAVNAVLPGYIDTEILLALEREGKFDRAAAAGAIPMGRLGRTDEIAEAVHYLARGGYHCGSLLSVDGGVDAYGGSGKASTAVMPHRPVRAGDVACVTGGASGIGAVVADRLAGLGWLVAIIDSREIADGPHPAWQADIASEASVESAMAGIAGQLGPVTLLVNNAGIVEPMAKSADQALADFRRTIDVNVKGTIHASRAAARQMIGAGGGAIVNLSSITASLGLPGRNAYCASKSAVTMLTRSLACEWAAHGIRVNAVAPGYILTPAVQALLASGERDMNSVVRRIPVARLGQPDEVADAIAFLASDAASYVTGATLQVDGGYLASGHPPDGPMP

SEQ ID NO: 48751 - protein, 478 aa, Geobacillus kaustophilus HTA426
MPIAVQKQKLYINGEWREGKSYTELKSPYSRETIAEIPVATEQEVDEAIAAAYAARQTMAAMPAHERAAILERVGEQLKARQEEAARLIALEAAKPIITAKGEVARTIQTYKFAAEEAKRIHGETLPLDAAPGGEHRIALTVREPIGVIGAITPFNFPMNLVAHKLGPAIASGNTVVLKPASQTPLSAYFIAELFEKAGLPKGALNVVTGSGRTVGDKIVTDPRISMITFTGSPEVGIAIRNKAGLKRVTLELGSNSAVIVDEQVDLDRIIPRCVFGAFTFQGQVCISLQRIYVHENRYDEFVEKFVAAAKQLKTGDPLDPTTDVSALITPNDVDRALSWIEEAKQGGANVVLGGERDGNILLPTVIVDAEPTMKVSCQEVFAPIVLINRVRSIDEAIELVNDSRYGLQAGIYTDNVHTAWKAAKQLHVGGVLINDIPTFRVDHMPYGGVKESGFGREGVRYAIEEMTELKLIIFNES

SEQ ID NO: 48752 - protein, 226 aa, Zea mays
MVRKLALASLFFNASEGSQCLSSSASFSTAASWQWPSCTQARTRSFRGEIVSMRHVDTSSKREEQEGYKTSMNPAYVVHDCYSSSLSDYSAAPAEPAADEDEAIIHGLRSSTTRRLLFEPESTSSIVKKTKKEAAFSGATALAIESADPYGDFRRATALSVLSPGPRRRLRRSMEEMVLSHGADDWVWLEKMLGWYLRPNGEKTHGLIVGAFVDLLVALAAQPAPS

SEQ ID NO: 48753 - protein, 435 aa, Thermoplasma volcanium GSS1
MSGKADPLEIAKEQVAPVKEEIEEDPFEIALKQLNKAAKVLNLDEQALEILSSPQKILQVSIPVKMDDGKVRVFTGFRVRHNIARGPAKGGIRYHPQETLSTVKALSMWMTWKCAIADIPYGGAKGGIICDPSTLSQGELERLSRGYIRAIADFIGPEVDVPAPDVNTNPQIMAWMMDEYENIVRHSAANVITGKPLEVGGSLGRFDSTGKGGMFVLREGAKKIGLDLSKARVAVQGFGNVGQFAVKFVQEMFGAKVVAVSDIKGGIYSENGFKFDDLLAWSKKIGSVVGFPGSKPITNEELLESDVDVLIPAAIEEQITEKNADKIKAKIILELANGPTTPEADEILYKKGKLVLPDVLSNSGGVIVSYFEWVQNNYGEYWTTEEVYDKLDQKITKAARQVLDTMDKYHVDPRTAAYVIAVKKVADAMKVRGWY

SEQ ID NO: 48754 - protein, 416 aa, Thermoplasma volcanium GSS1
MPESIDPFEMALQQLDKAARVLNLDEQALEILRQPEKILQVSIPVRMDNGKIKVFTGFRVRYNTARGPGKGGIRYHPDETLSTVKALASWMTWKCAIADIPYGGAKGGIICDPKSMSQGELERLSRGYIRAIADFIGPEVDVPAPDVYTNPQIMAWMMDEYENIVRHSAPNVITGKPLEIGGSEGRGDATAKGGMYVLREGAKRVGLDLSKATVAVQGFGNAGQFAVKFVQEMFGAKVVAVSDTKGGIFKSDGINYEALLDHKRKTGSVVGFPGSKPITNEELLESDVDVLIPAAIEEQITEKNADKIKAKIILELANGPTTPEADEILYKKGRLDLPDFLSNSGGVTVSYFEWVQNNYGEYWTAEEVYEKLDKKMTKAAHEVFDAMDKYKINPRTAAYVISVKKVADAMKARGMY

SEQ ID NO: 48755 - protein, 382 aa, Robiginitalea biformata HTCC2501
MKLPFESKLPGLEPSIFGVMNRISLDAGALNLAQGFPDFGADPELIRLHSEALEEGYNQYAPMSGIYSLREAIAEKTETLYGASYHPETEVTVTAGATQALYTAIAATIRPGDEVIVFKPAYDHYEPSVKAHGGVPVLLQLQGPDFRIDWVAFDAALTASTRMVIINTPHNPSGTVLSREDMEMLETRLRGTNILVLSDEVYEHLVFDGQEHQSVARFPGLRERAFVCASFGKTFHITGWKTGYCLAPELLMQEFRKIHEFAIFCVSHPAQRALKTYLENPDHYLELNDFMQRKRDLFLEAVASSRFTFTPAAGTYFQLLGYQDISEAPDTEFAETLARDKGLAGIPISVFNRNRQDNRQLRFCFAKKDETLKRAGEILSQV

SEQ ID NO: 48756 - protein, 610 aa, Aspergillus nidulans FGSC A4
MPIIFPPLAVLPQLTLHPSVNADHLDVAKIVNDWLFSFTEKLSSGQQSNISSLFLEKESWFRDFVSFSWDFASHNGAAAICEYLAGSTSGFAEPKADQPGALRPQLVEIGGLQFVQAGFSFRNTFGTGRGVLRLANVEPEEWKAWTVFTVLERLNGQDELEATRAEKAEAQAGASGYGTEPSSVQSDDGGLQVLVVGAGQCGLALAAHLQNLGLNYLVVDKFSRPGDSWRARYDTVRLHTPIYTDHYPFLKYPASWPRYLDRAHVTKWMEHYEEIMGLNVRHSTLASNFRYNETSRVWTVDLQSKDCIQTVHAKHVVLATGLLGAIPNRPTFPGEASFKGQILHTSAHKSAALMPEALKKKITIIGSGTSAHDIAQDFVNHGAENVTMVQRGAMYVVSRDSMERIQLPLWNTPGVSLEDADLLSHSLPIAVARTLSVGESQMMSAKDKDMLDALEKAGMAVKRGDGDSLLDYQLIKGGHFYADQGACQMIIDGRIKVRQCEQGVQGYYEDGVILANGTKIESEVVILATGFELSTKLIERLMGEDVMNKVARICTLHNSQERIGVWKPTGVPGFWYMTGSFIWSRQFSGILALQIAAIERGMNTEYYESR

SEQ ID NO: 48757 - protein, 563 aa, Arabidopsis thaliana
MGKPARWLKSVLLGKKPSKSSGSKDKERIVNGKEVVVISKIEESDVVSDLSSIGNAAVYTSGIVETQNLKHEDVSDDEIQVSEVQPTDSQDVASVPDDSLSESEKIQQEIAAVTVQAAYRGYLARRAFKILKGIIRLQALIRGHMVRRQAVSTLCCVMGIVRLQALARGREIRHSDIGVEVQRKCHLHHQPLENKANSVVDTHSYLGINKLTGNAFAQKLLASSPNVLPLSLDNDSSNSIWLENWSASCFWKPVPQPKKASLRKSQKKFASNPQIVEAEFARPKKSVRKVPSSNLDNSSVAQTSSELEKPKRSFRKVSTSQSVEPLPSMDNPQVDLEKVKRGLRKVHNPVVENSIQPQLVPQIAVEKPNGSLEESVNAFDEEKEDEVAETVVQQPEELIQTHTPLGTNESLDSTLVNQIEESEENVMAEEKEDVKEERTPKQNHKENSAGKENQKSGKKASSVTATQTAEFQESGNGNQTSSPGIPSYMQATKSAKAKLRLQGSSSPRQLGTTEKASRRYSLPSSGNSAKITSHSPKTRVSNSSGKSGNKTEKTLLSSREGNG

SEQ ID NO: 48758 - protein, 1478 aa, Saccharomyces cerevisiae
MPFLRKIAGTAHTHSRSDSNSSVKFGHQPTSSVASTKSSSKSPRATSRKSIYDDIRSQFPNLTPNSTSSQFYESTPVIEQSFNWTTDDHISAGTLENPTSFTNSSYKNDNGPSSLSDSRKSSGGNSVNSLSFDKLILSWDPTDPDEWTMHRVTSWFKFHDFPESWILFFKKHQLFGHRFIKLLAYDNFAVYEKYLPQTKTASYTRFQQLLKKTMTKNVTNSHIRQKSASKLKSSRSSSESIKSKLKNSKSQEDISNSRSTSESALSPTKSGPSKTDEKNFLHSTSTHQKTKSASSLYRRSFISLRGSSSSNASSAKSPSNIKLSIPARPHSIIESNSTLTKSASPPASPSYPSIFRRHHKSSSSESSLLNSLFGSGIGEEAPTKPNPQGHSLSSENLAKGKSKHYETNVSSPLKQSSLPTSDDKGNLWNKFKRKSQIGVPSPNTVAYVTSQETPSLKSNSSTATLTVQTADVNIPSPSSSPPPIPKTANRSLEVISTEDTPKISSTTASFKETYPDCINPDKTVPVPVNNQKYSVKNFLLDQKFYPLKKTGLNDSENKYILVTKDNVSFVPLNLKSVAKLSSFKESALTKLGINHKNVTFHMTDFDCDIGAAIPDDTLEFLKKSLFLNTSGKIYIKDQMKLQQKPKPAPLTSENNVPLKSVKSKSSMRSGTSSLIASTDDVSIVTSSSDITSFDEHASGSGRRYPQTPSYYYDRVSNTNPTEELNYWNIKEVLSHEENAPKMVFKTSPKLELNLPDKGSKLNIPTPITENESKSSFQVLRKDEGTEIDFNHRRESPYTKPELAPKREAPKPPANTSPQRTLSTSKQNKPIRLVRASTKISRSKRSKPLPPQLLSSPIEASSSSPDSLTSSYTPASTHVLIPQPYKGANDVMRRLKTDQDSTSTSPSLKMKQKVNRSNSTVSTSNSIFYSPSPLLKRGNSKRVVSSTSAADIFEENDITFADAPPMFDSDDSDDDSSSSDDIIWSKKKTAPETNNENKKDEKSDNSSTHSDEIFYDSQTQDKMERKMTFRPSPEVVYQNLEKFFPRANLDKPITEGIASPTSPKSLDSLLSPKNVASSRTEPSTPSRPVPPDSSYEFIQDGLNGKNKPLNQAKTPKRTKTIRTIAHEASLARKNSVKLKRQNTKMWGTRMVEVTENHMVSINKAKNSKGEYKEFAWMKGEMIGKGSFGAVYLCLNVTTGEMMAVKQVEVPKYSSQNEAILSTVEALRSEVSTLKDLDHLNIVQYLGFENKNNIYSLFLEYVAGGSVGSLIRMYGRFDEPLIKHLTTQVLKGLAYLHSKGILHRDMKADNLLLDQDGICKISDFGISRKSKDIYSNSDMTMRGTVFWMAPEMVDTKQGYSAKVDIWSLGCIVLEMFAGKRPWSNLEVVAAMFKIGKSKSAPPIPEDTLPLISQIGRNFLDACFEINPEKRPTANELLSHPFSEVNETFNFKSTRLAKFIKSNDKLNSSKLRITSQENKTE

SEQ ID NO: 48759 - protein, 448 aa, Thermoplasma volcanium GSS1
MIMENEERTEKYNEDALRYSEYYKGKIQTMSKVPVRSLDDFSIWYTPGVAAVSRKIATDHDLSFELTGRWNTIAILTDGTRVLGLGNIGPEAAMPVMEGKALIFNYLGGVNAIPVPIRVSSREEFVSVAKSLEPSFGGINLEDIESPKCFFLLETLQKEMNIPVWHDDQLGTASITLAGIINSIRIVGKKIEEVKVVFNGAGAANIAAAYLFKAAGFKKENIILVDSKGVLQPERQDMDSLMLNNPWKYQLAIETNGERVKGDLKEALKGADILISAAKSGPDTVDAKLVKEMNNDPIVFVLANPIPEMWPEEAKENGAKIVATGRSDFPNQINNSLVFPGVFRGVLDARAKGVNFDVMVAASYEIANFVEEPTAEKIVPTMEEWELYPRLASAVATKTVELGLARKIDSKEGFYKRARDIIENNRNIYRKMMDLGLIRMMPNGERKY

SEQ ID NO: 48760 - protein, 439 aa, Zea mays
RSLSFSPPAVRPFQLAKHSRAAAMAGAGAPAVPQAGRPAPNFDVIVVGAGIMGSCTAHAAASRGARVLLLERFDLLHPLGSSHGDSRIIRDAYAQPRYLRMVRLARCLWAAAEAEAGYRVLTPTPHLSMGPRSSASLAAAIANIGAEEVDVDDLHRRWGGAFALTVPGPVDAWVTALSDHGGVLSATKAVAMFQSLAVAKGAVVRDNTEVVGIDRAPEPDGGGVVVRAAGGEAFRGARCVVTVGAWAAKLLGSWGVDLPIRPLHTLHLYWRVKPGQEQTVSASAGFPTFSSYGDPPVYGAPSLELPGLIKISCDGGPPCDPDARDWLAGDAEVTHRVARWIQEAMPDHVDAAGGPVVRQSCICSMTPDADFVMDFLGGGRDVVVGAGFSGHGFKMGPAVGKILAEMAIDGGSETAAEAGLDLGFFRIGRFDGNPMGNAK

SEQ ID NO: 48761 - protein, 776 aa, Schizosaccharomyces pombe
MIGSINESPIEEHMNDSPSTKEKADSVDISDYIVSHSDDSLSKDIKKDTKSFLDVEHGEISTVDEFEEDSPYPEVRAAVPPTDDPSMPCNTIRMWTIGLIYSTVGAAVNMFFSLRNPTVTLSVLISELLAYPALQIWDLIFPDREFRIGRLKFNFKPGPFNVKEHALIVVMSSVSFGNAYSTDIILAQRVHYKQRFGFGYEICLTLATQLIGYGLAGLSRRLLVRPASMLWPVNLVQCTLIKTLHRKDLRNAVANGWRISPFRFFLYVFIASFIWNWFPSYIFQALSLFAWVTWIRPNSPTVNQIFGESTGISILPMTFDWNQISAYILSPLMAPADALMNILLGVILFFWIVTPALNFTNTWYGDYLPISSSGIIDHFGNSYNVTRILTKDATFDLDAYQNYSPIFMSTTYALAFGLSFASITSVIFHVILYHGKEIYDRLRDPPAPDIHEKLMKAYDEVPFYWYLSVFLAFFGMMMGTIYGWKTETPWWVIIVGVIFSAVWFIPIGIVQAITNIQLGLNVFTEFIVGYMYPGRPLAMMIFKTVGYITMTQGLAFAADLKFGHYMKLPPRIMFYTQMIATIWSCFVQIGVLDWALGNIDNVCQADQPDNYTCPNATVFFNSSVIWGVIGPKRMFSGKNTYTGLQYFWLAGVLGTILFWALWKKWPQKWWGQLNGPLIFGGTGYIPPATPVNYLAWSGIGLFFNYYLKKIFADWWQKYNFTLSALDTGTQLSVIILFFCLQLPMVNFPDWWGNDGAFNTLDATGAAVRKLVNESAR

SEQ ID NO: 48762 - protein, 543 aa, Schizosaccharomyces pombe
MPAMKRKKLDMESSRWFPKGETCFQRWYRSFLPPEDGKPQKLKRTLTARHIQMIGIGGAIGTGVWVGSKNTLREGGAASVLICYSLVGSMVLMTVYSLGELAVAFPINGSFHTYGTRFIHPSWGFTLGWNYLASFLATYPLELITASICLQFWININSGIWITVFIALLCFVNMFGVRGYGEVEFFVSSLKVMAMVGFIICGIVIDCGGVRTDHRGYIGATIFRKNAFIHGFHGFCSVFSTAAFSYAGTEYIGIAASETKNPAKAFPKAVKQVFIRVSLFYILALFVVSLLISGRDERLTTLSATAASPFILALMDAKIRGLPHVLNAVILISVLTAANGITYTGSRTLHSMAEQGHAPKWFKYVDREGRPLLAMAFVLCFGALGYICESAQSDTVFDWLLSISNLATLFVWLSINVSYIIYRLAFKKQGKSYDEVGYHSPFGIYGACYGAFIIILVFITEFYVSIFPIGASPDAGAFFQSYLCFPVVVIVFIAHALITRQKFRKLSEIDLDTGFSKYDRLEESDKGPMTAKSLAKSVLSFCV

SEQ ID NO: 48763 - protein, 362 aa, Mycobacterium sp. MCS
MSQTVRGVISRSKQQPVEVVDIVVPDPGPGEVVVDIIACGVCHTDLTYREGGINDEYPFLLGHEAAGTVESVGEGVTNVVPGDFVILNWRAVCGQCRACKRGRPHLCFDTHNAAQKMTLTDGTELTPALGIGAFADKTLVHEGQCTKVDPAADPAVAGLLGCGVMAGIGAAINTGAVGRDDTVAVIGCGGVGDAAIAGAALVGAKKIIAVDTDDKKLQWAREFGATDTINARSVDDVVEAIQELTDGFGTDVVIDAVGRPETWKQAFYARDLAGTVVLVGVPTPDMRLEMPLVDFFSRGGSLKSSWYGDCLPERDFPTLISLYLQGRLPLDKFVSERIGLDGIEDAFHKMHAGEVLRSVVVL

SEQ ID NO: 48764 - protein, 233 aa, Triticum aestivum
  misc_feature (192)..(192): Xaa can be any naturally occurring amino acid
  misc_feature (205)..(205): Xaa can be any naturally occurring amino acid
KKTFSTRSPPSLSLSSPPSLCSFLPSKRQSRTPGSSNQAMSLAPSIPSIKVKVGRIAPPPPYRACKSFAVIRSSKAEGPRRPTAPPLSPPPPMPPKTPALSTPPSLSQPPTPVKPAQPSPPPPETKPAVAAAATPPVGGVVTFEYQRKVAKELQEYFKKKKLEETNQGPFFGWLAKNEIANGRWAMFGFAVXDANRVRNRLGFRXANEDPSLQFWDCGFGLMAHVWRCCSVFL

SEQ ID NO: 48765 - protein, 495 aa, Catharanthus roseus
FFIFLFFVFLLINGRRKSTRTKTINLPPGPWKLPILGNLHNMMMGSVPHRLLRDLAKKHGDLMLLKLGEFNAIVVSSPRMAKEVLKTHDLSFLNRPIIQAPKILCYDNSDLVFSQYGDSWREMRKIFVLELLSTKRVRSFQPIRQDEGSRLVSLIKESVGKSIDLSEKINSYTTSMVARAAFGKVNDAGVTFLKLVKEASEVAGGFDPADIFPSYKFLNVFFNSRSKLLKIHGKTDMILEEMIDEHIKNHEMGKKANGENGKEDVIDILLSIKDSGELQFPFQMNNVKALIFDMFAAGTETSSSTVEWAMSELIRNPDVMAKAQNEVRQVLKGKQIVDESVLQELEYLKLIVKEVLRLHPSSPLLIPRECGEDCQIDGYDIPVKTRVFVNIWAIARDDKYWKDPESFIPERFENTCFDFTGNNFEYLPFGSGRRMCPGMTFGLANVDLVLALLLYHFNWKLPPGVNDIDMTERVGLGATKKHSLVLIPTLYDPSF

SEQ ID NO: 48766 - protein, 215 aa, Geobacillus kaustophilus HTA426
MRRERMKTMGSIWPVLLFGLLLGMKHATEPDHVIAVSTIASRTKKLSLSSLAGMFWGIGHTLTLLVVGMAMIAFERQIPEQIASYLEMGVGIMIVILGIASFRSTMRLDHRHQGDIHDLHVKSTLIGIVHGLAGSAGMVLLTMTTVKGTWMALAFILIFGLGTVIGMMLFTTFLGIPFVWMKAKQQVMNQWIVKTVSLISIAYGVYYMYHIAAEI

SEQ ID NO: 48767 - protein, 430 aa, Catharanthus roseus
KLGGFNTIVASSPRMAKEVLKTHDLSFLNRPIIQATKILCYDNSALVFSQYGDSWRQMRKIFVLELLSTKRVRSFQPIRQDEGSRLVSLIKESVGKSIDLSEKIKLYTTSMVARAAFGKVNDAGVTFLKLVTEAAEVAEGFDPADMFPSYKFLNVFFNSRSNLLKIHGKTDMILEEMIDEHIKSHQMGKKANGENGEEDVIDILLSIKDSGDLGISHWMNNVKALIFDMFSAGTETSSATVEWAMTELMKNPSVMRKAQDEVRQAFKGKKTIDESDLEELKYLKLVVKEVLRLHPFAPLLVPRECREACQIDGYDIPVKTRVFVNVWAIGRDEKYWKDPESFIPERFEDNSLDFTGNNFEYLPFGCGRRICPGMTFGLANVHLVLALLLYHFNWKLPPGVNDIDMAERPGLGASKKHGLVLVPSFYQPSF

SEQ ID NO: 48768 - protein, 204 aa, Geobacillus kaustophilus HTA426
MEPVRIGIGGPVGAGKTMLVEKLTRAMHRRFSIAVITNDIYTKEDAQFLIKHSVLPEDRIIGVETGGCPHTAIREDASMNFAAIDELKRRHPDVELILIESGGDNLAATFSPELVDFSIYVIDVAQGEKIPRKGGQGMIKSDLLVINKIDLAPYVGASLEVMERDAKAARGAKPVIFTNLKEEIGLFDVVDWIEKQVLLAGLEE

SEQ ID NO: 48769 - protein, 368 aa, Ostreococcus tauri
MDDGTLPRIVVERLRDGTSGFELYTTRVAHESASSDGSTTKLIVELQDGHKIEACVMRHAKGRTTLCVSSQVGCKMGCTFCATGTLGELGNLASFEILEQLAHANRVAAPLNNYDSVIEAIGVMTDDKAFALSASKITVSTVGVIPRMRTLTRDAPGTCLALSLHAPTQELRQKIVPTATAYKLDDLMRVLEEYLASGPKMKTMIEYCVLGGVNDDETCAEKLGELFRGKEEKIILNLIPLNPTDTPAGHVPPTPEAVRKMMEILMKKYGLFVTRRHTMGDDIAGACGQLALKTPGDPDMEDMMAPRRTTSAAKVRRAPPREERTSPTLVEASQPSSSSRAQRTEYALIGVSVLSAGMLAYALYSRRR

SEQ ID NO: 48770 - protein, 647 aa, Arabidopsis thaliana
MAFWLSLIFFCFCTFASSTPPDDPVKCESGNNMCTVTNSYGAFPDRSICEAAKVEYPKTEAELVSIVAAATRAGQKVRVVTRYVHSIPKLVCTDGKDGVLISTKFLNNVVGTNPEAKTLTVESGVTLRQLIGEAAELELALPHAPYWWGLTVGGLMGTGAHGSSLWGKGSAVHDYVSEIRMVSPGLASDGYVKVRVLSETIDPDEFRAAKVSLGVLGVISQVTFQLQPMFKRSLTFVMQNDSDFGDQAVTFGEKHEFADFLWLPSQGKVVYRMDDRVPVNTSGNGLFDFFPFRPQLSVALAIIRSLEESEESSGDANDKCARAEQITSFLFSISYGVTNNGMEFTGYPVIGKQNHMMSSGTCLDSHQDGLITSCPWDPRIKGQFFHQTAFSIPLTRVKGFINDIKALVKIEPKSLCALERSNGILIRYVTSSPAFLGKEEKALDFDLTYYRSKDDPLAPRLYEDFIEEIEQMAIFKYNALPHWGKNRNLAFDGVIRKYKNANTFLKVKERFDPLGLFSTEWTNQILGLKGNVTIVKEGCALEGLCVCSDDAHCAPKKGYLCRPAGGGGSSGAAAGLDDFHFPPDIPSMQERKDEAMRVLKADLMTELDKEVKSLEEDSWMFEGPRSRIHLISRRGNFLKKGGEVKLW

SEQ ID NO: 48771 - protein, 490 aa, Oryza sativa (japonica cultivar-group)
MAPPPVNSGDAAAAATGEKSKLSPSGLPIREIPGGYGVPFFSPLRDRLDYFYFQGAEEYFRSRVARHGGATVLRVNMPPGPFISGNPRVVALLDARSFRVLLDDSMVDKADTLDGTYMPSRALFGGHRPLAFLDAADPRHAKIKRVVMSLAAARMHHVAPAFRAAFAAMFDAFNKLNMRYMLDFTCAALFGGEPPSKVVGDGAVTKAMAWLAFQLHPIASKVVKPWPLEELLLHTFSLPPFLVRRGYADLKAYFADAAAAVSTTPRRATRGIPRDELLDNLVFVAIFNAFGGFKIFLPHIVKWLARAGPELHAKLATEVRATVPTGEDDGITLAAVERMPLVKSVVWEALRMNPPVEFQYGHARRDMVVESHDAAYEVRKGEMLFGYQPLATRDEKVFDRAGEFVADRFVAGGAAGDRPLLEHVVWSNGPETRAPSEGNKQCPGKDMVVAVGRLMVAELFRRYDTFAADVVEAPVEPVVTFTSLTRASSG

SEQ ID NO: 48772 - protein, 511 aa, Oryza sativa (japonica cultivar-group)
MAPPRANSGDGNDGAVGGQSKLSPSGLLIREIPGGYGVPFLSPLRDRLDYYYFQGADEFFRSRVARHGGATVLRVNMPPGPFLAGDPRVVALLDARSFRVLLDDSMVDKADTLDGTFMPSLALFGGHRPLAFLDAADPRHAKIKRVVMSLAAARMHHVAPAFRAAFAAMFDEVDAGLVAGGPVEFNKLNMRYMLDFTCAALFGGAPPSKAMGDAAVTKAVKWLIFQLHPLASKVVKPWPAGGPPPPHLPPAAVPWCAASTARSRRTSPPPPRPSSTTPRRTTRESRRDELLHNLVFVAVFNAYGGFKIFLPHIVKWLARAGPELHAKLASEVRAAAPAGGGEITISAVEKEMPLVKSVVWEALRMNPPVEFQYGRARRDMVVESHDAAYEVRKGELLFGYQPLATRDEKVFDRAGEFVPDRFVSGAGSAARPLLEHVVWSNGPETGTPSEGNKQCPGKDMVVAVGRLMVAGLFRRYDTFAADVEELPLEPVVTFTSLTRAADGDGAARRGV

SEQ ID NO: 48773 - protein, 158 aa, Synechococcus sp. PCC 7002
MTQTATDVLRLIQEENIQIIDLKFVDLPGIWQHCSFYQDQLDEASFVDGVPFDGSSIRGWKAINESDMAMVPDPTTAWIDPFCKEKTLSLICSIKEPRTGEWYSRDPRSIAQKAVDYLAASGIGDTAYFGPEAEFFVFDDVRFDQTENKGFYYVDSVE

SEQ ID NO: 48774 - protein, 118 aa, Saccharophagus degradans 2-40
MSSKNKIIQELEAEQLKQDVPEFSPGDTVVVQVKVKEGNRERLQAFEGVVIARRNRGLDSAFTVRKISHGIGVERTFQTHSKQVDSVAVKRRGDVRQAKLYYLRELTGRAARIKEKLG

SEQ ID NO: 48775 - protein, 456 aa, Magnetospirillum magnetotacticum MS-1
GPLPGVNWDVCRVDGHDPETIATAIAAAQKSGQPSLIACKTTIGYGAPTKAGSEKTHGAPLGAEEIAGARAKLNWPHAPFEIPADVLSAWRAAGSKGSEARATWEKRFAAYGNKAEFESTNAGILPAVWKQAVSDFKKKVSAEQPKWATRKASQEVLEALTPVIPAMIGGSADLTHSNLTITKATKPVTPRDFSGRYIHYGVREHGMAAIMNGLSLHGGFIPYGGTFLIFANYLWPALRMSAMMDQRVLYVLTHDSIGLGEDGPTHQPIETLSALRATPNVLVFRPADPVETMEAYEAALDNATGPSVFALSRQNLPTLRTTHTDENLTAKGAYVLAEAEGKKRQVTLIATGSEVSLAMEARKLLADKGIAACVVSMPCWELFERQPKEYRSKVLGEGTVRVAVEALGTFGWERWVGENGAVIGMNGFGASAPAEKLYEHFGITAEKVAEAAMVRL

SEQ ID NO: 48776 - protein, 295 aa, Staphylococcus aureus subsp. aureus MW2
MTHLFEGVGVALTTPFTNNKINIEALKTHVNFLLENNAQAIIVNGTTAESPTLTTDEKERILKTVIDLVDKRVPVIAGTGTNDTEKSIQASIQAKALGADAIMLITPYYNKTNQRGLVKHFEAIADAVKLPVVLYNVPSRTNMTIEPETVEILSQHPYIVALKDATNDFEYLEEVKKRIDTNSFALYSGNDDNVVEYYQRGGQGVISVIANVIPKEFQALYDAQQSGLDIQDQFKPIGTLLSALSVDINPIPIKALTSYLGFGNYELRLPLVSLEDTDTKVLREAYDTFKAGENE

SEQ ID NO: 48777 - protein, 116 aa, Brassica napus
  misc_feature (21)..(21): Xaa can be any naturally occurring amino acid
  misc_feature (78)..(78): Xaa can be any naturally occurring amino acid
  misc_feature (81)..(81): Xaa can be any naturally occurring amino acid
  misc_feature (108)..(108): Xaa can be any naturally occurring amino acid
  misc_feature (115)..(115): Xaa can be any naturally occurring amino acid
MASSMLSSAAVVTSPAQATMXAPFTGLKSSAAFPVTRKANNDITSIASNGGRVSCMKVWPPVGKKKFETLSYLPDLTXVEXGVKEVDYLLRNKWNFLCVEFELEHGFXVYREHGXH

SEQ ID NO: 48778 - protein, 476 aa, Sulfolobus tokodaii str. 7
MSSYEDLLKVLDSRKVTRLYWIITILAAIGGFLFGYDTAVIGTAAEFAPYHYSGFLLGYEIASASLGAAIGAIIAYFYTDRYGRKSLLILDAGIYTAAAVLSALTINGIMLLVMRTIIGIAIGADSAVATAYITEYAPKDKRGSLAIMQQWMITIGILGSYLVGSAILYFLPSLAYVFDWRLILGLAAVPALIGLIFRFMMPESPRWLIYTGQFDKLKRELAKFGISVSDDVLERTRTEIQSEMSIKLDTAAKKALLLVGLWLVFQQITGINVPFYYGPILLSKLHIFSSTTNPVYSAIDGVLESTILAVINVAATYIAFRYIDKIGRRTLGISAYIGMAIFDLIGGISTLFGFDIGLLISFAGFIIFFAYGVGGTGWLIQAEYFDTRIRGRMAAIGALIDWLANFALIEVFPVMLSTVGLGGSMFIFFILDLVALVFVYFFIPETKGMSLEDVVKMFSSVPISKIKNGREIVLSK

SEQ ID NO: 48779 - protein, 198 aa, Triticum aestivum
  misc_feature (17)..(17): Xaa can be any naturally occurring amino acid
  misc_feature (70)..(70): Xaa can be any naturally occurring amino acid
  misc_feature (168)..(168): Xaa can be any naturally occurring amino acid
  misc_feature (191)..(192): Xaa can be any naturally occurring amino acid
SNTDHQTLSLKLKHPTXSSHSSLSSSTKLDCSLPSTPALAMDMGMDLSGSSPSSSVSSSPEHASGRASPXKRPAGRTKFRETRHPVYRGVRRTGNAGRWVCEVRVPGKRGARLWLGTYLTAEAAARANDAAMLALGGRSARCLNFADSAWLLAVPSALSDLADVRRAXLQAVADFQRREAANGLIARTVAXXTPSSAH

SEQ ID NO: 48780 - protein, 229 aa, Novosphingobium aromaticivorans DSM 12444
MIPPFIDLSVHHKPGGLSDRIAFGFTKALRWCADTFFAERYGHRAVVLETVAAVPGMVGATINHLACLRRMCDDKGWIKTLMDEAENERMHLMTFIEISKPTLFERAVIMGVQWVFYLFFFGLYLVSPKTAHRVVGYFEEEAVISYTHYLAEIDQGRSANVPAPAIAKRYWGLPDNAMLRDVVLVVRADEAHHRDVNHGFANELAGLPVAEPAACPPHHALEPNWKKAA

SEQ ID NO: 48781 - protein, 196 aa, Triticum aestivum
  misc_feature (152)..(152): Xaa can be any naturally occurring amino acid
MGSGSFLKVLAKNFDVLAGPLVSLAYPLYASVRAIETKSQVDDQQWLTYWVLYSFITLFELTFAPILEWLPFWPYGKLFFNCWLVFPCFNGAAYVYEHFARPMFVNRQIVNIWYVPRKEKLSKSDDVLSAAENYIELNGPEAFEKLISTSTXTSTKPSKFRSTRRSILQEAEAEKMGKAERDSWGENPFYDKNYRH

SEQ ID NO: 48782 - protein, 726 aa, Ostreococcus tauri
MRANAPSVVLTNARGNAHVNPSPRHRSCRRAETRAHASSSSSKKDSADVVVIGGGLSGLAACRELGRRGDDYLLLESSDDIGGRVRTDVVDGYLLDRGFAIFLTSYPEARRVLDYDALDLKPFYAGADVRFDGAFHRVADPFRHPVDGLQSLPNPIGSVVDKVLVGLVRFQTVLALGSLEDMMSRDGETTIMKRLKDFGFSDAMIDRFFRPFMAGIFFNRELTTSSRLFNFVMRMLATGQNCLPAKGIGAVSAQLRDGLALDSVRLNAKVANVGERSADLSRTLTLESGESITARKAIIVACEGPEAARLLGKSLGKSPSKSESAVGTTCLYFAMEKAPTEDAILYLDGDNNGGIVNNCCFPSNVAPSYAPAGKSLASVSIIGVPEEDDETIESKVRQELSAWFGADSVSTWRLLRVYRIPYAQPNQEAPTDFCRTTSLGDGVFVAGDHRYSATFDGALLSGLRMLNHLTPVRASEDLTAQECASDAVILLNFDVPSNALGLWMRCGYRVCADGGANRVRDLQDEYERATHTVKYAGDSVFKHPNRIVGDMDSVSASVMAMYRDDPRYGCCVDDQREDQDSTDFVKCLRAIVQHRPEIKRVFTLGALGGRLDHILYNMKTLFDFPSLEIVLIGDHSTAFAVPSGRTIVKRDMRYETVHCGLVPLQGDARVSTKGLKWDLNDDVMSFNSGGLISTSNQFDADVVVIDTDTPLLFTSSPSVPLRSDGI

SEQ ID NO: 48783 - protein, 780 aa, Oryza sativa (japonica cultivar-group)
MATPRGHLPACVAAVAAAAALLTSLLPPPVAGQPLGNFCGDSGNYTANSTYQGNIRSISATLPKNASSSRTLFATATLGAVPDIVYALALCRGDTANATACAGCVAAAFQDAQQLCPYNKDATVFYDACALRFSNQNFLASTNGDNKFLILMNTQNVSAPAKVFDAAVGVLINATADYAAANSSRRFGTGEEGFNGSKIYGLAQCTPDMATATCRSCLGGIVGMMPKYFSGKQGGRVLGLRCNYRYEIYPFFDGVSLLQLPAASLGAPPAPSPAAVNVTPPATTTGTRRRGNTTGRVLAIALPIVAAILAAVVICFYIWKRKTERARKPSIADPTDPADIESIDSLILSISTLRVATNNFDDSNKLGEGGFGAVYKGVLPSDQEIAVKRLSQSSRQGIEELKNELVLVAKLQHKNLVRLLGVCLEEHEKLLVYEYMPNKSLDTILFDPDRSNVLDWWKRLKIVNAIARGLQYLHEDSQLKIIHRDLKASNVLLDSDFNPKISDFGLARLFGNDQSQDVTNRVVGTYGYMAPEYAMRGHYSIKSDVFSFGVLILEIVTGRKNNVSYDSEQSVDLLTLVWEHWLAGTVVELADSSMAGHCPGDQILKCVHIGLLCVQEDPTERPMMSMISDFGLARLFGNDQSQDVTNRVVGTYGYMAPEYAMRGHYSIKSDVFSFGVLILEIVTGRKNNVSYDSEQSVDLLTLVWEHWLAGTVVELADSSMAGHCPGDQILKCVHIGLLCVQEDPTERPMMSMGKTYFGCVWNSKFPTPLPRFPRARFSNC

SEQ ID NO: 48784 - protein, 245 aa, Xylella fastidiosa 9a5c
METATVTRVNSTQPANACAPSHIPIIINNPMSEAKRRAAEKAIEYVENDMIIGVGTGSTVAYFIDALGRTPKRIKGAVSSSEQSTAHLKQHGIEVLELNHTGTLPLYVDGADECDPYKRLIKGGGASLTREKIIAEASKQFICIIDPNKQVATLGKLPLPIEVIPMARSLVARQIMARTDGQPVWREGVITDNGNVILDVHHLRITDPVKLEQELNQIPGVVCVGLFARRCADLVIIGSEPPHIL

SEQ ID NO: 48785 - protein, 510 aa, Saccharophagus degradans 2-40
MKTPLTDINAKQAGVLLFSILIVALCGIVYELIIGTVSSYLLGNSVHQFSLTIGFFMFAMGVGSMISKYFDDQFVRNFIFVEIAIALVGGICSILLFIAFPMARALYELVMYSLILIIGALVGMEIPILTSLLAQKRSLKESIANVMSLDYVGALIGSVSFPLLLLPSLGLVQSSFAIGLINILVATINVIVFRHYLRHYHAMLLSCIGILVLLTGCIFYGTVLTRFAEKHLYFDQVIYSTQTPYQKLVVTRSTTTREQRLYIDGHIQFSSRDEYRYHEYLVHPVMSIPGPRKNVLILGGGDGLAAREVLKYDDVETIHLVDIDPEMLRIANELPMLRRLNKGSLDAEKLTAFSQDAFSFINEPGIDYDRVIIDMPDPHNEAINKLYSREFYTMIKRRMTPEGILVSQSSSPFFTRHVFWCIEQTLDHVFDNTLSYHTALPSFGIWGFNMARNNVAFPADIEFNIETRALTQASMQAARNFDKDIAKVETTVNSIMEPKLYHLYIEDLRR

SEQ ID NO: 48786 - protein, 426 aa, Neisseria meningitidis FAM18
MENSLKEAALKFHELPVPGKISVTPTKSLATDKDLALAYSPGVAAPCMEIHADPQNAYKYTAKGNLVAVISNGTAVLGLGDIGALAGKPVMEGKGVLFKKFAGVDVFDIEIDEKDPQKLVDIIAALEPTFGGINLEDIKAPECFYIERELRKRCKIPVFHDDQHGTAIITAAAVLNALRFTGRKIEEATLVCSGAGAAAIACLNQLLDLGLKRENVTVCDSKGVIYKTREDKDRMDESKQFYAIEDNGQRVLADAVKGKDIFLGLSGANLLTPEMLNTMNEKPIVFAMANPNPEILPPLAKETRPDVVIGTGRSDFPNQVNNVLCFPFIFRGALDVGATTINEEMKRACVYALADLAMEEVTEEVVAAYGKKFEFGAEYLIPTPFDSRLLPRVATAAAKAAMESGVATRPIADLEAYAAKLSEWKL

SEQ ID NO: 48787 - protein, 142 aa, Glycine max
PTRPPTRPPTRPPTRPGWWGHEYVRNLAGEIAQEYTKRQSEEAPIDDLMELVQQIVAFHMKHNAEPEAVDLLMEVEDLDMLSGHVDKTNFKRTCLYLTSSARYLPGPDDMLVLDIAYSIYKQFEEYPNALQIALFMDNSQHV

SEQ ID NO: 48788 - protein, 285 aa, Oryza sativa
MACHYCFVSSINFFLQVAFKTGDFNHQVIFIGGLTDGFLATDYLEPLSLALEVEKWSLVQPLLSSSYTGYGISSLEQDALELDQLISYLINKENSDGVILLGHSTGCQDIVHYMRTNFACSKAVSGVILQAPVSDREYRATLPETAEMIDLAAKMLSEGRGMDLMPREANPDAPITAYRYHSLCAYMGDDDMFSSDLSEDQLRQRLGHMSTTQCQVIFSMGDEYVPEYVDKEALVDRLCRALGNAEKVEIEWGNHALSNRVQEAVRAIVDFVKREGPKGWDDPWS

SEQ ID NO: 48789 - protein, 130 aa, uncultured archaeon GZfos27B6
MSLNDPLADALSHIKNTERVGKMECEIKPASKLIGNMLGVMQEGGYIEEFEFVEDGKAGVFKVKLRGKINNCNAIKPRFYVRAKEYEKWEKRFLPARKFGLLIVTTSKGVMTHEKAIEAGVGGQLLAFVY

SEQ ID NO: 48790 - protein, 339 aa, Coccidioides immitis RS
MRIRIRGPSGQSTVSLQESATIGDLLDQIKENTSLPVFDIRHGYPPKSLALDQFGRQSKVTDIGVDLNGEQLIIIKRNDSTISDTQPISTQAPEVTTTQPSNSSEQRPNFPSSKQKVTRSEDDPPEIPSPNHGGTIVLRIMPDDNSCLFRAVGSAVLGAMDTMTELRSIVAQTIHEHSDVYTRAVLERSPDDYCRWIQSEEAWGGGIELSILSKHFDIEICSIDVQTLRIDRFNEGRPTRCIVVYSGIHYDTIALSPSDPPFNHAYASPDFDTKIFDSADQVILEKAVELCRILQQQHYYTDTAKFQVKCSVCGGVFIGEKGAARHASETGHYDFGEAS

SEQ ID NO: 48791 - protein, 134 aa, Brassica napus
MSIFRNSECRFIDRVMTRSDDSAEIHDMKARSGNEMKKTLTWWDLMWFGVGAVIGSGIFVLTGQEARERSGPAVVLSFVVSGVSAMLSVFCYTEFAVEIPVAGKRIFIFLSTENNHQNILKTRLKLSYISLFCL

SEQ ID NO: 48792 - protein, 408 aa, Ostreococcus tauri
MPIIALARPRPARAPPSRRAKTRARVVLARAASLSLCARGANAPHPDKTAKGGEDAWFARVDATRGGGVLGVADGVGGFNDQGVDPGLYARVLAHEALREIAREGETAAKDAMAAAQRETKIPGAATMCVVRLDGDVLRCANVGDSGFRVVRDGRVVGASTAQQHYFNCPYQLAYAELAKDGDSASDAEEFEVKVRVGDIVVLGSDGLFDNVFDEEIAAVATEAYGRASDEASGAGAAAQALVKVARGHAEDKKYDSPYAREMAKSETDKGGAPKAVGLFGGLNKMLAAALWPERWTTSPSSSPASASASCDANTEALAKARELASIEEVKVQRTVALRKEMDAAFKESVAASEKKSKAIANAKPEFTRAQVDSMDAPTIRKLLQERGLPSSGKLERLRDRLAEVKAL

SEQ ID NO: 48793 - protein, 420 aa, Debaryomyces hansenii CBS767
MIVRHAWPVVIGRTLVLGFFFVIGCISILGNQLIGTFVFANDAVQKQAVINLTKKHFIALFGTITQWVSPCKISITYDPSTLPEGDSFKVDPLGNLSSILSPNSVLISNHQLYTDWLYLWFILYTAKLGDSVYIMLKDLSKIPVLGIGMKNYNFLFLSRKWEKDKIVLTNQLLTIDANARGLGPANGVTHVTSTNVGSSELHHWPEGHKAGQIWPYLVILYPEGTVTSARTRAKSNKFCEERNMPVLKHTLLPRVRGLFLTLRKLRNTVEIVYDFTCGYSDLKPGEYGEHIYTLKRHYLKGYGPKKISYHLRGWKLSEIPLGEETEDIDDVSSEDLIKFEEWLFKVWYEKDRMLDQFYKLGSFVDPESEVNYTAGKVAENTVVADFRINSIADIVGSFASLTIVLLILRIIWMTLLKILF

SEQ ID NO: 48794 - protein, 764 aa, Legionella pneumophila subsp. pneumophila str. Philadelphia 1
MLKILKRIVQDVTAASDLKEALGILVQRINTAINAEAVSVYLIDNKNAEYVLIATEGLNKQAEFRVRIALDCGLIGLIGRREEPINIENAPSHPDFYHNPLIGEDHLNAFLGVPIIQHRKLYGVLVVQQLEQRYFDDAEESFLITLAAQLGGIIAHAEATGELAELTQPKKGIGVDKVEATYTALTGIGSVPGIGIGTAVVVYPPADIDAVPRNPVEELEDEINAFYEALETTRDDIRRLSKRMKETVAEEEHALFDVYLRILDRDSLGAEVEHVIREEKISAQAALATVIKKHVQQFESMGDDYLRERASDFRDLGRRVLAELQRTQREEIVYPKRTILIGEEITAAALAEVPEGQLAGVVSAKGSNNSHVAILARALGVPTVMGLRGLKVELVSRRALIVDGYYGHVYISPSKSLLAEFKQLAQEEQELNQSLVSLRDKPAETTDNYRVSLQVNTGLAMDAGLSMSVGAEGVGLYRSEVPFMSRDRFPSEDEQTIIYRQTLKAFAPRLVTMRTLDIGGDKILPYFPVEEENPYLGWRGIRITLDHPDVFLIQVRAMMRASEELDNLRIMLPMVTTLSEVEEAVYLIEQAFEELVEEGCEIVKPKIGVMIEVPAAAYLAREMAKRVDFISVGSNDLTQYLLAVDRNNARVAALYDPLHPAMLRTLLKIVEGGHAAGVEVSICGEMASDPLAVILLIAMGFDTLSMNSASLPRVKWVIRNFAIANARKILAEVLEFEHPAEIRFHLQKALEEEGLGGLIRAGKS

SEQ ID NO: 48795 - protein, 379 aa, Arabidopsis thaliana
MATQGQVITCKAAVAYEPNKPLVIEDVQVAPPQAGEVRIKILYTALCHTDAYTWSGKDPEGLFPCILGHEAAGIVESVGEGVTEVQAGDHVIPCYQAECRECKFCKSGKTNLCGKVRSATGVGIMMNDRKSRFSVNGKPIYHFMGTSTFSQYTVVHDVSVAKIDPTAPLDKVCLLGCGVPTGLGAVWNTAKVEPGSNVAIFGLGTVGLAVAEGAKTAGASRIIGIDIDSKKYETAKKFGVNEFVNPKDHDKPIQEVIVDLTDGGVDYSFECIGNVSVMRAALECCHKGWGTSVIVGVAASGQEISTRPFQLVTGRVWKGTAFGGFKSRTQVPWLVEKYMNKEIKVDEYITHNLTLGEINKAFDLLHEGTCLRCVLDTSK

SEQ ID NO: 48796 - protein, 269 aa, Haloarcula marismortui ATCC 43049
MPEMSDAMSKPHTERFRLENQRAIITGASSGIGRAIAEEFAADGADVVVCSREQDNVGPVADEINDSDRPGEAVAIECDVTDREAVEALVEATVDEFGGLDVLVNNAGASFMSGFDDISENGWKTIVDINLHGTYHCTQAAGDALAADGGGTVINLSSVAGEQGAPYMSHYGAAKAGVSNLTSTLSAEWADRDIRINCIAPGFVATPGVESQMGVSADNIDREAVERRIGLSEEIADIALFLASPASSYIVGQTITAAGVPRLEETPDI

SEQ ID NO: 48797 - protein, 630 aa, Oryza sativa (japonica cultivar-group)
MAASRVALSVPVAAAVALLLLALPRAAVSYPWGLCNDTAGEFPARRSSYLASINLIAATLPGNASASPDLFATAEGFCAPRDQVSALALCRGDAKASTCLACLTQAFLDLPKACAYQKVAAIFYDSCQLGYSNATIAAGDLSTEKIPIYGFRSYANVTTEQARYNRLVAALVNATADYAARNSTRRLYASGEADFNAEFPKVYSWAQCTPDLTPASCRSCLAQIIGTYIGFFENRVGGFVRAVWCSFQYSTTPFLDGPMLVRLQGTSGASPAPSPAAVVPAVNQTPPAATPTLEGEDIENLDSMLIDISILRSATGDFAESNKLGEGGFGAVYKGVLPDGYEIAVKRLSKSSTQGVEELKNELALVAKLKHKNLVSLVGVCLEQQERLLVYEFVPNRSLDLILFDTEKSEQLDWEKRYKIINGIARGLQYLHEDSQLKVVHRDLKASNILLDVNMNPKISDFGLARIFGRDQTQAVTKNVIGTYGYMAPEYLTRGNYSVKSDVFSFGVMVLEIVTGRKNNHSYNSQQSEDLLTMIWEQWVAGTVLEMVDPSMNSFFSESDVMRCIHIGLLCVQGDPANRPVMSSVVLMLGTDTVELHAPAKPTLFARKGGGDESGVASGGMSIVSLEEQS

SEQ ID NO: 48798 - protein, 337 aa, Shewanella sp. MR-4
MAIKIGINGFGRMGRLALRAAWEWDDVEFVQINDPAGDAATLAHLLEFDSVHGRWRYPVTASHDGIQIQDKTIHTTGNKTIAETDWSGCDVVIEASGVMKTKALLQAYLDQGVKRVVVTAPVKEEGVLNVVMGVNHQLYDPTIHPIVTAASCTTNCLAPVVKVIHEQIGIRHGSMTTIHDITNTQTILDAPHKDLRRARACGLSLIPTTTGSATAITHIFPELKGKLNGHAVRVPLANASLTDCVFELERRVTEAEVNALLQSAAEGELKGILGYEERPLVSVDYKTDPRSSIVDALSTMVVNGTQLKLYVWYDNEWGYANRTAELARLVGQLDMPR

SEQ ID NO: 48799 - protein, 716 aa, Sulfolobus tokodaii str. 7
MVFSHKDRPLRPGEPYPLGANWEEEDDGVNFSIFSENATKVELLIYSPTNQKYPKEVIEVKQRSGDIWHVFVPGLGPGTLYAYRIYGPYKPDQGLRFNPNKVLIDPYAKAINGTLNWNDAVFGYKIGDSNQDLSFDDRPDDEFIPKGVVINPYFEWDDDHFFRRKKIPLKDTIIYEVHVKGFTKLRPDLPENIRGTYKGFASRQMIEYLKDLGVTTVEIMPVQQFVDDRFLVEKGLRNYWGYNPINYFSPECRYSSSGCMGEQVNEFKEMVNELHNAGFEVIIDVVYNHTAEGNHLGPTLSFRGIDNLAYYMLVPDNKRYYLDFTGTGNTLNLSHPRVLQMVLDSLRYWVLEMHVDGFRFDLAAALARQLYSVNMLSTFFVAIQQDPVLSQVKLIAEPWDVGPGGYQVGNFPYLWAEWNGKYRDTIRRFWRGEAIPYEELANRLMGSPDLYAGNNKTPFASINYITSHDGFTLEDLVSYNQKHNEANGFNNQDGMNENYSWNCGVEGETNDANVIQCREKQKRNFIITLFVSQGVPMILGGDELSRTQRGNNNAFCQDNEISWFNWNLDERKQRFHDFVRSMIYFYRAHPIFRRERYFQGKKLHGMPLKDVTFLKPDGNEADEQTWKSPTNFIAYILEGSVIDEVNDRGERIADDSFLIILNGSPNNIKFKFPQGKWSLVVSSYLRELRDDERVVDGGKELEIEGRTAMVYRRIEY

SEQ ID NO: 48800 - protein, 173 aa, Triticum aestivum
  misc_feature (79)..(79): Xaa can be any naturally occurring amino acid
MAPTVMASSATSVVPFQGLKSTAGLPVSRRSNGASLGSVRNGGRIRCMQVWPIEGIKRWETLSYLPPIRTEALLRQVDXLIRSKWVPCLEFSKVGFIFREHNASPGYYDGRYWTMWKLPMCGCTDPTQVINEVEEVKKEYPDAYVRIIGFDKLRQVQSVSFIAFKPPGCKESG

SEQ ID NO: 48801 - protein, 1215 aa, Mycobacterium sp. MCS
MTVPVVIDPRYHDAVIFDLDGVLSDPAPTVTLARELQDVGVKTAACSSNSHGRDMVKSIGAEGFDVCVDGSAEDRAGAPCLEAARRLGVRPQRAVLIEDSAAGRTPGRDGGFALVIRVDRTRHPDEPIDGDADRVVAGLAGIAVRTGDRRVSEVPNALESYGQLIGITGARESVLFLDYDGTLSPIVSEPDAAVLVDGAAEALALVAAVCPVAILSGRDLADVRTRVGAPGLWYAGSHGFELTGPDGTYHQNEAAAAFVPVLERAAGDLRDLLGHVPGIFVEHKRFAVAVHYREVGSSDEVAEIVSTTHRLGRQAGLRVTSGRMLVELRPDIDWDKGTTLRWIRDRIDAAGSLMPIYIGDDLTDEDAFDAVRFDGVGIVVRHDEDSDRKTAARFSLQSPDQVREFLQRGSQWLAYKHQVASEAWDLTYEGYDPQSEKLREALCTVGNGYFATRGAAPESKAGQVHYPGTYAAGIFNRLVDDVSGTAVDNESLVNLPDWLSLTFRIDGGDWFDIDEVEVLSYRQTLDLRGATLTREVRFRDDAGRTTSVTQQRFVAMHLPHVGALQTKIVAEDWSGRITIRSTLDGNVTNSLVERYRDLGKEHLELIEKRQLSDDSVLLTVRTTQSGIPIAMAARCIVWRDDAPVGASYRLVGDGAEIGHEITVEQSVGEALTVEKLVTLFTGRDVATSDPAVDAERWVARLGRYAEVREGHLTDWTHLWERLSIEFDDFTDEVRILRLHLLHLLQTVSPNSADLDVGVPARGLHGEAYRGHIFWDELFIFPVLNLRLPMITRSLLAYRYRRLPEARHAAREAGYAGAMFPWQSGSDGREESQRLHLNPRSGNWNPDASARAHHIGIAVAYSAWKFYQATGDLAYLIDYGAEMLAEVARFWVSLASYDEDRGRYSIRGVIGPDEFHSGYPDAPYDGIDNNAYTNVMAVWVIMRALDALDLLPLPNRLDLLETLGLTSGELAHWDDVSRRMYVPFHDGVISQFEGYGELEELDWDRYRAHYGNIQRLDRILEAENDDVNRYKASKQADVLMLLYLMSVPELGEILNRLGYHFPADQVPSMVDYYLARTSHGSTLSGVVHTWVLARANRDRAMEFFELALKSDVSDIQGGTTSEGIHLAAMAGTVDLMQRCFTGLETRSNRLILSPYWPESLGVLAVPIHYRGLHLHLRVSGKGVIISVDPREAAGVVVECRGRVVQLMPGTTVRFPG

SEQ ID NO: 48802 - protein, 334 aa, Glycine max
MPKERRDRSLSHESSRASPYPSSSSRVGRSALKESEENVKEWEEARCPVCMEHPHNAVLLICSSHEKGCRPYMCNTSYRHSNCLDQFCKSFADTSSTIPQVESQISDTVESRIDVPEDRNEGTVRSRIDVPEDRNEGTVQSRIDVPEDRSEDLVTMQTLSCENDAKSKLVCPLCRGQIKEWKVVEAARHFMNEKSRSCSCETCNFSGTYPDLRKHARLEHPLERPSAVDPERQRSWRRLERQRDLGDLLSTLQTSFGVDDPIDDGGLLAVFFLILQPASMSRGTTLQMRIRRPTTTLWGENYDGQSGSDDANESSDGGSDSRPRRVRRRRTPPP

SEQ ID NO: 48803 - protein, 143 aa, Shewanella sp. MR-4
MAIERTFSIIKPDAVAKNHIGAIYNRFETAGLKIVAAKMLHLTKEQAEGFYAEHSERGFFGALVAFMTSGPIMVQVLEGENAVLAHREILGATNPAQAAPGTIRADFAQSIDENAAHGSDSLESAAREIAYFFSAEELCPRTR

SEQ ID NO: 48804 - protein, 424 aa, Zea mays
MASLFGNGGYIYSSGSEGEDEDEGTEGYRKGGYHAARPGDRFAGGRFVAQRKIGWGNFSTVWLAYDTLHSRFVALKIQKSARDYAHAALHEIELLSAVAKGDPTNSKCVLRLLDHFKHAGPNGQHVCLVTEFLGDSLLRLIRYNRNKGIGLSRVKEICRSVMVGLDYLHSELGIIHTDLKPENVLLESTINPAKDPVRSGFTPILDRPVGNQYGGTVISFSEKMLKMRARRAVAKISQRRVSLGGVGAELEKERCLDGISLKCKIVDFGNACWADQQHAGEIQARQYRAPEVIIGSGYSYSADIWSFACIAFELATGDLLFAPMNRQGCSEDEDHLALMMETLGKMPRKIASSGTRSKDYFDRYGDLKRVRRLKFWPLDRVLVERYSFSEPDAKGFADFLRPMLDFAPEDRPSAAQCLKHSWLN

SEQ ID NO: 48805 - protein, 319 aa, Geobacillus kaustophilus HTA426
MKTLDVVTFGETMVLFTSEAMTPLEYSSHFSKQIGGAESNVAIGLQRLGHSVGWFSKLGNDPFGRYIHKFVRGEGVDTSRCIYTDEAPTGIFFKEKRSPSNIKVYYYRRNSAASLLSPDDLDEEYIANAKFLHITGITPALSTSCRETVFKAIEIAKRHRVKIVFDPNIRLKLWTIEKARQVLMEIAAEADIILPGLDEGELLSGRNTPEDIARFFGEEKLVIIKLGERGAYYQFGSEEGYVKGFAVPQIVDPVGAGDGFAAGVISGLLQNVPISEAVRRGNAVGAIVVGTNGDVEGLPTREELDEFLQGAAYQRDVKR

SEQ ID NO: 48806 - protein, 300 aa, Geobacillus kaustophilus HTA426
MKGIIPPVVTLFNEKGEFDWEANYLLADYLIERGVHGLLYMGSTGEFSTLTTEERKNFAERMIRYIDGRVPVLIGAGSTSLKETISLSQHAESIGASGVLVVNPFYWKYTERQLYDYYISVAQSIRIPLLIYNIPLLTGQDLSPDLVLRLALDQENIVGIKDTTEKLGHIRQLIRIKEQRKDFAVFAAFDDLLFPSLQMGAAGAINGTAVFCPELSVRLFESFQSQQYEDAFRANASILRLMEIYELSQPLFLAIKEAVHQLILGRQTALRLPLKECADLKERVHMFLNKHNLHINKVRK

SEQ ID NO: 48807 - protein, 976 aa, Picrophilus torridus DSM 9790
MGTLTIEKNRYNFLEGDTLLNVFIKAGIDIPHVCYNPALGPLQSCDTCIVSVNGRLVRSCSTIAEDNMNIEYKNNDVKNAQIEAINRLLREHNLHCTVCENNNGDCALHNAVDSSGLERQKYKYEKKPYEIDDSNPFYRYDPNECILCGRCVEACQDVEVNETIHIDWTLERPRVVWDDGKMINESSCVSCGHCVTVCPVNALMEKSMLEEAGYFTSLTRKAKESLIDFGKNLEDQLTIRPIMEISNIEARMRNEQIKKTKTVCTYCGVGCSFTMWTKGRKILKVQPEIESPANGISTCIKGKFGWGFVNSDDRLKRPLIRKNNKFVEVSWDEALDFAAAGLKRISDKYGGDSIMFIASSKGTNEEAYLIQKMARQIFKTNNVDNSSRFCQAPATTGLWRTVGYGGDAGSIDDIYNSELVMIVGANTAESHPVIATRIKRAHKLNNQRLIVIDLRRNEMAQRADLFLHPRPGTDLFLLSAITKYIIDNNWHDKKFIEERVNNFDEYYKSLDNFTLENAEKITGIDKNEIIKVASMIHSVKSMCILWAMGVTQHSAGSDVSTAISNLLLITGNYGRPGTGAYPLRGHNNVQGASDFGAMPTYLPGYQSIKNKDAIKKFEKAWNTKLPMNPGIDNVSCIENIDNDKIKAMYIIGQELAETGPDTNMINKSLEKLEFLIVQDVFFSETARYADVVLPSCVSLEKEGTYVNTERRIQRIYKVMEPYAETRPDWEIIQDIARRLGYNWNYKSPSDIMDEAASLCPIFSGVSYSRLEGFNSMQWPTYENGDSSKYLYKDGFNFPDGRARLYILKYRPPIMEDDDYPLHLNNGRMLEHFHEGNETFKTPGIRDKVPDTFLEISPELADEYNIKTGDFVRVTSRYGSIKVRALVTDRVKGKELYMPMNAASSDNGINLLTSYSRDPDSDTPAYKELPVRIKKLKDNGGSPLPKTNPRFGTPVPQIGINIEMKWKRADYKKITGD

SEQ ID NO: 48808 - protein, 475 aa, Arabidopsis thaliana
MSVQEYLDKHMLSRKIEDAVNAAVRAKTSDPVLFIANHLKKAVSSVITKVKARQILDSRGIPTVEVDLHTNKGVFRASVPSGDSSGTYEAIELRDGDKGMYLGNSVAKAVKNINEKISEALIGMDPKLQGQIDQAMIDLDKTEKKSELGANAILAVSIAACKAGAAEKEVPLCKHLSDLSGRANMVLPVPAFTVLSGGKHASNTFAIQEIMILPIGASRFEEALQWGSETYHHLKAVISEKNGGLGCNVGEDGGLAPDISSLKEGLELVKEAINRTGYNDKIKIAIDIAATNFCLGTKYDLDIKSPNKSGQNFKSAEDMIDMYKEICNDYPIVSIEDPFDKEDWEHTKYFSSLGICQVVGDDLLMSNSKRVERAIQESSCNALLLKVNQIGTVTEAIEVVKMARDAQWGVVTSHRCGETEDSFISDLSVGLATGVIKAGAPCRGERTMKYNQLLRIEEELGDQAVYAGEDWKLSL

SEQ ID NO: 48809 - protein, 123 aa, Glycine max
MGIRGSLVLAMLVLGGISAETETEGILGTPTPFECGDNMAIGLNCGRYVSRIGPKEPPSPACCQALEGADIPCLCQYFTIYALLFSLEKGVYVLNSCGIPVPPGTRCGSYTFPPAPAPARPEN

SEQ ID NO: 48810 - protein, 352 aa, Anabaena variabilis ATCC 29413
MKAKLRFQPVSHSWVALHPKPKGVIQFIGGAFFGTFVPMLFYRYLLQYLFDNGYTIILLPFNFTFNHYAEAGFLIREEYEIAPELIRMAKLANYDYQVYLNDRKFSWIGHSIGCKYIALLEAFSALPRERKELEEFIGDIVAKTSNPSEQAKNERKIQAIVENLEVLMNDLKQQRAKATQLIKYYLGYEPDTYWDRMEDPSIDRTFFKSLFIKGQTSILLAPVNTGTDSAVPKFLANIIDKLGWGVKPSPQETYALIQATNLFNLLGLIRFKSDNIAKSTGDWFINVFKKPPTDFQNYLAGGHLKPLGIRVGGYVVNFPDSLPIIESAQRRSSELEIYVDSLLQALEKERRL

SEQ ID NO: 48811 - protein, 202 aa, Triticum aestivum
MGAVRWYSKFVQKSRLVPARNPVDIVDPRVRAAAPAPGQANPSPLVYSRLRIKPTRESSDSYSSSRGAARISDQMALASGPAATFSARPAAPGAGRPYSCAAAATGGARFRGADGKWWAPLLGWSGQPDYIDAQPAPAPVSEEERAAAGGAAGARRFGVLTEEKARQLRVRMMETESFHDAMYHSAIASRLASAARDGDAKP

SEQ ID NO: 48812 - protein, 189 aa, Saccharophagus degradans 2-40
MKQVLVLVADGTEEIEAVTVVDVLRRVGAKVTVASVMPQMATIAASRGVKIVADTILRPHLFDTQWDALVLPGGMPGAEYLGLSAEVVTLIKNTKAAGNIIAAICAAPAVVLGRNGLLEGAEATCHPSFQAELAHHTTVSSARVVDAGWLITSQGPGTAIEFALKLVARLYSPIEAAALAEAMVVDIPI

SEQ ID NO: 48813 - protein, 130 aa, Triticum aestivum
MVRVSVLNDALKSMSNAEKRAKRKVMTRPSSKVIIKFLLVMQKHGYIGEFEYVDDHRAGKIVVELNGILNKCGVISPRFDVGVKEIEGWTARLLPSRQFGYIVLTTSAGIMDHEEARRKNVGGKVLGFFY

SEQ ID NO: 48814 - protein, 129 aa, Triticum aestivum
MEIQHHGGVGNSKVVKVQSQEAWDLFTDQASKEGRPVVAHFGASWCVTSLSMNYKFEELAQTHPEVLFLYVDVDDVQSVSSKYGVKAMPTFFLIKNKEVVSKIVGANPDEVKKLVDASAEPFQTQIVVE

SEQ ID NO: 48815 - protein, 412 aa, Burkholderia vietnamiensis G4
MSLDSRQLATLAQQYGTPLWVYDADVIRERIAQLRQFDVIRYAQKANSNLHILKLMREEGACVDAVSLGEIERSLAAGFSPAGEPEGVVFTADLIDRPTLAAVLKHGVTVNAGSLDMLARVGEHAPGHRVWLRVNPGFGHGHSNKTNTGGPQSKHGIWIDDVPRAIEIVHRYGLKLVGIHMHIGSGVDYGHLSQVCDAMVDLVTSLGHDIDAISAGGGLSIPYRDGEPRVDVGHYFNQWDAARKRIERHLGHAVRIEIEPGRFLVAEAGTLVTEVQAVNRRPQHDFVLIDAGFNDLMRPSMYGSYHAVSVHAPDGTLPAGRPLVDIAIAGPLCESGDVFTQDAGGVVTHRKLPQPQIGDLLFLHDAGAYGASMSSNYNSRPLAPEVLVDRGTPRLIRRRQTIGELLALETFE

SEQ ID NO: 48816 - protein, 631 aa, Aspergillus nidulans FGSC A4
MKGFRQRVHEQLSRAKDNKSSKKKESASQASQQNSANLGIHHGQQSASPNQVTPTSSTTSVNDIRGKAPEDASQAGGFPPATPTKQGQPMAPSVVISPSGPHAPPPGAAETMPGDLAPPRKSHVFDRLQTTPKDMSEGIRTPKRQHSSRFDISDQRQRELEKLPGFHEVPPNRRQELFMQKIDQCNIIFDFNDPTADMKSKEIKRLALHELLDYIANNRSVITEPMYPRVVEMFAKNLFRPIPPPITPQGEAFDPEEDEPVLEVAWPHIQVVYEFFLRFIESQDFNTNIAKAYIDHHFVLQLLELFDSEDPRERDFLKTTLHRIYGKFLNLRSYIRRSINNVFFQFSYETERFNGIAELLEILGSIINGFALPLKEEHKLFLTRVLLPLHKVKSLSMYHPQLAYCIVQFLEKDSTLTEDVVLGLLRYWPKTNSTKEVMFLNEVEDIFEVMDPAEFAKVQEPLFQQLAKSVASPHFQVAERALYFWNNEYFCNLVSDNVEVILPIMFPPLFENSKGHWNRTIHSMVYNAMKMFMEINPQLFDECSHEYNERQNSAEMREKARQNRWEKVAERAMQRQNGVNLPRNSTTAEIPLQLDDVDALTQESQRRLQSLKLDEAGSKDRRPREGSITSP

SEQ ID NO: 48817 - protein, 446 aa, Yersinia pestis KIM
MVNRISDFCWGAEIHSDDEFLNLLFTLIKGGNMEQPSPVTRQSFDEWIVPTYAPADFIVVRGEGSTLWDQQGKSYIDFAGGIAVNALGHGHPAVRAALIEQADKVWHLGNGYTNEPVLRLAKQLIDATFAEKVFFCNSGAEANEAALKLARKYALDNFANKAGQQGEKNQIVAFRNAFHGRTLFTVSAGGQPKYSQDFAPLPGGIHHGIFNDLASAEHLITDQTCAVIVEPIQGEGGVLPADKEFLHGLRALCDRHNALLIFDEIQTGVGRTGELYAYMHYGVSPDVLTSAKALGGGFPIGAMLTTTKYASALSVGSHGTTFGGNPLACAVAGTVLSLINQPTLLAGVKARHQWFIDELAEINARHNVFAEIRGRGLLIGCVLNAQYAGKSKEIVQAAAQYGLIALIAGPDVVRFAPSLIISPKEIKEGLARLAMGIEQVCQKVTS

SEQ ID NO: 48818 - protein, 300 aa, Parvularcula bermudensis HTCC2503
MAFSLATVTQWMAGSMTALVTPFKGGEVDYDAYAALIERQIAAGTRAVIPVGTTGESATLSEREHIAVVTHCVETVKGRIPVIAGAGSNNTVAAIRLAEQAEGAGADALLATTGYYNKPPQSGIEAHYRHLAEATDLPILVYNVPGRTQTDVAVETLARLSTVPTIVGVKDATGDLGRVALHRRACGKDFIQLSGEDMTAVGYNAMGGQGCISVTANVAPEQCAQLQDACLNGRFADALELQDRLTALHEALFVETSPGPTKYALARLGLCREELRLPLVPTSERSKAAVDRALDELGLL

SEQ ID NO: 48819 - protein, 511 aa, Clostridium difficile 630
MKHELVLVIDFGGQYNQLIARRVRENNVYCEILPCTASIERIKEKNPKGIIFTGGPNSAYLEDSPTISKEIFELGVPILGICYGIQIMSHVLGGVVRKGNKQEKEYGKTAITYGKSSLFEGITTNSVWMSHTDLIEKVPEGFTIVANTNDCPVAAMENVERNLYGVQFHPEVEHCLEGDKILTNFLYNICKVKGDWTTDSFIEDKIKELKEKIGDKKALCALSGGVDSSVAAVLIHKAIGDNLTCIFVDHGLLRKNEGNDVERIFREKFDINLIRVNAEDRFLSKLKGVSEPEAKRKIIGEEFIRVFEEESNKLGKMDFLVQGTIYPDVIESGHGNAATIKSHHNVGGIPEDVDFQEIVEPLRELFKDEVRKIGLELGIEEGLIFRHPFPGPGLGIRVIGDVTKEKCDILREADAVYMDELRKAGLYREIWQAFATLPDVKTVGVMGDERTYAYLVGLRAVTSSDGMTSDWYKMPYDVLERISNRIINEVDGVNRVVYDITSKPPGTIEWE

SEQ ID NO: 48820 - protein, 414 aa, Arabidopsis thaliana
MSATALSRLNPVSQFGFQRIVAGKSKSFFSNSGQRRLFSDSSRFRQAMAASGSLPVFGDACLDDLVTTCSNGLDFTKKRSSGGSFTINCPVASMRLGKRGGMMKNRLVCHYSVVDPLEKSRALFGTLSKSVHTSPMACFSVGPAHELSSLNGGSQESPPTTTTSLKSLRLVSGSCYLPHPEKEATGGEDAHFICDEEQAIGVADGVGGWAEVGVNAGLFSRELMSYSVSAIQEQHKGSSIDPLVVLEKAHSQTKAKGSSTACIIVLKDKGLHAINLGDSGFTVVREGTTVFQSPVQQHGFNFTYQLESGNSADVPSSGQVFTIDVQSGDVIVAGTDGVYDNLYNEEITGVVVSSVRAGLDPKGTAQKIAELARQRAVDKKRQSPFATAAQEAGYRYYGGKLDDITAVVSYVTSS

SEQ ID NO: 48821 - protein, 392 aa, Janusia mediterranea
DLEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCLAPSVKVIQDERLPQPLSLCGSTLRSPHGCHAQYMTNMGTIASLVMSVTVNEDDDTMDGDQQQMARKLWGLVVCHHTSPQFVPFPLRYACEFLIQVFGVQITKKVELAAQVREKHILQIQTMLCDMLLRDAPVAIITQSPNVMDLVKCDGAALYFKSKTWFLGVTPTEEQIRDIAEWLLKYHSGNTGLSTDSLMEAGYPGASGLGDAVCGMAAVSITSRDFLFWFRSHTAKEIKWGGAKHDPDDKDDLRKMHPRSSFKAFLEVVKWRSMPWEDMEMDAI

SEQ ID NO: 48822 - protein, 392 aa, Janusia linearis
DLEPVNPADVPVTAAGALKSYKLAAKAISRLQSLPSGNISLLCDVLVKEVRDLTGYDRVMVYKFHEDEHGEVVSECRRSDLESHLGLHYPATDIPQASRFLFMKNKVRMICDCLAPPVKVIQDERLPQPLSLCGSTLRSPHGCHAQYMTNMGTIASLVMSVTVNEDDDTMDGDQQQMTRKLWGLVVCHHTSPQFVPFPLRYACEFLIQVFGVQINKEVELAAQVREKHILQIQTMLCDMLLRDAPVAIITQSPNVMDLVKCDGAALYFKNKTWLLGVTPTEEQIRGIAEWLLKYHSGNTGLSTDSLMEAGYPGASGLGDAVCGMAAVSITSRDFLFWFRSHTAKEIKWGGAKHDPDDKDDLRKMHPRSSFKAFLEVVKWRSMPWEDMEMDAI

SEQ ID NO: 48823 - protein, 428 aa, Saccharophagus degradans 2-40
MSKIANVIGFEVMDSRGNPTVMAEVVLESGVVGTACAPSGASTGSREALELRDGDKSRYLGKGVLKAVANINETIKPLLVGKDVAAQRELDDIMLKADGTENKANLGANAILAVSLAAAKAAAQDKGIPLYAHIADINGTPGKYTMPVPMMNIINGGEHADNNVDIQEFMIQPVSAPNFTEALRMGAEVFHSLKKVLAGRGLNTAVGDEGGFAPNLPSNEAALEAIAEAVAAAGYKLGEEITLALDCASSEFYKDGVYDMSGEGKKFSPEEFADYLAELASKYPILSIEDGMDESDWDGWKVLTEKIGSTCQLVGDDLFVTNTKILKEGIDKSIANSILIKFNQIGSLSETLDAIKMAQEAGYTAVISHRSGETEDTTIADLAVATAAGQIKTGSLSRSDRVAKYNRLLRIEAELGEKAPYRGRAEFK

SEQ ID NO: 48824 - protein, 424 aa, Parvularcula bermudensis HTCC2503
MTAIIDINAREILDSRGNPTVEVDVFTEDGVMGRAAVPSGASTGVHEAHERRDGGERYGGKGVRGAVDAVNSSIFEAIVGLDVEEQVFIDEAMIDLDGSPNKASLGANAILGVSLAVAKAAAKQTGQPLYRYVGGVSADLLPVPMMNIVNGGAHADNPIDIQEFMIMPTGAGSFAEALRMGAETFHALKAELKAAGHNTNVGDEGGFAPTLSSTDEALDFIMKAIDKAGYTAGDDMHLALDVASTEFYKDGKYHLEGEGKTLDAAGMTDYLVRLVDAYPIISIEDGMAEDDWDGWVTLTEKIGDRCQLVGDDLFVTNEKRLVTGLEKGAANSILVKVNQIGTLTETMRAVSRAHRGGYTAVMSHRSGETEDTTIADLAVATACGQIKTGSLARADRTAKYNQLLRIEEDLGPSARFAGKSILRG

SEQ ID NO: 48825 - protein, 50 aa, Arabidopsis thaliana
  misc_feature (15)..(15): Xaa can be any naturally occurring amino acid
  misc_feature (17)..(17): Xaa can be any naturally occurring amino acid
  misc_feature (38)..(39): Xaa can be any naturally occurring amino acid
  misc_feature (46)..(46): Xaa can be any naturally occurring amino acid
MPLLWLLSGQATMVXPXNGLKSSAAFPATGKANNDITXXTSNGGRXNCMQ

SEQ ID NO: 48826 - protein, 392 aa, Janusia californica
DLEPVNPADVPVTAAGALKSYKLASKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMTNMGTIASLVMSVTVNEDDDTMDGDQQQMTRKLWGLVVCHHTSPQSVPFPLRYACEFLIQVFGVQINKEVELAAQVREKHILQIQTMLCDMLLRDAPVAIITQSPNVMDLVKCDGAALYFKNKTWLLGVTPTEEQIRGIAEWLLKYHSGNTGLSTDSLMEAGYPGASGLGDAVCGMAAVSITSRDFLFWFRSHTAKEIKWGGAKHDPDDKDDLRKMHPRSSFKAFLEVVKWRSMPWEDIEMDAI

SEQ ID NO: 48827 - protein, 668 aa, Oryza sativa (japonica cultivar-group)
MPAAAAAHHLAGVAAAFLLAVLLHVHLAAARAAATRENSTFQANVNRLSATLPRNTSSSPAMYATGAAGDVPDKVYGYALCRGDVADAHACERCVAAALRDAPRVCPLVKDALVFHDLCQLRYSNRNFLLDDDYYVATYSLQRSSRLVSAPAPAAVAAFDAAVAMLANATAEYAAAANTSRRYGTAEEEGVDGDGDSGRPRMYALAQCTPDKAADVCRACLTTLTTVQLPKLYSGGRTGGGVFGVWCNLRYEVFPFFSGRPLLHLPAFVEAPPPATSAAATRRGEKKRNKTGIVLAIVMPTIAAMLLIVVAYFCCWRRRRPEEQTFLPYDIQSIDSLLLDLSTLRAATDDFAETKMIGRGGFGMVYKGVLPEGQEVAVKRLCQSSGQGIEELKSELVLVAKLYHKNLVRLIGVCLEQQEKILVYEYMSNKSLDTILFDIDKNIELDWGKRFKIINGIAQGLQYLHEDSRLKIVHRDLKASNILLDFDYNPKISDFGLAKIFDGDQSKDITHRIAGTYGYMAPEYAMHGHYSVKLDVFSFGVLVLEIVTGRRNSGSYDSGQDLDLLNHVWGHWTRGNVVELIDPSLGNHPPIEQMLKCIHIGLLCVQKRPASRPTISSVNIMLSSNTVRLPSLSRPAFCIQDVSASDSSNPHSTAVSSNDMSITDLVPR

SEQ ID NO: 48828 - protein, 392 aa, Gaudichaudia mcvaughii
DLEPVNPADVPVTAAGALKSYKLAAKAISRLQSLPSGNISLLCDVLVKEVRDLTGYDRVMMYKFHEDEHGEVVSECCRSDLESYLGLNYPATDIPQASRFLFMKNKVRITCDCLAPSVEVIQDERLTQPLSLCGSTLRSPHGCHAQYMTNMGAIASLVMSVTVNEDDDTMDGDQQHMTRKLWGLVVCHHTSPRFVPFPLRYACEFLIQVFGVQVNKEVELAAQVRERHSLQIQTMLCDMLLREAPVAIITQSPNVMDLVKCDGAALYFKNKTWFLGVTPTEEQIRGIAEWPLKYHSGNTGLSTDGLMEAGYPGASGLGDAVCGMAAVSITSRDFLFWFRSHTAKEIKWGGAKHDPDDKDDLRKMHPRSSFKAFLEVVKWRSTPWEDIEMDAI

SEQ ID NO: 48829 - protein, 670 aa, Oryza sativa (japonica cultivar-group)
MATAVAATAMRRGQHLPLSLSLCYNLAAVALLVAVFLHAPPRAGAQPLPWQLCNATAGNYTEGSTYQANVRALAQRLPRERVVFPALFAEYTAGTAPNVQLCAFNKRATLFNDPCILRYSDLDILANVTDNSGRFVAWNYNNVSAAKAAAYDAASGRLVNATADYAAADPVRRFGTGEVGSDDETYPRIFSLAQCTPDMSEADCRSCLGDIIRKATPKYFVGKPGGRVFGVRCNFRFEAYEFFSGRPLLQLSGPPPPPANMTPPVTSEGRTSHRTGRILAITLPIAGAALAFIALTCFCFRRKRTPANKASSLPFSTNPDDIQSIDSLLLDLSTLRAATDNFADRNKLGEGGFGAVYKGVLSEGQEIAVKRLSQSSRQGIEELKTELVLVAKLRHKNLVSLVGVCLEGDEKLLVYEYMPNKSLDTILFDYEKSKDLDWGKRLKIVSGVARGLQYLHEDSQLRVVHRDLKASNVLLDFDHNPKISDFGLAKLFEWDQTQDVTSHIAGTYGYMAPEYAMRGQYSVKSDAFSFGVMILEIVTGRRNSSFSNSEQSIDLLSLVWEHWTTGTIEELLDPAMRGRSADDLLKLINIGLLCVQDNPADRPTMSAVSVMLSSETFSIQAPSRPTFCIQETDSAADTDLYSSALRSTGDSKTRAVASPNEVSLTELEPR

SEQ ID NO: 48830 - protein, 455 aa, Anabaena variabilis ATCC 29413
MKLPDSPKIPRFMQLVQWIYQPLQLMEASAKAHGDCFTLWLTNKRPIVFLSNPQAIQELFTTPLEQLDARGTAQVLQPLLGENSLLLLSGETHQRQRKLLTPPFHGDRMRAYGDIITNITQEVISKWQLGEPFSVRDSMQEITLRVILQAVFGLREGERYTQLQKRLCDILDLSGSALRSTLSFLPALQIDLGSWSPWGHFLRQRAAIDQLLYAEIQDRRDHPDPSRTDILSLMMAARDENGEAMTDIELRDELMTLLVAGHETTASALTWALYWIHKLPQVREKLLAELDNFGDNGDVNEITRLPYLTAVCQETLRIYPIAMVTIPRIVKTTLEIGGHQFAPGTMLVGCIYLMHRRPDLYPQPQEFKPERFLEKQYSLYEYLPFGGSNRRCVGMAFALYEMKLVLATVLANMDLALVDNYPVKPTRRGVTLAPSGGKWLIATGQHQKVKSPVEV

SEQ ID NO: 48831 - protein, 392 aa, Aspicarpa hirtella
DLEPVNPADVPVTAAGALKSYKLAAKAISRLQSLPSGNISLLCDVLVKEVRDLTGYDRVMVYKFHEDEHGEVVLECRRSDLESYLGLHYPATDIPQASRFLFMKNKVRMICDCLAPPVKVIQDKRLPHPLSLCGSTLRSPHGCHAQYMTNMGTIASLVMTVTVNEDDDMMDGDQQHMTKKLWGLVVCHHTSLRFVPFPLRYACEFFIQVFGVQINKEVELAAQVREKHILQIQTMLCDLLLRDAPVTIITQSPNVMDLVKCDGAALYFKNTTWLLGVTPTEEQIRGIAEWLLKYHSGNTGLSTDSLMEAGYPGASGLGDAVCGMAAVSITSRDFLFWFRSHTAKEIKWGGAKHNPDDKDDLRKMHPRSSFKAFLEVVKWRSMPWEDIEMDAI

SEQ ID NO: 48832 - protein, 643 aa, Oryza sativa (japonica cultivar-group)
MACYYLAAAAAGLALLLLHAPLTDAQTLVPLCGDSGNYTEHGTYHANIQYLATSLPSYASSSPSLFASGSSGTVPDAIYALALCRGDTNSSSCATCVAAAIQSAQELCPLVKTVIVYDDTCILRFANDAFPISPTSNSQGMVVAWKAQNVSAAVAPAFEAAVVRLINTTADYAATDSVRRFGTGEEAFDETTFPKIYSLAQCTPDMAATACRSCLEDIVGRMVSGNLIGRMGGRVLGVRCNLWFEVYPFFSGRSLLQLPGPSPSPAPPVTAAGERSKNKRSAILAISMPTIALVLATIAAWFCSTSWRRRRLARKTLRPKSSEDEMQSFASLVLDLQTLRTATDNFSEHQRLGEGGFGVVYKGDLPEGQEIAVKRLAQTSRQGIEELKTELLLVAKLNHNNLVRLIGVCLEENEKILAYEYMPNRSLDTILFDAERIKELDWGQRFKIINGIARGLQYLHEDSQLKIVHRDLKASNVLLDSAYNPKISDFGLAKIFERDQSQVITHRIAGTYGYMSPEYAMRGQYSMKLDVYSFGVLVLEIITGRRNFGSYGSDHVVDLIYVTWEHWTSDKAIELIDPSLGNHYPVDKVLKCIHIGLLCVQPKPADRPLMSAVNAMLSSTGTVRLPCLSRPSFWVQEIGATAS

SEQ ID NO: 48833 - protein, 343 aa, Arabidopsis thaliana
MSYPERKRKRSRWSKPHSTQNPSPSLPDDVLLSIFARVSRLYYPTLSHVSESFRSLLASPELYKARSLSGNTEICLYVCLRCSTGYRWFSLSRKPDQTLTYEERKSSGYALARVPIPGGSPNVRSSSLVAVGSDIYNICGSINKASSSSSVSILDCQSHTWREAPSLPVELSSISASVRDGNQGGHGYSDSRKNSFKVFAYNSKEGRWDHLVGLGAGSFMLPDSYCVIDNVSYSVSDGMFRWYDTEVRRWKDLRGLFQLPKFSAGACVILADYGGKMAVLWDQLPYHHGFHKTIQCAVIALERRTSFVFREKSCQIWGKVEWVDDLLTVPTSYDLVKVLVATL

SEQ ID NO: 48834 - protein, 710 aa, Candida albicans SC5314
MNLVIAYFLSWVFFATSVKAGKNAKFQLYGDITYFYTCNLQISSSVSYCATPYNATCLCANKNALATYAGCLAFDNRNTTTAVNYMMNYCEENGNVTVEKDWYEKSYQYFLSNAKTEKEIPNFNKTIPIDVPFKLDEAEMKLYERAYKQFLGNYDDSLYYGAGILGYWLLIMCIGAIVNWGKVMFPGLTKKLTSKPINLWRQYVSMPATFRKKKAEELRIFKFFDSLIPSRFESIVIFLFYIVVLMIHAMNMHYVDGDPVFENNKYNSQARNVADRTGITGTIMMPLVFLFSSRNNFLQWLTGWNYNTFVTYHRHIARVMFILIALHSILFTVLLRDDMSEFSETYMIWGVLATVSGGIILFQAMLFFRRRWYEIFLFIHILFAALYVAGTWIHVDELGYVWFVYPAVAVWCADRVVRIARLVIFGFPKARVSLLADDTIKVEIPKPSYWKTIPGGHAFIHFLKPTYFWQSHPFTFVESPADTHIILYCKVKGGITHSLYQLLVRSPGQAITMRVGVEGPYGEPTPARYADTAVFIAGGNGIPGIYSEVMDMARRMPNETKNAMKLYWIIRDYKSLEWFNDELTLLGNTNIETTIYVTKPDLSNLLTGDGSDDTSSKKESDSQDMNLESKESLQGVDLVKSRFSHITFKKGRPSIEDIVDLEIKESNGSVAFVACGHPAMVDETRYFCSRNVDNPQKKRVDFYEQVQVWT

SEQ ID NO: 48835 - protein, 323 aa, Triticum aestivum
  misc_feature (156)..(157): Xaa can be any naturally occurring amino acid
  misc_feature (313)..(313): Xaa can be any naturally occurring amino acid
SARAGLSGQLQKAFVTGVPALKRSELQAACEDFSARGGCLSDYMMYKGTLSSGVEIAVISTTKKSGKEWSKHCEARFRKKITSLSRVNHKNFVNLLGYCQEEQPFTRMMVFEYAPNGTLFDHLHVREDGHLDWPTRLRVAVGIAYCLEHMHQLSPXXILKTLDTSTVYLTDDFAAKIADVFFCSDDADAFMASLQSLLALSDRESVVYSYGMVLLEIMSGRFTASAGGLLEGWAASFLRGERQLRDVMDPDLSWNAPLHAETVNRLDGVIRSCTDREARRRPAMAEVARRLRGITAMPPDAATPKVSPLWWAXELEIISTEAT

SEQ ID NO: 48836 - protein, 393 aa, Triticum aestivum
MAAASSLHVAAPAATPRVGSAGPKSASAARSVRVARSGAAARHGGRLVACAAVATKADAPASEAASKSEGHEVLLFEALREGLMEEMQADPTVCVFGEDVGHYGGSYKVTKGLADMFGDLRVLDTPIAENSFTGMGVGAGMKGLRPVVEGMNMGFLLLAYNQISNNCGMLHYTSGGQFKIPLVIRGPGGVGRQLGAEHSQRLESYFQSIPGLQMVACSTPYNAKGLMKAAIRSENPVVLFEHVLLYNLKEKIPDEEYTLCLEEAEMVRPGEHVTILTYSRMRYHVMQAAKTLVNKGYDPEVIDIRSLKPFDLHTIGNSIKKTHRVLIVEECMRTGGIGASLRSAIIDNFWDYLDAPIMCLSSQDVPTPYAATLEDATVVQPAQIVAAVEQICQ

SEQ ID NO: 48837 - protein, 471 aa, Herbaspirillum seropedicae
MARTAAEVLKMVKDNEVKFVDFRFADTRGKEQHVSVPVSHFDIDKFESGHAFDGSSIAGWKGIEASDMLLIPDPNTANIDPFMEETTLFMQCDVIEPSDGKGYDRDPRSIAKRAEAYLKSSGLGDTAYFGPEPEFFIFDGVRWGADMSGSFVKIDSEEASWSTGAKIEGGNSGHRPTVKGGYFPVPPVDSFQDMRSEMSLIIESLGIPVEVHHHEVAGAGQNELGTKFSTLVERADWTQTMKYVIWNVAHTYGKTATFMPKPLVGDNGSGMHVHQSVWKDGKNLFAGDGYAGLSEFALYYIGGIIKHAKALNAITNPGTNSYKRLVPGFEAPVKLAYSARNRSASIRIPHVANPKGRRIETRFPDPLANPYLCFSALLMAGLDGVQNKIHPGEAATKDLYHLPPEEDKLIPTVCSSLDEALEHLDKDREFLTRGGVFTDSMIDAYIDLKMQEVQRFRMTTHPIEFDMYYSL

SEQ ID NO: 48838 - protein, 301 aa, Aspergillus nidulans FGSC A4
MSTVAAARYGKDNVRVYKVHKDPKTGVQTVTEMTVCVLLEGEIDTSYTKADNSVIVATDSIKNTIFILAKQNPVTPPELFGSILGTHFINKYKHIHVAHTNIITHRWTRLNIDGKPHSHSFVRDSEETRNVQVDVTEGVGIDIKSSINKLTVLKSTGSQFWGFVRDEYTTLPEVWDRILSTDVEATWAWKRFSGLDEVRGNVPKFDETWEAARNITLKTFAEEESASVQATMYKMGEQILAYQPLLETVEYSLPNKHYFEIDLSWHKGLKNTGKDAEVFVPQTNPNGLIKCTVGRKSKAKL

SEQ ID NO: 48839 - protein, 377 aa, Elaeis guineensis
MADAEDIQPLVCDNGTGMVKAGFAGDDAPRAVFPSIVGRPRHTGVMVGMGQKDAYVGDEAQSKRGILTLKYPIEHGIVNNWDDMEKIWHHTFYNELRVAPEEHPVLLTEAPLNPKANREKMTQIMFETFNVPAMYVAIQAVLSLYASGRTTGIVLDSGDGVTHTVPIYEGFALPHAILRLDLAGRDLTDALMKILTERGYSFTTTAEREIVRDIKEKLAYVALDYEQELESAKSSSSVERSYELPDGQVITIGAERFRCPEVLFQPSLIGMEAAGIHETTYNSIMKCDVDIRKDLYGNVVLSGGSTMFPGIADRMSKEISALAPSSMKIKVVAPPERKYSVWIGGSILASLSTFQQMWISKEEYDECGPAIVHRKCF

SEQ ID NO: 48840 - protein, 574 aa, Burkholderia vietnamiensis G4
MRAAAAPRAYAKATRLAKHICRTEFIMSTPSNVSPPIAVERSAVLDEAHLGDIRGALGTIAHHDTAARGTWWARLRTLLAIIGPGLIVMVGDNDAGAFGTYTQAGQNYGTTLLWTLLLLVPVLYVNQEMVLRLGAVTGVGHARLIFERFGKFWGAFSVIDLFLLNALTIVTEFIGITFVLAFFGLPKVAGVCVAAALTMAAVSTGDFRRFERFAIVLCVLSLLLVPVLVSIHPPVSQMSRDFFIPNWPAHAKLSDVMLLVIGIVGTTVAPWQLFFQQSYVIDKRITPRFMKYEKIDLWIGIAFVLIGAVAMIGFSAALFGGHPEAGNFTDAGGIIAGLEKYAGRTSATLFAVALLDACIIGAAAVSLSTAYAIGDVFKIRHSLHRGVSDAKGFYLVYFGIVAAAAALVLIPGSPLGLLTEAVQTLAGVLLPSATVFLLVLCNDRQVLGPWVNSTRLNVFTGAVIWVLVLLSIILTASVMYPDISGEAIVDVLVGGTVLAIAGYLATVLIRRNRRVVEPGIDRSLRDAWRMPPLDSLTPQKMTVATRVWMAVLRGYLVVAVGLVIVKVVQMTLLK

SEQ ID NO: 48841 - protein, 643 aa, Shewanella oneidensis MR-1
MCGFAGFFNTSNLTDHARILECMGLELFNRGPDSFGIWFNSDDRIGLVHRRLAIVDLSAAGHQPMTSDSGRYIISYNGEIYNHQELRDELESIRQYNWRGHSDTETLLAAIEQWGLKITLQKATGMFGIALWDTLNKELYLARDRFGEKPVYYGLHKDAFIFASQLNAFRAYPDFKPEINRDSITLLLRHNYIPAPYSIYSDIHKLLPATILKLDSNNNISLETYWSAKDIMSNASSTETDLPVGKQVEALENTLKKAVALQMSADVPLGAFLSGGVDSSLIVSLMQAQSNKPVKTFSIGFDDPRFNEAVFAKEVAKHLGTEHTELYLTAEDALEVIPKLAEIYDEPFSDSSQIPTFLVSKIARQYVTVSLSGDAGDELFCGYNRYLMTSKVWKRLSVLPVFLRSFLANVFTFVPVNVWNLFGKLLPSRLQLSNLGDKLHKAAAVLACRDVEQLYLGLVSHWQNPEQVVLGSKEPLTVLTDPKRKANFSDPILQMMAQDTLSYLTDDILVKVDRAAMAVSLETRVPFLDHSVLEHAWRLSLDLKLRDGKTKWCLREILYKYVPKDLIERPKMGFAVPLDAWLRGPLKVWADNLLAAERLRQEGFFDAELIDRMWQEHKSGKRNWQYQLWDILMFQSWYEKYHK

SEQ ID NO: 48842 - protein, 392 aa, Gaudichaudia albida
DLEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMIYDCLAPPVKVIQDKRLPQPLSLCGSTLRSPHGCHAQYMTNMGTIASLVMSVTVNEDDDTMDGDQQHMTKKLWGLVVCHHTSPRFVPFPLRYACEFLIQVFGVQINKEVELAAQVREKHILQIQTMLCDMLLRDAPVTIITQSPNVMDLVNCDGAALYFKNKTWLLGVTPTEEQIRGIAEWLLKYHSGNTGLSTDSLMEAGYPGASGLGDAVCGMAAVSITSRDFLFWFRSHTAKEIKWGGAKHDPDDKDDLRKMHPRSSFKAFLEVVKWRSMPWEDIEMDAI

SEQ ID NO: 48843 - protein, 392 aa, Gallardoa fischeri
DLEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQDEQLPQPLSLCGSTLRSPHGCHAQYMTNMGTIASLGMSVTVNEDDDMMDGDQHQMTRKLWGLVVCHHTSPRFVPFPLRYACEFLIQVCGVQINKEVELAAQVRKKHILQIQTMLCDMLLRDAPVAIITQSPNVMDLVKCDGAALYFKNKIWLLGVTPTEEQIRDIAEWLLKYHSGNTGLSTDSLMEAGYPGASALGDAVCGMAAVSITSRDLLFWFRSHTAKEIKWGGAKHDPDDKDDLRKMHPRSSFKAFLEVVKWRSKPWKDVEMDAI

SEQ ID NO: 48844 - protein, 392 aa, Peixotoa glabra
DLEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCLAPPVQVIQDERLPQPLSLCGSTLRSPHGCHAQYMTNMGTIASLVMSVTVNEDDDTMDGDQQQMTRKLWGLVVCHHTSPRFVPFPLRYACEFLIQVFGVQITKEVELAAQVRKNHTLQIQTMLCDMLLRDAPVAIITQSPNVMDLVKCDGAALYFKNKTWLLGVTPTEEQIRDIAEWLLKYHSGNTGLSTDSLMEAGYPGASTLGDAVCGMAAVSITSRDFLFWFRSHTAKEIKWGGAKHDPDDKDDLRKMHPRSSFKAFLEVVKWRSMPWEDVEMDAI

SEQ ID NO: 48845 - protein, 549 aa, Legionella pneumophila subsp. pneumophila str. Philadelphia 1
MKSIKQLIRLIHINYILAKNGLDNVVVSIKLFAPLRFIVYLNPWNWLRKEKLTRGEALRKSLEELGPIFIKFGQALSTRPDILPEDIAKELSKLQDKVPPFPSHIAMNIIEQAYKQSAYDVFAQFDPIALASASMAQVHAATLKTGENVVVKILRPNMRRLIEQDLSIMYTIAALADRYWPEGKRFKPKEIVKEFEHTLLDELDLMREAANAAQLRRNFNQSPMLYIPEIYWDYCHHNILVIERIHGIPVTDIASLRDHGIDIKKLAERGVEIFFTQVFRDCFFHADMHPGNIFVSYQNPKDPQYICVDFGIIGTLTDNDKRYLAENLVAFFNRDYKRVAELHVESGWVSRDTPVAEFESSIRTVCEPIFEKPLKDISFGQVVFRLFQVARRFHMEVQPQLILLQKTLLAIEGLGRQLYPELDLWATAKPFLEKWVREQMGPKAFIKRLKQNLPFFTEQLPHMPKLIFDILEMKKDQLLTVHELTRLQSENNNQTIQWKSMGLGVFFSFLSLGVISYFDLLDYNHLTTITIAGSVLAGIFVLINRKIRN

SEQ ID NO: 48846 - protein, 392 aa, Ryssopterys timorensis
DLEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCLAPPVKVLQDERLPQPLSLCGSTLRSPHGCHAQYMTNMGTIASLVMSVTINEDDDMMDGDQQQMTRKLWGLVVCHHNSPQFVPFPLRYACEFLIQVFGVQINKEVELAAQVREKHILQIQTMLCDMLLRDAPVAIITQSPNVMDLVKCDGAALYFKNKTWLLGVTPTEEQIRDIAQWLLEYHSGNTGLSTGSLMEAGYSGASALGDAVCGMAAVSITLRDFLFWFRSHTAKEVKWGGAKHDPDDKDDLRKMHPRSSFKAFLEVVKWRSMPWEDIEMDAI

SEQ ID NO: 48847 - protein, 545 aa, Haloarcula marismortui ATCC 43049
MAQTVHRTDDVHPLIEPIADHVLSTERHENAPAAVIRADEVQTVLSTLRTEAGLDHCACVTAQEYADRFETIYHLRRYADPTQELSVVVPTARESPTSESAVPVYPTAAWHEREAYDLVGIEYEDHPDLRRILLPETWQGHPLSRDYNQDQPQIVSFREHERLLEDHRAGPETMHINMGPHHPSTHGVLHLNVQLDGEQVAAVDPDIGYIHRCEEQMCQQGTYRHQIMPYPDRWDWGGAGLLNEWAYARAAEALADIEVPAYAQVIRTMGGELSRILSHMLAVATYALDVVGEFTATFQWGVRDRELVQDILEDLTGQRLMFNYLRLGGVAWDLPEPREAFFEKIRAFLDDLPHKLTEYHDMLTSNEILQLRTIDTGHLSAETAKAYGCTGPVARASGVDYDLRRDDPYGYYDELDWSVVTEQGGDNFSRLLVRLREVEESAKIIGQCVDLLEDWPEDDREIQANVPRTLRPDPDTEIYRAVEAAKGELGIYIRSDGTETPARFKIRGPSFSHVQALSEMARGEYVPDLVATIGSLDTIMGEVDR

SEQ ID NO: 48848 - protein, 618 aa, Candida albicans SC5314
MSEQAQTQVSADQQQHQHNHHHHHHHHHHNENQSQQQVPIDPAANPANRIGRYQILKTLGEGSFGKVKLAQHLGTGQKVALKIINRKTLAKSDMQGRVEREISYLRLLRHPHIIKLYDVIKSKDEIIMVIEFAGKELFDYIVQRGKMPEDEARRFFQQIIAAVEYCHRHKIVHRDLKPENLLLDDQLNVKIADFGLSNIMTDGNFLKTSCGSPNYAAPEVISGKLYAGPEVDVWSAGVILYVMLCGRLPFDDEFIPALFKKISNGVYTLPNYLSAGAKHLLTRMLVVNPLNRITIHEIMEDEWFKQDMPDYLLPPDLSKNKNSKIDVDEDVIRALSVTMGYDRDEIVNVIEKANKQVAAGNSSSQQSKSSNEILDAYLLMKENHALVKDLKKSKSENIESFLSQSPPPSPFPNAGSTSSAPGVQQSLTYQTLATVPDLSTLPNSTIAILPTSLPSIHRAYMAETKQNGDPSQQHAPPPTKKSKTRWHFGIRSRSYPLDVMGEIYRALKNLGAEWAKPTEEELWTIRVRWKYDTSAQFECGSAPNLMKMQIQLFQLEPNNYLVDFKFDGWESAHGNAGTDSPQSHRQQDLDEVGSFSAYPFLHLATRLIMELAVNSQSG

SEQ ID NO: 48849 - protein, 392 aa, Sphedamnocarpus sp. Davis 03-01
DLEPVNPADVPVTAAGALKSYKLAAKAISRLQSLPSGNISVLCDVLVKEVRDLTGYDRVMVYKFHEDEHGEVVSECRRSDLESYLGLHYPATDIPQASRFLFIKNKVRMICDCLAPPVKVIQDERLPQPLSLCGSTLRSPHGCHSQYMTNMGTIASLVMPVTINEDDDTMDGDQQQMTRKLWGLVVCHHTSPRFVPFPLRYACEFLIQVFGVQINKEVELAAQVREKHILQIQTMLCDMLLRDAPVAIITQSPNEMDLAKSDGTDLYYKNKTWLLGVTPTEEQIRDIAEWLLQYHSGNTGLSTDSLMEAGYPGASALGDSVCGMAAVSITSRDFLFWFRSHTAKEIKWGGAKHDPDDKDDLRKMHPRSSFKAFLEVVKWRSMPWEDVEMDAI

SEQ ID NO: 48850 - protein, 446 aa, Marinobacter sp. ELB17
MSNNALFYLTSNDMPLVSHADGIYIWDTTGRRYIDACSGAITCNVGHNHPTVKRAMVEQLDKVAFSYRTQFESQVALDLANRLVGLTDGELDKVFFVGSGSEAVESAIKLAVQYFVAKGQPERCKFVSLRPSYHGSTMGALGLTGYEPLEAPYRSITISSVKVPSPDLYRYQEVSVEEHIASVLEQTESAILAAGPETIAALALEPVGGASTGGRMVTKAYMEGLRALCDRYGFLFIMDEVLSGMGRTGAWFAYQHFGVVPDILALAKGLGSGYYPIAAMMARQELVDEVSRSGGFMHGHTYAGNPLACATGLAVIGVMDSEQLVNNAVEQGAYLRQQLDQLALKYDRIGNVRGIGLLQGVELVQDKASKQPFPASFNAFEKLTALAKVRGLLIYPRRCLNGLEGDHVLITPPLTVTAADIDDIIALLDDSLAAFEQVSLRQEVCS

SEQ ID NO: 48851 - protein, 146 aa, Brassica napus
MGTGNSKEKWRQRSSSSFRSASSPPSSPWASHQSYPPPPSYAPPPEYVQPPSPSYTTQPYSQPPPSQSYGNDKKRLERKYSKISDDYSSLDQVTEALAHAGLESSNLIVGIDFTKSNEWTGARSFNRKSLHFIGNTSNPYEQAIAI

SEQ ID NO: 48852 - protein, 259 aa, Aspergillus nidulans FGSC A4
MDLHSKLQAAWYRLINTYRPGTIELTGSIATQTVGFILPATLYLLIDTLFPEFSKRHKIQSAGRQPTRPQILHCVKVTLFNHVWVVAIHAMLVYWAGLDHAIMNLDPIVPPWREFIVDFVFALLAREILFYYIHRTLHHPRIYAYIHKMHHKYTTPVAFAGEYAHPVEHVIANILPITLPLYLKGAHYLSIIAFVSFELWEAAADHSGYDFLKLPPAELHDLHHEKFRVHYGTIGLMDWIHGTDVVGWDRPETDKRDEQ

SEQ ID NO: 48853 - protein, 217 aa, Brassica napus
  misc_feature (210)..(210): Xaa can be any naturally occurring amino acid
SPDTPERADESDIDIKKRKEYEGRGREDEDEDEDEEYMHKGKWVLLRKDGFNQGSAKVTACDYHQGLDMVVVGFSNGVFGLYQMPDFICIHLLSISREKLTTAVFNQRGNWLTFGCAKLGQLLVWEWRSESYILKQQGHYFDVNCVTYSSDSQFLATGADDNKVKVWNVASGSCFITFTEHTIAVTALHFMADNHSLLSASLDGTVRAWXFRKYKNY

SEQ ID NO: 48854 - protein, 239 aa, Triticum aestivum
  misc_feature (155)..(155): Xaa can be any naturally occurring amino acid
  misc_feature (182)..(182): Xaa can be any naturally occurring amino acid
MTSVWKTKVLPGLNKIFDKDGKKAAAAEFLKSFNKEEIDKEIEDKKTELEPKVVETIEASPPEIKGLIKDKKTSKIRKNSVAVTKFLDDLAKIDFPGAKLVSDAVAKSGTTPLSPAIVFILDKVAPFVPAPKEEPKVEPEVAAAAPAEETTTREXVAVEEEKKEEGPAPAEVVQEKKKEKPXEAAGPAAEEPKNKGSGPAAPHSHKHPRPHLGLANCSQMKKHLSRTAHLGRRSPSSGH

SEQ ID NO: 48855 - protein, 328 aa, uncultured bacterium
MSLKKSSISIIKAPIEKEMKQFDSYFKESMKSKVRLLDIINNYIIKRKGKEVRPILTFLSARLLGDIQESTYVAAALTQLLHTATLIHDDVVDEAYERRGFFSINALWKSKAAVLVGDYLLSKGLLVALENKEYDQLQVVSDAVREMSEGELLQLEKSRKLDITEDVYFDIIYKKTASLIASCTQLGALSVGATKDQQEKLKRFGECLGVAFQMKDDLFDYEKQGNIGKPTGNDIKEKKLTLPLIYVLRNVSDKERKWALKIIRKHNKNSEKVNELIQFVKEKGGIDYTRDKMLEYKQKSLEILSNFPESEANTSLKELVEYTISRTK

SEQ ID NO: 48856 - protein, 509 aa, Yersinia pestis KIM
MMSGKHSAETHHAAKKRWLDSHDTGYHKSMGLRHIQMIAIGGSIGTGLFLGTGARLQMAGPALALVYLVCGIFSFFILRALGELVLHRPTSGSFVSYAREFLGEKASYVAGWMYFLNWAMTGIVDITAVALYMHYWGTFSDVPQWLFALGALSIVATMNMIGVRWFAEMEFWFALIKVAAIALFLIVGVIFLGTGQSVAGHTTGIHLITDNGGFFPHGLLPALIMVQGVIFAFAGIELIGTAAGECKDPEKMLPKAINSVIWRIGLFYVGSVVLLVCLLPWHAYQAGQSPFVTFFSNLGVPYIGTIMNIVVLSAALSSLNSGLYSTGRILRSLSMGGSAPKFMSKMSPQSVPYAGILVTVGIYVLGVLLNYLVPSQVFEIVLNIASLGIISSWAFIIICQMKLRQAIKRGMAKPVSFKMPGAPVTSWLTLIFLAGVLVMMAFDYPNGTWTIASIPVLTLLLIAGWFSLRKRANEVAAAPIDVWSQEILFEEPDAQNVSPKELYEQKSVG

SEQ ID NO: 48857 - protein, 392 aa, Tristellateia madagascariensis
DLEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMANMGTIASLVMSVTINEDDDTMDGDQQQMARKLWGLVVCHHTSPRFVPFPLRYACEFLIQVFGVQINKELELAAQVREKHILRIQTMLCDMLLRDAPVGIITQSPNVMDLVKCDGAALFYKNKFWLLGITPTEAQIRDIAEWLLEYHSGNTGLSTDSLMEAGYPGASVLGDAVCGMASVSITSRDFLFWFRSHTAKEIKWGGAKHDPDDKDDGRKMHPRSSFKAFLEVVKWRSLPWEDVEMDAI

SEQ ID NO: 48858 - protein, 392 aa, Tristellateia africana
DLEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCLAPQVKVIQDERLPQPLSLCGSTLRSPHGCHAQYMANMGTIASLVMSVTINEDDDTMDGDQQQMARKLWGLVVCHHTSPQFVPFPLRYACEFLIQVFGVQINKEIELAAQVREKHILRIQTMLCDMLLRDAPVGIITQSPNVMDLVKCDGAALFYKNKFWLLGITPTEAQIRDIAEWLLEYHSGNTGLSTDSLMEAGYPGASVLGDTVCGMASVSITSRDFLFWFRSHTAKEIKWGGAKHDPDDKDDGRKMHPRSSFKVFLEVVKWRSLPWEDMEMDAI

SEQ ID NO: 48859 - protein, 775 aa, Oryza sativa (japonica cultivar-group)
MWHLGSGSCSFSSPLSPFVLTRRDRRGVKMSGAALVAIAASIGNLLQGWDNATIAGAVLYIKKEFKLESEPTVEGLIVAMSLIGATIITTFSGPVSDWIGRRPMLILSSILYFLSSLIMLWSPNVYVLLLARLIDGFGIGLAVTLVPLYISETAPSEIRGLLNTLPQFSGSGGMFLSYCMVFGMSLLPSPDWRIMLGVLAIPSLFFFGLTIFYLPESPRWLVSKGRMAEAKKVLQKLRGREDVSGEMALLVEGLEVGADTSIEEYIIGPAIEPADEHVVDGDKDQITLYGPEEGQSWIARPSKGPSILGSVLSLTSRHGSMVNQSVPLMDPIVTLFGSVHENMPHAGGSMRSTLFPNFGSMFSVTDQHPKVDQWDEENLHRDDEEYASDGAGGDYEDNVHSPLLSRQTTSAEGKDIAHHAHRGSALSMRRRSLLEEGGEAVSSTGIGGGWQLAWKWSEREGEDGKKEGGFKRIYLHQEEVPGSRRGSVISLPGGGDAPEGSEFIHAAALVSQPALYSKDIIEQRMSGPAMIHPSEAAAKGSSWKDLFEPGVRRALLVGVGIQILQQFAGINGVLYYTPQILEQAGVAVLLSNLGLSSASASILISSLTTLLMLPSIGLAMRLMDISGRRFLLLGTIPVLIASLVVLVVSNVIDLGTVAHAALSTISVIIYFCCFVMGFGPIPNILCAEIFPTRVRGICIAICALTFWIGDIIVTYSLPVMLNAIGLAGVFGIYAVVCSIAFVFVFLKVPETKGMPLEVITEFFAVGAKQMQATKA

SEQ ID NO: 48860 - protein, 392 aa, Heladena multiflora
DLEPVNPFDVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMANMGTIASLVMSVTINEDDDTMDGDQQQMARKLWGLVVCHHTSTQFVPFPLRYACEFLIQVFGVQINKEVELAAQAREKHILQIQTTLCDMLLRDAPVAIITQSPNVMDLVKCDGAALYYKNKFRLLGVTPTEAQIRDIAEWLLEYHSGNTGLSTDSLMEAGYPGASVLGDAVCGMAAVSITSRDFLFWFRSHTAKEIKWGGAKHDPDDKDDGRKMHPRSSFKAFLEVVKWRSLPWEDMEMDAI

SEQ ID NO: 48861 - protein, 384 aa, Bunchosia armeniaca
DVPVTAAGALKSYKLAAKAISRLQSLPSGNISLQCDVLVKEVRDLIGYDRVMVYKFHDDEHGEVVSECCRSDLESYLGLHYPATDIPQASRFLFMKNKVRMICDCLAPPVKVIQDERLPQPLSLCGSTLRSPHGCHAQYMENMGTIASLVMSVTINEDDDMMDGDQQQMARTLWGLVVCHHTSPRFVPFPLRYACEFLIQVFGVQINKEVELAAQVREKQILRIQTMLCDMLLRDAPVAIITQSPNVMDLVKCDGAALYYKNKFWLLGVTPTEAQIRDIAEWLLEYHSGNTGLSTDSLMEAGYPGASVLGDAVCGMAAVSITSRDFLFWFRSHTAKEIKWGGAKHDPDDKDDGRKMHPRSSFKAFLEVVKWRSLPWEDIEMDAI

SEQ ID NO: 48862 - protein, 394 aa, Glycine max
MRTRRGACYSGVVSRMCSDARVSKKKNKDLHMHMHMHMHVPAGDSIIYSRKRQKKTPEKTAGADYEFFESLPDDLVISIFCKLSSTATKPSDFVNILITCKRLNRLALHSLVLSKASPKTFTIKARDWCDSAHKFLKHCADAGNVEACYTLGMIRFYCLQNRGSGASFMAKAAINSHARALYALAVIQFNGSGGTKSDKDLRAGVALCARAAFLGHVDAMRELGHCLQDGYGVRQNIAEGRRFLVQANARELAAVLSTGAAARTWLSWNLQPQQLRQGSGCPLLSDFGCNVPAPEVHPASLFMAEWFAARGGSPGPGLRLCSHAGCGRPETRKHEFRRCSVCGVVNYCSRACQALDWKFRHKAECSPVQRWLEEDGEDVGNDDGDGEVEVMVDS

SEQ ID NO: 48863 - protein, 392 aa, Thryallis longifolia
DLEPVNPADVPVTAAGALKSYKLAAKAISRLQSLPSGNISLLCDVIVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMANMGTIASLVMSVTINEDDDMMDGDQQQMARKLWGLVVCHHTSPRFVPFPLRYACEFLIQVFGVQINKEVEFAAQVSEKHILRIQTMLCDMLLRDAPVAIITQSPSVMDLVKCDGAALYYKNRFWLLGVTPTEAQIRDIAEWLLEYHSGNTGLSTDSLLEAGYPGASVLGDAVCGMAAVSITSRDFLFWFRSHTAKEIKWGGAKHDPDDKDDGRKMHPRSSFKAFLEVVKWRSLPWEDVEMDAI

SEQ ID NO: 48864 - protein, 261 aa, Guillardia theta
MNVKYINVWKYNVKDIFKEINNLCKDTCLISLDTEFPGIVLKIKSFKYSSENASYHMLRKNVNILKTIQIGLTFDKNCNFKFSTTFQFNFVYDFENNCFAQDSIDLLSKSKLLFETNNKIGINLDLFKEFLTSSSLLCNKKLKWITFHSGYDFGYLINLITNKELPLSKKDFIEHLNFYFPCFFDLKHLGYFSSNFYGSLDKIAEKFNINRIGKSHQAGSDSLITLNIYKIISNDIKPREYFRKFKCVLYNSPSVVHNYYL

SEQ ID NO: 48865 - protein, 364 aa, Bacillus clausii KSM-K16
MEKQILLLPGDGIGPEIIAETKRVLEEIARLYHHTFQFVEGRIGGDAIDATGSPLPEETLDLAKGSDAILLGAVGGPKWDGNAPEKRPEKGLLQIRKALGLYANLRPVRVLKPLMGASTLKEEVLADVDLLIVRELTGGLYFGEPRERRQINGEDGAVDTLLYTRGEIERIVHQAFQFARTRKKRVVSVDKANVLESSRLWREIADEVAREYPDVTLSHMLVDNAAMQLIRDPRQFDVIVTENLFGDILSDEASMITGSLGLLPSASMNTSKVGLFEPVHGSAPDIAGTGAANPLATILSAAMMLQYSFGLADEAKAIEVAVDRVLAQGVRTKDIAKASENAVSTTAITNAVMEALALKSASSR

SEQ ID NO: 48866 - protein, 152 aa, Casuarina glauca
MALTEKQEALLKQSWEVLKQNIPAHSLRLFALILEAAPESKYVFSFLKDSNEIPENNPKLKAHAAVIFKTICESATELRQKGHAVWDNNTLKRLGSIHLKNKITDPHFEVMKGALLGTIKEAIKENWSDEMGCAWTEAYNQLVATIKAEMKE

SEQ ID NO: 48867 - protein, 748 aa, Propionibacterium acnes KPA171202
MRLTPTLPDGHGLRIGILTSGGDAQGMNAAVRAVVRSALSVGAEVYAIYEGYQGMIDGGDGIRRFGWDDVGSILNRGGTVIGTFRCKGMRERPGRLKAVRNLLEHGIDRLVVIGGDGSLTGLDVLRTEWTDLVAELVDTGQVSAEVAREHPALMIAGLVGSIDNDLVGSDMTIGADTALHRIVDAIDDLASTAASHQRSFVVEVMGRHCGYLALMAAVAGGADYVLIPERPPEDGWEDRMCAELKRGRQAGRRDSIVVVAEGATDRSGNRISSEYVRQVLEDKLGEDARVTILGHVQRGGRPSAYDRWASTWLGYHAVHEVLSTTPEAEGRVIGTGSNRIHRLPLVKAVADTKSVPGLITEGRYNEAMRMRGRSFVEMDAIFTELSEPARTTSDTAGDADRKRVAIMHAGGPAPGMNTAARAAVRLAISRGHTVVGIHNGFIGLATGDMSELAWSDVEGWAGEGGAELGTRREIPSTRDLYAVSRALEDHHIDALLVIGGYSAYEGIYTMMTERDRYPAFRIPTVCIPASIDNNLPGSELSIGTDTALNVIVEAMDKIKESGIASRRCFVVETMGRDCGYLALMSGIAAGAERIYTNEDGISLDDLANDVHWLRESFAHGRRLFLAVRNENASHNYTTDFIARLLEEESHGMYDVRQVVLGHMQQGGSPSPFDRLLANRLGYRALNLIDDELAAHQDGSWFIGVNESGMRPCSMDTMPSLIDAAHRRPREQWWLQLRTIARMVSDEVR

SEQ ID NO: 48868 - protein, 322 aa, Zea mays
  misc_feature (267)..(267): Xaa can be any naturally occurring amino acid
MAKKRKRTDAPAEAAGAEKPDDSAPARPERTLFGFKDLVPDAEPASAGAEAAVAPFRNREKVLITCSRRITYRYRHLMQDVLSLLPHAKKDSKVESKQSKGNALNELLELRSCSSCLFFECRKQKDLYLWMVKSPGGPSVKFLVNAVHTMEELKLTGNHLKGSRPLLTFSTNFDEQPHWKLVKEMITQIFATPKDHRKAKPFHDHVFVFSIVDGHVWFRNYQISVPHNEIDKVDKGGLDKMTLIEVGPRFCLNPIKIFGGSFGGPTXYENPYYISPNQIRALEKRQKAGKYAKKVKAKVRRKMHEMENTLEPDEFAELWKGE

SEQ ID NO: 48869 - protein, 174 aa, Triticum aestivum
MAPAVMASSATTVAPFQGLKSTAGLPVGRRSSGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 48870 - protein, 428 aa, Propionibacterium acnes KPA171202
MGSSARFVDEDTHLDFSKVVATDGQVGYDVAGLLNKTGNVMIDPGFVNTASCESQITYIDGEQGVLRYRGYPIEQLAEQSTFLETAYLVLYGELPSKAQLDGFEERIRRTTLIDERMRDLFRCFPRRSHPMPVLAAGIMALSTFSQKSSGTDPDQIEAATTRLIAKVPTLAAFGYKNSMGQPTLYPDNSLSYVQNFIRMSFGFPTEPYEFNDEITRALETLLILHVDHEQNCSTSTVRMVASSGANMYAAVAAGVNALSGPKHGGANQAVLEMLQFIRDSGMTTKEFVRKVKDKESDIKLMGFGHRIYKNYDPRAAIIKKHADRIMELHTGREDLLEIAKELEETALNDDYFKERKLYPNVDFYTGLIYEAMGFPMNMFTVLFALGRLPGWIAQYREQVASGGNKIWRPRQIFTGSDKRDYVPLNKRA

SEQ ID NO: 48871 - protein, 1299 aa, Nostoc sp. PCC 7120
MTTDRDSSSKKFGLSPEQFAALFPFHLVIDRELKIVQAGEVIQRILEPMVLLDSYLGEHFQISRPKCLTSFEGICQQTRSLFILQAHYQEIQLKGQMLNLESRDHLLFLGSPWITDIADLKNLGLKINDFPLHDSVSDYLFLLQAKNSALADAQKLTTKLKDQKTELQTTALRLRTLIESLQSGILLEDANQHIILVNQEFCDYFRIPLPPQALQGMDCQQALEASKHLFTEPERFICTTDEIIRQGKMFLHQEWELQDGRTLEQNYIPIVVDHKLYGHLWKYRDITQYKKSEVALRLSEERLKLAVDAVEEGLWDWNLVTGEVYRSARWFTMLGYTPMEIGNDIKFRDKLIHPDDIPLMQQRLISHLKGDTPFYEVEIRLLAKSGEWRWILDRGKLVSRDSQGRAIRMVGTHLDITQRKQAEQDLQQQYQHTLLLKQITEEIRQSLQWEKILKTTVTEVQRILQVDRALIFQINSDGSGKVVQEAVMPGWSVTLDQDIYDPCLKDGYLNMYRDGRITAIADVYQGGLKPCYVEFLQQFQVKANLVVPIRVRRNLWGLLIVHQCDRPRQWTELELDLLKHLADQMGIALTQSQLLAQETRQAQLLALQNEELNVAKQVAEKANMAKSNFLATMSHEIRTPMNAIIGMSGLLLDTTLKPEQFDYVETIRNSSHTLLTIINDILDFSKIESGKLELEEQPFDLRLCVEEALDLLAPQAASKGIELMYQLEPDTPTLVVGDITRIRQILWNLVSNAVKFTKIGEICITIGAKQKIYKQTDPTRYEFQFAVQDTGIGIERDRLHRLFKPFSQVDASMTRRYGGTGLGLAISKRLSEIMGGKMWVESQSHQGSIFYFTATLQVNSSAINSAAKVDPELVGKRLLLAVGNANLRKCLTRQLQSLGLDVQAVDSNATALHCLWQHTSLALAVLDVDSPQINGLHLSTKIRAIPQHQNLPLVMLSAKGKQTLEVKQVASEFTAFLHKPLRHYQLHNTLLQIVRGKWLSKSTPQGIIPSYSRLPKPNLPAIDTHLAENLPLKILLVEDVLVNQKIAMNMLHLLGYRTDVANNGLEALEALQRQLYDVVFMDIQMPEMDGWETTHKIRQEFSPTLQPWIIAMTAHARPEDRQQCLAAGMDDYISKPISLEDITTALKKFGSQRQPALESPASVSISAPPAPTPQPKIEEVIDQQTLEYLRNLGGSDEADEDGGGSSIITELIQLYLEDTPAKIQAIQDAATLEDRSQLARIAHALRSPSVSIGAINLGKICETVEDEAKEQSMDQLTALVNQLNNEYQNVVAALKTLIF

SEQ ID NO: 48872 - protein, 391 aa, Zea mays
  misc_feature (160)..(160): Xaa can be any naturally occurring amino acid
MSKAAAASLPPPPPEVAHLVEQLQRHHLAPDASLLSSSAHSDLLQAVYAEAVAMVEEYHSAAGAGKKLNCSPQVYESLEHRLAVAEAAQRLRLPLLSQDGEVHEQEIEKLSTYSRSSFDSTLTSATPSSSSISTSYNNYSSSASAVTVAAPHWSGSSDAXEPGVGGVPDRFLGITSDYLYQVQQEQPAMSVDMVDYQRTLAREIEARLEAKCDALADLFAMDERDSSSLSQISSARLPERVKLIIEEIEKEEAHLLEDLASMDRKFAEHYNDDLKKTWLIKRCRTMNAKLSYLEHHLLRDTYTKDTVPALHRIRKYLVEATKEASNSYNEAVSRLREYQGVDPRFDVIARQYHEIVKLLTLVELHQKLEGMQWTIHQVEMDLKPHHDHAAV

SEQ ID NO: 48873 - protein, 373 aa, Rickettsia sp.
RVSAEADCFTYDPGFMSTASCQSTITYIDGDQGILRHRGYDIKDLAEKSDFLDVAYLLIYGELPSGEQYNNFTKQVAHHSLVNERLHYLFQTFCSSSHPMAIMLAAVGSLSAFYPDLLNFKEADYELTAIRMIAKIPTIAAMSYKYSIGQPFIYPDNSLDFTENFLHMMFATPCTKYKVNPIIKNALNKIFILHADHEQNASTSTVRIAGSSGANPFACISTGIASLWGPAHGGANEAVINMLKEIGSSEYIPKYIAKAKDKNDPFRLMGFGHRVYKNYDPRAAVLKETCKEVLKELGQLDNNPLLQIAIELEAIALKDEYFIERKLYPNVDFYSGIIYKAMGIPSQMFTVLFAIARTVGWMAQWKEMYEDPE

SEQ ID NO: 48874 - protein, 374 aa, Oceanobacter sp. RED65
MVDKALSGAGLRGQVAGETSLCTVGKSGTGLTYCGYDITDLAENAKFEEVSYLFSRGHLPNQSELNEYLSKLKKLRGLPQALKEVLERIPKEAHPMDVMRTGASMLGNLETEESFDEANDHIDRLVAVFPSIICYWYKFSHEGKRIETETDDASVGAHFLHMLTDKKPNELHEQVMNVSLILYAEHEFNASTFTARVCASTLSDIHSCVTGAIGSLRGPLHGGANEAAMELIENMKDPEDAETTLMGMLERKEKIMGFGHAIYRESDPRNTIIKKWSEKLAADVGDNRLYPVSVRCEEVMWREKKLFCNADFFHASAYHFMGIPTKLFTPIFVMSRVTGWTAHVKEQRANNRIIRPSAGYIGPESRPVPPISER

SEQ ID NO: 48875 - protein, 390 aa, Echinopterys eglandulosa
DLEPVNPADVPVTAAGSLKSYKLAAKAISRLQSLPSGNISLLCDVLVKEVRELTGYDRVMVYKFLEDEHGDVVSECRRSDLESYLGLHYPATDIPQASRFLFMKNKVRMICDCLAPPVKVIQDERLPQPLSLCGSALRSPHGCHAQYMMGTIASLVMSVTINEDDDTMDGDQQQMARKLWGLVVCHHTSPRFVPFPLRYACEFLIQVFGVQINKEVGLAGQVREKHILRIQTMLCDMLLRDAPVAIITQSPNVMDLVMCDGAALYYKNKFWLLGVTPTEAQIRDIAEWLLKYHSQNTGLSTDSLMEAGYPGASVLGDAVCGMAAVSLTSKDFLFWFRSHTAEGIKWGGATHDPDDKDDGRKMHPRLSFKAFLEVVKWRSLPWEDVEMDAI

SEQ ID NO: 48876 - protein, 392 aa, Dicella nucifera
DLEPVNPADVPVTAAGALKSYNLASKAISRLQSLPSGNISLLCDVLVKEVRDLTGYDRVMVYKFHEDEHGDVVSECRRSDLESYLGLHYPATDIPQASRFLFMKNKVRMICDCLAPPVKVIQDERLPQPLSLCGSTLRSPHGCHAQYMTNMGTIASLVMSVTINEEDETMDGDQQQMTRKLWGLVVCHHTSPRFVPFPLRYACEFLIQVFGVQINKEVELAAQVRENHILQIQTMLCDMLLRDAPVAIITQSPNVMDLVKCDGAALYFKNKTWLLGVTPTEKQIRDIAEWLLEYHSGNTGLSTDSLMEAGYPGASVLGDAVCGMAAVSITSRDFLFWFRSHTAKEIKWGGAKHDPDDKDDGRKMHPRSSFKAFLEVVKWRSIPWEDIEMDAI

SEQ ID NO: 48877 - protein, 419 aa, Pyrococcus furiosus
VEADPYEIVIKQLERAAQYMEISEEALEFLKRPQRIVEVTIPVEMDDGSVKVFTGFRVQHNWARGPTKGGIRWHPEETLSTVKALAAWMTWKTAVMDLPYGGGKGGIIVDPKKLSDREKERLARGYIRAIYDVISPYEDIPAPDVYTNPQIMAWMMDEYETISRRKTPAFGIITGKPLSIGGSLGRIEATARGASYTIREAAKVLGWDTLKGKTIAIQGYGNAGYYLAKIMSEDFGMKVVAVSDSKGGIYNPDGLNADEVLKWKNEHGSVKDFPGATNITNEELLELEVDVLAPAAIEEVITKKNADNIKAKIVAEVANGPVTPEADEILFEKGILQIPDFLCNAGGVTVSYFEWVQNITGYYWTIEEVRERLDKKMTKAFYDVYNIAKEKNIHMRDAAYVVAVQRVYQAMLDRGWVKH

SEQ ID NO: 48878 - protein, 219 aa, Zea mays
RTLAPRPSCRRRSRHRTAMGIDLVAGGRNKKTKRTAPKSDDVYLKLLVKLYRFLVRRTKSNFNAVILKRLFMSKTNRPPLSMRRLVRFMEGKGDQIAVIVGTVTDDKRISGGGGGSGGGGSGGGGGSGGGPTSGRCPVDALKLGVCANLLNGLINATLGTPPRTPCCTLIQGLADLEAAVCLCTVLRANVLGINLNLPINLSLLVNYCGRRVPSGFQCF

SEQ ID NO: 48879 - protein, 392 aa, Heteropterys thyrsoidea
DLEPVNPADVPVTAAGALKSYKLASKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMTNMGTIASLVMSVTINEDDDMMDGDQQQMTRKLWGLVVCHHTSPRFVPFPLRYACEFLIQVFGVQINKEVELAAQVREKHILQIQTMLCDMLLRDAPVAIITQSPNVMDLVECDGAALYFKNKTWLLGVTPTEEQIRDIAEWLLEYHSGNTGLSTDSLMEAGYPGASVLGDAVCGMAAVSITSRDFLFWFRSHTAKEIKWGGAKHDPDDKDDLRKMHPRSSFKAFLEVVKWRSMPWEDVEMDAI

SEQ ID NO: 48880 - protein, 381 aa, Heteropterys leona
ETPAGALKSYKLASKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQDETLPQPLSLCGSTLRSPHGCHAQYMTNMGTIASLVMSVTINEDDDMMDGDQQQMTRKLWGLVVCHHASPRFVPFPLRYACEFLIQVFGVQITKEVELAAQVREKHILQIQTMLCDMLLRDAPVAIITQSPNVMDLVKCDGAALYFKNKTWLLGVTPTEEQIRDIAEWLLEYHGGNTGVSTDSLMEAGYPGASILGDAVCGMAAVSITSRDFLFWFRCHTAKEIKWGGAKHDPDDKDDLRKMHPRSSFKAFLEVVKWRSMPWEDIEMDAI

SEQ ID NO: 48881 - protein, 392 aa, Tetrapterys microphylla
DLEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQGERLPQPLSLCGSTLRSPHGCHAQYMTNMGTIASLVMSVTINEDDDMMDGDQQQMTRKLWGLVVCHHTSPRFVPFPLRYACEFLIQVFGVQINKEVELAAQVREKHILQIQTMLCDMLLRDAPVAIITQSPNVMDLVKCDGAALYFKNKTWLLGVTPTEEQIRDIAEWLLEYHSGNTGLSTDSLMEAGYPGASVLGDVVCGMAAVSITSRDFLFWFRSHTANEIKWGGAKHDPDDKDDGRKMHPRSSFKAFLEVVKWRSMPWEDVEMDAI

SEQ ID NO: 48882 - protein, 192 aa, Anabaena variabilis ATCC 29413
MNFAEPASVIRLTSLSVIAALGLLAPVNAQNPQPIDPNSPNNLRPTAQNNSLLSIEGGERLMKEAEQAVAAQNYTLAAKKLQEARQVYNQLSNFYQDLNSSFSGIDNRVSDSQRQRALLTAQKRDEATYQLALVHRAQNQAELAVPLLVQIIKSQNPTRDLGKKAYQQLFELGFVEAPFPRQGGNPASSSQK

SEQ ID NO: 48883 - protein, 372 aa, Escherichia coli K12
MKYDLIIIGSGSVGAAAGYYATRAGLNVLMTDAHMPPHQHGSHHGDTRLIRHAYGEGEKYVPLVLRAQTLWDELSRHNEEDPIFVRSGVINLGPADSTFLANVAHSAEQWQLNVEKLDAQGIMARWPEIRVPDNYIGLFETDSGFLRSELAIKTWIQLAKEAGCAQLFNCPVTAIRHDDDGVTIETADGEYQAKKAIVCAGTWVKDLLPELPVQPVRKVFAWYQADGRYSVKNKFPAFTGELPNGDQYYGFPAENDALKIGKHNGGQVIHSADERVPFAEVASDGSEAFPFLRNVLPGIGCCLYGAACTYDNSPDEDFIIDTLPGHDNTLLITGLSGHGFKFASVLGEIAADFAQDKKSDFDLTPFRLSRFQ

SEQ ID NO: 48884 - protein, 149 aa, Staphylococcus aureus subsp. aureus MW2
MERTFLMIKPDAVQRNLIGEVISRIERKGLKLVGGKLMQVPMELAETHYGEHQGKPFYNDLISFITSAPVFAMVVEGEDAVNVSRHIIGSTNPSEASPGSIRGDLGLTVGRNIIHGSDSLDSAEREINLWFNENEITSYASPRDAWLYE

SEQ ID NO: 48885 - protein, 319 aa, Staphylococcus aureus subsp. aureus MW2
MAKLNMNNEIKKVEQRLEKAIKSKDSVLEQASLHLLSSGGKRVRPAFVILSSQFGKDEQTSEQTYQVAVALELIHMATLVHDDVIDKSDKRRGKLTISKKWDQTTAILTGNFLLALGLEHLMAVKDNRVHQLISESIVDVCRGELFQFQDQFNSQQTIINYLRRINRKTALLIQISTEVGAITSQSDKETVRKLKMIGHYIGMSFQIIDDVLDFTSTEKKLGKPVGSDLLNGHITLPILLEMRKNPDFKLKIEQLRRDSDRKEFEECIQIIRKSDSINESKAVSSKYLSKALDLISELPDGHPKSLLLSLTKKMGSRNT

SEQ ID NO: 48886 - protein, 336 aa, Mycobacterium avium 104
MADQEMTMREALNLALDQALAADERVFLLGEDIADPGASGPTAGLSTKYGCDRVLDTPISEAAIVGAAIGAAIDGLLPVAEIMIMDFIGIAADQLINNAAKLRFMTAGRTSAPLTVRTQVYAGLSTGATHSQSLEAWFMHIPGLKVIVPATPRDGKGLLSSAIFDPDPCLFIETIRLQGKKGLVPVEPGFRIPLGQADIKRPGTDVSLIGYGRPVHDALAAAAMLGDQGVSAEVVDLRTLVPLDVDTVVASVRRTRRAVIVHDAVQFAGPGAEVAAILHSRLFSELAAPVERVAARFVPNPAAAALEAQVYPSPERIAAAALKTLGRTLTGATAHG

SEQ ID NO: 48887 - protein, 180 aa, Mycobacterium avium 104
MTDAGEATPVAELIASLTRQVPDFPKPGIQFKDLTPLFADATAMTAVTGALARHASGADLVAGIDSRGFLVAAAVADRLHTGVLAIRKGGKLPPPVHAERYDLEYGSATLEIPADGIDLRGRRIVIIDDVLATGGTLAAAARLLRRTGATVTAAAVVFELGALGGRAALAPLPVHRLTCQ

SEQ ID NO: 48888 - protein, 251 aa, Zea mays
EGKHREFAIRMGSKAPFCLTLLLLLAAACGPAAHANDAVELPHHGSALKEHISSTKIPARLKRGSGLCSACENFTSEAVTYLGKEQTQDRIVEFLHDACSQSFSFEQKCVELMDSYATLLFAKITEIRPEAFCKRYGLCRDTALLSGVGSDSTCVFCHHLLDEIMSKLKDPDAEFEIIQILVKECNKIEGHVQQWQEAGSAIHSPHLGETVRSSSRRTMSARSHRACPASSRKTFSSMLKGALWSDAWLEG

SEQ ID NO: 48889 - protein, 392 aa, Mascagnia anisopetala
DLEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMTNMGTIASLVMSVTINEDDDMMDGDQQQMTRKLWGLVVCHHTSPRFVPFPLRYACEFLIQVFGVQINKEVELAAQVREKHILQIQTMLCDMLLRDAPVAIITQSPNVMDLVKCDGAALYFKNKTWLLGVTPTEEQIRDIAEWLLDYHSGNTGLSTDSLMEAGYPGASVLGDAVCGMAAVSISSRDFLFWFRSHTAKEIKWGGAKHDPDVKDDGRKMHPRSSFKAFLEVVKWRSMPWEDIEMDAI

SEQ ID NO: 48890 - protein, 307 aa, Oryza sativa (japonica cultivar-group)
MKEDPTVCVFGEDVGHYGGSYKVTKGLAEMFGDLRVLDTPIAENSFTGMGVGAAMKGLRPVVEGMNMGFLLLAYNQISNNCGMLHYTSGGQFKIPIVIRGPGGVGRQLGAEHSQRLESYFQSIPGLQMVACSTPYNAKGLMKAAIRSENPVVLFEHVLLYNLKEKIPDEEYVLCLEEAEMVRPGEHVTILTYSRMRYHVMQAAKTLVNKGYDPEVIDIRSLKPFDLHTIGNSIKKTHRVLIVEECMRTGGIGASLRSAIIDNFWDYLDAPIMCLSSQDVPTPYAAPLEDATVVQPAQIVAAVEQICQ

SEQ ID NO: 48891 - protein, 392 aa, Mascagnia chasei
DLEPVNPADVPVTAAGALKSYKLASKAISRLQSLPSGNISLLCDVLVKEVRDLTGYDRVMVYKFHEDEHGEVVSECRRSDLESYLGLHYPATDIPQASRFLFMKNKVRMICDCLAPPVEVIQDERLAQPLSLCGSTLRSPHGCHAHYMTNMGTIASLVMAVTINEDDDMMDGDQQQMTRKLWGLVVCHHTSPRFVPFPLRYACEFLIQVFGVQIHKEVELAAQVREKHILQIQTMLCDMLLRDAPVAIIMQSPNVMDLVKCDGAALYFKKKTWLLGVTPTEEQIRDIAEWLLEYHSGNTGLSTDSLMEAGYPGSSALGDAVCGMAAVSITSRDFLFWFRSHTAKEIKWGGAKHDPDVKDDGRKMHPRSSFKAFLEVVKWRSMPWEDIEMDAI

SEQ ID NO: 48892 - protein, 392 aa, Mascagnia bracteosa
DLEPVNPADVPVTAAGALKSYKLAAKAISRLQSLPSGNISLLCDVLVKEVRDLTRYDRVMVYKFHEDEHGEVVSECRRSDLESYHGLHYPATDIPQASRFLFMKNKVRMICDCLAPPVKVIQDKRLPQPLSLCGSTLRSPHGCHAQYMTNMGTIASLVMSVTVNEEDDMMDGDQQQMTRKLWGLVVCHHTSPRFVPFPLRYACEFLIQVFGVQINKEVELAAQVREKHILQIQTMLCDMLLRDAPVAIITQSPNVMDLVKCDGAALYFKNKTWLLGVTPTEEQIRDIAEWLLEYHSGNTGLSTDSLMEAGYPGASVLGDAVCGMAAVSITSRDFLFWFRSHTAKEIKWGGAKHDPDDKDDGRKMHPRSSFKAFLEVVKWRSMPWDDVEMDAI

SEQ ID NO: 48893 - protein, 299 aa, Candida albicans SC5314
MPVEELEDRVIITDPNDSTNRATILKFGATVVSWKNNNQEKLWLSEGAHLDGSKAVRGGIPLVFPVFGKQKDSNHPTFKLPQHGFARNSTWEFLGQTQESPITVQFGLGPENVDPETLKLWNYDFTLILTVSLTKDKLVTSIDVENTGKEAFEFNWLFHTYYRIHDITDTLVTNLIDQQCYDQLIGESYIEKAPVISFHEEFDRIYSKVSLEKSIQVVDKGQVLFNLHRKNLPDSVVWNPWTKKAEGMADFQPKSGFHQMVCVEPGHVNSMVSLPAGGKWSGGQEITIGGEIKVQANIY

SEQ ID NO: 48894 - protein, 1501 aa, Debaryomyces hansenii CBS767
MSSTSNSVEHKSKFEDSNSVTEFVPSADQSSVPQYEGFDDATNDIKELARTMSNISRQQTNKTKGSEDLIRYLSHMSQVPGVEPYNNEIEDTLNPDSDNFNAKYWVKNLRKLHDSDPNYYKPSSLGIAYRNLRASGVAADSDYQPTVDNALYKLGGEAFRSLQKDDPSRYFDILKSMDGIMRPGEVTVVLGRPGSGCSTLLKTIASHTYGFKIGEESKISYDGLTPKDIENQFRGDVVYSAETDTHFPHLTVGDTLEFAAKLRTPQNRGNIDRETYAKHMASVYMATYGLSHTRNTNVGNDFVRGVSGGERKRVSIAEVSLCGSNIQCWDNATRGLDSATALEFIRALKTSATILDATPLIAIYQCSQDAYDLFDNVVVLYEGHQIFFGKADEAKEYFINMGWECPQRQTTADFLTSLTNPAERTPRPGFENSVPYTPKEFETHWKNSPQYKKLVEDIEEYFQKTDSDSHGEEYHQAHVARQSNHISPKSPFTVSFFMQTRYIMGRNILRLKGDPSIAIQSIFGQAVMGLILSSVFYNLQPVTDSFYYRGAAMFFAVLFNAFSSLLEIMSLFEARPIVEKHKQYALYRPSADALAGIITELPTKLFMSMSFNFVFYFMVHFRRDAGRFFFYWLMCIMCTLVMSHLFRSLGAVSNSLAGAMTPATVLLMAMVIFTGFVIPTPNMLGWSRWINYINPVAYVFEALMTNEFSGRDFECSQFVPAGPSYQGISPDQRICSTTGSRPGSEVVRGSEYLATSYEYYASHKWRNFGITVAFVVFFLFIYISLTEFNKGSMQKGEVALFLKSSLTDQKKKSGKSETTSKDIENSAIPDEKISQKDQLEANKETETAEKALPSSNDIFHWRDLTYQVKIKSEDRVILNHVDGWVKPGQLTALMGSSGAGKTTLLNCLSERVTTGVISDGVRMVNGHSLDSSFQRSIGYVQQQDLHLPTSTVREALRFSAQLRQPNSVTTKEKNDYVEYIIDLLDMYPYADALVGVAGEGLNVEQRKRLTIGVELVAKPKLLLFLDEPTSGLDSQTAWSICKLMRKLADHGQAILCTIHQPSALLLQEFDRLLFLQKGGKTVYFGDLGENCQTLINYFQKYGAHHCPEEANPAEWMLQVVGAAPGSHANQDYHEVWRSSSEYQGTQAELDNMERELVNLPVDESPEAKKSYAAPIWKQYLIVTKRVFQQNWRSPTYIYSKLFLVVSSALFNGFSFFKADRSMQGLQNQMFAMFMFLIPFNTLVQQMLPYFVKQRDVYEVREAPSKTFSWFAFVAAQITSEVPYQIFCGTIAFLCWFYPVGFYQNAVPTNSVDQRAVLMWMYICSFYVYTSTMGQLCMSFNELADNAANLATLLFTMCLNFCGVLAGPDVLPGFWIFMYRCSPFTYFIQGMLSTGLANTNAECSKAEFLHFKPNEGQSCGEYMSDYIKQAGGYLVDEKASSECQFCPMASTNDFLASVNSFYDERWRNWGIFICFIAINIILTIFFYWLARVPKGNREKKKK

SEQ ID NO: 48895 - protein, 393 aa, Mascagnia stannea
VIEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCLAPPVEVIQDERLPQPLSLCGSTLRSPHGCHAQYMTNMGTIASLVMSVTINEDDDMMDGDQQQQMTRKLWGLVVCHHTSPRFVPFPLRYACEFLIQVFGVQINKEVELAAQVREKHILQIQTMLCDMLLRDAPVAIITQSPNVMDLVKCDGAALYFKNKTWLLGVTPTEEQIRDIAEWLLEYHSGNTGLSTDSLMEAGYPGASVLGDGVCGMAAVSITSRDFLFWFRSHTAKEIKWGGAKHDPGDKDDGRKMHPRSSFKAFLEVVKWRSMPWEDVEMDAI

SEQ ID NO: 48896 - protein, 573 aa, Bacillus clausii KSM-K16
MLHSLKGIAASAGVAIAKAFVHEEPDFTIKQKEAKNPSDEIKRLDEALAISREELTAIKEKALNELGEDKAEIFSAHLLVLSDPELVDAVKAKVNEDSVTAEFALNEVANMFITMFENMDNEYMKERAADIRDVSRRVLGHLMGIEVVSLAAIEEDTIIIAHDLTPSDTAQLNPDVIKGFATNIGGRTSHSAIMSRSLEIPAVVGTKEATAKIENGALVIVDGIDGHVIVNPTEEELAAYEQKQADYEAQKAEWAKLVNKKTTTQDTHHVELAANIGTPKDLDGVINNGAEGIGLYRTEFLYMGRTELPSEEEQYEAYKEVVERMDGKPVVIRTLDIGGDKELPYLDLPHELNPFLGHRAIRLCLEKQDMFRAQLRALLRASAHGNLKIMFPMIATLEELRQAKQILHEEKDKLQASNVDVSDEMEVGIMVEIPSTAVAAPQFAKEVDFFSIGTNDLIQYTMAADRMNERVSYLYQPYHPAVLRLIDMVIQAAHAEGKWVGMCGEMAGDEIAIPLLLGLGLDEFSMSATSILPARSQISKLSKAELESFAQEALTKDTADGVEQLVRSKYSQS

SEQ ID NO: 48897 - protein, 1499 aa, Debaryomyces hansenii CBS767
MSTGSLSSAGRETKDINSQYELTDSSENNEIHEYEGFDNTATGDIRELARTVSHISREQTNKTSDSEDIVRYLSHFSSIPGVEPYTEAEDTLNPDSDLFDARLWVKNLRKLHDSDVEYFKPSSLGVAYRNLRACGVAADSDYQPTVLNGITKYLTDGFRYLQKDDPSRYFDILKSMDGIMRPGEVTVVLGRPGSGCSTLLKTIASHTYGFKIGEESKISYDGLTPKDIENQFRGDVVYSAETDTHFPHLTVGDTLEFAAKMRTPQNRGNVDRETYAKHMASVYMATYGLSHTRNTNVGDDFVRGVSGGERKRVSIAEVSLCGSNIQCWDNATRGLDSATALEFIRALKTSATILDATPLIAIYQCSQDAYDLFDNVVVLYEGHQIFFGKADEAKEYFINMGWECPQRQTTADFLTSLTNPAERVPRPGFENSVPYTPKEFETHWKNSPQYKKLVEDVEEYFQKTDSGNHGEEYHKAHVARQSNHISPKSSFTVSFFMQTRYIMGRNILRTKRNPSVAIQSIAGQAFIGITLGSMFYNLSATTETLYYRCATLFGAVLFNAFSSILEIMSLFEARPIIEKHKQYALYRPSADALAGIITELPTKLALSIAFNFFIYFLSNLRRDAGRFFFFWLMCCMCTLVMSHLFRSLGAISTSFAGAMTPATVLLLAMVIFAGFVLPTPSMLGWSRWINYLNPIAYVFEALMANEYTDRDFECSQFVPSGPGYEDRNSVHRICAATGSKAGSDVLHGDDYLSVSYEYYNFHKWRNFGITVGFIIFFLFVYITLTEFNKGSMQKGEVALFLKSSLTDQKKKSGKSETTSKDIENSAIPDEKISQKDQLEANKETETAEKALPSSNDIFHWRDLTYQVKIKSEDRVILNHVDGWVKPGQLTALMGSSGAGKTTLLNCLSERVTTGVISDGVRMVNGHSLDSSFQRSIGYVQQQDLHLPTSTVREALRFSAQLRQPNSVTTKEKNDYVEYIIDLLDMYPYADALVGVAGEGLNVEQRKRLTIGVELVAKPKLLLFLDEPTSGLDSQTAWSICKLMRKLADHGQAILCTIHQPSALLLQEFDRLLFLQKGGKTVYFGDLGENCQTLINYFEKYGAHHCPEEANPAEWMLEVVGAAPGSHANQDYHEVWKNSTEFQTVKDELANMETELVSLPRDESPEAKKSYATPIWKQYLIVTKRVFEQNWRSPIYIYSKVFLVVSSALFNGFSFFKADRSQQGLQNQMFAVFMFLVPFNTLVQQILPGFVKQRDVYEVRESPSKTFSWFAFITAQITSEIPYQVLVGTIAFLCWYYPVGFYENSVPTNTVDGRAVTMWLYITAFYVYTSTMAHVCISFNELADNAANLAINFFTMCLHFCGVLISPEAMPGFWVFMYRVSPLTYVVQGMMSTGLANNGLQCSSKELLRFEPTSGNTCGEYMSDYISQAGGYLVDSYATSECEYCTMNSTNDWLATFNAYYSERWRNWGIFLCYIAFNMIITVFLYWLARVPKGNREKKK

SEQ ID NO: 48898 - protein, 392 aa, Hiptage benghalensis
DLEPVNPADVPVTAAGALKSYKLASKAISRLQSLPSGNISLLCDVLVKEVRDLTGYDRVMVYKFHEDEHGEVVSECRRSDLGSYLGLHYPATDIPQASRFLFMKNKVRMICDCLAPPVKVIQDERLPQPLSLCGSTLRSPHGCHAQYMTDMGTIASLVMSVTINEDDDMMDGDQQQMARKLWGLVVCHHTSPRFVPFPLRYACEFLIQVFGVQINKEVELAAQVREKHILQIQTMLCDMLLRDAPVAIITQSPNVMDLVKRDGAALYFKNKTWLLGVTPTEEQIRDIAEWLLEYHSGNTGLSTDSLMEAGYPGASVLGDAVCGMAAVSITSRDFLFWFRSHTAKEIKWGGAKHDPDDKDDGRKMHPRSSFKAFLEVVKWRSMPWEDVEMDAI

SEQ ID NO: 48899 - protein, 129 aa, Brassica napus
MGCAGSTQSQGEGSVKKIRKPKPWKHTQPITKAELMKLREEFWDTAPHYGGRKEIWDALRAAAEADISLAQAIVDSAGVIVQNNDLTVCYDERGAKYELPKYVLSEPTNLGEDNWFLRDQDHFEKTRKM

SEQ ID NO: 48900 - protein, 602 aa, Oryza sativa (japonica cultivar-group)
MDSDYGVPRDLSALQKARALYRPDLPPCLQGTTVKVEYGDAAIAADVAGAHVISHAFPHTYGQPLAHFLRKTAAVPDATVITEHPVVRVGVVFSGRQSPGGHNVIWGLHDAIKAHNANSKLIGFLGGTDGLFAQKTLEISDEVLSSYKNQGGYDLLGRTRDQIRTTEQVNAAMTACQALKLDALVIIGGVTSNTDAAQLAETFAESKCSTKVVGVPVTLNGDLKNQFVETTVGFDTICKVNSQLISNVCTDALSAEKYYYFVRLMGRKASHVALECALQSHPNMVILGEEVAASKLTIFDITKQICDAVQARAEKDKNHGVVLIPEGLVESIPELYALLQEIHGLHDKGVSVENISSHLSPWASALFEFLPPFIRKQIETEKLLAQLVEAEMNKRLKEGTYKGKKFNAICHFFGYQARGALPSKFDCDYAYVLGHVCYHILAAGLNGYMATVTNLRSPVNKWKCGAAPITSMMTVKRWSRGPAASQIGKPAVHMASIDLKGKPYELLRQNSSSFLMEDIYRNPGPLQFEGPGGETKPISLCVEDRDYMGRIKQLQEYLEKVKSIVKPGCSQDVLKAALSAMASVTEMLTIMSSPSFSGQATI

SEQ ID NO: 48901 - protein, 474 aa, Propionibacterium acnes KPA171202
MADEIEFGTGGWRAIIADTFTRLNVERVAQALADRIHDENQEHRPVVIGYDQRFLSPEFAWWAAEVLAGNDIVVRIIDRPAPTPMIMWTVRDLGCAYGMAVTASHNPATYNGLKVFTEGGRDAKVEITEPIQHRANSISPKDIRRVHRTDALRDGVIEVQTSMNWYIDAILDHVDLEAIRHAHLKVVLDPMFGVSRTCLQTILMTARCDVDTIHERRDTLFGGRLPSPNSRTLQTLAQEVVERGADIGIATDGDADRLGIIDDQGHFLHPNQILVLLYTYLLEDKGWQGPCVRNLATTHLLDRVAEAHGQTCYEVPVGFKWVSSKMAETNAVIGGESSGGLTVQGHIAGKDGVYAGTLLVEMIAKRGKKLSQIYADIEERYGRLEMVEDDFSFAPEDKEYLKRRIYQDKDLPDFGLEVDHISDMDGVKVYFANGGWIIVRFSGTEPLLRVFCEMPVAQMARECIDKVVKHYHFE

SEQ ID NO: 48902 - protein, 279 aa, Aspergillus nidulans FGSC A4
MEWDPTQFFREDDTPRQPFVLLVLNQPINETALAVLWKHDGGANRFFEWTKSKGRENDDLPTTIVGDMDSARSEVRTHYSNLGVNIVQDGDQYTTDFTKSLRYIRKHESDILSSAGLSSNDKLSILILGGLGGRVDQAFSQVHHLYMMNQNQAETNGDLYLISEESISFVLQPGQNTIHVPRTNRPRSTDRYQSPPIPTPDEEHGKHLLEENVGIIPVSGPARITTSGFEWDVQNWQTEIGGQLSTSNHIRAEIVTVQTNVSVLFTVELARRLKRSARW

SEQ ID NO: 48903 - protein, 278 aa, uncultured bacterium
QPNAMGGREVGGLANQLAAHLYFEDDKEIDLVKRFWQAPNMATQQGLKAVDMFNAVDEGKIKAIWIIATSPVVSMPNANLIKRALKKCPMVVLNECYEGSDTIKYADVILPATTWGEKHGSVTNSDRTISIQRGMVTAPGEARNDWQIVCEVAKKMGFKNAFDYKHSVEIFREHAAISGFENSHPTTVNRSDNDIYRVFDISALAQISNEAYDNFTPTKWPININNPYGTQRLYSDNVFTHKSTKANFIAITPRLPFYAPTEHQVIMNTGRIRDQWHT

SEQ ID NO: 48904 - protein, 268 aa, uncultured bacterium
QPNAMGGREVGGLANMLAAHMDYNEENTSTVSEFWDTKNLTKTPGLKAVDLFEAVADGRIKAIWIMGTNPVVSMPDADRVRAALQACDTVIVSDCVADTDTTATANILLPASGWGGKSGTVANSERRISRQRALVKPVDQAKSDWWIISQVGQAMGFNNAFDYHSPRDIFIEHAKLSGFKNTGNRLFNISTLSHLSEQQYNQLEPIQWPVTPLKPKGAARLFEDKLFFTPSKKANFVVINPQLPQCHTPSDDFPLTLNTGRIRDQWHT

SEQ ID NO: 48905 - protein, 571 aa, Porphyridium purpureum
MVQIYNGGAGFERALSRGKSKDGKPKATAAATAAPAASSSAAPARAAPARAAPAAAAPVSKPTAEKPAVAQDATLVKLAAGMGVMSDLEKKFIELEAKLVAQPAGQAMPGKSNIFANNEAWRQEMLKQDPEFFNRLANGQSPEYLWIGCADSRVPANQLLDLPAGEVFVHRNIANQCIHSDISFLSVLQYAVQYLKVKHILVCGHYGCGGAKAALGDSRLGLIDNWLRHIRDVRRMNAKYLDKCKDGDEELNRLIELNVLEQVHNVCATSIVQDAWDAGQELTVQGVVYGVGDGKLRDLGVVVNSSDDISKFYRTKSDSGALKAGNPNAPLVQVTKGGESELDSTMEKLTAELVQQTPGKLKEGANRVFVNNENWRQKMLKQDPQFFSNLAHTQTPEILWIGCADSRVPANQIINLPAGEVFVHRNIANQCIHSDMSFLSVLQYAVQYLKVKRVVVCGHYACGGCAAALGDSRLGLIDNWLRHIRDVRRHNQAELSRITDPKDSLNRLIEINVLEQMHNVCATSIVQDAWDAGQELEVQGVVYGVGDGKLRDMGVVAKANDDIGQIFRTKQ

SEQ ID NO: 48906 - protein, 268 aa, uncultured bacterium
QPNAMGGREVGGLANMLAAHMDYNEENTSTVSEFWDTKNLTKTPGLKAVDLFEAVADGRIKAIWIMGTNPVVSMPDADRVRAALQACDTVIVSDCVADTDTTATANILLPASGWGEKSGTVTNSERRISRQRALVKPVDQAKSDWWIISQVGQAMGFNNAFDYHSPRDIFIEHAKLSGFKNTGNRLFNISTLSHLSEQQYNQLEPIQWPVTPLKPKGTARLFEDKLFFTPSKKANFVVINPQLPQCHTPSDDFPLTLNTGRIRDQWHT

SEQ ID NO: 48907 - protein, 111 aa, Zea mays
  misc_feature (19)..(19): Xaa can be any naturally occurring amino acid
  misc_feature (21)..(21): Xaa can be any naturally occurring amino acid
CFGSIITIIGGPGIKCFGXPXHATYQEFSVRMHADLHINPYYGKTLSKGIISLYEVDLAIATNMIYYVLSSSAQYIHAEVILAIDGYTNMSNVIECVVHANAKHFADDGIT

SEQ ID NO: 48908 - protein, 571 aa, Porphyridium purpureum
MVQIYNGGAGFERALSRGKSKDGKPKATATATAAPAASSSAAPARAAPAKAAPAAAAPVSKPTAEKPAVAQDATLVKLAAGMGVMSDLEKKFIELEAKLVAQPAGQAVPGKSNIFANNEAWRQEMLKQDPEFFNRLANGQSPEYLWIGCADSRVPANQLLDLPAGEVFVHRNIANQCIHSDISFLSVLQYAVQYLKVKHILVCGHYGCGGAKAALGDSRLGLIDNWLRHIRDVRRMNAKYLDKCKDGDEELNRLIELNVLEQVHNVCATSIVQDAWDAGQELTVQGVVYGVGDGKLRDLGVVVNSSDDISKFYRTKSDSGALKAGNPNAPLVQVTKGGESELDSTMEKLTAELVQQTPGKLKEGANRVFVNNENWRQKMLKQDPQFFSKLAHTQTPEILWIGCADSRVPANQIINLPAGEVFVHRNIANQCIHSDMSFLSVLQYAVQYLKVKRVVVCGHYACGGCAAALGDSRLGLIDNWLRHIRDVRRHNQAELSRITDPKDSLNRLIEINVLEQMHNVCATSIVQDAWDAGQELEVQGVVYGVGDGKLRDMGVVAKANDDIGQIFRTKQ

SEQ ID NO: 48909 - protein, 268 aa, uncultured bacterium
QPNAMGGREVGGLANMLAANMDYNEENTSTVSEFWDTKNLTKTPGLKAADLFEAVADGRIKAIWIMGTNPVGSMPDADRVRAALQACDTVIVSDCVADTDTTATANILLPASGWGEKSGTVTNSERHISRQRALVKPVGQAKSDWWIISQVGQAMGFNNAFDYHSPRDIFIEHAKLSGFKNTGNRLFNISTLSHLSEQQYNQLEPIQWPVTPLKPKGTARLFEDKLFFTPSKKANFVVINPQLPQCQTPSDDFPLTLDTGRIRDQWHT

SEQ ID NO: 48910 - protein, 268 aa, uncultured bacterium
QPNAMGGREVGGLANMLAAHMDYSVENTATVREFWNTKNLSQTPGLNAVDLFEAVADGRIKAIWIMGTNPVGSMPNADRVRAALQSCDTVIVSDCMADTDTTATANILLPATGWGEKSGTVTNSERRISRQRALIHPVGQARSDWWIISQVGQAMGFNDAFDYHSPQRYFYRTCPTKCVKNTGNRLFNISTLSHLSEQQYNQLEPIQWPVTPLKPKGTARLFEDRLFFTPSKKANFVVISPQLPQLHTPNNDFPLTLNTGRIRDQWHT

SEQ ID NO: 48911 - protein, 446 aa, Oryza sativa (japonica cultivar-group)
MRALLPRLPRRQRRPGPELRVPARGLLEARVPWVRDRALDHVVERERHLVPFLLAKDALLSAAPPPHAVPLHSLPSTIPFPFRPLRFLRLYTSAFALSPHPVAVSPTPRLAGIHSAEAQVLDSTRADAADRLLRLLMLAPARALPLHLVARLRLDLGLAPDFPRSLLPNYPDYFALSRDGALLELVCYRKDLAVSAMQSYAQRTGGYKVGDAVPFPLSFPRGFELDKKVRKWLDDWQRLPYISPYEDGSHLTPRSDITEKRTAAVLHEVLSLTVGKKMEKEVLVKLGEALRLPPGFRKVLARHPGIFYLSHKLRTQTVVLRESFRRHMLVDKHPMMGIRYQYLHLMHMGQEEAGKRKGKGRKTVRGEQMIGEEFGAEGENDDEEDEEYDDDEEEDMEAGVASGDEDSDDDDDDEEGEKEDMEAGVASRDEDSDDEDADDTDHAAKG

SEQ ID NO: 48912 - protein, 392 aa, Callaeum septentrionale
DLEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMTNMGTIASLVMSVTINEDDDMMDGDQQQMTRKLWGLVVCHHTSPRFVPFPLRYACEFLIQVFGVQINKEVELAAQVREKHILQIQTMLCDMLLRDAPVAIITQSPNVMDLVKCDGTALYFKNKTWLLGVTPTEEQIRDIAEWLLEYHSGNTGLSTDSLMEAGYPGASVLGDAVCGMAAVSITSRDFLFWFRSHTAKEIKWGGAKHDPDEKDDGRKMHPRSSFKAFLEVVKWRSMPWEDIEMDAI

SEQ ID NO: 48913 - protein, 447 aa, Enterococcus faecalis
  misc_feature (42)..(42): Xaa can be any naturally occurring amino acid
MKVIVLGSSHGGYEAVEELLNLHPDAEIQWYEKGDFISFLSXGMQLYLEGKVKDVNSVRYMTGEKMESRGVNVFSNTEITAIQPKEHQVTVKDLVSGEERVENYDKLIISPGAVPFELDIPGKDLDNIYLMRGRQWAIKLKQKTVDPEVNNVVVIGSGYIGIEAAEAFAKAGKKVTVIDILDRPLGVYLDKEFTDVLTEEMEANNITIATGETVERYEGDGRVQKVVTDKNAYDADLVVVAVGVRPNTAWLKGTLELHPNGLIKTDEYMRTSEPDVFAVGDATLIKYNPADTEVNIALATNARKQGRFAVKNLEEPVKPFPGVQGSSGLAVFDYKFASTGINEVMAQKLGKETKAVTVVEDYLMDFNPDKQKAWFKLVYDPETTQILGAQLMSKADLTANINAISLAIQAKMTIEDLAYADFFFQPAFDKPWNIINTAALEAVKQER

SEQ ID NO: 48914 - protein, 109 aa, Magnetospirillum magnetotacticum MS-1
MNNPVFDRIRQDISENDVVLYMKGTPMFPQCGFSAAVVQVLTNLGVKFKGIDILVDPSLRDGIKQFTNWPTLPQLYVKGEFVGGCDIVREMAESGELKQLMADKGVASA

SEQ ID NO: 48915 - protein, 392 aa, Mascagnia hippocrateoides
DLEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMTNMGTIASLVMSVTINEDDDMMDGDQQQMTRKLWGLVVCHHASPRFVPFPLRYACEFLIQVFGVQINKEVELAAQVREKHILQIQTMLCDMLLRDAPVAIITQSPNVMDLVKCDGAALYFKNKIWLLGVTPTEEQIRDIAEWLLEYHSGNTGLSTDSLMEAGYPGASVLGDAVCGMAAVSITSRDFLFWFRSHTAKEVKWGGAKHDPHDKDDGRKMHPRSSFKAFLEVVKWRSMPWEDIEMDAI

SEQ ID NO: 48916 - protein, 385 aa, Picrophilus torridus DSM 9790
MLNGFNTRAVQAGDLKIREIGNVVTPIFENSTFIYPNSESEYMDSSSGMPYIYSRWGNPTVQSLEDKYRVLENTGHAVAFSSGMGAITAAVLSNIKKKRILSIMDLYGQTFQFFSRTLKTLGIHVDFIDVDKLNNLDFDAKNYDLVYAESITNPLLKVIDIKNVASFCHENDVLFIDDATFASPYNQNPVELGADIVVHSATKYISGHSDVIIGIAGTNNYYNNLIEMRKTLGASPDAFQAYLSYRGLKTLGLRMERHNKNAMELARFLRDSKKVLNVNYPGLDDNKYHGIAGKEMRGYGGMLSFTLNSMEDAHKLIKNLEIPAYAASLGGVESLITMPVETTHASLSPEERRSLGISDSLVRFSTGIEDIDDIIKDFENALSKL

SEQ ID NO: 48917 - protein, 392 aa, Hiraea fagifolia
DLEPVDPADVPVTAAGALKSYKLAAKAISRLQSLPSGNISLLCDVLVKEVRDLTGYDRVMVYKFHEDEHGEVVSECRRPDLESYLGLHYPATDIPQASRFLFMKNKVRMICDCLAPPVKVIQDKRLPQPLSLCGSTLRSPHGCHAQYMTNMRTIASLVMSVTINEDDDTMDGDQQQMTGKLWGLVVCHHTSPRFVPFPLRYACEFLIQVFGVQINKEVELAAQVREKHILQIQTMLCDMLLRDAPVAIITQSPNVMDLVKCDGAALYFKNKIWLLGVTPKEEQIRDIAEWLLEYHSGNTGLSTDSLMEAGYPGASVLGDAVCGMAAVSITSRDFLFWFRSHTAKEIKWGGAKHDPGDKDDGRKMHPRSSFKAFLEVVKWRSMPWEDVEMDAI

SEQ ID NO: 48918 - protein, 392 aa, Ectopopterys soejartoi
DLEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCMAPPVEVIQDERLPQPLSLCGSTLRSPHGCHAQYMTNMGTTASLVMSVTINEDDHMMDGDQQQMTKKLWGLVVCHHTNPRFVPFPLRDACEFLIQVFGVQINKEVELAAQVREKHILQIQTMLCDMLLRDAPVAIITQSPNVMDLVKCDGAALYFKNKTWLLGVTPTEEQIRDIAEWLLEYHSGNTGLSTDSLMEAGYPGASALGDAVCGMAAVSITSRDFLFWFRSHTAKEIKWGGAKHDPDDKDDGRKMHPRSSFKAFLEVVKWRSMPWEDVEMDAI

SEQ ID NO: 48919 - protein, 709 aa, Metallosphaera hakonensis
MVFETRDRPLRPGRPYPLGSNWIEEEDGVNFSLFSENAEKVEIVLFSNKNDPKEVIEVKNRTGDIWHTFVPGLIPGQLYGYRVHGPYKPEVGLRFNPNKVLIDPYAKAVSGPVKWDDSLFGYKIGDQAQDISFDERDSSGFIPKSVVIDPHFDWDDDFHKRRPELKDTIIYETHVKGATKLRLDLPEEIRGTYLGLSSRQMIEYLKDFGFTSVELMPVYQFIDQRFFVEKGLANYWGYDPINFFSPECRYSSSGCEGGQVIEFKRMVNELHNAGIEVIIDVVYNHTAEGNHLGPTLSFKGIDNLAYYMLVPDNKRFYLDFTGTGNTLNLSHPRVIQMVLDSLRYWVTEMHVDGFRFDLAAALARELYNVNMLNTFFITIQQDPILSQVKLIAEPWDVGPGRYQVGNFPHMWAEWNGKYRDTMRRFWRGEQLPYSEVANRLMGSPDIYLGNNKTPFASINYITSHDGFTLEDLVSYDQKHNEVNGFNNQDGMNDNFSWNCGAEGPTDDPKVWECREKQKRNFLITLMVSQGVPMILGGDELSRTQRGNNNAFCQDNEVSWYDWNLDERRAKFQEFVMRMVRFYRAHPVFRRSKYFQGKKLHGIPMKDVTFLTPDGKEVDEQTWNSPTQTVVVLLEGSAMDENNSRGERIADDSFLIVLNANPNAIKLNPPRGKWRLVVSSMREEKVDVVESGKEVEIEGRTALVFRRIES

SEQ ID NO: 48920 - protein, 1053 aa, Ustilago maydis 521
MSYHVIHYRRFTIGFADLTHRRSTHDVRQFALELATVTGKGGFDMHIQLAVPERSIILKTASASASPSTSASPSACASSFSSPSPHLTLSSRLDRAPKMSSSSPSSASASSRRPLVGVSFKMYFDIPKTKAYVDETISLLSSTLPSLGQPIDVFVIPDFITLTSVAAQICSSSSTLLLGAQDVHSHDFGAFTGEVSPNVLSQVGVKLVEIGHAERRRYFGETDQDVANKAAAIAKNGMVPLICIGEVSRPKNLDQLSIQDVDLVVNECWRQIQPALDAIESHVDVVLAYEPVWAIGQPQPASPDYVVKITKALRKRYNKEYVDSHKARSDASLRILYGGSAGPGSLINPRLLSIPSRKSPVQTSRLQNTPLVQVRALVPILMLLPQHLERSLSLLGHVFLLAHHHLCTRRLGITIEAIASLTIQTSTSSIGDLERIVKLVLRERKDDTDHREKSSYELLYCTPTELNASVRGGGGANSLSSKGSVWWARCVSIRGQRSRYRQRIPRYSTPSCSGCIIHPTAVNIRSQSKTCHLLATTPPSDKGIEVRLPVITTNMQPSSRNRSTCVETRSKCVSNQAAVAASYASCFPSRRRGWQNEARGSSALSIMFSQIQAPIATLPFGSELHRYPIGLAPSTKPRSGLCPQLGCNNFISIRFARCRFVIRDILRFILDSRKSRRLTAFHPGNLILTTSSKLGGAQEKEKQEQRAPTMMTSRFLVSGNPATDPKAAAQWLAEQRRRPIRAPHKTVQYGELVITRGGLSSVSKEDLWSILEQVAIAAIEVARFDLAELCISRLSSRFANSQRVTSLQGMLLEGQAKSRDAIRLYESVLETEQTSLILSRRRIGAIKSTGDIKQTLHALNSHLDIFYNDPEAWQELAEVYATQSMYAQSAFALEELLLQVPQNGFFQLKYAETLYTAAELTKSYKAYLRVLEMCQSDAATTQPVAPNTTAAHGAWLRALWGTKMVSTQLHYFRTLQTETDPNPDDLICIDLAKVTTALIATPPRASSTDDAIDQAKVLKIDELVTKLLLTNVYTPQAVACKHLRDVARAVLAA

SEQ ID NO: 48921 - protein, 392 aa, Stigmaphyllon paralias
DLEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMTNMGTIASLVMSVTINEDDDTMDGDQQQMTRKLWGLVVCHHTSPRFVPFPLRYACEFLIQVFGVQINKEVELAAQIREKHILQIQTMLCDMLLRDAPVAIITQSPNVMDLVKCDGAALYFKNKTWLLGVTPTEEQIRDIAQWLLEYHSGNTGLSTDSLMEAGYPGASALRDAVCGMAAVSITSRDFLFWFRSHTAKEVKWGGAKHEPDDKDDLRKMHPRSSFKAFLEVVKWRSMPWEDVEMDAI

SEQ ID NO: 48922 - protein, 566 aa, Bacillus clausii KSM-K16
MASDEKRWFQHYPKQVRPFLDYEDVPLQHFFKQSANRFPQHEAIHFLGKTLSYEELYDQTLRFANRLQKLGVKKGDRVAIMLANSPQSVIGYYAVLMVGGVVVQTNPLYVERELEHQLADARAKVILCLDSVLPKVEKVMARTSLELVIVTSIAEYLPFPKNMLFPFVQKKQGIPKVKVTYSERVLPFARLVKEGEALEPEVEMNADDLALLQYTGGTTGLAKGVMLTHRNLVVNAVQCDAWLYKTEERSERVLGVMPFFHVYGMTTVMNFAVKTAATMVLLPKFKPEEVLRTIEKQRITLFPGAPTMYVALVNNERIHQYDLTSIKACISGASALPLEVQQKFEAQTKGRIVEGYGLTETSPVVCANPIWEKRKTGSVGIPWPDTDVMVYSLEKDGEAEIGEVGELFVRGPQVMKGYWMRPEETAQTFHGEWLKTGDMARMDEEGYVYIVDRKKEIIIAGGFNIYPREVEEVLFEHEAVVQAAVIGVPDEYRGETVKAFIVLKAGETISEKEMEAYCRQKLAAYKIPRLYEFRDELPTTLTGKILKRVLISEEQARKEEQAQQEA

SEQ ID NO: 48923 - protein, 308 aa, Escherichia coli O157:H7 EDL933
  misc_feature (210)..(210): Xaa can be any naturally occurring amino acid
MLELQEASRLPERLGDDFVRAANIILHCEGKVVVSGIGKSGHIGKKIAATLASTGTPAFFVHPAEALHGDLGMIESRDVMLFISYSGGAKELDLIIPRLEDKSIALLAMTGKPTSPLGLAAKAVLDISVEREACPMHLAPTSSTVNTLMMGDALAMAVMQARGFNEEDFARSHPAGALGARLLNKVHHLMRRDDAIPQVALTASVMDAMXELSRTGLGLVAVCDAQQQVQGVFTDGDLRRWLVGGGALTTPVNEAMTVGGTTLQSQSRAIDAKEILMKRKITAAPVVDENGKLTGAINLQDFYQAGII

SEQ ID NO: 48924 - protein, 214 aa, Triticum aestivum
  misc_feature (133)..(133): Xaa can be any naturally occurring amino acid
  misc_feature (141)..(141): Xaa can be any naturally occurring amino acid
  misc_feature (151)..(151): Xaa can be any naturally occurring amino acid
MFLKGGEFPGYRRPTRPQAIYPHSTAMAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGXYYDGRYWXTMWKLPMFGXCTDATQVINEVEEVKKEYPGRLWSASLGFKQTCRKGEKAVSFNPPFKTTGAGTGSSGKGTKTG

SEQ ID NO: 48925 - protein, 268 aa, uncultured bacterium
QPNAMGGREVGGLANMLAAHMVYSVENTATVREFWNTKNLSQTPGLNAVDLFEAVADARIKAIWIMGTNPVVSMPNADRVRAALQSCDTVIVSDCMADTDTTATANILLPATGWGEKSGTVTNSERRISRQRALIHPVGQAKSDWWIISQVGQAMGFNDAFDYHSPRDIFIEHAQLSAFKNTGNRLFNISTLSHLSEQQYNQLEPIQWPVTPLKLKGTARLFEDRLFFTPSKKANFVVISPQLPQLHTPNNDFPLTLNTGRIRDQWHT

SEQ ID NO: 48926 - protein, 268 aa, uncultured bacterium
QPNAMGGREVGGLANMLAAHMDYSVENTATVSEFWNTKNLSQTPGLNAVDLFEAVADGRIKAIWIMGTNPVVSMPNADRVRAALQSCDTVIVSDCMADTDTTATANILLPATGWGEKSGTVTNSERRISRQRALIHPVGQAKSDWWIISQVGQAMGFNDAFDYHSPRDIFIEHAQLSAFKNTGNRLFNISTLSHLSEQQYNQLEPIQWPVTPLKPKGTARLFEDRLFFTPSKKANFVVISPQLPQLHTPNNDFPLTLNTGRIRDQWHT

SEQ ID NO: 48927 - protein, 260 aa, uncultured bacterium
QPNAMGGREVGGMANLLAVHKDLHNEEHRREVAQFWGVDKISPKPGLTATEMFDALESGKLKAVWIACTNPLVSMPNSHQIEKAMANSKFVVVQEISHKSDTLQYADLVLPAAAWLEKEGTMTNSERRISYLPKEIEAPGEARPDVEIFCDFAQRMGFRGFNYNSTSEIYDEYASMTKGTNIDVSFLNYDRLKTEGTFQWPVNEYRHKGTPRLFEDKKFYTASQKAIFNIPSTIENTSVKTNDEFPLILTTGRVRDQWHT

SEQ ID NO: 48928 - protein, 724 aa, Oryza sativa (indica cultivar-group)
MPSLATIGAVVFQLLVTTTTLSAAAPTPIALPGCPESCGGIQVPYPFGIGDGCSYHGFNLTCDDEAHHHQTPPKLFMATDNGTVVQVLNISLPDGTVRVRSKLSQSSIAGSSSSSNASSSRSDLPADGPFTVSSAYNWLVAFGCNIVADLTPYGNIAEGSSCAATCPLVLRHRALPYVRWEGCPLVHDPAAFVAEQGWFSANENAMLYNFTNWLPFTVESVPVVLEWWLDLIRDGAILPLSVGPNTTDFRCLSLHSSSYYNDLNYDRRRCNCSQGYKGNPYIRDGCRDIDECQQPDVYPCHGTCINMPGTYRCLAKKSVKSLPGLITIIAVSAGFGLLFSLLGVAKITNKIKQRRAKKLRRKFFKKNHGLLLQQLISSNKDIAERMKIFSLEELDQATNKFDQNHILGGGGHGTVYKGILSDQRVVAIKKSKIVVQREIDDFINEVVILSQTNHRNVVKLYGCCLETEVPLLVYEFISNGTLSFHLHGQNENPLKWKDRLRIALETARAIAYLHSAASISVLHRDIKSANILLTDTMTAKVSDFGASRSISIDETGILTVIQGTYGYLDPEYYYSSRLTEKSDIYSFGVILAELLTRVTPVFSSETSERTSLASYFVSFIRDNRLSDILDSQIVNEVGAEDAKVVAKLAEACLRLKGEERPTMRQVETTLEDVQRSKVQLNHQIARVSNSNTLKNQTYEGSKCYEGTRQYSLEKEFIQSSEFPR

SEQ ID NO: 48929 - protein, 289 aa, Solibacter usitatus Ellin6076
MPLDPEVAAHLELQRHLPPRSSLDIAATREMMRRAAALSGPPPLLPRVEDIALPTGLRARQYWPALDPALPLTVYFHGGRFFSGDLESHDTICRLLALASASRVLAVDYRLAPEHPFPAAVEDARTALAWALLQDVPVAVAGDSAGANLAAVAALDHRHSLRLRCQLLIYPMIDAVCASHSYTEFAEGYGPGAADMRRGWSEYLPAGSDPRDPLASPLYTPDLTGAAPALVITAEYDTLRDEAESYARRLSAPVQRYPGAIHGFFLMQSPLALARQSLQDAAAFLRHHL

SEQ ID NO: 48930 - protein, 260 aa, uncultured bacterium
QPNAMGGREVGGMANLLAVHKDLHNEEHRREVAQFWGVDKISPKPGLTATEMFDALESGKLKAVWIACTNPLVSMPNSHQIEKAMANSKSVVVQEISHKSDTLQYADLVLPAAAWLEKEGTMTNLERRISYLPKEIEAPGEARPDVEIFCDFAQKMGFRGFNYNSASEIYDEYASMTKGTNIDVSFLNYDRLKTEGTFQWPVNEYRHKGTPRLFEDKKFYTASQKAIFNIPSTIENTSIKTNDEFPLILTTGRVRDQWHT

SEQ ID NO: 48931 - protein, 333 aa, Pichia pastoris
MAITVGINGFGRIGRLVLRVALSRADIKVVAINDPFIAPEYAAYMFKYDSTHKAYKGEVSASGNKINIDGKEITVFQERDPVNIPWGKAGVDYVIESTGVFTTLEGAQKHIDAGAKKVVITAPSKDAPMFVVGVNEEKYTSDLNIVSNASCTTNCLAPLAKVVNDTFGIDSGLMTTVHSMTATQKTVDGPSHKDWRGGRTASGNIIPSSTGAAKAVGKVIPELNGKLTGLAFRVPTVDVSVVDLTVNLKKETTYEEIKSVIKAASEGKLKGVLGYTEDAVVSSDFLGDERSSIFDASAGIQLTPSFVKLISWYDNEYGYSTRVVDLLQHVAKA

SEQ ID NO: 48932 - protein, 267 aa, uncultured bacterium
QPNAMGGREVGGLAGLLAAHMDYSLENIATVAEFWGTDSVSCEPGLKAIDLFDAVADGRIKAIWIMGTNPVVSMPNADTVMAALENCDTVIVSDCIAETDTTATANILLPATGWGEKEGTVTNSERRISRQRSLLPPLGEARHDWWIMCQVAQAMGYQKGLSYSSPRDIFIEHAALSTFKNKGNRLFNIGALSALSEAGYDQLDPIQWPVTAQNSIGTKRLFMDDKFLTPSGKAQFIGSTAELPRQSLSDRFPLALNSGRIRDQWHT

SEQ ID NO: 48933 - protein, 194 aa, Debaryomyces hansenii CBS767
MTDILKITNTNPRGIPEAPFIDKVEDYVKNPDVDFDKVISAFQDRLQQYKFMEVSKKQQLGDLNVKIPDIEKNLNIISHIKETKKSDDEEDKTIETNFELNDTLYTRAAIDASSLESVYLWLGAEVMLEYPLDEAIELLNDRLKSNTAQLGLVKEDLEFLKENITTMEVNTARLYNWDVERRKKLRATEGGAKN

SEQ ID NO: 48934 - protein, 392 aa, Lasiocarpus sp. Anderson 13834
DLEPVNPADVPVTAAGALKSYKLAAKAISRLQSLPGGNISLLCDVLVKEVRDLTGYDRVMVYKFHEDEHGEVVSECRRSDLESYLGLHYPAIDIPQASRFLFMKNKVRMICDCLAPPVKVIQDKRLSQPLSLCGSTLRSPHGCHAQYMANMGTIASLVMSVTVNEDDDMIDGDQQQMARKLRGLVVCHHTSPRFVPFPLRYACEFLIQVFGVQINKEVELAAQVREKHILRIQTMLCDMLLRDAPVAIITQSPNVMDLVKCDGAALYYKNKFWLLGVTPTEAQIRDIAEWLLEYHSGNTGLSTDSLMEAGYPGASVLGDAVCGMAAVSITSRDFLFWFRSHTAKEIKWGGAKHDPEDKDDGRKMHPRSSFKAFLEVVKWRSLPWEDVEMDAI

SEQ ID NO: 48935 - protein, 379 aa, Picrophilus torridus DSM 9790
MVSSRLSQISESATVSMSNRASELRKAGKKLYNFGIGEPDMTTPDNIIKMAFDDAMSGKTHYTPSAGIPELREKIALKMKSKNNIDVVAKNVLVTPTKFSINLALYTIIDPGDEVLIPSPYYVSYPDIVKINSGKPVFADCDDEYNIDIDNLRRAITPKTRAILINNPVNPTGKVLSEKNIRETVDFALENNLYIISDEIYEDIIYRGKMFSPASIPEAFDKTVTVSGFSKSYAMTGWRVGYMVAPEEIIKSADKIQQQTLTCAPSISQYAALHALDDDDSVKHIRETFEKRRDLVVSLLKETNLHFYEPEGAFYVFPGYESDVKSYDAAMNLLENKNVIVTPGAPFGSEYHFRISFATSEDDIKNGIPLIGEYFKSIS

SEQ ID NO: 48936 - protein, 392 aa, Ptilochaeta nudipes
DLEPVNPVDVPVTAAGALKSYKLAAKAISRLQSLPGGNISLLCDVLVKEVRDLTGYDRVMVYKFHEDEHGEVVSECRRSDLESYLGLHYPATDIPQASRFLFMKNKVRMICDCLAPPVKVIQDERLSQPLSLCGSTLRSPHGCHAQYMANMGTIASLVMSVTVNEDDDMMDGDQQQMARKLWGLVVCHHTRPRFVPFPLRYACEFLIQVFGVQINKEVELAAQVREKHILRIQTMLCDMLLRDAPVAIITQSPNVMDLVKCDGAALYYKNKFWLLGVTPTEAQIREVAEWLLEYHSGNTGLSTDSLMEAGYPGASVLGDAVCGMAAASITSRDFLLWFRSHTAKEIKWGGAKHDPEDKDDGRKMHPRSSFKAFLEVVKWRSLPWEDVEMDAI

SEQ ID NO: 48937 - protein, 392 aa, Ptilochaeta bahiensis
DLEPVNPADVPVTAAGALKSYKLAAKAISRLQSLPGGNISLLCDVLVKEVRDLTGYDRVMVYKFHEDEHGEVVSECRGSDLESYLGLHYPATDIPQASRFLFMKNKVRMICDCLAPPVKVIQDKRLSQPLSLCGSTLRSPHGCHAQYMANMGTIASLVMSVTVNEDDDMMDGDQQQMARKLWGLVVCHHTSPRFVPFPLRYACEFLIQVFGVQINKKVDLAAQVREKHILRIQTMLCDMLFRNAPVAIITQSPNVMDLVKCDGAALYYKNKFWLLGVTPTEAQIREIAEWLLEYHSGNTGLSTDSLMEAGYPGASVLGDAVCGMAAVSITSRDFLFWFRSHTAKEIKWGGAKHDPEDKDDGRKMHPRSSFKAFLEVVKWRSLPWEDVEMDAI

SEQ ID NO: 48938 - protein, 404 aa, Oryza sativa (indica cultivar-group)
MASSSSSSSSSPPPPPPRRSVFDAAYIRAEFAAAGISPHFIPLIWKYVLQNPRCGDLDAVPSLPAAAYALLRQKFQPTTSTLTTAAESKDHTTTKLLIRLKLQFDLNLVTLLSDNKHNGESVEAVIMRYDTRLGKYDGKPRPGGVRSTLCVSSQVGCKMGCRFCATGTMGFKSNLSSGEIVEQLVHASRYSQIRNVVFMGMGEPLNNYTALVEAIQVLIGSPFQLSPKRITVSTVGIIHSINKFNNDLPNINLAVSLHAPDQDIRCHIMPAARAFPLVKLMNALQSYQNESKQTIFIEYIMLDGVNDQEQHAHQLGKLLEMFKAVVNLIPFNPIGSSNNFKTSSEHNVKKFQKILRGIYNIRTTIRQQMGQDIAGACGQLVVSLPDERSAGGATLLSDIEDIRI

SEQ ID NO: 48939 - protein, 392 aa, Dinemandra ericoides
DLEPVNPADVPVTAAGALKSYKLAAKAISRLQSLPSGNIPLLCDVLVKEVRDLTGYDRVMVYKFHEDEHGEVVSECRRSDMESYLGLHYPATDIPQASRFLFMKNKVRMICDCLSPPVEVIQDERLPQPLSLCGSTLRSPHGCHAQYMANMGTIASLVMSVTVNEDDDMMDGDQQRMARKLWGLVVCHHTSPRFVPFPLRYACEFLIQVFGVQINKEVDLAAQVREKHILRIQTMLCDMLLRDAPVAIITQSPNVMDLVKCDGAALYYKNKFWLLGVTPTEAQIRDIAEWLLEYHRGNTGLSTDSLMEAGYPGASVLGDAVCRMAAVSITSRDFLFWFRSHTAKEIKWGGAKHDPGDKDDGRKMHPRSSFKAFLEVVKWRSLPWEDMEMDAI

SEQ ID NO: 48940 - protein, 495 aa, Debaryomyces hansenii CBS767
MMMKPFSRISIKEQNNDQAEEKKNEIPAKEEAPAQVETTSGAIETKAEEPAYGTPVQQQAAVPVAAPAQPEQNAIPPPPPVSDQMSGQMPGQMQGQMPGQMPGQMPGQMPGQMPGQMPGQMPGQPPQMPDFQQMQQMQQQFQGGMPLPPQPPQPPQPQQLPPSNMGKDHGKMFIGGLNWDTTEQGLVEYFTKYGEVIDHTIMRDNNTGKSRGFGFLTFKDPKSVDEVIKTDHILDGKLIDPKRAIAREEQDKVGKIFVGGIDPMVNEKDFNDFFSQFGSIIDAQLMIDKDTGRSRGFGFITYDSPDAVDRVTVNKYLTLKGKSMEVKRAEPRGQHQQNQMQQQQQQQQPYNYGNYGNQYGQTQYQQPGMASYGQGMNGMSPEMMQEYWQRMQQWYMYQQQQQQAQGSTGDYNQQSEQPEQPLNPQQQAPTESQDNQEPENGSDSSGTPSGPSRRMNLPKGPRRAPPSGPSGNSRGRGGYQNRNRGYHPYTRGGRR

SEQ ID NO: 48941 - protein, 224 aa, Anabaena variabilis ATCC 29413
MPIKRIIAGLNEFHDNYFVAHRELFEHLSHGQNPELLFITCSDSRIDPFLITQSQPGDLFVIRNVGNIIPPYSRLNGGEAAGIEYAVEALGIKDIVICGHSHCGAMKGLLQIGNLAQQMPSVYEWLRCHAEATRRLVMDNYQGYSHEKLLKIAIEQNVLTQIENLETYPVIRSKLHSGQLTLHAWIYEIETGEVFAYDAENSQFKVIENRLFPVPNPLTNLHSA

SEQ ID NO: 48942 - protein, 808 aa, Bacillus clausii KSM-K16
MLVSYKWLQEYIEIGDISPQEIAEKMTRSGIEIDFIHERNKGATNVVVGYVAEVAPHPDADKLNVCQVDIGEEERVQIVCGAPNVSSGQYVAVAKVGARLPGGIKIKKAKLRGQHSNGMICSLQELGIDSKLVPKGYVDGIYVFPETQSVEPGQDALAIFELNDSVLELDLTPNRSDCMHMLGVAYELAALYDRPIKMPKTKVKEVIESADGYINVSVENGEDTPFYQALVIKDVKIGPSPSWLQNRLMAAGIRPISNVVDVTNYVLLEYGQPLHAFDYHALASKSIHVRRAKAEEAFTTLDGEKRTLSPEQLVVTNGREPVALAGVMGGLHSEVTAATTTVVLEAAAFHPTVVRRSARLAGLRSDSSARFEKGINQERVSEAARRAAYLIQEIAGGIVLSGAAIADARVRSERVIALDLDKMNERIGTNLSIMEVAALMRRLQFPCEKVGSDLHVTVPHRRGDITIPEDLYEEVARLYGYDELPSTLPVGNTTQGKRTAEQAKRRKMEAYLRSAGLSEAISYALTSSEKAALFAAETIKPIQVAMPMSEERSTMRTSLLPHLYDICTYNLNRKNNDVLLYERGSVFLSEQETLTELPTEQERLAVLLSGTYMSHPWQGEKKAVDFYVLKGIAEGLMETLGLSEQIEYKPDVRPGFHPGRTANVLLKGESIGFLAQVHPSTQKALDLNETYVLELNVDALFAAETEALIYRGIPRYPAITRDMALVVSKETTAAELMAIIREAGGELLETVSIFDVYEGEHMESGKKSIAFSLTYRHAERTLTDEEASLAHEGIVAEVQKQTGAVLRA

SEQ ID NO: 48943 - protein, 392 aa, Mcvaughia bahiana
DLEPVNPADVPVTAAGALKPYKLAAKAISRLQSLPSGNISLLCDVLVKEVRDLTGYDRVMVYKFHEDEHGEVVTECRRSDLESYLDLHYPATDIPQASRFLFMKNKVRMICDCLAPPVKVIQDKRLSQPLSLCGSTLRSPHGCHAQYMANMGAVASLVMSVTINEDDDTVDGDQQQMARKLWGLVVCHHTSPRFVPFPLRYACEFLIQVFGVQITKEVELAAQVREKHILRIQTLLCDMLLRDAPVAIITQSPNVMDLVKCDGAALYYRKKFWLLGVTPTEAQIRDIAEWLLEYHSGNTGLSTDSLLEVGYPGASALGEVVCGMAAVSITSRDFLFWFRSHTAKEIKWGGAKHDPDDKDDSRKMHPRSSFKAFLEVVEWRSLPWEDVEMDAI

SEQ ID NO: 48944 - protein, 559 aa, Oryza sativa (japonica cultivar-group)
MGSMAAAAEAAQEEETVVFRSKLPDIEIPSHLTLQAYCFEKLPEVAARPCLIDGQTGAVYSYGEVEELSRRAAAGLRRLGVGKGDVVMSLLRNCPEFAFTFLGAARLGAATTTANPFYTPHEIHRQASAAGARVIVTEACAVEKVRGFAADRGIPVVAVDGDFDGCVGFGEAMLDASIEPLDADEEVHPDDVVALPYSSGTTGLPKGVMLTHRSLVTSVAQQVDGENPNLYFRREDVVLCLLPLFHIYSLNSVLLAGLRAGSAIVIMRKFDLGALVDLTRRHGVTVAPFVPPIVVEIAKSPRVTADDLASIRMVMSGAAPMGKDLQDAFMAKIPNAVLGQGYGMTEAGPVLAMCLAFAKEPFEVKSGSCGTVVRNAELKIVDPDTGATLGRNQSGEICIRGEQIMKGYLNDPESTKNTIDKGGWLHTGDIGYVDDDDEIFIVDRLKEIIKYKGFQVPPAELEALLITHPDIKDAAVVPMIDEIAGEVPVAFIVRIEGSAISENEIKQFVAKEVVFYKRLNKVFFADSIPKSPSGKILRKDLRAKLAAGIPTNDNTQLKS

SEQ ID NO: 48945 - protein, 445 aa, Mortierella alpina
MATPLPPTFTVPASSTETRRDPLRHEVLPPLFNNEKVNILNIWKYLDWKHVIGLGVTPLVALYGIFTTELQTKTLVWSIIYYFATGLGITAGYHRLWAHRAYTAGPAMSMALALFGAGAVEGSIKWWSRGHRAHHRWTDTEKDPYSAHRGIFYSHLGWLLIKRPGWKIGHADMEDLNKNALVQWQHKHYPILVLLMGLVFPTAVAGLGWGDWRGGYFYAAILRLIFVHHATFCVNSLAHWLGDGPFDDRHTPRDHFITAFLTLGEGYHNFHHQFPQDYRSAIRFYQYDPTKWLIATCAFFGFASHLKTFPENEIRKGKLQMIEKKVLDKKTKLQWGTPIADLPILSFEDFQHACKNDSKQWILLEGVVYDVADFAVEHPGGEKYIKMGVGKDMTAAFNGGMYDHSNAARNLLSLMRVAVVEFGGEVEAQKSRPSVPVYGEHSKEE

SEQ ID NO: 48946 - protein, 378 aa, Oryza sativa (japonica cultivar-group)
VFYGLEYAHALDDLKAVVAELYKSHSRSVEVQYADVLCSVMSPSSAAEVEHGQSDGSTHSDDLSIQSDVATFVNNCCNVEGSTRKYSLGGLTWSTSIDDNMEDYLLYWIGQDNSAFANIVLTFNKCDIVRYDTVANQPSRDVSHLMKILRRRYYLVEKAKDANIVGILVGTLGVAGYLHIIEQMKDLIKAAGKKSYTLVMGRPNSAKLANFPECEVFVYVSCAQTALLDSKDFLAPVITPFEAVLAFSRGREWTGEYLLDFKDLITTDKPEISSTTEEARFSFIKGGYVEDNCLEDNEEQPETSLALAEVTEKALSIKNQNNDAVLYQGGAKSAIDYLKARSYRGLTGEYEGPAPDSVLTGRTGRAAGYNNEKKEITQ

SEQ ID NO: 48947 - protein, 244 aa, Escherichia coli K12
MNFEGKIALVTGASRGIGRAIAETLAARGAKVIGTATSENGAQAISDYLGANGKGLMLNVTDPASIESVLEKIRAEFGEVDILVNNAGITRDNLLMRMKDEEWNDIIETNLSSVFRLSKAVMRAMMKKRHGRIITIGSVVGTMGNGGQANYAAAKAGLIGFSKSLAREVASRGITVNVVAPGFIETDMTRALSDDQRAGILAQVPAGRLGGAQEIANAVAFLASDEAAYITGETLHVNGGMYMV

SEQ ID NO: 48948 - protein, 204 aa, Staphylococcus epidermidis RP62A
MSNPIKIGIGGPVGAGKTQLIEKVVKRLAKKMSIGVITNDIYTKEDEKILVNTGVLPEDRIIGVETGGCPHTAIREDASMNFAAIDELLERNDDIELIFIESGGDNLAATFSPELVDFSIYIIDVAQGEKIPRKGGQGMIKSDFFIINKTDLAPYVGASLDQMAKDTEVFRGNHPFAFTNLKTDEGLEKVIEWIEHDVLLKGLT

SEQ ID NO: 48949 - protein, 342 aa, Schizosaccharomyces pombe
MSEVIKSVPPGSQNTSQWIISKDQLVFTPSALDGIPLDQEEIQRSKGCNFIINVGLRLKLPQTALATANIYFHRFYLRFSLKNYHYYEVAATCIFLATKVEDSVRKLRDIVINCAKVAQKNSNVLVDEQTKEYWRWRDVILYTEEVLLEALCFDFTGEHPYPYVLSFIKKFVADDKNVTKVAWTYINDSTRSIACLLYSPKTIAAAAFQFALEKNEINLSTTTDGLPVWMEESQVSYEDVKGVLTLIDSLYKKINPSKQALPIDQKNGSHASSVAPGTPSSLASVSTQATPQHQNSSGRTDSFHSLNTETPSKSTVDDQILSTAAQPKKSSDTDKEMETEAS

SEQ ID NO: 48950 - protein, 243 aa, Zea mays
ETTRSWALCSRTETWHHTLLSTTRAWVCVPTFSTRSFLPSISSLFIASQETRAKQRLRSSSAAAMSLAPSIPSIKVKVGAVSVAPPHRACRSFAVIRSSKAEGPIRRPAAPPLSPPPPMPPKTPALSTPPTLSQPPTPVKPAAPPTSSQPMPPSPEPKPVDATAQMRKPVAGAMTLEYQRKVAKDLQEYFKKKKLEEADQGPFFGFLPKNEISNGRYVCPPSHEPNTSKFQASANRDTSMSRL

SEQ ID NO: 48951 - protein, 274 aa, Halomonas sp. 'Belize Reef cbno3r1'
QPNAMGGREVGGLANQLAAHMEYHTPGARELVSPFWTTQHLTPVLPDAPGYKAVELFDAIERGEISALWVMATKSAVSMPDGRKCAARWQKCPLVIVSECVANTDLLPFADIVLPASGWSEKDGTVTNSERRISRQRGLLPAPGEAKHDWWILCEVAKRLGWGEAFDYTQPWEIFDEHARLSGYENSGDTQRLFDISGLAGLGQSAYDALAPIQWPVTQQAPRGTARLFEDGRFATPNGRAKLLPITPRPPAQALSDDYPLRLNTGRIRDQWHT

SEQ ID NO: 48952 - protein, 268 aa, Marinomonas sp. 'Barents Sea 8'
QPNAMGGREVGGLANQLAAHMDFATPGAQDLVQRFWQAPNMATKDGLKAVDLFQAMEEGKVKVVWIMSTNPMVSLPDTAQVRRALEKCELVIVSDCKAHTDTTVMADVLFPATGWSEKDGTVTNSERRISRQRGLFPAPGEAKHDWWVICEVAKSLGFQSAFPYQNVHEIFAEHAALSAFENNGKRDFDMGHFSQITKADYDALTPVQWPVPKSRPEGTKRMFEDGRFFTSDGRAKFVAISPSLPKHQASQEWPFTLNTGRVRDQWHT

SEQ ID NO: 48953 - protein, 270 aa, Marinobacter sp. 'Sargasso Sea s450ao'
QPNAMGGREVGGLANTLAAHMDYDSPGARSRVADFWGTGVVADGPGYKAVDMFEAVHRGDIRVIWIMGTNPAVSLPDSARVREALARCPTVIVSDCVAHTDTTDLADILLPAAGWGEKDGTVTNSERRISRQRCFLPLPAEVKPDWWIMSSVAGKLGFGEAFNYKRPADIFREHAALSAHENNGERLFNLAGLVNLSDPGYDTLQPVQWPILGSTGPGVVDSARLFADGRLSPTISAPDLLHRNRLAAQQTSDDYPMVVNTGRIRDQWHT

SEQ ID NO: 48954 - protein, 209 aa, Nicotiana sylvestris
MADDEYRCFIGNLSWSTSDRGLKDAFEKFGNLVDAKVVLDKFSGRSRGFGFVTFDEKRAMEDAIEAMNGVDLDGRDITVDKAQPDKGSGRDFDSDRPRDRDRDRGRDRDRDRGSRDYGGGRGSGGGGDCFNCGKPGHFARECPSEGGRGGRYGGGGGGSRSSGYGPDRNGDRYGSRSGRDGGGRGGGERFSRDRSGPYERRSSGGSRAG

SEQ ID NO: 48955 - protein, 135 aa, Arabidopsis thaliana
MTMFRSISMVMLLVALVTFISMVSSAASSPEADFVKKTISSHKIVIFSKSYCPYCNKAKSVFRELDQVPYVVELDEREDGWSIQTALGEIVGRRTVPQVFINGKHLGGSDDTVDAYESGELAKLLGVSGNKEAEL

SEQ ID NO: 48956 - protein, 284 aa, Alteromonas sp. 'Sargasso Sea s450co'
QPNAMGGREVGGLANMLAAHMDLENPEHIEAVKTYWDAPVMPKGQTHKAVDLFNAIESGKVKFVWIMGTNPVVRMPNRGQVERALSKCEMVVVSDIVESNDTLNYAHIALPATGWSEKDGTVTNSERRISRQRGILPPPGSAKHDWQTMCNVAAKMGFGEAFNFTHPSQIFCEYAGLTGYHNNGKRQLDLSPLQGLSEAQYNGLSPVQWPFYNAALNTSSPGAKLEANDKPNLISKRPFEDKQFSTPSGKAKLIPVTYKAPLQVTSDAYPFVVNSGRARDQWHT

SEQ ID NO: 48957 - protein, 932 aa, Debaryomyces hansenii CBS767
MSDEEDYDIAGTLALAGSDSEPESDLNSDNEEVQDEIVSDEDDTKHKPNKKQKLEKGKSKQTFPSLELSDDEAENESKDMASYFVANNPQAKKAKNGSFPSFGFSKFLLTNISKKGFKQPTPIQRKTIPLIMENRDVVGMARTGSGKTAAFTLPLVEKLKSHSPRVGVRAIILSPSRELASQTFKQVKEFSKGTDLRSIVLIGGDSLEEQFSSMMTNPDVIVATPGRFLHLKVEMELELKTVEYIVFDEADRLFEMGFAEQLNELIAALPSSRQSLLFSATLPRSLIDFAKAGLTNPVLVRLDAETKISDQLQMAFFSIKNNEREASLLYVLQEVIKLPLASPEEVKRYSDMEKRDNGSEDEAEDENNNKKKRFKFKKERLPPANMLPSKHSTIIFVPTKHHVEYVTTLLKDAGYLVSYIYGTLDQHARKQQLYQFRIGMTSLLVVTDVAARGIDIPILANVVNYTLPGSSKIFIHRVGRTARAGNSGWAYSIVNEKELPYLLDLELFLGRKVLLTSMHEKKCEMLKTKQSSNYVEPKVSYTDRLVLGSIPRVDIETFQELYENILRNHYELSVVKGVATKGEKLYYRTRQSASQESLKRSKEILLTGNWDDQHLLFGPNLEKEKEKFLTQLLNRKSKETVFEFNKKGNDRDEDSLVEFMHKRRKQIAPIQRRAKEKRELLEKERMAGLTHGIENEILKNDGEIGYSGITIEADEEELQDAFEDADELIEKKKIEKKKSFRDPQYFLSHYAPAAVIQDQQLSLSSSFANDAAKATFDLDNDEKLNANKQVMQWDRKKGNYVNAHSTDKKFIIGESGQKIPATYRSGRFDDWKKQRNLKPTKTGAMEANATNGNDRRFKHKKVASPKLPDKFRDDYHKQKEKVKKAVDSGLKVKGYNKPGQKQELRSTEDIRKAREAKDKKKQKNARPSRKRK

SEQ ID NO: 48958 - protein, 392 aa, Burdachia sphaerocarpa
DLEPVNPADVPVTAAGALKSYKLAAKAISRLQSLPSGNISLLCDVLVKEVRDLTGYDRVMVYKFHDDEHGEVVSECRRSDMESYLGLHYPATDIPQASRFLFMKNKVRMICDCLAPPVKVIQDERLPQPLSLCGSTLRSPHGCHAQYMVNMGAIASLIMSVTINEDDDTIDGDEQQMARKLWGLVVCHHTSPRFVPFPLRYACEFLIQVFGVQITKEVELAAQVREKHILRIQTLLCDMLLRDAPVAIITQSPNVMDLVKCDGAALYYKKKFWLLGVTPTEAQIRDIAEWPVEYHSGNTGLSTDSLMEAGYSGASSLGDAVCGMAAVSITSRDFLFWFRSHTAKEIKWGGAKHDPADKDDGRKLHPRSSFKAFLEVVKWRSLPWEDMEMDAI

SEQ ID NO: 48959 - protein, 392 aa, Glandonia macrocarpa
DLEPVNPADVPVTAAGALKSYKLAAKAISRLQSLPSGNISLLCDVLVKEVRDLTGYDRVMVYKFHEDEHGEVVSECHRSDLESYLGLHYPATDIPQASRFLFMKNKVRMICDCLAPPVKVIQDERLPQPLSLCGSTLRSPHGCHAQYMANMGAIASLVMSVTINEDDDMIDGDEQQMARKLWGLVVCHHTSPRFVPFPLRYACEFLIQVFGVQITKEVELAAQVREKHIFRIQTLLCDMLLRDAPVAIITQSPNVLDLVKCDGAALYYKKKFWLLGITPTEAQIRDIAEWLLEYHSGNTGLSTDSLMEAGYPGASSLGDAVCGMAAVSITSRDFLFWFRSHTAKEIRWGGAKHDPDDKDDGRKMHPRSSFKAFLEVVKWRSLPWEDVEMDAI

SEQ ID NO: 48960 - protein, 392 aa, Barnebya dispar
DLEPVNPADVPVTAAGALKSYKFAAKAISRLQSLPSGNIFLLCDVLVKEVRDLTGYDRVMVYKFHEDEHGEVVSECRRSDLESYLGLHYPATDIPQVSRFLFMKNKLRMICDCLAPPVKVIQDENLPQPLSLCGSTLRSPHGCHAQYMTNMGTIASLVMSVTINEDDDMKDCEQPQMPRKLWGLVVCHHTSPRFIPFPLRYACEFLIQVFGVQINKEVELAAQVREKHILRIQTLLCDMLLRDAPVAIITQSPNVMDLVRCDGAALYYKNEFWLLGVTPTEAQIRDIAEWLLECHSGNTGLSTDSLMEAGYPGASVLGDAVCGMAAISITSRDFLFWFRSHTAKEIKWGGAKHDPDDKDDGRKMHPRSSFKAFLEVVKWRSLPWEDIEMDAI

SEQ ID NO: 48961 - protein, 465 aa, Candida albicans SC5314
MFPNSPDAFHQVRMMQSSIKASNFKLQSMEFRCHSNNVCEYQMEMLHHLLSVEAKTLPNLSLIEQQPEIKLGMRPLLLDFLMEVITILSLSRSTFPLTVNLIDRYCSTRIVKKQHYQLLGLTSLWISCKNLDSKFKVPTLNDLRKICVDSYYKELFVEMEKHILKSLEWVVNAPTFDAFIDLYSNLLISNSSNFEVANIIKKSSHKIKLFSNYIGELFQFYPNIYYDYTSSQIALIAILITVLTLKIPVDLISLLNFYNGLVKTEMFKSNVEQGAEDQFEEILSVDSFKSLFNKSFFKNLIKIIDNPPSSLKIKYFAENGKYSVLMKQLVTTASNTLKCILDPVPTTPKANSFVKHQQQQHHYHPRPPMSINTSMIPLTPVSNSTSPNRFSPDQIFSENESTPGIAFGTMTPDSQSTSPGEKRSYECIDELEIGTSTIAGYTLKNHDTLKRSKSANYGTLFYLQQ

SEQ ID NO: 48962 - protein, 392 aa, Spachea correae
DLEPVNPADVPVSAAGALKSYKLAARAISRLQSLPSGNISLLCDVLVKEVRDLTGYDRVMVYKFHEDEHGEVVSECRRPDLEAYLGLHYPATDIPQASRFLFMKNKVRMICDCLAPPVKVIQDEKLPQSLSLCGSTLRSPHGCHAQYMANMGSIASLVMSVTVNEDDDMVDGDQQRMARKLWGLVVCHHTSPRFVPFPLRYACEFLIQVFGVQINKEVELAAQGREKHIMQTQTLLCDMLLRDAPVAIVTQSPNVMDLVKCDGAALYYRKKFWLLGVTPTEAQIRDIAEWLLEYHSGNTGLSTDSLMEAGYPGTSVLGNAVCGMAAVKITSRDFLFWFRSHTAKEIKWGGAKHDPDDKDDIRKMHPRSSFKAFLEVVKWRSLPWEDMEMDAI

SEQ ID NO: 48963 - protein, 101 aa, Bacillus cereus G9241
MKPNFSKGLLPAVVIEEGTKEVLMLAYMNEDAYKKTLETKRTWFYSRSRRALWNKGETSGNVQHVQSLYLDCDQDAIVVVVKQVGPACHTGEKTCFHYKII

SEQ ID NO: 48964 - protein, 442 aa, Arabidopsis thaliana
MGYGGDEVSAIVVDLGSHTCKAGYAGEDAPKAVFPSVIGAVDGVEAMDVDVDSTKTNSNSEDSKTESEKEKSKRKLYVGSQAMSYRRDHMEVLSPIKDGIVSDWDLVDNIWEHAFKSCLMIDPTEHPMLLAEPPLNTQQQREKAAELMFEKYKVPALFMAKNPVLTSFATGRATSLVVDCGGGSTTISPVHDGYVLQKAVVSSPLGGEFLTDCLLKSLESKGIKIRPRYSFKRKEVRAGEFQVEDVDIPDTTESYKLFCQRMIVGDIKDSICRVPDTPYDDKSYSNIPTTSYELPDGQTLEIGADRFKVPDVMFNPSIVQTIPGMEKYAEMIPSVRGLPHMVMESINKCDVDIRRELYSSILLAGGTSSMQQLKERLEKDLIEESPHSARVKVLASGNTTERRFSVWIGGSILASLGSFQQMWFSKSEYEEHGASYIQRKCP

SEQ ID NO: 48965 - protein, 107 aa, Bacillus cereus G9241
MENAFKLLFETIEERKRNPLSESYTNYLFLKGEDKILKKIGEECSEVIIASKNNDKEELVKEMVDVLYHCFVLLAEKNISLEDIMEEVTERNGKLSRVGDRREIDTL

SEQ ID NO: 48966 - protein, 392 aa, Tricomaria usillo
DLEPVNPADVPVTAAGALKSYKLASKAISRLQSLPSGNMSLLCDVLVKEVRDLTGYDRVMVYKFHEDEHGEVVSECRRSDLESYLGLHYPATDVPQASRFLFMKNKVRMICDCLAPPVKVIQDERLPQPLSLGGSTLRSPHGCHSQYMTNMGTIASLVMSVTINEEDERMDGDQQQMTTKLWGLVVCHHTSPRFVPFPLRYACEFLIQVFGVQIDKEVELVAQVREKHILQIQTMLCGMLLRDAPVAIVTQSPNVMDLVKCDGAALYFKSKTWLRGVTPTEEQIKDIAEWLLKYHSGNTGLSTDSLMEAGYPGASVLGDAVCGMAAVGITSRDFLFWFRSHTAKEINWGGAKHDPDDKDDGRKMHPRSSFKAFLEVVKWRSMPWEDMEMDAI

SEQ ID NO: 48967 - protein, 438 aa, Bacillus cereus G9241
MYLHGTSRINGQGHLEIGGCDTTQLAKQYGTPLYVYDEESIRGKCRAFHRAFKESGFSYQVAYASKAFLCMEMCRVAREENMSLDVVSGGELYTALQSGFPASRIHFHGNNKTDEEIVMALQANIGCFVVDNFLELEILHDLAVQHGKFVNILIRVTPGVEAHTHEYITTGQDDSKFGFGVSNGQAMQAIELALQKSNYNVLGIHSHIGSQIFETAGFVRAIEVLRQFLEEVRERTHYVVKVLNVGGGFGIRYTESDTPLTLETYVRAVTSAVREQFTVCEYPLPEIWVEPGRSIVGDAGTTLYTVGSVKDIPGIRKYVSVDGGMTDNLRPALYNARYEAMLANRGNDENEEVVSIAGKCCESGDMLIWDITLPKVASADLLAISCTGAYGYSMANNYNRIRRPAVVFAKGGTSQIVVERETYENIIGNDRIRIKELV

SEQ ID NO: 48968 - protein, 495 aa, Oryza sativa (japonica cultivar-group)
MAAAAPAGAQNRCVFVGNIPYDATEEQLVQICEEVGPVVSFRLVIDKETGKPKGYGFCEYKDEETALSARRNLQGYEINGRQLRVDFAENGRNADRNREKGRGGPGMASSVDTQKQLAGTPVVGDTGLHQPVGLPSAIHAASVMAGILGGSQTANVQNGLPVQYGLGNDPLTHYLARMSKHQLYEIMSELKSLTSQNKDVANKLLQGIPQLSKALFQSQIMLGMVTPQMMQMAKSQQPSSSLAQSSSHISEPFPQPDAMISSVPRPSASLPNPNVLQDPSAQLHNFPQYPHSSQPAGTIFPHGSQSGVGIHPPIVSQLLGASSSVPPLPLATSGSLISQVQPPFMPHHPRPPAMPAGMQQLPLTHPHVPQVPAIPDIAQKEMRFPEQANRSTEFAHHPKLRKLEDGTSTPGIVNNNPAVYPAPSQGMLPGGPSGSYNSAAVSFQQPENEVPQLTPDVESALLQQVLQLTPEQLSSLPVEQQQQVIQLQKMLSAGK

SEQ ID NO: 48969 - protein, 129 aa, Xylella fastidiosa Ann-1
MSVPVPRVEPLICDEAVLRQVDTTTAVIVFDGVCVLCNGWVRFLLRRDRKKRYRFAAMQGQHGGALLRAYGLDPEDPLSFLLVEDGKGWSDSDAVLRVLVGLGGGGARCCLLVRVAASLERCWLSLVGA

SEQ ID NO: 48970 - protein, 386 aa, Guillardia theta
MVKFDQIGICKQISRVCEAVGFKKATKVQVYTIPHFLIGKDLLVYSQTGSGKTLAYILPLLQKLLYKKNNYLPIIIVPSRELVFQISTTFETISCVFNIRIASLTGGIDPNVQLVMISSNPDIIISTPGRLVEILKLTKNLEIKFCTDLVLDEADKLIHSDFKREINIINSKTNKNKKLMLFSATMSLGLEKIKFFKISNPVRIIINQNFFISPNLIQNYIFCPFRYKEIYLLYLINEFYEEKLICFVETQKMTEKISILLKKFSFDCYIIHGSLSQNERIDTLSKFTNGKKKILVATDLASRGLDICAVSLIINYDFPIYLKDYIHRTGRTGRAGRAGRAISLITQYDLRTFQKIESILNIKIAELNISKRKIEYIKNVLGKKDY

SEQ ID NO: 48971 - protein, 687 aa, Propionibacterium acnes KPA171202
MATELTWTDTDRLAVDTARVLAADAVEKTGNGHPGTAISLAPLGYLLYHKVMSIDPSDPNWLGRDRFIMSAGHSSLTQYTQLYLAGLGLELSDLESLRTWGSLTPGHPEYGLTKFVETTTGPLGAGVANAVGMAMAARRERGLLDPDAAPGTSLFDHYIYAIAGDGCMQEGIASEASSLAGTQELGNLIMFYDDNRITIEGDTAIAFSENVEARYEAYGWHVQHVDFTNGGTTYEENVEALMEAIDNAKTVTDKPSFIRLTTVIGWPIPKLAGLAQVHGAKIGAEGVSALKEKLGFEDKPFAIDLEMVQQVRAAFAERGKGLREVWDEKFAAWHDANPDGAALLERMLAHKLPDDLDIPTFEPGKMSTRKASGAVLSALGPQLPELWGGSADLAGSNNTTMKGADSFLPEDRCSEKDPGGPYGRTIHFGVREHAMGGILNGITLAGLTRCYGGTFFVFSDYMRPSVRLAALMKIPSIFVWTHDSIGVGEDGPTHQPVEHLASYRAIPGLDIVRPADANETAVAWRTIVEHTDRPAGLVLSRQDLPTIDRSKYASAEGVARGAYVVCEASAEPKVILIGTGSELSVALEAREKLEADGIATRVVSMPCQEWFDEQDEEYRESVLPSSVTARVSVEAGIAMGWAKYVGCKGASVSLEHFGASASGALLFEKFGFTADHVAEVAHTVFME

SEQ ID NO: 48972 - protein, 519 aa, Oryza sativa (japonica cultivar-group)
MQFSSVFPLEGKACVSPIRRGGEGSASDRLKIGDSSSIKHDRAVRRMCLGYRGTKNGAQCVLTSDAGPDTLHVRTSFRRNFADPNEVAAVILGGGTGTQLFPLTSTRATPAVPIGGCYRLIDIPMSNCFNSGINKIFIMTQFNSASLNRHIHRTYLGGGINFTDGSVEVLAATQMPGEAAGWFQGTADAVRKFIWVLEDYYKHKAIEHILILSGDQLYRMDYMELVQKHVDDNADITLSCAPVGESRASDYGLVKFDSSGRVIQFSEKPKGTDLEAMKVDTSFLNFAIDDPTKFPYIASMGVYVFKRDVLLNLLKSRYAELHDFGSEILPRALHEHNVQAYVFADYWEDIGTIRSFFDANMALCEQPPKFEFYDPKTPFFTSPRYLPPTKSDKCRIKDAIISHGCLLRECTIGHSIVGVRSRLNSACELKNTMMMGADLYETEDEISRLLSEGKVPIGVGENTKINNCIIDMNARVGRNVVITNSEGVQESDRPEEGYYIRSGIVVILKNATIKDGKVI

SEQ ID NO: 48973 - protein, 336 aa, uncultured gamma proteobacterium eBACHOT4E07
MIRNFLINILFSIPVWLIELVYKFNKDVKRGFIFDSQSRMLFALMPKLDLHKIEDDDIPKIRNLINEKRKNLRLSNKTKKNVITKDHFIDQENNLKLREYIPYKTDNDNVILYFHGGGYVLNSIDTHNLTVSYFSEKLRTRIFSLAYGLSPENKYPHAMNQALSAIDWLVKNGHHIKNISLCGDSAGAHLAASVAHSLSNDQKENVHSQFLIYPMCDPSCASESIELFKDNYLLTKESMKWFWQKFKNNDEDNLKDTFNLLLFNPNKDFPKTIIVTAGFDPLSDEAEKYAFLIHQSGNYVKQLHYPSLFHGFAAMTRLKSANKAVNDFLLEYKKIL

SEQ ID NO: 48974 - protein, 465 aa, Porphyromonas gingivalis
MDHLTVIIGAGLTGLTTAAFLRAAGRPVLVLERAAHIGGQIRTYREDGFVFETGPNTGTISSPEVAELFELLGLEPEIATPAASNRLIWKGNKLYPLPRNIAEAVGTPLFSLWDKWRILGEPFRRRGGQPNETVGALARRRLGKSFVDYAVDPFLGGIYAGDPDQLVTRFALPKLYDLEQRYGSFVLGAVRKARQPQSERDRKASRKVFSVQGGLGLLVEALADYIGREHILTETQIRYINHPGAHTFGLTYTDASEEEHTIPCRHLVSTVAAHHIPTLFDRFPANESAVFEQLYYAPMIEVAVGFRRNVATHLPAFGCLIPSRENRRILGILFPSDCFRGRAPEGGALYSIFMGGVRNASLIDLSDEEISTIAMEELRDMLHIPHTCKPDLLHISRHRHAIPQYYADTELRQDIIRRMEMRWPGLHLGGNMHGGIGMAHRISQGVEMARSIIEETAIAERSARG

SEQ ID NO: 48975 - protein, 322 aa, Oceanobacter sp. RED65
MQTVQTILEKHRVSDSLAQAIHCVLDCSKEISVLLQKGAMAGVLGSAENENVQGETQKKLDVISNDLLKERLAECPVVAGIASEEEDLPVAANEDGQYLVIYDPLDGSSNIDINVTVGTIFSILPSRGEDPSKEATYLQNGRQQVAAGYVLYGPATMLVMSTGKGVDIFTLDPTSNEFVLTQEQVQITPSTKEFAINMSNQRFWAEPVQTYVSDLLAGEEGPLAKRYNMRWIAAMVAEVHRILNRGGIFMYPWDNREPNKPGKLRLMYEGNPMSMLVEQAGGLSVNGEINIMDIEPEKIHQRVPVFLGSKEEVEKALSYHKA

SEQ ID NO: 48976 - protein, 444 aa, Synechococcus elongatus PCC 6301
MISTVSKPRVVVIGGGFGGLYTALNLGKTSVELTLIDKRNFHLFQPLLYQVATGEISPGDIPAPLRAIVGRNPNTRVILGEVTDIDPQAHWVRVGDEIVEYDYLVVATGASHHYFGNDQWQPFAPGLKTVEDALEMRRRIYFALEQAEQESDPERQQAWLTFTIVGAGPTGVELAGAIAELTRGEMRKEFRNVDTTKAKVILIEGMDRVLPPFPPELSAQAQVQLEGLGVTVQTKAMVTDIQEDRVVFKTGDDLHEIPSRTTLWAAGVKASPLGKLLAQRTGAELDRIGRVIVQPDLQLPTDPNVYVLGDLAHCPDQAGNPLPGVAAVAMQQGAYLGKALKRRLKSQPVDPFRYQDFGSMAVIGRNAAVARLAGIRLSGFPAWLVWAFIHVWYLIEFDSKLLVMVQWAWTYFNQKRGTRLIVNHHRMSAPAAMTNPAEKELAKS

SEQ ID NO: 48977 - protein, 392 aa, Tetrapterys discolor
DLEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMTNMGTIASLVMSVTVNDDDDMMDGDQQQMTRKLWGLVVCHHTSPRFVPFPLRYACEFLIQVFGVQINKEVELTAQVREKHILQIQTMLCDMLLRDAPVAIITQSPNVMDLVKCDGAALYFKKKTWLLGVTPMEEQVRDIAEWLLEYHSGNTGLSTDSLMEAGYPGASDLGDAVCGMAAVSITSRDFLFWFRSHTAKEIKWGGAKHDPDDKDDGRKMHPRSSFKAFLEVVKWRSVPWEDVEMDAI

SEQ ID NO: 48978 - protein, 575 aa, Candida albicans SC5314
MENKVSEISEMTTDLNSNSETKFDHFTTTTKTTTDQIQKKSTETTTTTQSISINSKDEKKAGSKLSRVVKVSRRALTTYASFIGPGLLVSVAYMDPGNYATGITAGASNKYSLLFIVLLADIIAIFLQVLCIKLGCVTGYDLARCCREYLPKKLNWILWILAECAIISTDVAEVIGSATALNILLKIPLPAGVVITIVDVIFVLIAYRTDTSSLKFVKIFEYAVGCLVMIVVICFAVELSQITANVGQVFRGFVPSKEMFDGNGMTVATSVIGSTVMIHSLFLGSGLVQPRMRDYDVKHGYVNLYEIAKEEKVQEEEEEDQTEISPVASNPIQNNIAPTYEQEAKFFRIKYKPSYKSICYCLKYSKIELIVTLATIALFVNAAIVIIAGATLYGTSEAMNADLYTIHSLLSKSLSPAVGTIFMVALLSSGQSAGVVCTIAGQMVGEGHINWTLKPWMRRILTRAISIIPCLTISVFIGKNGLGVALNISQIIISILLPPLTAPLIYFTCCKKIMKVELGEEDEVEGIEDEGSGKRYKYMTNSWLTTIIVVIIWLLVAILNVYAIYQMAVSGVTGS

SEQ ID NO: 48979 - protein, 392 aa, Stigmaphyllon sagraeanum
DLEPVNPADVPVTAAGALKSYKLAAKAISRLQSLPSGNISLLCDVLVKEVRDLTGYDRVMVYKFHEDEHGEVVSECRRSDLESYLDLHYPATDIPQASRFLFMKNKIRMICDCMAPPVKVIQDETLPQPLSLCGSTLRSPHGCHAQYMTNMGTIASLVMSVTINEDDDTMDGDQQQMTRKLWGLVVCHHTSPRFVPFPLRYACEFLIQVFGVQINKEVELAAQVREKHILQIQTMLCDMLLRDAPVAIITQSPNVMDLVKCDGAALYFKNKTWLLGVTPTEEQIRDMAQWLLEHHSGNTGLSTDSLMEAGYPGASALGDAVCGMAAVSITSRDFLFWFRSHTAKEVKWGGAKHDPDDKDDLRKMHPRSSFKAFLEVVKWRSMPWEDIEMDAI

SEQ ID NO: 48980 - protein, 392 aa, Lophopterys floribunda
DLEPVNPADVPVTAAGALKSYKLAAKAISRLQSLPSGNISLLCDVLVKEVRDLTGYDRVMVYKFHEDEHGEVVSECRKSDLESYLGLHYPATDIPQASRFLFIKNKVRMICDCLAPPVKVIQDERLPQPLSLCGSTLRSPHGCHAQYMTNMGTIASLVMSVTINEDDDTMDGDQQQTTRKLWGLVVCHHTNPRFVPFPLRYACEFLIQVFGVQINKEVELAAQVREKHILQIQTMLCDMLLRDAPVAIITQSPNVMDLVKCDGAALYFKNKIWLLGVTPTEEQIRDIAEWLLEYHSGNTGLSTDSLMEAGYPGASVLGDAVCGMAAVSITSRDFLFWFRSHTAKEIKWGGAKHDPDDKDDGRKMHPRSSFKAFLEVVKWRSMPWEDVEMDAI

SEQ ID NO: 48981 - protein, 392 aa, Mionandra camareoides
DLEPVNPADVPVTAAGALKSYKLAAKAISRLQSLPSGNISLLCDVLVKEVRDLTGYDRVMAYKFHEDEHGEVVSECRRSDLESYLGLHYPATDIPQASRFLFMKNKVRMICDCLAPPVKVIQDERLPQPLSLCGSTLRSPHGCHAQYMTNMGTIASLGMSVTVNEDDDTMDGDQQQMTRKLWGLVVCHHTSPRFVPFPLRYACEFLIQVFGVQINKEVELAAQVREKHILQIQTMLCDMLLRDAPVAIITQSPNVMDLVKCDGAALYFKNKTWLLGVTPTEEQIRDIAEWLLKYHCGNTGLSTDSLMEAGYPGASALGDAVCGMAAVSITSRDFLFWFRSHTAKEIKWGGAKHDPDDKDDLRKMHPGSSFKAFLEVVKWRSMPWKDVEMDAI

SEQ ID NO: 48982 - protein, 152 aa, Prochlorococcus marinus subsp. pastoris str. CCMP1986
MIKERTFLAIKPDGVQRGYVSDIIGRFEKKGFKLVGLKQLIPTKQLAQDHYGVHRERPFFKDLVEFISSGPVVAMIWEGEGVILSARKLIGATKPLEAEPGTIRGDLAIDIGRNIIHGSDGEETAKFEINLWFNQDEICDWETSDSEWRAEN

SEQ ID NO: 48983 - protein, 392 aa, Aspicarpa brevipes
DLEPVNPADVHVTAAGALKSYKLAAKAISRLQSLPSGNVSLLCDVLVKEVRDLTGYDRVMMYKFHEDEHGEVVSECRRSDLESYLGLHYPATDIPQASKFLFIKNKVRMICDCLAPSVKVIQDERLTQPLSLCGSTLRSPHGCHAQYMTNMGAIASLVMAVTVNEDEDTMDGDQQHMTRKLWGLVVCHHTSPRFVPFPLRYACEFLIQVFGVQVTKEVELAAQVREKHSLQIQTMLCDMLLRDALVAIITQSPNVMDLVKCDGAALYFKNKTWFLGVTPTEEQIRGIAEWLLKYHSGNTGLSTDSLMEAGYPGASGLGDAVCGMAAVSITSRDFLFWFRSHTAKEIKWGGAKHDPDDKDDLRKMHPRSSFKAFLEVVKWRSTPWEDIEMDAI

SEQ ID NO: 48984 - protein, 268 aa, Anaplasma phagocytophilum HZ
MVERLTCNQDVVGSSPAVGSLCVIIMDDMSFLVVANWKANGNARLAESFLDVLSSQNSLSGGSTCSVVLCPPYTAMPSLRGRSCVVRLGGQDCFAGVSRGCTGEITAKMLRECGCEYVILGHSDRRTLLNESDSLIKLKAESAIGECLIPIICVGENREERESGATGRVLLEQCRSCLPEEGEFFVAYEPIWAIGGSVIPDIAMIEEAFSIIKSHNPGLRIIYGGSVNESNIRSLKTGVSGIAGVLVGSASLDADGFARMLDNVMECL

SEQ ID NO: 48985 - protein, 540 aa, Bacillus cereus G9241
MSYEKVWANNEKLNQTEKNKLKKDGLEIFNDIPYYAENGFESIPKEEWDAFKWAGLYLQRPKEAGYFMMRVNIPSGIITNAQAEVLASIAEDYGRDVIDITTRQAIQFHWLEIHQIPDIFKRLARVGLSSAGACGDITRNITGNPLAGIDANELFDTTGIVKEVYDYFQHNEEFSNLPRKFKMSISSNIYNSANAEINCVAFTPATKEIDGEKKVGFHIKVGGGLSARPYLADELDVFVLPEEVKTVAIAIATIFRDFGYREKRHLARLKFLVADWGAEKFKEKLIEYTGPLQSKGESALKGWNAGYFYGVQDQKQDGLKYVGFNVPVGRLHAEEMFEIARIAKQYGNGQIRTCNSQNFIIPNVPPENVTGLLNEPLFDAISASPKSFIGHAVSCTGIEYCNLALVETKERLRKIAEYLDTQIALDVPVRIHMVGCPNSCGQRQIADIGLQGVKMKTKEKGIVQAFEIYVGGTLLDGGAYNQKLKGKIDGEDLPDVLASFISYFKENKLPAETFYDFVGRIGIDTLQIVLNNVLEEVIAS

SEQ ID NO: 48986 - protein, 434 aa, Escherichia coli K12
MTTPLKKIVIVGGGAGGLEMATQLGHKLGRKKKAKITLVDRNHSHLWKPLLHEVATGSLDEGVDALSYLAHARNHGFQFQLGSVIDIDREAKTITIAELRDEKGELLVPERKIAYDTLVMALGSTSNDFNTPGVKENCIFLDNPHQARRFHQEMLNLFLKYSANLGANGKVNIAIVGGGATGVELSAELHNAVKQLHSYGYKGLTNEALNVTLVEAGERILPALPPRISAAAHNELTKLGVRVLTQTMVTSADEGGLHTKDGEYIEADLMVWAAGIKAPDFLKDIGGLETNRINQLVVEPTLQTTRDPDIYAIGDCASCPRPEGGFVPPRAQAAHQMATCAMNNILAQMNGKPLKNYQYKDHGSLVSLSNFSTVGSLMGNLTRGSMMIEGRIARFVYISLYRMHQIALHGYFKTGLMMLVGSINRVIRPRLKLH

SEQ ID NO: 48987 - protein, 692 aa, Guillardia theta
MESFKNEILGWNFFYSKTNEFLYRLFFVPIVFATFFHFKYCFEPLYFEELRYQINKNIKENFVTDLKIDGIIRSTKIKFDKLFVKIKIKTKSIDKVKNTIGNFFILTIKNDNIIAKKHFFTFFGKVVNIKKKKLIIMEINPIFFLRINKKDKIILFLSRYFSKISLVLKEFETIRKFNYLYNPIRTILMNPVNESIILRNSFFDECIDRHYNLHFNKNQLSCIKDFQNNHITLIQGPPGTGKTRTILGILAILFEEKKKYGIKLKISVDKKKQNDQVIICAPSNAAIDENLSRMLFGIPYLYQNNLNNPRLLRLGPNYNKYLDHISFETLSLIKLSDIDFENKFKFSNFNIINLKRSIINTGSLIFTTLACSNYHLINNLTSKQYLIIDEAAQSIELSSLIPIKKYTHRIILVGDIHQLPATVFSKSAIAFGYNRSLLKRFQLNRYPTLFLGIQYRMHPQISSFPARKFYKNNLKDSWKVSKISNFHQLRCFSPLIFFDIIDGVENYHTDNHFSWCNLDEIRFINLYFRSIICLISNLNELTIGFISGYSGQIEEMRDILSNSKIKLNEQISTIDSFQGKEKDILFFSCVRSKIERGIGFLADGRRINVAFTRAKLGFWIFGNSFSLRKDSNWNETVFDFKIRNNYFVSRKPYERSNRRVIYWDILDHENYTFDGEVEFTNTKILIESLFEN

SEQ ID NO: 48988 - protein, 451 aa, Prochlorococcus marinus str. MIT 9303
MSDAISHEIDHFMKGLMKRNPGEPEFHQAVHEVVETLIPFILSNRVYKDAQILERMTEPDRVVIFRVCWEDDAGNIRTNRAWRVQFNNSIGPYKGGIRFHPNVTLSVLKFLGFEQTFKNSLTGLPMGGGKGGSNFNPKGKSDREIMRFCQSLMIELHRHIGEDTDVPAGDIGVGSREISYMFGQYKRLENRFSGILTGKGLSFGGSLVRTEATGYGCAYFCENMLNHIEDSLVDKICSISGSGNVALYAVEKAIELGAKVVTLSDSDGFVHVPNGINLEMLAFVKELKTVRRGRIHEFANHYKGVDFYAGKRPWNVPCDIAFPCATQNEINRADSQELINNGVKAVVEGANMPTNLDGIHEFRHAKVILAPAKAANAGGVAVSGLEQSQNALRLSWSREEVDQRLKSIMLEIHSKCVQHSHKYEDYTDYITGANIAGFKKVADAMLAYGIV

SEQ ID NO: 48989 - protein, 54 aa, Triticum aestivum
TPCGHNFCLKCLEKWVNSGKRTCGKCRGPITSKMASQPMIKAALVADIRMARTA

SEQ ID NO: 48990 - protein, 318 aa, Xylella fastidiosa Ann-1
MYFKAVVLINFKSITVLSLSGIITALVTPFDRDGAFDRDAWIRLLDMQLAGGVQGVVIAGSTGEAATLTDAEYDEMLCSAVVRVGGRVPVLAGTGLSGTAKTISQTKRAADNGAGYALVVTPPYIRPNQGGLKAHYLAVAEQGGLPVVLYNVPSRTGCDLLPETVADLAGHPSIVGIKEACASRERVQALLALRRPGFAVFSGDDSSAARSMLDGADGLVSVASNVLPSAYRHLCDLARAGERGAIDLWNARLSDFHAFCGLDSNPIPIKALLQRIGIGYGLRLPLLPLSVCHHDIVDHLADQVAALEALSSRKIVTA

SEQ ID NO: 48991 - protein, 399 aa, Nicotiana tabacum
MALQAASLLPSAFSIHKEGKSCATLKDSSLFGVALSYNQKSKFIPPAAWNKELTKKIAAVPIRAQIAATTPAVNQSTSEQKKTLRKGNVIITGASSGLGLATAKAIGETGEWHVIMACRDFLKAEKAAKSVGIPKENYTVMHLDLASLESVRQFVDTFRRSGRPLDALVCNAAVYLPTAKEPTFTADGFELSVGTNHLGHFLLSRLLLDDLKQSDYPQKRLIIVGSITGNTNTLAGNVPPKANLGDLRGLSGGLNSLNCSPMIDGGEFDGAKAYKDSKVCNMLTMQEFHRRFHEETGIAFASLYPGCIAETGLFRNHIPLFRALFPPFQKYITKGYVSEAEAGKRLAQVVRDPSLSKSGVYWSWNNTSSSFENQLSKEASDAEKARKLWEVSEKLVGLA

SEQ ID NO: 48992 - protein, 508 aa, Solibacter usitatus Ellin6076
MKVLTAAEMREVDRLTIEAGIPGIVLMENAGHRVLELLTERFAPLAEQRIVVLCGKGNNGGDGLVIARQLRTAVCPRELYVVLLAAPEELKGDAAANYRMLLACGGAVHRQIPAEARCASLVIDALLGTGVTGPATGLVLEGIRAINHDFPLAQVIAVDIPSGMPSDPGSSAGEIARADVTVTFTAAKVAQVIPPYCDQTGELLVRAIGSPASLYEDVRLSLLEPAMFRELLAPRAPSGHKGTYGHALVVAGSRGKSGAAAMSGMAALRAGAGLVTVASAASAIAEIAMHAPELMTEPLRETESGVIALNADLKVAAEGKTVIAVGPGLGRAPHIAALVQSMTETFAQPMVLDADALLAPPAGGPARTRVLTPHPGEMARLTGKTSAEVQGDRVGIARAYAMEHACTLVLKGQRTVIAFPDGRVWINPTGTPAMGTGGTGDILTGLTAGLLAQFPDRPDQAVGAAVYLHGRAGEIGAEALGEKCLVATDILQYLPDAMEESAHVPDGF

SEQ ID NO: 48993 - protein, 504 aa, Physcomitrella patens
MSDPYGRRLLVDDFHVGPVLGTGGFSVVRAGVRKQDNLQVAIKTLKKFGYGRGDHGRPGAQMSQAEALVKNEIMVMMRIVDEVSPHPNVIHLIDVYEDDGAVHLVLELCRGGELFDRIVQHERYSERDAAKVVRQIASGLAALHQAQIVHRDLKPENCLYVNPLAEAPLKIMDFGLSYIHHNTNSIVGIFGSIDYMAPEQLSLSGIMPANDMWSLGVILYILLCGYPPFRARSSRDKQMQILTGSYSMEEESWRGISHEAKQLIRRLLSVDPFARPTARELLSHPWVSGDIANRDLLHKDVFMRLQHFNARRKFRATAYASIVRTKFLLRTRYLKELLGDRVLTDSELEALRVNFMRISSNGQTATLKEFEEVLRSINLHCFVPLAPRIFELFDYNHDGGIDLREVVCGFSLLRTSHLDDALQMCFKIYDRDDSGYISKGELARVLGALPEDYLPADISQVQMDDIFEHVDTDSDGRISYQEFRRALSLQDAVMNHFRMEGQVQ

SEQ ID NO: 48994 - protein, 392 aa, Diplopterys cabrerana
DLEPVNPADVPVTAAGALKSYKLAAKAISRLQSLPSGNISLLCDVLVKEVRDLTGYDRVMVYKFHEDEHGEVVSECRRSDLEPYLGLHYPATDIPQASRFLFMKNKVRMICDCLAPPVKVIQDDRLPQPLSLCGSTLRSPHGCHAQYMTNMGTIASLVMSVTINEDDDTMDGDQQQMTRKLWGLVVCHHTSPRFVPFPLRYACEFLIQVFGVQINKEVDLAVQMREKHILQIQTMLCDMLLRDAPVAIITQSPNVMDLVKCDGAALYFRNKTWLLGVTPTEEQIRDIAEWLLKYHSGNTGLSTDSLMEAGYPGASALGDAVCGMAAVSITSGDFLFWFRSHTAKEIKWGGAKHDPDDKDDLRKMHPRSPFKAFLEVVKWRSMPWEDVEMDAI

SEQ ID NO: 48995 - protein, 247 aa, Oryza sativa (japonica cultivar-group)
MKLRPKRPGWKSLMPLQLSRKSALRFFLFPKVQAAGQSPDDTPVYLNVYDLTPMNGYVYWAGLGIFHSGIEVHGVEYAFGAHDYPSSGVFEVEPRQCPGFRFRKSIFLGTTCLDPIQVRQFMELQSVNYNGDTYHLITKNCNHFCKDMCYKLTGNKIPKWVNRLARIGAICNCLLPESLKISPVGHDPNSRPEDCEKRRLRNPLSCFSSISSQRQLPPSSPFPTSPVKEPLAYSSSRKSSAPSLRNR

SEQ ID NO: 48996 - protein, 344 aa, Bacillus clausii KSM-K16
MNVKMAINGFGRIGRMVFRKAFLEGKVDITAINASYPADTLAHLIKYDSIHGPFMADVYAKDGQLFVNGKKIELLAERDPRRLPWEALGIDIVIEATGKFKTKEAAGAHLQAGAKKVIITAPAKGEDATIVVGVNESDYNPQEDHILSNASCTTNCLAPVAKVLDEKFGIESGMMTTVHSYTNDQKNIDNPHKDLRRARACGQSIIPTSTGAAKALSKVLPNLDGKLTGMALRVPTPNVSLVDLVVNLKTETTAEAINNAFWEASQGTLKGILGITDEPLVSIDFNGEEQSAVVDGQSTAVLNNRQAKVLAWYDNEWGYSCRVVDLMNHVAAQMSTKEEIHSAS

SEQ ID NO: 48997 - protein, 694 aa, Synechococcus elongatus PCC 6301
MTVSSRRPESTVAVDPGQSYPLGATVYPTGVNFSLYTKYATGVELLLFDDPEGAQPQRTVRLDPHLNRTSFYWHVFIPGIRSGQVYAYRVFGPYAPDRGLCFNPNKVLLDPYARGVVGWQHYSREAAIKPSNNCVQALRSVVVDPSDYDWEGDRHPRTPYARTVIYELHVGGFTKHPNSGVAPEKRGTYAGLIEKIPYLQSLGVTAVELLPVHQFDRQDAPLGRENYWGYSTMAFFAPHAAYSSRHDPLGPVDEFRDLVKALHQAGIEVILDVVFNHTAEGNEDGPTLSFKGLANSTYYLLDEQAGYRNYTGCGNTVKANNSIVRSLILDCLRYWVSEMHVDGFRFDLASVLSRDANGNPLSDPPLLWAIDSDPVLAGTKLIAEAWDAAGLYQVGTFIGDRFGTWNGPFRDDIRRFWRGDQGCTYALSQRLLGSPDVYSTDQWYAGRTINFITCHDGFTLRDLVSYSQKHNFANGENNRDGTNDNYSWNYGIEGETDDPTILSLRERQQRNLLATLFLAQGTPMLTMGDEVKRSQQGNNNAYCQDNEISWFDWSLCDRHADFLVFSRRLIELSQSLVMFQQNELLQNEPHPRRPYAIWHGVKLKQPDWALWSHSLAVSLCHPRQQEWLYLAFNAYWEDLRFQLPRPPRGRVWYRLLDTSLPNLEACHLPDEAKPCLRRDYIVPARSLLLLMARA

SEQ ID NO: 48998 - protein, 421 aa, Candida albicans SC5314
MLSSARKILLQSPKQLTTLIRPTNSFIIKRRNYSGSSIFKGARNYFLGFRNNSEDSQINNNNNNNNNNSSMHYDSVDESIPYVKYPLFTKEQLKKIATDKFKLQVGHASFGYHSDSIVPSINSLSDLTDPTSLNSLLPRRRPQGSPSDTLSIKAGDDTMLVSPSVIAVADGVSGWESDGITSSSGIWSRSMVETFSRLMTEYKLNHFPHYLNQRDIQEILDDSYLHTSHLMDLQKLNGSSTLILGMLNGDLLSIVSIGDSKIFIIRDGEIVLTNEEQTKAGLCPEQIGTHTLDHLPSDIAWIKSFKLMEGDYILMCSDGISDNLYEWEILNYLNEWINTKRNNNNNNNVKNIASKLLIKAKEVAFDDYAYTPYNEKVNSLNNTNGGSNGTNHSQGGKVDDMSVIIAKVELNKKDNTKLVIN

SEQ ID NO: 48999 - protein, 495 aa, Gibberella zeae PH-1
MTSTTQISLPNGKKYDQPTGLFINNEFIAATGDEFVVTNPHTEEEVIKLKGASKEDVDKAVQAARKAFEGEWSELAAVDRGAFLYKIADLIDRDRELIAAIDAFDNGKPFSACLAGDLDESYNVFRYYAGAADKISGKTIETSPAKLAYVLQEPLGVCGQIIPWNFPFMMLAWKVAPALACGNTVILKPAEQTPLSALYFGNLVKEAGLPAGVVNVLPGLGPSTGKAIAGHMDIDKVAFTGSTNTGRAIMKDAANNLKNITLECGGKSPSIVFADAELEQAVKWCHFGIMDNKGEVCTSTSRIYVHEDIYDKFLEKFVEVTKENDKLGAPFDESTVQGPQVSKTQYDRVLSYIEEGRKSGAKLLYGGSKHGGKGYFLQPTVFADTTEDMKIMKEEIFGPVVSIAKFSTDEEAIKKANDTSYGLAAALFTEKIARAHKVARKLQAGMVWINSSGDSHFGIPFGGYKSSGIGRELGQYALDAYTQPKAVHVNLGFEL

SEQ ID NO: 49000 - protein, 452 aa, Pseudomonas putida KT2440
MSEQNSQTLAWQTMSRDHHLAPFSDVRQLAEKGPRIITSAKGVYLWDSEGNKILDGMAGLWCVAVGYGREELAEVASQQMKQLPYYNLFFQTAHPPALELAKAIAEVAPQGMNHVFFTGSGSEGNDTVLRMVRHYWALKGQKNKKVIIGRINGYHGSTVAGAALGGMSGMHQQGGVIPDVVHIPQPYWFGEGGDMTEADFGVWAAEQLEKKILEVGVDNVAAFIAEPIQGAGGVIIPPQTYWPKIKEILARYDILFVADEVICGFGRTGEWFGTDYYDLKPDLMTIAKGLTSGYIPMGGVIVRDEVAKVISEGGDFNHGFTYSGHPVAAAVGLENLRILRDEQIIQQVHDKTAPYLQQRLRELADHPLVGEVRGLGMLGAIELVKDKATRARHEGKGVGMICRQHCFDNGLIMRAVGDTMIIAPPLVISIEEIDELVEKARKCLDLTYEAVR

SEQ ID NO: 49001 - protein, 750 aa, Methanococcus maripaludis
DLRNDDVDIAGGKGASLGEMWNAKLPVPPAFVVTSEAYRYFIKETKLQDEIERILSNIDVNNNEELNKASKEVRYAIENVKIPDDLKLSIIESYHKMCELSGDDETFVAVRSSATAEDLPDASFAGQQETFLNMKGNEQVLQAVQECFSSLFTPRAIFYREEKGFDHFEVALAAVVQKMVNADQAGVMFTVNPINQDYNQMVIEGAWGLGEGVVSGTVSPDTYIVAKDTQEILSVNVARKDTMFIKDADGVTKEIKTSEDLIEKQVLSEEMIKKLENVGQTIENHYKRPMDIEWSIENGEIYMLQARPITTLTDKKDSKSSNEIEGKIILKGIGASPGVESGKVKIISEIEEIGRILDGDILVTKMTTPDMVPAMKKAAAIITDDGGLTCHAAIISRELGTPCVVGTKGATKNLKDEECVTVDGEKGIVYEGKIGKPEEKAPAQVVYAGAPVITATEIKANVSMPEVAERAAATGADGVGLLRAEHMILGTGVHPGKILNEQGEGALTEVFAEGIRKVADAFYPRPVTYRTLDAPTDEFVGLKGGEDEPHEHNPMMGWRGIRRGLDQSEILKCELKAIKKLREDGYRNINVMIPLVTNVDEIRKVKEIANEVGLKLRQDVEFGVMVETPAAALIIDDIIEEGIDFISLGTNDLTQYTIAIDRNNENVSKYYLENHPAVLKLIELVITSCKSAGVKTSICGQAGSRPQIVEKLVEWGITSISANIDAVETIRNVVARTEQKIILESIRKQK

SEQ ID NO: 49002 - protein, 327 aa, Prochlorococcus marinus str. MIT 9303
MSGTLLFNALRDAIDEEMARDSHVCVMGEDVGQYGGSYKVTKDLYEKYGELRVLDTPIAENSFTGMAVGAAMTGLRPIVEGMNMGFLLLAFNQISNNMGMLRYTSGGNFTIPTVVRGPGGVGRQLGAEHSQRLEAYFHAVPGIKIVACSTPTNAKGLMKAAIRDNNPVLFFEHVLLYNLIEELPDGDYVCALDQADLVREGKDVTILTYSRMRHHCLKAVEQLEADGIDVELIDLISLKPFDMETIVRSIRKTHRVIVVEECMKTGGIGAELIALITEQCFDELDARPIRLSSQDIPTPYNGKLENFTIIQPHQIVEAAQQIVLKGL

SEQ ID NO: 49003 - protein, 418 aa, uncultured gamma proteobacterium eBACHOT4E07
MKKNAFYAQSGGVTSVINATAASVILESKKYKSKIGKVYAGKNGILGALKEELIDTSKESKSAINSLKSTPGGAFGSCRFKLKSFEENKKEYIRLVEVFKAHNIGYFFYNGGNDSADTAYKVSQISKKLGYPINCIAIPKTVDNDLAETDCCPGFGSAAKYIATSTMEASLDVASMSETSTKVFILEVMGRHAGWMAASSALARIDQKDAPHIILLPEIRFNQIKFLNKVKDVVKKNGYCVIVASEGVKNSKGKFLAESDRKDAFGHSQLGGVAPYLAGLISQKLNLKNHWAVSDYLQRSARHISSKTDLLHAEAVGVHAVRYAIKGLNGVMPIIVRSKSEKYSWKIIPAPLSKIANVEKKLPNSFISKDGFDVTAKAIKYLKPLIQGEAYPKFKNGIPHSQKLKLVEVKKKLPTWKD

SEQ ID NO: 49004 - protein, 960 aa, Pseudomonas putida KT2440
MINFFDPASDKSSDLGTPARESDVQVSLSIDGRAISVPAGTSVMRAAAMLGTSIPKLCATDSLEAFGSCRMCMVEIEGMRGYPASCTTPVSEGMVVRTETPRLAGLRRNVMELYISDHPLDCLTCSANGNCELQTVAGQVGLREVRYGYDGANHLDEKKDVSNPYFDYEPSKCIVCSRCVRACEDIQGTFALTITGRGFESRVAAAGGENFLASECVSCGACVQTCPTATLTEKSLVQLGQPERSVITTCAYCGVGCSFRAEIKGDQLVRMVPDKNGGANHGHACVKGRFAWGYATHPDRITKPMIRKRLEDPWQEVSWDEAVTYAASEFRRIQLKYGRDSIGGITSSRCTNEEAYLVQKLVRTAFGNNNVDTCARVCHSPTGYGLKQTLGESAGTQSFDSVMQADVVLVIGANPTDAHPVFGSQLKRRLRQGARLIVIDPRRIDLVDSPHARADLHLQLRPGTNVAMLNALAHVIVTEGLLAQSFIDARCETGDFARWRDFVSLPDNAPEVLGPVCGVPAEQIRAAARLYATGGNAAIYYGLGVTEHSQGSTAVMGIANLAMATGNIGREGVGVNPLRGQNNVQGSCDMGSFPHELPGYRHVSNEGVRAEFEQAWGVTLQPDPGLRIPNMFEAALDGSFKALYCQGEDIAQSDPNTQHVTAALLAMECVVVQDIFLNETAKFAHVFLPGSSFLEKDGTFTNAERRISRVRKVMEPLAGKADWEATVALANALGYPMNYRHPSEIMDEIARLTPTFRRISYAELDRHGSLQWPCNDAAPDGTPTMHIDQFVRGKGRFMLTGYVPTDEKVNNRYPLLLTTGRILSQYNVGAQTRRTGNVAWHDADRLEIHPTDAESRGIQDGDWVGIGSRAGQTVLRAKVSTRVAPGVVYTTFHFPESGANVITTDNSDWATNCPEYKVTAVEVVKVFQPSQWQKRYQDFSDEQQRLLKERRTAEKAEVRR

SEQ ID NO: 49005 - protein, 148 aa, Glycine max
  misc_feature (13)..(13): Xaa can be any naturally occurring amino acid
  misc_feature (25)..(25): Xaa can be any naturally occurring amino acid
  misc_feature (63)..(63): Xaa can be any naturally occurring amino acid
  misc_feature (70)..(70): Xaa can be any naturally occurring amino acid
  misc_feature (85)..(85): Xaa can be any naturally occurring amino acid
LSRAYASNMGGYXNEGLAEVLAAQXSPKNSNGFHGTAYAERQTLRLSEEYNVIYFSILAGDHXIEMDYQXIIPAHTETDAAITVXALPMYETPAIAFGMMKIDKDGRILELADKPTGQQSKAMKAYTTILVLDDDRTKQSPYIGMMGV

SEQ ID NO: 49006 - protein, 1426 aa, Mycosphaerella graminicola
MTLQRSSSWGVQTGTGEEVYRTLSRTFSNRPKEETYPESTSSSDDSTKKAADWGLTEELKQTQQQNENDGAKDKKLGITWTDLDIKGIGADAAFAENVISQFNIPKKIKEGRQKPPLKTIVDKSHGCVKPGEMLLVLGRPGAGCTSLLKILANRRLGYAEIDGDVKYGSMDHKQAQQYRGQIVMNTEEELFFPTLTVGQTMDFATRMKVPYNVPSNFSSAKELQQAQRDFLLKSMGIEHTDDTKVGNEYVRGVSGGERKRVSILETMAARATVVCWDNSTRGLDASTALEYTRCVRAMTDVLGLSSIVTLYQAGNGIYELFDKVLVLDEGKEIFYGPMSQAKPFMEDLGFVCTDGANVADFLTGITVPTERRIRDEYEDRFPRNADEVRAAYQKSNIKARMEQEYDYSDTEEAKTCTQTFCEAVQAEKHKSLPKKSPLTTSFYTQVQTSVIRQYQLLWGDKATFFIKQISTVSQALIAGSIFYNAPANSSGLFIKGGALFFSLLYNALVAMNEVTDSFSARPILAKHRGFAYYHPAAFCVAQITADIPIIIVQVTLLSLPMYWLTGLKPTAAAFFTYWAILFATSMAITAFFRMIGAGCATFDAASKVSGFAVSALIMYTGYMLPKPNMHPWFVWIYWIDPLAYGFEALMGNEFSNQVIPCANNNLVPNGPGYADSAFQACTGVRGAPRGSTIVTGEQYLDSLSYSPSNVWRNFGVLWAWWLLFVALTIYFTSNWSQVSGNSGFLVIPREKAKKAAHLMNDEEAQPAGMSEKKTAEDKEKDGNVDSQLIRNTSVFTWKGLTYTVKTPTGDRVLLDDVKGWVKPGMLGALMGSSGAGKTTLLDVLAQRKTEGTIKGSILVDGRDVPISFQRSAGYCEQLDIHEPLATVREALEFSALLRQPRDVPREDKLKYVDTIIDLLEMHDIENTLIGTTYAGLSVEQRKRLTIGVELVSKPSILIFLDEPTSGLDGQAAFNIVRFLRKLADVGQAVLVTIHQPSASLFAQFDTLLLLAKGGKTVYFGDIGDNGQTVKDYFGRYDAPCPKNANPAEHMIDVVSGTLSKDKDWNRVWLDSPEHSAMTTELDRIVSDAASKPPGTLDDGREFATSLWTQIKLVTNRNNISLFRNNDYTDNKFMLHIGSALFNGFTFWQIGNSVQDLQLRLFALFNFIFVAPGVIAQLQPLFLERRDLYEAREKKSKMYHWSAFVTGLIVSEIPYLVVCAVLYFVCFYYTVGFPAASSSAGAVFFVMLFYEFIYTGIGQFVAAYASNALFAFLINPFIISMLALFCGVLVPYAQIQPFWRYWFYYLNPFNYLMGSLLVFTTWNVPVTCKTSELAVFDTPNAGQTCQEYLAGFLQGMGRTSNLLNPQATSGCEVCQYRTGADYLYGLNLTKKSDGWRDAGIVVLFAFSSYGCVYLLMKLRTKASKKAE

SEQ ID NO: 49007 - protein, 1321 aa, Mycosphaerella graminicola
MATDSSSRSASRSRFRDWDAIFLPDLSPTPTTVAFEGKLPKPNAMVPVPTVASAVLSTITLPWRVGQRLFRRTHETPRKPIFSLFVRPGEMVLVASAEPAECTQLLRAIVRHVSYPGVAVFCSADDVHPHVLTVEQLLRFRLRARAVRSPSAEDDAVELLLRLFRIESIRNTLIGNAVVRGISGGERRRLSVAEALLSGANVLCFDDLTRGLDAAIALHCVQCLRSVADAYRLTIFASLSAASDTIYATFDQLVAIRDGHQVFGGPPTAVRPCGDDAQTQPAPPLASYFDHLHARIAPRASSPTAHDMADAFRRSAHYADTAVCLATYLAEEQASSGSSNQSPRHHQKRHAMNRKVVALLQRQMLLAWKDRFALTVSWILFLVLGCTIGLACFQLQRTGAGAQARGGLLYTCVLGIAVSAQVEVAKTTLGRPLLRKVFAYRFERPAAFWTAQIAVDTMLESMRVFIFAICVYFLTALHRTAPAFLYFLAVLLLLYMCNVLMNRAIGCMCRSFDSAIRTATFVFVFYMITAGYIVSQATQPSWLKWTYYLNPLALAFSALMMNEFEHITIDCQSSVLSFPPTRPLPVNALQSGVTCGLATSADRTFLVAGGTYLQLDFDYDTHDKVRTILNLLALVGLFFIANLALAEILDWDSPASSVMVSVPKNIQPPQQTRTACMTAFVPTPPTSEFVQSPAAWTRGVSRLTFCRLRYDIATERGQQSRRLLDEVTGVLESGQLLAVMGASGAGKTTLLNLLSGREHSGVRGGTVSACTSRGLPPTIGYAEQVDIHEPKSTVREAMLFSACLRQPKHVSFAEKRAWVDHLIPLLELTPIQNAIIGVVGSGSELSARDRKRTTIAVELAAKPDILFLDEPTTGLGSEGALAIARLLRKLADHGQAIACSIHQPSASTLENFDQVLFLHNGKMVYFGPLGSGLCRPAEYIARQTCSSCPVGRDPVEWMTTQVIGSSPAHHETWSDAWASSEEADMLQASLKPTSYSETSRAESMRGHPCQASVWYQIHQLTLRNSTALWRTPEYGFSRFINHVALAVTIRIVLPHAGHSIRDMVHRVLALWQTTMLPAFILTTVEYRFHASRRLSLRESATSTYSNTALAVSAMLVEIPYCFLCTAGFVLPLFSLVGPLVLSQVTYFALAVFLVQIFCVTLAQAIATLSPYERISTLFNTPSITVFALFCGISVPRSELPGFLRNWLYYLNPYTWLMSGLLTNSIHGFNVQCAGNELTDITVPLPQTCQQAMSLLSTLHDPGYIAGNTSEVCHYCPLTTGDRYSESLGLSYAQRWKYLGVFSVFCVSNVGLILLAQQFRRR

SEQ ID NO: 49008 - protein, 599 aa, Oryza sativa (indica cultivar-group)
MTTLQLDPPVVPARRSAATSCDLHPDETFTGFCTACLRERLAGLEASAAAASAPGRKSTSAIRSLFARPFGGGAGGSSVAGAGASLPDLRRCKSFSTLWSLFHQDDRGRVPSSSSAADIAPPHQQPPPRPFIPDDFLDEDIPVVMEHDEIMPVVEPVIVVDTSGEIETEPNVVAREGKAMKDHMDFESSQPKKPPTKDLKESFWVAASVFSKKWQKWRRKQKLKKEAAVSKAAAAAMPPPEKPSKPSFLRRRRLRGEAGSELAGGRRSCDTDPRFSLDAGRMSVDDAGFSWDEPRASWDGYLFGAGAGIGLGRAPPPLSRLPPMMSVLEDTPATIVERSDGQIPVEDDADIDPPGGSLQTRDYYLDSSTRRRRSLERSSSVRRPSFEVTEPKPAPTTIANGKESPLRGSEFYHFHHAEDLLDRGFSSNSLIEDISASLEAALSGPGSAKKPRRWRKAWSLWGFIHRRASGRRSGGPSDIADRSFSEAWPDLRVRGYNPKMQRCNSNLSARSSFSSNSGGLGSSRRSHVDVNGSSARRREEHVLERNRSARYSPPGRVDNRHAALLPDADAQRRRRRLFPAGPAAAAGAGAACRPRPGGS

SEQ ID NO: 49009 - protein, 856 aa, Oryza sativa (japonica cultivar-group)
MGASRKLQGEIDRVLKKVQEGVDVFDSIWNKVYDTENANQKEKFEADLKKEIKKLQRYRDQIKTWIQSSEIKDKKALMDARKQIEREMERFKVCEKETKTKAFSKEGLGQQPKTDPKEKAKAETRDWLNNVVSDLENQIDNFEAEVEGLSIKKGKQRPPRLVHLEKSITRHKAHIKKLESILRLLDNDELSPEQVNDVKDFLDDYVERNQEDFDEFSDVEELYSTLPMEKVEALEDMVSLAPSSLVKGVASVSTTAVLSTKSSVATSPTQATVSAAPSLSVSQDQAEETASQESNPESAPQTPPSKVGSQPSVPVVPTTISTSTAAVSVSAETISSPVRPIVPTTTAAVLPASVTARSAPENIPAVTSAPANSSSTLKDDDNMSFPSRRSSPAVTEIGLGRGITRGLTSQGLGSAPISIGPVSGNGSVSALTDLSKRNMLNTDERINSGGISQQLISPLGNKAQPQQVLRTTDTISSDSSNTNESTVLGGRIFSPPVVSGVQWRPQNTAGLQNQSEAGQFCGRPEISADQREKYLQRLQQVQQQGSLLNVSHITGISQKQFPSQQPNPLLQQFNSQSSSISSQAGIGLGQVQVPESGHTKSEEQQQSFAEDVSVESVATAGANKHMSEDDTKIPFSNPSASITEGTQLSRDPDLPAGQPLQPGMSSSGVGVIGRRSVSDLGAIGDNLSVASASTSHDLLYNLQMLEAAFHRLPQPKDSERVKNYIPKHPAVTPASFPQIQAPVVSNPAFWERMGGDSLSTDLLFFAFYYQQNTYQQFLSARELKKQSWRFHRKYNTWFQRHVEPQVTTDEYERGSYVYFDFHVIDDGTGSGWCQRIKNDFTFEYNFLEDELSVQTN

SEQ ID NO: 49010 - protein, 319 aa, Bacillus clausii KSM-K16
MKRIGVLTSGGDSPGMNAAIRAVVRKAIFHGLEVYGISYGYQGLINGDIKKMELGSVGDIIHRGGTMLYTARCEEFKTLEGQQKGIEQLKKFGIEGLVVIGGDGSYRGAQQLTKHGFPTIGVPGTIDNDIPGTDFTIGFDTALNTVIDAIDKIRDTATSHDRTYVIEVMGRHAGDLALWAGLADGAETIVIPEAEHNMEQILATIKRGQERGKKHSIIVVAEGVGSGIEFGDRISKEMNMETRVTVLGHIQRGGSPTGADRVLASRLGAKAVDLLLEGKAGMTVGIQKNELVYHPIDEILDRPHTIDQEMYKLSQELSI

SEQ ID NO: 49011 - protein, 113 aa, Prochlorococcus marinus subsp. pastoris str. CCMP1986
MAETTIFSKIINGEIPCEKLHEDELCLAFNDIASQAPVHFLVIPKKPLVSLCECLEEDRDLLGHLLLIGKNIAKSKQLKNWRTVINTGEESGQTVFHLHIHFLAGRKMSWPPG

SEQ ID NO: 49012 - protein, 245 aa, Zea mays
MAEVVVHIYDVTNTGSDKTNNTILQINRIFKDGIGLGGIFHSAIQVYGNDEWSYGYCEQGTGVFRCPSSKNPMYTYREKIVLGRTDCTIFMVNQIFRELTREWPGHTYDLLSRNCNHFCDVLCDRLGVPKLPGWVNRFAHAGDTALEVAETTAMRLKQAKTELLSASKVAYRFLSNVTSSVTNSSNGSPQQPGTVNNSDNVNSRMQGTWLKGMLNTSKPSTSTEIENKDEDANHDSEVLQFQQQP

SEQ ID NO: 49013 - protein, 410 aa, Bacillus clausii KSM-K16
MPTTREEALHMHRINQGKLESKAKVPVKDARDLSLAYSPGVAEPCKEIFEDVETVYEYTMKGNMVAVVSNGTAVLGLGNIGPEASLPVMEGKAVLFKSFAGVDAFPICLRSNDVDEIVNTVKLLEPTFGGVNLEDIAAPDCFVIEERLKKETNIPIFHDDQHGTAIVTLAGLINALKISGKKLSEIKVVANGAGAAGIAIIKLMLRMGVRNIIMCDTKGAIYEGRPYGMNAVKEAVAKRTNMNKEEGKLEDVIKGADVFIGVSVEGAVTKEMVESMNDNPIIFAMANPVPEIMPEDAKAAGASVIGTGRSDFPNQVNNVLAFPGIFRGALDARATHINEEMKVAAVYAIANLVSEEELSVDYVIPAPFDSRVAPAVAAAVAKKAMETGVARVKVDPEEVAEKTRKLAIID

SEQ ID NO: 49014 - protein, 385 aa, Oryza sativa (indica cultivar-group)
MARPRTRSVARMEATAAAAAAAEEEEAGNPDGAEGAAVVAVAPEAAAEGPNEPNAGEASREPDAGQASREPDVAGPSRQPGAAGPSREPGAAGGPRQPGAAGGPWQLVPNAAGPAVAPYVEDIDRYLRSLEAEESRRPIVNYDQEIQGGHINMRGKLVNWMAELFHMLIYLAVSYVDRFLSRNVVNRERLQLLGTSALFVASKYEDRCHPSARFFSSITADTYTTQQVVAMEANILSFLNFQMGSPTVITFLRRFLFSCRGSNRPINIRLELMCIYLAELSLLDDYNIRFLPSIVAAACLFVGKFTLNPNTRPWNLSVQRITGYKVSDIEDCIRSIHDLQAGRKWSNLRAIRSKYEDDAFERVSTIPSPNTIKPSFLRDLKYVNG

SEQ ID NO: 49015 - protein, 344 aa, Oryza sativa (indica cultivar-group)
MWNRMMNKNEIFKRWYLREDKPHGSAGGLYSFRDYIMEDSPSHIVLLNCDVCSSFPLPDMLEAHKKYGGMGTLLVNKILITNCYHHLIIVEAHKKYGGMGTLLVNKVSAESANQFGELVADPETNELLHYTEKPETFVSDLINCGVYIFTPNIFNAIEDVLKQKKDRANLRRVSSFEALHSATKALPADYVRLDQDILSPLAGKKELYTYQTLDFWEQIKTPGMSLRCSGLYLSQFRHTSPHLLASGDGKRSATIIGDVYIHPSAKIGPNVSISANARIGAGARLIHCIILDDVEIMGEGDHNAKLGITILGEAVDVEDEVVVVNSIVLPNKTLNVSVQEEIIL

SEQ ID NO: 49016 - protein, 654 aa, Ustilago maydis 521
MNTQEPYASGSTASGASTSAQRTCMSDQIRASGYFYSQTDDPFAAAFWSQFQDPHVLAARHIPADSSASAAMKAYREYRDRVRKPVLATYTILGFLSSGTYGRVYKARLRTPPQLASSSGTAGIANANAGTGSGTATVGSGASTAKKRGGLLQQHQLLDSPSSSLHATPKSVADGAGVGVNGTPSASPSLSASLGTSTANAPGGSDNTLQLSSNELPDTQIYAIKKFKPDSKETDATIYTGISQSAMREISLNRELSHVNIVTLHQVMLEDKAIYMVFEYAEHDLLQIIHYHSTALRAPIPLAVLKSLLWQLINGVAYLHANWILHRDLKPANILVTSQGVVKIGDLGLARLYSSPLQSLYNGDKVVVTIWYRAPELLLGARHYTTAIDMWSVGCIWGELLALRPMFKGEEAKMDPKTKAAPFQTDQLKRIVEVLGTPNKDRWPAIESMPDYKGWWPHLRLDNYPKTLSRWYATRNKGDDGYELFNSLLQYDPEQRLTANQALEHAWFTAQDPKPTANAFSSLAKPHATYPNRRVIQDDMDPKMKSNYVPPIKSHHMQPWHQARATHVSTGADEASADADAGSSSGSGPTSGCNGSDGQTGPCGWSGQFRSGNSGQCRRSGGTATDRDREYRWHRRRDRHTKLGRKHRSFTAHV

SEQ ID NO: 49017 - protein, 535 aa, Gibberella zeae PH-1
MASELSSAPVLSTPDDHILEVPAADSIPTSTLSDDALRTTYEIVRTADEIRAGGWKRIGLQFPDFMLVDAPRVVEALSKEINTHDQEEAKPERRIYVLADSSYSACCVDEIAAEHVSADVVVHYGRTCLSPTSHLPAIYVYTTHDLDYEVTINEIKKEFSDKTVKLVIMADLTYQNHVDKVVSLLKEQGYNDAVSTEVTRDPAALIPNRKILSDETHDDEHWKAYSIIHISDPPSALLLALYTRFASLHVLSTPSPALENPTMRTAGLLRRRFAKVLALASAGVIGILVNTLSVANYLSSINTLRERIARADKKSYTIVVGKLNPAKLANFAEIEGWVVVGCWESGLIEDDAGYWRPVITPFELEVALMSEEERVWGGEWWGGIEKLGLNDKPEDASKESEGAVAEEEVEFEDVAGGVEGEESAPPEFDMRTGKLISSSRPMRLPVRKNPSTTAETEANSDGQPTSTQQNDSLIKRSVGELASINGVASPGAEFLRSGRTWQGLGTDFDNEASTLVEEGRSGVARGYEVGESGRH

SEQ ID NO: 49018 - protein, 258 aa, Xanthomonas axonopodis pv. citri str. 306
MTTHRWRLDGQTALITGASAGIGLAIARELLGFGADLLMVARDADALAQARDELADEFPERELHGLAADVSDDEERRAILDWVEDHADGLHLLINNAGGNITRAAIDYTEDQWRGIFETNVFSAFELSRYAHPLLTQHAASAIVNVGSVSGITHVRSGAPYGMTKAALQQMTRNLAVEWAEDGIRVNAVAPWYIRTRRTSGPLSDPDYYEQVIERTPMRRIGEPEEVAAAVGFLCLPAASYITGECIAVDGGFLRYGF

SEQ ID NO: 49019 - protein, 237 aa, Triticum aestivum
  misc_feature (158)..(158): Xaa can be any naturally occurring amino acid
  misc_feature (205)..(205): Xaa can be any naturally occurring amino acid
  misc_feature (209)..(209): Xaa can be any naturally occurring amino acid
  misc_feature (219)..(219): Xaa can be any naturally occurring amino acid
RSLRIELPAGELGMDDGVLLKWKADFGSTLAPGGILGAASASASPSSAAKDGATAAPPPPTADCAESDDSGSIPESFYTNGGLKLRVLWTISSLIAASARHYLLQPIISDHALLESLDLTDADGQGALTMDKWQLQELRVRPVSASGDSHRTLMPALXSMRLWYAPHIELPGGTVLCGATLLAVGPSEEAMMDAVGNATAGSAGXSWVXDAFEDHIGRXSGVASQSRGCYTLEMNQF

SEQ ID NO: 49020 - protein, 734 aa, Arabidopsis thaliana
MKGATLVALAATIGNFLQGWDNATIAGAMVYINKDLNLPTSVQGLVVAMSLIGATVITTCSGPISDWLGRRPMLILSSVMYFVCGLIMLWSPNVYVLCFARLLNGFGAGLAVTLVPVYISETAPPEIRGQLNTLPQFLGSGGMFLSYCMVFTMSLSDSPSWRAMLGVLSIPSLLYLFLTVFYLPESPRWLVSKGRMDEAKRVLQQLCGREDVTGKMALLVEGLDIGGEKTMEDLLVTLEDHEGDDTLETVDEDGQMRLYGTHENQSYLARPVPEQNSSLGLRSRHGSLANQSMILKDPLVNLFGSLHEKMPEAGGNTRSGIFPHFGSMFSTTADAPHGKPAHWEKDIESHYNKDNDDYATDDGAGDDDDSDNDLRSPLMSRQTTSMDKDMIPHPTSGSTLSMRRHSTLMQGNGESSMGIGGGWHMGYRYENDEYKRYYLKEDGAESRRGSIISIPGGPDGGGSYIHASALVSRSVLGPKSVHGSAMVPPEKIAASGPLWSALLEPGVKRALVVGVGIQILQQFSGINGVLYYTPQILERAGVDILLSSLGLSSISASFLISGLTTLLMLPAIVVAMRLMDVSGRRSLLLWTIPVLIVSLVVLVISELIHISKVVNAALSTGCVVLYFCFFVMGYGPIPNILCSEIFPTRVRGLCIAICAMVFWIGDIIVTYSLPVLLSSIGLVGVFSIYAAVCVISWIFVYMKVPETKGMPLEVITDYFAFGAQAQASAPSKDI

SEQ ID NO: 49021 - protein, 464 aa, Arabidopsis thaliana
MVDSKRMDSGSKDMINDLPDALLCHVLSYLTTKEAASTSLLSRRWRYLLAFVPNLEFDDSAYLHRDKRVKNPLHEKGLVGFVLTVDDKRKKLSTSFPDFVDRILDLQGNSPLDKFSLKMVDDHDPVDPDCVAPWIHKVLVRGVSDLHLVIDMNEWTSLPAKIFLTETLVKLTLKIRDGPPIDVKHVHLPKLKTLHLESVMFDEEDIGFSKLLSGCPELEELVLHHIWSCVWTSCSVSVATLKRLTFCCNNMKFCGMHEENPNNVSFDTPNLVYLEYAEVIANNYPKVNFDSLVEAKIDIWMTNDQLDEVRIRDIYEKNVMVGNATDLIVGIRNVRVLCLSADTLEVLTYCCKQIPIFNNLTHVTIQSTPKVGWKSLLKLLKNSPKLQTLVFQGLLHRDTKEEGVAIIKIEKQIEKVKHFLETMPHLEQLVLHYDSSIDGDMKQLLMLSSLASPKCKVQLIPLVT
